United States Patent 6,812,339 (POLYMORPHISMS IN KNOWN GENES ASSOCIATED WITH HUMAN DISEASE, METHODS OF DETECTION AND USES THEREOF) - sequence listing, part 84

SEQ ID NO: 23635 - DNA, 601 bp, Human
aatacattcaagccatttaggctggacactggaactgccaattttagtgaaaagctctggacgatttaatgacctccttactgcctggtccatccttcttccctttttcataacagctttgatggttatgtggaaactttagctaactttagttcttgtccaaaatacctataacaacttcagagagctgaacagacgtgaatataaatttaattcgtagctatgaccagaaactaggactttcttttcctcttgagagagtactctctcataaagcaataattcctcagagtgataacargaaaactataaaggtttatagccaaaagagcctccttatctatcgataaagacagacagatgcttacctgtaaggcaagttttaaaagactcacactgagaaaagcactgctgtccctgatgttggctacacggccctttttcatgttcaattcagagcaaggtttcaaattctcagaacccaacaacgagagggtatcaattgaaggggaacaagtgatgagcagaaggatgaacctgtccaaatcagaatcttgctcttcaaagtgagcttgatgtcttcattcatcctgaccccaat

SEQ ID NO: 23636 - DNA, 601 bp, Human
gccaagagagtagaccttaggtactcttaccacacacacacaaaaagagatatctctatgtgatgctgagtatgttaatttactttagtgcactaatcacttatcttgtatgagtatcaagataagtatatcaaaattcacactgtatgccttaaatatatacaataaattttttaaaaaattaaaagaactaaatgcatagttttgacctacctggagatctctttccagacacaacaaatggtaccggtgccaggtaacaaatgcaggtccttgatgtgagaaatctatggccctgtargggcgtcctggtcctgaaacaattgggaaacatattagagatgacagaatagaattttttaaaatgttaaatcttacctgggctgtatctatagagccaataagtccatgatgttttatagtagtaagaaaaaaaagttttgttgttatttatatctccaaaagcaatagtaatgacatgaatttcagaagtaactagtacttttaggataaaccctcctttatctcttaaaaggttgatttctagcagagatccaggaaattcaggtgactttcaggattgggagcccctgatacatat

SEQ ID NO: 23637 - DNA, 601 bp, Human
gaagaaaaaagaaaaagagtgaatacatagagagttacatagtagttacaagggactgggagaaatgggaagatgtaggctgaaggtgcaaagttgcagttatgtaggataaataactcgaggtctgagactatagttaacgttgtattgtgtactggtgatttgccaagagagtagaccttaggtactcttaccacacacacacaaaaagagatatctctatgtgatgctgagtatgttaatttactttagtgcactaatcacttatcttgtatgagtatcaagataagtatatcaaaaytcacactgtatgccttaaatatatacaataaattttttaaaaaattaaaagaactaaatgcatagttttgacctacctggagatctctttccagacacaacaaatggtaccggtgccaggtaacaaatgcaggtccttgatgtgagaaatctatggccctgtaggggcgtcctggtcctgaaacaattgggaaacatattagagatgacagaatagaattttttaaaatgttaaatcttacctgggctgtatctatagagccaataagtccatgatgttttatagtagtaagaaaaaaaa

SEQ ID NO: 23638 - DNA, 601 bp, Human
ctttaaaaaggagaccctgccatttgcaaaatgtgaatgaatctagaagacattgtgccaactgaaataagacagatacagaaagaaaaacactgcactatctcacttatatgtggaatctaaagaaaagaagaaaaaagaaaaagagtgaatacatagagagttacatagtagttacaagggactgggagaaatgggaagatgtaggctgaaggtgcaaagttgcagttatgtaggataaataactcgaggtctgagactatagttaacgttgtattgtgtactggtgatttgccaagasagtagaccttaggtactcttaccacacacacacaaaaagagatatctctatgtgatgctgagtatgttaatttactttagtgcactaatcacttatcttgtatgagtatcaagataagtatatcaaaattcacactgtatgccttaaatatatacaataaattttttaaaaaattaaaagaactaaatgcatagttttgacctacctggagatctctttccagacacaacaaatggtaccggtgccaggtaacaaatgcaggtccttgatgtgagaaatctatggccctgtaggggcgtc

SEQ ID NO: 23639 - DNA, 601 bp, Human
aagtccctgctagctgggcatgggcccctcaaaacgcacacctatgcaggctcagggtgttggcagtgaagcctgggggccgggggagccacagctctgtgccctggagcagtctaaggacctgggacgaaagacagagcagtggggttaaaaacatggggattttgaggccgggtgaggtggcttacacttgtaatctcagcactttgggaggccaaggcaggcagattacgtgaggtcaggagatcgagaccatcctggcaaacatggtgaaaccctgtctctactaaaaatacaaaamttagctgggcgtggttgcgcatgcctgtaatcccggctactcaggaggctgaggcaggagaattgcttgaaccagggagtcggaggttgcagtgagccgagatcacgtcactgcactccagcctggtgacagagtgagactccatctcaaaaaaacaaaaaaacaaaaaacaaaaaacaaaacaaattttggaggaaaaaaatgaataaaggaaggtgaggtgaggagcctcttgggaaatttttggctgaaatgtgttccaggtgttccaggacagagaaacaaattcaaggagccttt

SEQ ID NO: 23640 - DNA, 601 bp, Human
caatgggatgtccggtgaagtaagagttccagggttaggctcctcttgaaaaagaataccacatttatctatggaaagcttgacgacattctaaaaatttaaaaaccttttaaactcagccttctctaaatttacttgatgacggaaatctcttttcacataccatccactactattccaaggtatggtgggaaatggcgcttgatggaattaagctcagtcacagaaaaagcactgatgatgtccctgctcgtggagcactgttctgagcactgtaggaaatgtacaggatgtggaagaygaagtccctgctagctgggcatgggcccctcaaaacgcacacctatgcaggctcagggtgttggcagtgaagcctgggggccgggggagccacagctctgtgccctggagcagtctaaggacctgggacgaaagacagagcagtggggttaaaaacatggggattttgaggccgggtgaggtggcttacacttgtaatctcagcactttgggaggccaaggcaggcagattacgtgaggtcaggagatcgagaccatcctggcaaacatggtgaaaccctgtctctactaaaaatacaaa

SEQ ID NO: 23641 - DNA, 601 bp, Human
atccacagggatgaaagaggccaggacctaaacactaagctgaaaaaggtctccaaggcctcccaggcagcgtttcccaaagtggattccaatgggatgtccggtgaagtaagagttccagggttaggctcctcttgaaaaagaataccacatttatctatggaaagcttgacgacattctaaaaatttaaaaaccttttaaactcagccttctctaaatttacttgatgacggaaatctcttttcacataccatccactactattccaaggtatggtgggaaatggcgcttgatggaatyaagctcagtcacagaaaaagcactgatgatgtccctgctcgtggagcactgttctgagcactgtaggaaatgtacaggatgtggaagacgaagtccctgctagctgggcatgggcccctcaaaacgcacacctatgcaggctcagggtgttggcagtgaagcctgggggccgggggagccacagctctgtgccctggagcagtctaaggacctgggacgaaagacagagcagtggggttaaaaacatggggattttgaggccgggtgaggtggcttacacttgtaatctcagcactttgg

SEQ ID NO: 23642 - DNA, 601 bp, Human
ctactggctaactttttttttttttttttttgagacagagtctcactctgtagcccaggctggagtacaatggcacactgcaacctccacctcctgagttcaagcaattctcctacctcagcctcctgagtagctgggactacaggcacatgccaccaagcccagctaacttttgtatttttagtagagacagagctgtcaggctggttggtcaccatgttggtcaggctggtctcgaactcctgacctcaggtgatccacctgtctcggcctcccaaagtgctgagattacaggcgtgarccaccgtgcccagctaggctaacttttcaaactttttgtagagacagggtttcactatgttactcaggctggtctcgaagtcctggcctcaagtgatccccctgccttggtctcccaaagtgcagaccattatttcactggcagagataaaaatttaaagatgttattgtgagggttttcatgaattagggataggacccagtatgtgagaatataatcagcacatccacagggatgaaagaggccaggacctaaacactaagctgaaaaaggtctccaaggcctcccaggcagcgtttc

SEQ ID NO: 23643 - DNA, 601 bp, Human
attgtcaaacttctggagagacaggcaatctcgtatgtcttttaaggttggcaatttcatgctgtttcttcccatttgatttcttctcagcaaaccttcataggttccattgcacaaggtgaccaggtggttgtagtcatccaagctaagatttgtaataagatttaaaataatatatgttggctgggcacagtggctcacgtctgtaatcccagcactttgggaggttgaggcaggtggatcccttgaggccaggagtttgagaccagctatggcaaagccccggctctactaaaaatayaaaaattagctaggcttggtggtgtgtgcctgttgtcccagctactcaggaggctaaggcaggagaatcgcttgaacccaggagacagaggctgcagtgagcagagatcatgccactgccctccagccttagtgacagagtgagaccctgtctcaagaaaaaaaaaaaatcccccaaaacaaaaaatgatatgtcttaacttatgtacagtattataaatttgggccaagcaaatcaatcagggtcacaatcatggtaaaattgtattacaattactttaccagagttaacaatatgtgg

SEQ ID NO: 23644 - DNA, 601 bp, Human
ctaagtgtagcatggctcagtctgctgaggttggacacagccttcagagtagtgtcaaaggtgggggaagggtaacatttaaggttgttttgaaaaggaggatgaattagtttttcattgtgacaaaagtgctattaaaacagattgcattttctatatgtttgagttaggggagttgttctcaaaatgcagtgctcagaccaccttaactggcatcatttgggatttggttagaaatgcaagttgttaagacacagcctacacctactgaaccagaaactctgggagcagggcatgaaayatgtgtttttctttggtgattttgagatgtgcttaaattctaggcctacctctacaggtacataccaccacacctggctacttttttatatttttttgtagagacagggtcttgctctgttgcccaggtggtctcaaactcctggactcaagcagtcctcccgcactggcctcccaaagcactaggattacaggcatgaacaccatgcccaacctgtggtggaagattaatagttggtctttaaatgttaagtattgtaatgtcattgctgtgctatgatttgagttgaatttagtctgc

SEQ ID NO: 23645 - DNA, 601 bp, Human
tttgtgtactgtatgacaactttcatatctgtctctcattcccttggagagcaggctctatgttttcttcagatatttattgccagggttcagtaccatgcccagcagattgtctgtgatcagtaaattcttttatttaacatataatctgatatttatatttctcaaccaaatagaccttcagcttgactgaaggtccagctactcaggaggctgaggtaggaggatcacttgagcccaggagtttgaggttacaattagccatgattgtgccactgcactctaccctaggtgacacagygagatcctggctctaaaaaaaagaaaaaagaaaaaaattttctaccaccatagaaagactttaagaattatgagaaatatgtttataaataagactttaaacaaagatgggtccaaaaaggggatggtagatagattaaagatcttctccaaaactggattctctctctctcttaactgtgtttaaagtagacaatttgtatgggcccagggcagggcaggctggactcaaatgtagaggttgtgctaagtgtagcatggctcagtctgctgaggttggacacagccttcagagtagtgt

SEQ ID NO: 23646 - DNA, 601 bp, Human
tatttctgaattatatctcttttgtgtactgtatgacaactttcatatctgtctctcattcccttggagagcaggctctatgttttcttcagatatttattgccagggttcagtaccatgcccagcagattgtctgtgatcagtaaattcttttatttaacatataatctgatatttatatttctcaaccaaatagaccttcagcttgactgaaggtccagctactcaggaggctgaggtaggaggatcacttgagcccaggagtttgaggttacaattagccatgattgtgccactgcaytctaccctaggtgacacagtgagatcctggctctaaaaaaaagaaaaaagaaaaaaattttctaccaccatagaaagactttaagaattatgagaaatatgtttataaataagactttaaacaaagatgggtccaaaaaggggatggtagatagattaaagatcttctccaaaactggattctctctctctcttaactgtgtttaaagtagacaatttgtatgggcccagggcagggcaggctggactcaaatgtagaggttgtgctaagtgtagcatggctcagtctgctgaggttgga

SEQ ID NO: 23647 - DNA, 601 bp, Human
gtgctcaaggcaaatgttgtactttcctcaccctaatcccagccctgccctcaaggaataatctctaaatccagctagtccctgtacagtgtggctagttcatttttatttcattggttagaaatttcaaagaaccatagggaggttttttattaatccaataaactcagagagaattgtcaagtcaggtgtaaaagcagatagttcatttaataagatctatttaaaactttcagttttctaaaacaagagtcagctcattagtccctttctgatgtttaattggtagtttaaaggctcrttttgctaaatacgtatatgctagaaaaatggtcaataaacttaactagacctgaaagcttcggctaaaggtcttggtttacattataaagaaagaaagcaagaaagctagcttctttagaagatgaatgaatcacccatttggaagttgtgttagttacctggcagatcgatggcatagctgtagccaagttggtctgaggttaaaaagagttcttcattagtcactggagggaagaaaggaaccatgttgtacatccgattgtgaccaataggggccagctcctgaggccaggcatct

SEQ ID NO: 23648 - DNA, 601 bp, Human
aaaagtctgcctttatttaaaattttgatgatgtattattcatggttaattttttgcattaattttgactttccaaaattttgtattatattattacttaccttgattactgagttttctggcctcctcttgaattttgtgctcaaggcaaatgttgtactttcctcaccctaatcccagccctgccctcaaggaataatctctaaatccagctagtccctgtacagtgtggctagttcatttttatttcattggttagaaatttcaaagaaccatagggaggttttttattaatccaatwaactcagagagaattgtcaagtcaggtgtaaaagcagatagttcatttaataagatctatttaaaactttcagttttctaaaacaagagtcagctcattagtccctttctgatgtttaattggtagtttaaaggctcattttgctaaatacgtatatgctagaaaaatggtcaataaacttaactagacctgaaagcttcggctaaaggtcttggtttacattataaagaaagaaagcaagaaagctagcttctttagaagatgaatgaatcacccatttggaagttgtgttagttacct

SEQ ID NO: 23649 - DNA, 601 bp, Human
ataggctaaatgggaaatgactgattcagttataagacgatgtgggtatgaaaaacaaacaaaagtctgcctttatttaaaattttgatgatgtattattcatggttaattttttgcattaattttgactttccaaaattttgtattatattattacttaccttgattactgagttttctggcctcctcttgaattttgtgctcaaggcaaatgttgtactttcctcaccctaatcccagccctgccctcaaggaataatctctaaatccagctagtccctgtacagtgtggctagttcayttttatttcattggttagaaatttcaaagaaccatagggaggttttttattaatccaataaactcagagagaattgtcaagtcaggtgtaaaagcagatagttcatttaataagatctatttaaaactttcagttttctaaaacaagagtcagctcattagtccctttctgatgtttaattggtagtttaaaggctcattttgctaaatacgtatatgctagaaaaatggtcaataaacttaactagacctgaaagcttcggctaaaggtcttggtttacattataaagaaagaaagcaa

SEQ ID NO: 23650 - DNA, 601 bp, Human
aacattctttaaatggtgtgtggagccatattggggcctgggccaaaaagaaaaacatgtgccctgtatatacttgtcaaaatatcctcccatatgttgaaccaagtgggaaaagttaataagaaatctacaatcttaaaacatgactttaaaaacagtaactaatgcaacatacacatagagtcccacgtagcccaatctgttggtagaccaatcaatgtcagccttcatgaacctatccatcgcaggtggtataggctaaatgggaaatgactgattcagttataagacgatgtgggtrtgaaaaacaaacaaaagtctgcctttatttaaaattttgatgatgtattattcatggttaattttttgcattaattttgactttccaaaattttgtattatattattacttaccttgattactgagttttctggcctcctcttgaattttgtgctcaaggcaaatgttgtactttcctcaccctaatcccagccctgccctcaaggaataatctctaaatccagctagtccctgtacagtgtggctagttcatttttatttcattggttagaaatttcaaagaaccatagggaggttttt

SEQ ID NO: 23651 - DNA, 601 bp, Human
accttgctttcagttcttttaggtataccagaagtataattgctgggtcatatggtaattatttgttccatttttttgaggaatccccatactgttttccatagtggctgcaccattttacattcccaccagcaatgcacaaggattccaatttctctacaccctcagcaacacttactattttctatttttttttgatagcagtcatcccaatgggtatgaggtggtatcttattggggtttctgcctggcatctaaggccctctgtacctaggctctttcataaatttgaacttaattygaggtaattctctgcccaagcgtcccactacagccaggcttgaaagactcaggtcaaagagagagagactgagctctgaaatcatcttgattgctttctaggctgagactttgggtaaataggctgtgtgatttttcaccttcttgattaagattttttaaattgttttgtttttgtttttttgggtttttttgaaacagggtctcactctgttgcccagactggagtgcagtggcacaaacagggctcactgtagcctctacatcctgggctcaagcgattcttccacctcagcctccc

SEQ ID NO: 23652 - DNA, 601 bp, Human
acttgtttcgacatgacccttagagggagcagaagcaccatgcctcctcaggcaccatgaactgctcctgccgccacctgggatattcactgagtggcacattctggttcttaactctaattactaaacagttctgccttttaatgagccatgttgcacccctgtgactctgactcattggttcaagttctacctcttaagtcttttaacttttcgccgtaacaaccctatatatagttgaaggtaatgattttcctgttctttctccccctcaagtctctctccttttttttttttttttgacagtctcattctgtcacccaggctggggtgcaatggtgtgatctcggcccactgtaacctccaactcctgggttcaagtgattctcatgcctcagcctcctgagtagctgggactatgggtgcatgccaccatgctgggatactttttgtatctttagtagagacagggtttcgccatgttggccaggctggtctcaaactcctgggctcaagtgatccacccaccttggcctccaaagtgctgggattataggcatgagccaccatgcctggtcaagtcttctctctttgaagccaa

SEQ ID NO: 23653 - DNA, 601 bp, Human
tttcaaaatacagtcatgggctgcataatgatgtttctgtcaatgatagaccttgtatacaatggtggccccataagattataacaacatatttttactgtaccttttctatgtttagatacacaaatacttaccattgtgttacagttgcctacagtattcaatacagtagcatgcgatacagctttgtagcctaggagcaatagggtgtgtcatatagcataggtgtgtagcaggctatcccatctaggtttgtgtgagtacattttctgatggtcacacagtgacaaaattgtctaaygacacatttctcagaacatattcctgttgttaagtggtacatgattgcatgtccacaattgtttgatattcctcccttctagaagtagagcgtaattcttgccttgaatgcagctggactttgtgatttgtttctagtaaatagaaagtagcaaaaataagaaatacctttctagggtaggacataagagacactgtagcttccatcttgttctgggggaagccagctgccatgtcaggaagcagccttttcaagggggccacacggaaggaactgaggcctcctgtgaacaggtacgtg

SEQ ID NO: 23654 - DNA, 601 bp, Human
agctttgtagcctaggagcaatagggtgtgtcatatagcataggtgtgtagcaggctatcccatctaggtttgtgtgagtacattttctgatggtcacacagtgacaaaattgtctaatgacacatttctcagaacatattcctgttgttaagtggtacatgattgcatgtccacaattgtttgatattcctcccttctagaagtagagcgtaattcttgccttgaatgcagctggactttgtgatttgtttctagtaaatagaaagtagcaaaaataagaaatacctttctagggtaggwcataagagacactgtagcttccatcttgttctgggggaagccagctgccatgtcaggaagcagccttttcaagggggccacacggaaggaactgaggcctcctgtgaacaggtacgtgagtctttttggaattggatctttcagccacagtccagccttcatacaactgtagcctcagccaacatcttgactgaaacttcatgagaaaccctgaggcccagccacccagctaagctccttcccaaattccttccccatagaaactgagataatgaatgtttttgtttaagccactgaatt

SEQ ID NO: 23655 - DNA, 601 bp, Human
ttgttctgtcattaatgaaactgcctctaatatatcagtgttaagtttaatgtttattattcatttcagtagaccgtgtggtacacgtacccttttgttactagaatagtaactgtttttatcatgatcaaatgttgaatttccatcaaaaaccactttagcatctagtgagataaacaaggggtttttctttttaatctcttagtattagtcatagatttaataatggtaccatcctcacatttctagaatgaacttttttttggtcatgatgtactattccattaatttggtaatgtgytgtttggaattttgcatgtatatttatttatacagttggttggtattattatttgtgtgtatggtgatttttgtttgttttgacttgtgggttctttttaggcagggtcttcctctgtcacccaggctggagtgtagtggcatgatcatagctcactgcagccttgaagtcctggactcaggtatcttcccacctcagtctcttggtgagttgggactataggtgcataccactgtccccatctacttaaaaaaaatttttttttttttttgtagagatagggtctcactttgctgccca

SEQ ID NO: 23656 - DNA, 601 bp, Human
acttttttttggtcatgatgtactattccattaatttggtaatgtgttgtttggaattttgcatgtatatttatttatacagttggttggtattattatttgtgtgtatggtgatttttgtttgttttgacttgtgggttctttttaggcagggtcttcctctgtcacccaggctggagtgtagtggcatgatcatagctcactgcagccttgaagtcctggactcaggtatcttcccacctcagtctcttggtgagttgggactataggtgcataccactgtccccatctacttaaaaawaatttttttttttttttgtagagatagggtctcactttgctgcccaggctggtctcgaactcctgggctcaagcgacccttccacctcggactcccaaggtgttgggaccacagatgtgagctgtgatgcctggcccatgtgtagtttgtgacaggttttaccatcaatgttatgaaaataaatggagaaattttgcatcttttctagcatagaaatgatctattccttgaaggtatgatagaaatcatctttaagattatatggattcagtactgtttgaggggaatcattattggaca

SEQ ID NO: 23657 - DNA, 601 bp, Human
cttttttttggtcatgatgtactattccattaatttggtaatgtgttgtttggaattttgcatgtatatttatttatacagttggttggtattattatttgtgtgtatggtgatttttgtttgttttgacttgtgggttctttttaggcagggtcttcctctgtcacccaggctggagtgtagtggcatgatcatagctcactgcagccttgaagtcctggactcaggtatcttcccacctcagtctcttggtgagttgggactataggtgcataccactgtccccatctacttaaaaaawatttttttttttttttgtagagatagggtctcactttgctgcccaggctggtctcgaactcctgggctcaagcgacccttccacctcggactcccaaggtgttgggaccacagatgtgagctgtgatgcctggcccatgtgtagtttgtgacaggttttaccatcaatgttatgaaaataaatggagaaattttgcatcttttctagcatagaaatgatctattccttgaaggtatgatagaaatcatctttaagattatatggattcagtactgtttgaggggaatcattattggacaa

SEQ ID NO: 23658 - DNA, 601 bp, Human
ttttttttggtcatgatgtactattccattaatttggtaatgtgttgtttggaattttgcatgtatatttatttatacagttggttggtattattatttgtgtgtatggtgatttttgtttgttttgacttgtgggttctttttaggcagggtcttcctctgtcacccaggctggagtgtagtggcatgatcatagctcactgcagccttgaagtcctggactcaggtatcttcccacctcagtctcttggtgagttgggactataggtgcataccactgtccccatctacttaaaaaaawtttttttttttttttgtagagatagggtctcactttgctgcccaggctggtctcgaactcctgggctcaagcgacccttccacctcggactcccaaggtgttgggaccacagatgtgagctgtgatgcctggcccatgtgtagtttgtgacaggttttaccatcaatgttatgaaaataaatggagaaattttgcatcttttctagcatagaaatgatctattccttgaaggtatgatagaaatcatctttaagattatatggattcagtactgtttgaggggaatcattattggacaac

SEQ ID NO: 23659 - DNA, 601 bp, Human
tttggttccagaagagtctctctttgatagcccaaagcccactggtgcaatagaacccaccagtcaacctattgcatctgccagcacagcactccgctccacatacagtgtgtgaattgtgcaacaggcccagggctgctcccaaccatctctagtgacaccacagagactacaggagacacaaatttgtcctcctacttctacctccagctcttagtcaggggccacgtgtgaggctggtatgtgtgggcttgcggggtcagaaggagggaaatcccgaaaatacctctgagttaaatgyttttctggtccactctgctctatatgtgttgtttctgctgaagcctttcaaagggctaagacccttctttggaatctaatagtgctattttgccaaattggacttcttactgttgttgaatcttttttctccttctgtcctgttgtctctacctgaagtacaatcttcttaatctccatttccatctgtgagaattctactcatcagttacttcccagcttaatgccactttctttcagaaactccctgagattccttccaccatcagtaatcgtcccttcatcacatgttctgccttac

SEQ ID NO: 23660 - DNA, 601 bp, Human
ctgaagcctttcaaagggctaagacccttctttggaatctaatagtgctattttgccaaattggacttcttactgttgttgaatcttttttctccttctgtcctgttgtctctacctgaagtacaatcttcttaatctccatttccatctgtgagaattctactcatcagttacttcccagcttaatgccactttctttcagaaactccctgagattccttccaccatcagtaatcgtcccttcatcacatgttctgccttacattccagcttcgtacatcctcatcaccctcttcctttytgcactgtgagctctttgagttcaggaactgtcttgttcacctttagatggagggtgttggaatgatgaggttagaggaagccaggtttgagtcccttcaacatttactcgccatgaaaccttgcacaagtaagttacttaacctctgagtggattttcccctctggaaaatgggcattacaacagtacctacctcatgaagctgttttgaagattaattgaggtaacataccacagtaaaggttgaaataaatgttaattcctttttctatacccttacggtaccctgcccatgtagcg

SEQ ID NO: 23661 - DNA, 601 bp, Human
ccttgcacaagtaagttacttaacctctgagtggattttcccctctggaaaatgggcattacaacagtacctacctcatgaagctgttttgaagattaattgaggtaacataccacagtaaaggttgaaataaatgttaattcctttttctatacccttacggtaccctgcccatgtagcgcctcatccacacaggccttcagtgattggtgattgaataaaaaatacagatccaaagtgcttttgtacaaaattcacttttgcattgttgagtcaatggcagatccagaaaagaatctgrggctgggcgtggtggctcacgcctgtaattccagcactttgggaggacaggagttcgagaccagcctggccaacatggtgaaaccctgtctctactaaaaatacaaaaattagcttgtcgtggtggcgggtgcctgtgatcccagccactcaggaggctgaggcaggagaatcacttgaactcggctggggtggggaggagggcggaggttgcagtgagccgggaggttgcagtgagctgagatcgtgccactgcactccagcctgggtggcagagtgagactctgtctcaaaaaaaaaa

SEQ ID NO: 23662 - DNA, 601 bp, Human
cgtggtggctcacgcctgtaattccagcactttgggaggacaggagttcgagaccagcctggccaacatggtgaaaccctgtctctactaaaaatacaaaaattagcttgtcgtggtggcgggtgcctgtgatcccagccactcaggaggctgaggcaggagaatcacttgaactcggctggggtggggaggagggcggaggttgcagtgagccgggaggttgcagtgagctgagatcgtgccactgcactccagcctgggtggcagagtgagactctgtctcaaaaaaaaaaaaaaaaaagaatccggggctgctgaacatcccacacttgtgcccacttgcacatgccgagtaagtggaacgttttaattatgtttcataaagtctctagaattaagtagggttttgttttaacaaacaaattgtactccttatatgaaagataaaattctatttggtggttgattggttggattttcaaataagcagttgctttctggtttgccttgacattttataaacataactacagatggaagctcaaaagagaggcaacatagtgttatagtggaaagatttgattcagagttaaattttaga

SEQ ID NO: 23663 - DNA, 601 bp, Human
cacagatcctgcactgctatggtcactgatgattataatttgaaaaattatcttcttttttaaagacaacactatacagatttgtccagagttgtacttctaccagattgtcatctatgtcaagaaaggaaattgggtttttcatcaactgaatgctttgaatttcttacattgctactgattaccttatgtttccttattttctggcatggagcaagctggtagccacctaatgtaaccatcacatgctaaaaggcacataatagacacttaagtagcagtgtatattctaagaaatcaratgattcagtggttgattatcccctttaagaaaaaagcagacgaaattaaaatttgtgttcctgaaaatgatataagagatattttcagccttttttttttattcttcaagaaaggatgcttaggcagaaatagcacatctgagaaactggcttctgtctcagatttagccctttttgaccccttcttctgtgagagggctttttgctggccagagtctagtggacatcagtgcctgtgtcagatcagggatgggcatcatcctgaccacctgagggagtgagatgtgaagtcactttga

SEQ ID NO: 23664 - DNA, 601 bp, Human
gattgtcatctatgtcaagaaaggaaattgggtttttcatcaactgaatgctttgaatttcttacattgctactgattaccttatgtttccttattttctggcatggagcaagctggtagccacctaatgtaaccatcacatgctaaaaggcacataatagacacttaagtagcagtgtatattctaagaaatcagatgattcagtggttgattatcccctttaagaaaaaagcagacgaaattaaaatttgtgttcctgaaaatgatataagagatattttcagccttttttttttattsttcaagaaaggatgcttaggcagaaatagcacatctgagaaactggcttctgtctcagatttagccctttttgaccccttcttctgtgagagggctttttgctggccagagtctagtggacatcagtgcctgtgtcagatcagggatgggcatcatcctgaccacctgagggagtgagatgtgaagtcactttgaatgcaagctagcagcaccctgggaagtgagcccatctgctccagaagagctaggccgtgcaggctccggaatgcctggctctgctgcagagaccaggctgtgact

SEQ ID NO: 23665 - DNA, 601 bp, Human
tggccagagtctagtggacatcagtgcctgtgtcagatcagggatgggcatcatcctgaccacctgagggagtgagatgtgaagtcactttgaatgcaagctagcagcaccctgggaagtgagcccatctgctccagaagagctaggccgtgcaggctccggaatgcctggctctgctgcagagaccaggctgtgacttgaggttaagccgcctagagacaaagtcaggatggcttgatctggacactgctggagtttttcttatctgaagcctatgaatgaccagtgtcagtgtgaaatrgtgctttcaagcaaaacgatctttcttaaggctctttgaattatcaaaatgggaagtggtacattttcattgtcactgctgaagacactcagttggttactcttttaattccaaattagacaaactagttctatttcttagtgcttccggaaagcctcctagaagaaaaaaaataaggatacatttgtaaatgacaagtgatttttctgactttaccctaaaatcatgtaagatatgtaaaacaaaccctataggctatccgttccttgtttacgtaccccgagagagcctactttttat

SEQ ID NO: 23666 - DNA, 601 bp, Human
atggcttgatctggacactgctggagtttttcttatctgaagcctatgaatgaccagtgtcagtgtgaaatggtgctttcaagcaaaacgatctttcttaaggctctttgaattatcaaaatgggaagtggtacattttcattgtcactgctgaagacactcagttggttactcttttaattccaaattagacaaactagttctatttcttagtgcttccggaaagcctcctagaagaaaaaaaataaggatacatttgtaaatgacaagtgatttttctgactttaccctaaaatcatgkaagatatgtaaaacaaaccctataggctatccgttccttgtttacgtaccccgagagagcctactttttataaaagctaaatatgtgaattacaaatggctgggctataggttttacttctttttcagctgttggatatcccacctgcctgttttcctctcttctctcccaagccatgcctctcggactcagaagttgaattacatataaccacatgggttgtttggaaacatagtcagtctttatttctagccgcttcatgaagtaggtgtgtgagaccctcagaggaaaatagagaag

SEQ ID NO: 23667 - DNA, 601 bp, Human
cctatgaatgaccagtgtcagtgtgaaatggtgctttcaagcaaaacgatctttcttaaggctctttgaattatcaaaatgggaagtggtacattttcattgtcactgctgaagacactcagttggttactcttttaattccaaattagacaaactagttctatttcttagtgcttccggaaagcctcctagaagaaaaaaaataaggatacatttgtaaatgacaagtgatttttctgactttaccctaaaatcatgtaagatatgtaaaacaaaccctataggctatccgttccttgtktacgtaccccgagagagcctactttttataaaagctaaatatgtgaattacaaatggctgggctataggttttacttctttttcagctgttggatatcccacctgcctgttttcctctcttctctcccaagccatgcctctcggactcagaagttgaattacatataaccacatgggttgtttggaaacatagtcagtctttatttctagccgcttcatgaagtaggtgtgtgagaccctcagaggaaaatagagaagtagaaacactttgttaattagaaatgcattaagaagctgcat

SEQ ID NO: 23668 - DNA, 601 bp, Human
acaaactagttctatttcttagtgcttccggaaagcctcctagaagaaaaaaaataaggatacatttgtaaatgacaagtgatttttctgactttaccctaaaatcatgtaagatatgtaaaacaaaccctataggctatccgttccttgtttacgtaccccgagagagcctactttttataaaagctaaatatgtgaattacaaatggctgggctataggttttacttctttttcagctgttggatatcccacctgcctgttttcctctcttctctcccaagccatgcctctcggactcmgaagttgaattacatataaccacatgggttgtttggaaacatagtcagtctttatttctagccgcttcatgaagtaggtgtgtgagaccctcagaggaaaatagagaagtagaaacactttgttaattagaaatgcattaagaagctgcatggatcttaacctttgcttgtaaaggaagaggtaataattgattacactgtgggcatacaacattccaggtgctatcttcagtgagggcattttcgagacagaaaggaaaactaatcacaagttctaatcccgagggtaatttagacttt

SEQ ID NO: 23669 - DNA, 601 bp, Human
ttgacttgtaacatgtgcttgccagctgactttcttctctaaggcatcctaaaactagggaaatgagactactggattctattcccagctctgccacttgatgctatatgaccctgggctgcccacatttcttctccatgcctattattttcctttcctcacaaaaacctcatgggcttggctgcatatgcattgggggtggaccattgaaaattctgttaaaaatgtgaaattaaacttctgattttctccttcccacaggtaaacacctttgtaaagaatctgtaaccaataccatgawgttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcttgtttttctaattcagttgctcatttatttcagcatgtatctcttggtgcttgctctaaattcacctctagactagtgtattagtccgttttcacactg

SEQ ID NO: 23670 - DNA, 601 bp, Human
tactgatctggggattgaacctggacactgggaagttttaaaagtttctcaagtaaattaagtgaatgtattctatagatagaaataagaagcacttaattaaacaaacaataatccattaattggcaacagatgtgtcaaagttggtacaagattccgattcacttacagttaattttaacagaacatagagtcttcatgtccaggagagtgagcccagcccagcaaatccagggtaaatattacgattaacagtcaccatcctgagatggtaaatgcagtagggaatggtttgcttggyctgagtacagcagtgttggtgtgtgagtgttggtgtgtgagtgttggtgggtgagtgttggtgtgtgagcgttggtgtgtgagtgttggtgtgtgagcgttggtgtgtgagtgttggtgtgtgagtgttggtgtctcctcaatattatttatcctagaaaaggaagatcaggggtgggaatccccagctttgtattttgcttgcaatacagggtatctttacaaatttgtaatcttcactacatgtctcaaaacttcctatacttgaacaacttgtcaaatccatgagtaaccaaaaagc

SEQ ID NO: 23671 - DNA, 601 bp, Human
aaatgttgaggctgcagtgagccatgatcataccactgcactctagcctgggtgacagaatgagaccttgtctcaaaaaaagaaaaaaagatactgattctggctttaccccagaaacctctgtttactgatctggggattgaacctggacactgggaagttttaaaagtttctcaagtaaattaagtgaatgtattctatagatagaaataagaagcacttaattaaacaaacaataatccattaattggcaacagatgtgtcaaagttggtacaagattccgattcacttacagttaaktttaacagaacatagagtcttcatgtccaggagagtgagcccagcccagcaaatccagggtaaatattacgattaacagtcaccatcctgagatggtaaatgcagtagggaatggtttgcttggcctgagtacagcagtgttggtgtgtgagtgttggtgtgtgagtgttggtgggtgagtgttggtgtgtgagcgttggtgtgtgagtgttggtgtgtgagcgttggtgtgtgagtgttggtgtgtgagtgttggtgtctcctcaatattatttatcctagaaaaggaagatcaggggt

SEQ ID NO: 23672 - DNA, 601 bp, Human
gatggagaagcttccatgaggaagcaatagcaagtgattttgcctttagatgggaatgagggtgatgcttgagaaaaagaaagagctgtgcaattaaaggttctcaactcagcatcatggaatctccaggaggcccacagctatgctgagttagttgctttagggtaggccacagatatccgtgttttttcaaaagctcctcaagtgatcctaaggtgcagatgagacgagaagctctggccaagcatgccgagtgcaggagaagcgggtaggagatgtgttcagccgggcagactgtgtycaatcacacaggcctcaggatgccagggttagagctggtgttttattttgagtgtgatgggaaggcactgtaggtggcataggtgtggcataaactaatttagaatttaaaagtagtactttcgatactgtctgaagcatagatggcagggggaaggggacagagtgaaaaaagcaaaagcagttaaatacacgggtaaactccagtgacacaacaaatacaaatctccaaccgtggctggccaactaagggccaccaggggaatacacgcattcgtgcacatcaaatggcttttgttga

SEQ ID NO: 23673 - DNA, 601 bp, Human
gggtgactgggaaagagtaaaagagcatcatagcaaagagaagccgaatgcaaagataggaaagatcacatttaagagcaaaggctttggagtcttctaacctggattcaggctttcactgtgtaacatgaagcaagtttctttctaagcttccattttctttttagacaaatgaggataatgccggcaacaatctcagatgcatgagaatgcatgagaagcacttagcagggttctggaacattgtcaacatagaatcgatgacacaactattatctctatttccagagcactaggcaaygagcagagatgctaggagaacattcataccagactgtgggggtacttatccactcactcactcacttgctcatttatttatttgtagccacaacttggaagtgatagcactaactcagtcatggagaagtcacatagtaggatctaaaaaacactaaaaggtagacctccaaggaaatgtaatcaaattagacttttcttttttctagatacatttcataagagtcacttagtcaaaacgtatatgctgtacagaaaattctactggactctcttgaaagtaaaaaaaaaaaaagaaaga

SEQ ID NO: 23674 - DNA, 601 bp, Human
taatattggctcatttgttataacaaatggaccacactcatgcaagacattaataataggggaaagtgggggagggaggataagggagtatatgggaactctctgcttattttctataaacctaaagctgttctgaaaaataaagtgatattaattaaaaaaaaatgaatcagagctaaccagatgacttgaaaggagtttcacatggtatcattgagtgagaaatgcaatttacaaaaaactataggattttatttttatagaccaagcaataactaaaaacatccctatatattttcaattatatgaacaagaagaaaaatataaaaatatggaaagatacatattagactttagagagccaagtgaagaagggaagaaataagaccgaagataaaaatgtatatgatcacatatttgcatttatgaaatattatgtctgaatatagatgcatataaaaattaaaggtattttcaaataagttacttgtctatacgtctgccttctttaccatactcctagaggtaagaaattgtatcttatttatctttggatgcctggagtctattctagtgcaagccacatagtgagtgttcaaga

SEQ ID NO: 23675 - DNA, 601 bp, Human
ttaaaagtgagaaaaattctgaatagtcttatatctaataaacaaattgaatccagatataagaaactttacatagagaaaactccaaggcaaaataactttaccagcaaacttcttgttatttattcaaatgagttgagaatttatgcccacacaaaaatctacacacaaatgtttatagcagctttattcataactgccaaaactgggaggcaactaagatgtcattcaacaggtgagtggataaacaaactgtagtagagatccatacaatggaatcttatttaatgataagaagaaagagctattaagccacaaaaagacatggaggaatctcaaacacatattgctaagtgaaataagccaatgtggtaaggttacatattgtatgattccaacaatatgagtttctggaaaaggtaaaactatggagagagtaaagagattggtggttgcttggagactgggggaaggaagggatgaatgggggaaacacagggatttttagcacagtcaaagtcatctgtataatactataatggtgaaacatgtcatcatacttttgtcaagagccatagatttgtcagaatccaccataatg

SEQ ID NO: 23676 - DNA, 601 bp, Human
cccttttccaaatttcttacagaaaaaacactttactattagattctcctgcagacaatactgtagccattattattacggtactagtgaagaattcctggttcccttctaaaccccatctcacccggcttacgctgcttaacaaagctcctcaattttagtaaacacgcaaccctgacgaggagaacagctttgaaaaccaagacgtgacactattattccaaatgtaggacatgaaaaatttacattagtgccaaatctataatagaaccactaaaactagtcatgtatcccgttaacyagtaatacaatctgatatataactgagctttgcaacttcgtcgagggcacaatccaacttctacaaatgagacgagcttctaattcaattatagcctctcttttcctccattcaagcattttcattccccttatctctttctaaagcattttccccattttttctgcttgtcattcctcaaagtttttggagaaattacaaaaccttaaatcacactctttcctgggataataaaaatactttaaaattgccagatgctgttgacttcagcaagagtaatcacagcaagctgttgaagag

SEQ ID NO: 23677 - DNA, 601 bp, Human
agaaataatatgatatttttagtgagaacactttatggagttttttttgtatgtgccagtttcgctcatcaaaaaataacattccactgaaaacacatctccatatttagtctctgatctttttttttcttttaacttcctctgtcttcctaaaatggcagctcttcataaagcaaattgagtgagttggtaaaaataaaaatccccttttccaaatttcttacagaaaaaacactttactattagattctcctgcagacaatactgtagccattattattacggtactagtgaagaattyctggttcccttctaaaccccatctcacccggcttacgctgcttaacaaagctcctcaattttagtaaacacgcaaccctgacgaggagaacagctttgaaaaccaagacgtgacactattattccaaatgtaggacatgaaaaatttacattagtgccaaatctataatagaaccactaaaactagtcatgtatcccgttaaccagtaatacaatctgatatataactgagctttgcaacttcgtcgagggcacaatccaacttctacaaatgagacgagcttctaattcaattatagcc

SEQ ID NO: 23678 - DNA, 601 bp, Human
ctcttcttcagtcaaaaggctccagtcaccccaacctccttgcatttcctccaacaccccaagcacatctcctctgcagggcctttgcacttgctcttcctctgccccctgctattggtgtggatggagccctcctgctcttcacatcactgccacagttcattttatccatgaggattccctgacctcccctcatcggccccatccattttgctctgctcaggttttcttcaccacatttattgctacctggcatattacactgctctttttttatctggttattgtctgtctcccccartttgaatgtaggctccataacaccaggggctggctgctctgtccattgtcatcctcatctctagagttgtgcccagcctgaggacgtgaagatgctcaacaaagagttgctgaaggaaagaatgaatgactgtcagcggggatgacacagtgggaggctgtgatccactttgccattcacttttgaaaagttctccctagaaagtgtaaaactgtttacaagccaagcattcaggacaagagtcttaccctatcaacatagaagcaggagcagtgatttgtatggaagttgcattggtga

SEQ ID NO: 23679 - DNA, 601 bp, Human
gctctcgcctgtaatcccagcactttgggaggccaaggcgggcagatcatgagtcaggagttcgagaccagcctgaccaacatggtgaaacctcatctctactaaaaatacaaaaattagccaggcatgcacctgtaatcccagctgtactcaggaggctgaggcaggagaatcgcttgaacctgggaggcagaggttgcagtgagccgagatggcatcactgcactctagcctgggcgacagagcaagactctgtctcaaaaaaacaaacaaacaacaacaacaacaacaaaaaaaaaamcagcaacaaaaccaaataaataacagaaatgagtaaatatggagctatcagagagccgtaaattgtacccagtatgttggttcctttacaggaaaataaacaaggggctgaaggtgctccatggcggaatttcaaaccactgacatgatttcaggaagtgaagtcttggagcacaaaatgaccgtggagctccctaaacttaatccacagatttcctgcatttctctaggccttacaaggctctttgggacctgaccttgtcccttccactctcttcttcagtcaaaaggctccagtcac

SEQ ID NO: 23680 - DNA, 601 bp, Human
cgggctcagtggctctcgcctgtaatcccagcactttgggaggccaaggcgggcagatcatgagtcaggagttcgagaccagcctgaccaacatggtgaaacctcatctctactaaaaatacaaaaattagccaggcatgcacctgtaatcccagctgtactcaggaggctgaggcaggagaatcgcttgaacctgggaggcagaggttgcagtgagccgagatggcatcactgcactctagcctgggcgacagagcaagactctgtctcaaaaaaacaaacaaacaacaacaacaacaacaaaaaaaaaaacagcaacaaaaccaaataaataacagaaatgagtaaatatggagctatcagagagccgtaaattgtacccagtatgttggttcctttacaggaaaataaacaaggggctgaaggtgctccatggcggaatttcaaaccactgacatgatttcaggaagtgaagtcttggagcacaaaatgaccgtggagctccctaaacttaatccacagatttcctgcatttctctaggccttacaaggctctttgggacctgaccttgtcccttccactctcttcttcagtcaaaag

SEQ ID NO: 23681 - DNA, 601 bp, Human
gtaaatttttactccattggacaaacccagaaacatttttaaaaacttactaatcgattttccccctgaatgaatgggttactacagacatttctaaccaaaataatgaattactaaccacggagcacagcccacagccttcctgatgtacttaatgcaactccagagaaaatggatgcttccgtactgctgtgatggtgccttcaggaatctgagggcaccagctgtaatcacacagagggagacacgaagcagtatctaatagcttgttcgttcaagccagaaagtcaggtttgaatayagattcgtacttggtcattttcttaatctgtaggcctcattttcttatctgtgaacaggcacacgatgacagttgttggaaagacagactgactttaaagagtcctaagataaagcatgtgataatccctgtgtctggtacatggtgagtactcaatgtatgctagttgttatttaaaaacagcaacaggccgggctcagtggctctcgcctgtaatcccagcactttgggaggccaaggcgggcagatcatgagtcaggagttcgagaccagcctgaccaacatggtgaaacctcatct

SEQ ID NO: 23682 - DNA, 601 bp, Human
ttgtgactgtgtcctggaaccactccaggttctgtctaagctcccaggactattgcgggaaggagggaggacaaggactagacctgccaaaactgagaagcaatctcccatttgctttctggccatacacttctatattatatctcacttgaacaaaggtttccaggtccttaaaaagtttataaaccattgataagttctaaagcccctttccgatggaatctttttcagagcaggtgctcatggctcatcctccctacaggcagatattggtgacagaccaaaaggccacaccaggctytgctggtcttctcctgggaagcactgacttttccatactctgttttttccgcctcagtgtccttcctcctcactgcaccctgctggaagccaacctgctcaatctgcacattctccagggggtattttttgttcctggggtcgtgaaaaccccatgttctcctcctcagaatgcctccattctattgctcgtatctctcttatcactcctgggggcatttatctgaatgttttctatcatctactgatgataagcgctacaagggcacaggctttctatggacatttgggagtagaaaca

SEQ ID NO: 23683 - DNA, 601 bp, Human
cttccacactaacttgctgtgtgaccttgagcaaatgactttacctctctgagcctcggttctctcacctgtacctcacagcggtgttgtgactgtgtcctggaaccactccaggttctgtctaagctcccaggactattgcgggaaggagggaggacaaggactagacctgccaaaactgagaagcaatctcccatttgctttctggccatacacttctatattatatctcacttgaacaaaggtttccaggtccttaaaaagtttataaaccattgataagttctaaagcccctttccratggaatctttttcagagcaggtgctcatggctcatcctccctacaggcagatattggtgacagaccaaaaggccacaccaggctctgctggtcttctcctgggaagcactgacttttccatactctgttttttccgcctcagtgtccttcctcctcactgcaccctgctggaagccaacctgctcaatctgcacattctccagggggtattttttgttcctggggtcgtgaaaaccccatgttctcctcctcagaatgcctccattctattgctcgtatctctcttatcactcctgggg

SEQ ID NO: 23684 - DNA, 601 bp, Human
aaaatccgtcctgagaattgcttgtttcttgagcccagcacttcacacagctgtgccttggaaacggatctgtaagtgggaaagacttcgtctctttggggaataaatgagacagcaagagcagagcactgagcacagtcccagcccatgagaaggactcaatacatttttaactaacttattcaaatattttggtccagcaggcataggccttggtcctattcccaccttccacactaacttgctgtgtgaccttgagcaaatgactttacctctctgagcctcggttctctcacctgtrcctcacagcggtgttgtgactgtgtcctggaaccactccaggttctgtctaagctcccaggactattgcgggaaggagggaggacaaggactagacctgccaaaactgagaagcaatctcccatttgctttctggccatacacttctatattatatctcacttgaacaaaggtttccaggtccttaaaaagtttataaaccattgataagttctaaagcccctttccgatggaatctttttcagagcaggtgctcatggctcatcctccctacaggcagatattggtgacagaccaaaag

SEQ ID NO: 23685 - DNA, 601 bp, Human
taaggcaaattatatgtgaatgcactgagagagacttgttgaaaatcacacaacagagaatccccttgtaaagtgaccacctgtcccagcataatgccttgcaaacagtaagcatttaataaatgtttgttgggtaatattaattcccttaatttgtgtaaatgtttcttttggtacattaaggatacttaaaataaggtatttatcatcaactggaaatcatattggagggaaaaatgctacaaagagcaactgcaaccgtggaatgattaattcagtgaatcacccgaggaagcgggcrtactgccagtgctggcctcaggctccatgccaccctctgctctgatggggatgccaaccctcccaggttcgctgacaaatccctcaggagaggaatgggtgggatgagatgaagcagatctgagggctgcagcacccgtacacccgcacagtcgtagcatgcaggtcctaatgtgcagatgtcactagcttccagtttatttatatcctgtgtgacaatctgaggctttgatgttgcagctttataggccaggggtcgtaacagttcagagaagacacagcaagactttatatctattgt

SEQ ID NO: 23686 - DNA, 601 bp, Human
gcagctggattagtccaacgggaatatggttgattttaatactaaaatgacggagtaatttctggatgtaaaataataagttcacacccatgtggagtctactatgtgccaggaactattctaagtgcttgacataagctcatgaccaccctatgaggtgagtactgcagatcatgctctgcagacaaagaaacttaacagcagaggatttaagtaacttgcccactatcgcccaactgggaagtgttggagccgggattcaattcaagctgttggcttcagattcccagttcatactcgytccctctatgaaacctccacccatccatttggaaaatgttgctagctagcttcaccttcttgtttcttttcagcataaagttcctcacttaaagaaatctattcctagagagcttgtgtgtaaactaaattaattttataaggcaaattatatgtgaatgcactgagagagacttgttgaaaatcacacaacagagaatccccttgtaaagtgaccacctgtcccagcataatgccttgcaaacagtaagcatttaataaatgtttgttgggtaatattaattcccttaatttgtgtaaa

SEQ ID NO: 23687 - DNA, 601 bp, Human
accagcctgaccaacatggcaaaaccctgactctactaaaaatgcaaaaattagccaggtgtggtggcacacacctgtaatcccagctactcaggaggctgaggcaggagaattgcttgaacccgggagacggaggttgtgatgagccaagatcaagccgctgcactctagcctgggtgagagtgagactcggtctcaaaaaaaaaaaaaaagtaaaaaccattcttacttgtggaccacacagaaatgggcagtggactgcatttggcccataaaccctagtgtgttaacccctgtcctrtatcagtggttactattttttcaggccaaaaaccatttggacaatctgatgaaactgatgtacctctctctaggtgggaaaagcctctccactgacatacatacaacatctgaaaattccatgggcatagattaggaatttgggctccagcaatattcttctttttaaaagtgctctggtagagcgaaggggtatgtgatggggggaacaactttttgacaataattagtggatcacccagtactaaatagctttatctattaacagtcataaattaaacatcaggttcagaaatcagca

SEQ ID NO: 23688 - DNA, 601 bp, Human
cagcacacggcaacttaccccaggctactctatagctctcccacatcatctccttccccagtctgcctgcccttagtagagctgatcatcttcttttgcactctattccctctgtaccttggttgaaccctttttagggtacaatgaggtattatgaggatttcattggcagcaagcaaagagcttgggttttgcagtttgaattctgactgtgccctgtgacctgcgctagctcctcaaacgttgatcctcagcttccacagtgacttgtataccataagtggcagcttttattatttaytttgataatattcccaactagaacagaaacattttgggggcaggcatgctgactaattcactttttaaaaaaatccatagcttagcacagagcttggaacataacaggaattccatgtttgttacataaattaataagtgaatcaagttatgtgaggctccaggtctgggaggtgagagtctgccctgagcctagccaggatgagagcagggatggtaggtgtgtaggcagagggtctgtgactagataagggggattggggaggtatccttggcatatgccagcaaacctcttccagga

SEQ ID NO: 23689 - DNA, 601 bp, Human
aactaatattgctattaataacgtatcacttagagccctagttttaaatagctgcatatcaaatagctgagtagctgactcatccataaaaccccacaacttataacacttactcttccaacccagccagtagtactcatttcaatgtgttgccgtgcctaggaagggaaagagacaatgacagcatttcaaagagaagtcagatgaaatctatagccataatttgtggtaatataaatagagctgtacttataataactgagagctatctccattcatatatttctatttatgttagtayttttcaagtcattacattagatcatttgactctcttgcctaaagttatatcctgggtccttctggaagctccactggtgttttaaatccagcatgcacaaaactaaagagaatttcatttgttttcctctgtcccaccagcctgttctactccctcattcttcttctagttagtggcacctattcacccaagccagagacctgggggtcattctagattcctgccctcctcataatcacctccttcagcccctgtcacctagttctttgacttctctgtccttctctacagctaagggct

SEQ ID NO: 23690 - DNA, 601 bp, Human
aatactcacagataatcactggttagagcttctatcccgatgacttcccaggtgccttttgtaataaatgtgcagtcctgatggttttttttttttttttcaaaaaaaaaaaaaagattgattagagactctctctgttcaaagtggaggattaaatcatttatatcaggaattcaaataaccttggattttcttgttgggtttccccacctcgttccacatgacacaatacaccactgaggagtttaaattaatctgatttttatacacattgatccaccttaccaaatgatttccactwcaagttggtttccaaaaaaaaaaaagaggtcaacatgaaataaaatatgtaagaatactcacttttttatctatttggaaatagcaaatgtgtctgtaaccttcttcattgctgatgatcttgtagaagctattaccatcaagggtaaaatgaggttctgaaggcctaaactagaaaataatagagaacaaaagaacattaaagcacagtgtctcatctcagtaccaactttagttttagaaagtcctgtccaatacctacgctcaaaaatccatgctccatttatatgccaaattaaaa

SEQ ID NO: 23691 - DNA, 601 bp, Human
ctcagataactggtttgaaaacatttatttatttttgtgctatggacagttcttttcagaatatccagatcctttctcccattttgagaagtaacctggcacactgtttaaaagggatggctcgggcggcagaggcctgttttgaatcctgttgtgcctgtaactcgctgtgtgaccacctgcataagtcacttggccactccttgcctgggtttcttcatttgtaattaataatagcaacagcaacagaagatggagcagtgagcatgttgggtgacacgcaccagccacatacattttytcattgaaagggacgagtgcataaaataatcatttaaaaccccacaatatgtatgtatttaacgctgaagtgcttctgttatacacaagggtgtgtgtttgtgcatgtgtgagtgtgttcggtctaaggcaagctatgcaagtctctcagtgataaggggaagaaaagattgtttatgctcactacttaaatgtgagtggagagaaggggacttaggtgatttcaagagctcctcagattcaaaaggaatagagggagctgcttcgaagtgagtaacagcggcgactgccctccctccca

SEQ ID NO: 23692 - DNA, 601 bp, Human
actggaaaggcacagggctcagtagaatgaagtaggaaatgaatctgtgccctgctgggcaccttgggcacattatcatctctgaacttaatatactcatctgcaaagtaaaatgtgagctgacatccttccccactctaaatccgtgatcccacagggtttttcaggctctgcccaggtgggctgcagagccctgtagccagcctccctagggagggacagatctccccccgctgcccccactcccatggagtcccagagccaggcggcacatctgcacagtgcctgacttggataagcsattcctttctggcatgcaaaagtgtttttctcacaagcccatatcgtcactgtttatcccaactgtggtagttgcagagtggaaggtaatgtatagaaaagctattttgtgagctctttaattttatgtgtttggatgataatattaatttttatactggattagaaagagtgaaggcactttccatacctggggatgaatcctggctcactagctctgtgacttaggacaacagaactgtgctttgatttcctcacatagaaaatgaggataataatatctacttgatagagatttctt

SEQ ID NO: 23693 - DNA, 601 bp, Human
cccatccccacagctccatcctacatcctgtctcaagtcacccgtctactaatgtggcttccgtgaccctaaaacctgcaggggctccccagtgttcatgactgaaatagaatgtcacatctcagtattcagtgccttctgtaccaggttgtcaatgttagctctggaaaactctaagctcttgcccctcacgtgtggctcaagggtaagcagcactagcatcacctagaagcttaatacaaatccagaaacctggaccttccttgacctgctgggtcagaatgtgcatcttaatataagrtcccaggagactcacatgcacattcagtttgagtagcactgatgtaaactgtttttcacgaggatgctatactttcctgtgcttttcctgatatttaaaattagatgtgttgaatcttttctattatcctaaatttttttaaaagcctaaaatgaatcaatcctaatataacagattcctccctcccctataagctgttagcccttagtggaaaaaataaagaaaaacaaacaataaataacaagattttctactcaaagaaacccattgttcttactggtctctgaacataatccatga

SEQ ID NO: 23694 - DNA, 601 bp, Human
aggataggacaagttctgcttacatgcctttgctaatgttttccttctacttagggaggtcagtcaaaagaactttcgttttaaacaaaacactataacattctaactttaaacaggaaaatgcattcatgcatttcttgagctagcaaatattttttcacatgtgaaatgccttgctcctctcaattatattaaatttggtagattaagagcttgccttaatattaggtatatatatcaagttccctaaccccaagattaaacaagattattttttaaaatagaaaaaaaaaaaagaccytaaaagagaggaaaaggaaaataactgaacagaaatatgtattaaatttaccattttttaaaaccttttctaatggagatcaaatcgttacttactaggaagtcaaagaagataaaaatatcactcaaaaggatgcttttttagcattggagccgaagcctaaaacaaattagtgtcacgaatgaattgacttcatttgttacaattattttacttgaaaagaaatcagataacacatctggaattttaaaatatgtatcttttcctttctttgtgcttttatgtgtggttttcatgaaa

SEQ ID NO: 23695 - DNA, 601 bp, Human
tgcacaggataggacaagttctgcttacatgcctttgctaatgttttccttctacttagggaggtcagtcaaaagaactttcgttttaaacaaaacactataacattctaactttaaacaggaaaatgcattcatgcatttcttgagctagcaaatattttttcacatgtgaaatgccttgctcctctcaattatattaaatttggtagattaagagcttgccttaatattaggtatatatatcaagttccctaaccccaagattaaacaagattattttttaaaatagaaaaaaaaaaaagaccctaaaagagaggaaaaggaaaataactgaacagaaatatgtattaaatttaccattttttaaaaccttttctaatggagatcaaatcgttacttactaggaagtcaaagaagataaaaatatcactcaaaaggatgcttttttagcattggagccgaagcctaaaacaaattagtgtcacgaatgaattgacttcatttgttacaattattttacttgaaaagaaatcagataacacatctggaattttaaaatatgtatcttttcctttctttgtgcttttatgtgtggttttca

SEQ ID NO: 23696 - DNA, 601 bp, Human
ctgcaagtttatttccttctttaaggactttgacttctgcatcatatgctttgcatttcccatagcacccggcacagtcttgctcacaatgactgtaaatcattgtggaatggactgcagtatgaatgaatgctaacatttaaaacttcagaggaagaaacaggttgcattggaaaacgggcatgtcattgggcattctatatactaacaagtttaactcccttgtatctgcaatcttcacaggctaccatctaccctacacagagctgtgtgcacaatctctgtaaagctctgtaaagcrctctcatttctgcttgttaatcaagaggagctccttatagctcatctcaattcatttaaatatgtcatctttgcaccatctacacaactcctggacatggatactctccaataacttattccctccccagcccatctctccactcatctgcttactgtccctgcacaggataggacaagttctgcttacatgcctttgctaatgttttccttctacttagggaggtcagtcaaaagaactttcgttttaaacaaaacactataacattctaactttaaacaggaaaatgcattcatgcat

SEQ ID NO: 23697 - DNA, 601 bp, Human
acatttctcttctccgtggagaagtatgcatccttcccaatcatgagccttaaactgtgccagcctatggggtgtccagaatgagtcctctaaaacttagcaacacaactaccatggttgtatatttccttcaaagatacttgtcagttttgtctttgaagatagttatcaaacacagacttcataggccaagattttagaagtattaatgtaatcttggaaatcaaagaaataatttctctaatagttaagaagggggagttgtggtataaaaaaaatgatgatgacaacaataaatgcrgctttggatatctttccatctcagcttaacacaatactcctggactgcaagtttatttccttctttaaggactttgacttctgcatcatatgctttgcatttcccatagcacccggcacagtcttgctcacaatgactgtaaatcattgtggaatggactgcagtatgaatgaatgctaacatttaaaacttcagaggaagaaacaggttgcattggaaaacgggcatgtcattgggcattctatatactaacaagtttaactcccttgtatctgcaatcttcacaggctaccatctacc

SEQ ID NO: 23698 - DNA, 601 bp, Human
gtcatcttctcctctctccatctatttcatcattcatggatccttctgcatttcctagtctatgatttcataacattattttcaaccaccctccctattatgcttccccagacatccatgctgttggttacagaaactcaaagttacatttcccacataccagttgaatgtaattaaatataagagtcagaatgagactggattcaaatcctgattcactttggcaagctacctaacctaatagtctctatttatttaattaaaatatggggtaagaacacccacctctcggggcttcagygacaatgcctgcaggtaaagcacttctcatgcaacatgcatcttatgagtaaccatcattgattgttaacatctcttgagccagatcacatctagttatagtcccataagtgaagagcacaagaatgagatgtggttcatacgtaacagagcccttatacatagtaccgatgatggttgtgctccacaattttcccaaaatagcagagtcaccctcatccagactgtaggagctactcctaggacttcagagttgtcactgcctatgacgtaaatgtacactgaaggaaatgtacacagt

SEQ ID NO: 23699 - DNA, 601 bp, Human
taatcaattgtcatcttctcctctctccatctatttcatcattcatggatccttctgcatttcctagtctatgatttcataacattattttcaaccaccctccctattatgcttccccagacatccatgctgttggttacagaaactcaaagttacatttcccacataccagttgaatgtaattaaatataagagtcagaatgagactggattcaaatcctgattcactttggcaagctacctaacctaatagtctctatttatttaattaaaatatggggtaagaacacccacctctcgrggcttcagcgacaatgcctgcaggtaaagcacttctcatgcaacatgcatcttatgagtaaccatcattgattgttaacatctcttgagccagatcacatctagttatagtcccataagtgaagagcacaagaatgagatgtggttcatacgtaacagagcccttatacatagtaccgatgatggttgtgctccacaattttcccaaaatagcagagtcaccctcatccagactgtaggagctactcctaggacttcagagttgtcactgcctatgacgtaaatgtacactgaaggaaat

SEQ ID NO: 23700 - DNA, 601 bp, Human
agtttatttttaaaatatcaaagcctcactctcaaacaaatgtatcccctgtttattctaaatctctattttttaattgttaaggaaaatagctaatcattaactttagtaaaagagaatttctttcctcaggaatccttaatcaattgtcatcttctcctctctccatctatttcatcattcatggatccttctgcatttcctagtctatgatttcataacattattttcaaccaccctccctattatgcttccccagacatccatgctgttggttacagaaactcaaagttacatttcycacataccagttgaatgtaattaaatataagagtcagaatgagactggattcaaatcctgattcactttggcaagctacctaacctaatagtctctatttatttaattaaaatatggggtaagaacacccacctctcggggcttcagcgacaatgcctgcaggtaaagcacttctcatgcaacatgcatcttatgagtaaccatcattgattgttaacatctcttgagccagatcacatctagttatagtcccataagtgaagagcacaagaatgagatgtggttcatacgtaacagagc

SEQ ID NO: 23701 - DNA, 601 bp, Human
ccctctttgcaaagggacaaaaggaaatgtttttcttttattgaattccataaaaatttcactgaacttttgccttgtttttatctttacataaattgcatcttgcaggatgtacacttttgtgtccagcttctttcattcaacagtatatgcaattcatccatgttgttatgcttagctctttttagttgctgcaatagtgtgtgccactgtataaacgcactatttctcaatacttatttaactggggttgtatatagtagatccttaattttgtaattttaggacttttgttggtcakatttgagagaccctggaaactatgccctctctcatagaggagcgatctggatagatacaagtttatttttaaaatatcaaagcctcactctcaaacaaatgtatcccctgtttattctaaatctctattttttaattgttaaggaaaatagctaatcattaactttagtaaaagagaatttctttcctcaggaatccttaatcaattgtcatcttctcctctctccatctatttcatcattcatggatccttctgcatttcctagtctatgatttcataacattattttcaaccaccctc

SEQ ID NO: 23702 - DNA, 601 bp, Human
tgtgtgtgtgtgtgtgtgtgtgtgtatgattcacagaaaacaaatcctggcagtttttttcacagttttatacaaaaatttgcagcccagatgcacttttctttacataattgaatttaaatctctccagatgtttttcagtttgggagagtctgcccctgcaatggagaaagataagggcatgaaaaacttctgagtaagggcttagaaatgtctccgggccccctacctgagaacttaaacaccattctctaaataaatcccttcttatgctgggtgttgattagttagctcagtaccrtgcactcaatagaaataaatttttccttgatggattaagaagtcttctttgccacaaaactgtgttcagagatggaatccaggtaaagaaataagaaaaatattgtatgcacctatttcttaatattagcctgacatcaaaagaaatttttttttacttaaaaatacctgacaaatggaactcaaatttttagcattgtgggtggttgcagacctttgcattaacctatcttgattttgacagtctttgtgttttcatgtaatatgtcctaggttgccctaagttaagcagtgctagaaa

SEQ ID NO: 23703 - DNA, 601 bp, Human
ataaatatctatcattttaacctaagatccagatgaacatggtttacttttgttggagttcataaaaattgtgtgtgtgtgtgtgtgtgtgtgtgtgtgtgtgtgtgtatgattcacagaaaacaaatcctggcagtttttttcacagttttatacaaaaatttgcagcccagatgcacttttctttacataattgaatttaaatctctccagatgtttttcagtttgggagagtctgcccctgcaatggagaaagataagggcatgaaaaacttctgagtaagggcttagaaatgtctcygggccccctacctgagaacttaaacaccattctctaaataaatcccttcttatgctgggtgttgattagttagctcagtaccgtgcactcaatagaaataaatttttccttgatggattaagaagtcttctttgccacaaaactgtgttcagagatggaatccaggtaaagaaataagaaaaatattgtatgcacctatttcttaatattagcctgacatcaaaagaaatttttttttacttaaaaatacctgacaaatggaactcaaatttttagcattgtgggtggttgcagaccttt

SEQ ID NO: 23704 - DNA, 601 bp, Human
aatagaatattttaaaagacactttaaaatatgagaacttcataaaatgctcatatctcttttaactttagcatttaaatattaatatcttaggttgtacgttagatgggaaaaatggcttttaagggcgaaacacattttcccctaggtagctgcagactttaattctgcttgtcatagaacacaatactcctttcttatttatgctaaccagatttacatgtataagaagatctgaaattttaaaaataacatttaaaaaatattatgcataactgcataatacaattgtaaacttttwaaaaaatatgccttgaaacaccatttacgtattccttttgtcccatctttgaataaaattgtttaaatttacacgtatataagaactctagacaacttctatgtattagattggtctatatacattaaatgaagttttcttctcatttcatatttttaaacttacaaagatttactccattattttattgaccactagaggtctccaaaaacaagccatccaacagaacaattaatatcaagcagaaaaatattatgaaaacaaattcattgtgtgtagatcaaattataactgtgccct

SEQ ID NO: 23705 - DNA, 601 bp, Human
cattaaaaatacgttttccttcatctgaaaatctctaatgcagaaaatgaatttgacataatacgtagaaatatcctctgcatagacaacaacagctctagccattcctgactttataaaacaatcctaattgtttatcgcctgtggttattcaacaaaagatcaccttgtaattgcaaaaactgaagcatgctgattattaagatcccactgttgttagaatagctagtaatacataccagacagaaatggattttcatatttgagctgagctattatcatgctggtttcactttagaaytactctgccacacatttactgaacaagtgattacttttgaatcaaaatagggagagactgaacaatcacatgaacaggagagcagtgtcttgatactcccagcatatgcgatattgtgcttcttaaccccaaactcgctaatattattgagcattactctgtgcatggctgaaggataccactcttctgacttcacgttgaaaaaaaaatttttaatgtttttattctgtcctgtctgtggcactgctaaaagaattagcccagaaagaggaaactagaccccaccagcaacttccctcc

SEQ ID NO: 23706 - DNA, 601 bp, Human
tttcaagctgcctctttcactaggaacatcagtatttttttttaaaagcacatttacaatgctttcccatcacccttgctgtgtttttgtagcacctatagccataactggcacctgggggcctgcgttgctggcagtttcccttacatttctttggagtcttttcaactgctgtggttttacttagaagtcagtgctttgcatatttgatttcctgagactgtttgaatagtctttctcagaaaactgtgccagtctggctgtgaacagctcttctccgaggggagctgacagtagcctsctcgtgttggtatgcttggacttgggttcccagccatgccctgctatcttctctccctaatccctcttatcctgtccctgccctagtgacatcactgcccacatcttgccatccctttaaagaagagaacaacatttgaaccagtccagttagaaaaagattaaaatcctgctcagggaatctatgcaaagcctccataaaaacaattcctatttgttgtttcagcagctgatgcagaaatgattttaaacaataaaacccgaccggataattcaaacttctgtaaggtaataatctgtt

SEQ ID NO: 23707 - DNA, 601 bp, Human
gtctactcaccagtcccccgctggtggacatttgagtgaatgcagatttttgctattgcaaacaatactgcagcaaacatctttgtccacttctggaggtctttttgtaacataggctcttagatttctctggtttctaggtggaaagagcttatttattgaaaaaaaaatttattgagctctaggcattggggaggctctgagcttaaaataggagacttgaccagaatttcacttctcagatgtcctataaaggtcacttaagtgcttttcatgatttgccagcctggtgctgccccaatagactcactgcatcttatctgtttttaattgcttgtgtctttgcctgggtagtggcataactgagtcaatgcttgggctcgcacctggtggtctatagccaaaaattgtctccattgtatccattgtatggatacactttccaggtatcagtgattacaatgcctcagagcctgggttctagaatttacagaggcagaatagcataatgataaataacttgtattctgagacacaactgcctgggtacaaatcccagctcttcacgatgtattcacaatatgactctgaacaagttact

SEQ ID NO: 23708 - DNA, 601 bp, Human
attgtctacaagataaagcctacaatcctctgcttgtcattcaaggcatggcccaatgtggccacagcctcacctcctgctacacacaacaaggcacctaccttgtactctggtcacacggaacacaccatatatttaattttcatgtttgtattttttttaaccttcactgcctaatgacaaatctgtttctctttcatgactcacctcaagcacatttcctctagggagacttttcttgacatgaccagatagaactcacgattccctcatctgtctcttcacttcatcccataaacamttccattatgacctcaaataacactttatggccattattttctccacatttgttctctctgtatgtgatactcctcaggggaagcccccatgtctttttcatctctgtgcctcttaaactctaaccataccgatcccattgtcctctgaacatgctaggcctttttatgacatccacctttgcacaggtggatctgtctgctgggaatgccattctccctttctcctctgcacaagcaaatatctacttatcttttgagactcatctcaagtgtgctctttctgaaatacgtgcatattc

SEQ ID NO: 23709 - DNA, 601 bp, Human
ctgttcattgtctaccccctccaaacaccaccatgtaggcagggaaacctgagggcttcattttgtgattgccaatagcatgggcaacttctctcttctgccacgatccagtttctcttcctttcctgcaacctttttctcaaagattcaggggatggatagagagccttgaggggagtggggtgcaagaagcaaatatcctggctacaaaagccagaagtagaaggtaattgatagggaaggagaaagaaatgtgcctattgtgtgcctggctctgctaggtgtgacttgagagtatacygggaagtaggagagggagagcagggtgatggagaatagtatggcagctgggtggggatttgggaaaccaagaagtctgcagggaatgcaaagctaacatgggtagagcccagctcatcgtgggtgctcccctcagagccaggacagcttggttgtggctgggtcacaaggggctttttctaactctggacattcccagtgcagaggacccagcatgagtgaagatatggcccagagctagaacgactccctgctcttggcctgccatcccctgccatcccccagccaccctgggtggctc

SEQ ID NO: 23710 - DNA, 601 bp, Human
tcagcccctcctgcctccctgagagggcttgctcagagcctgtcaggattctgcctgtttgtggctcaccagacactaggtctggattcctggtgagggatgatcatggagctgccggatcctgctatggactccccaggcagcacaggtaggatcagctcctggggctgcaggctggctgagtgctgagcttttcccatagcttgactgcttcctcacttccctttctcggtgtggctgtgagctatggttttaatgggatgattggtttcctaaattgcctggagagtcttgtgtgggraagaagtatggttgggggcaaggggagactacaagagtcttggccactgactagcagggccattttctttgcaaatgaaggcaagcatgtagacaagcaggtaggcaggtgtgggtctccctagtctggggtagagcagcccaggctgatttcctcctccaattccccttccctctgcctgctcctgccccctggctgggcagttctgacactgttctataggtagctaccttccttagggctatccgggataaccaccattcccccaaaccccacaattacccccatagggccttacca

SEQ ID NO: 23711 - DNA, 601 bp, Human
acatgcaaaccagcaaataataaacctttataaaatctaaaaagttaggtgatgattgcctttgaaaggcaaattgactatgactctttggaatttttttgtgtttagtctttgtttttgagacagcctctcacttcataacccaggctggagtgcagtggtgtgatcacagcttattgcagccttgacctcccaggcccaagctatcctccagcctcagcctcagcctcagcctcagcatcctgagtagctgggactacaggcgcatgctaccacacccagctaatttttgtgttttttkaagagaccaggtctcgccatgttggccaggctggtcttgaactcttgggctcaagtgatcggcctgcttggcctcctgaagtgttgggattacaggtgtaagccactgcccccagccgactgtgactctttgatactgactccaataacttctagccccttcccttgatagagagggccactctggtctataaggcagtgggatgggactcatggtgactagatctgagtggtggtccagcaagccctcttctccaaaaagaatcctcaaccctctgagatggattgtgaatagcctgaa

SEQ ID NO: 23712 - DNA, 601 bp, Human
gttcccttccactctcgctaggccccagacgtgtttccaaattaaccccactgttatgctcctccttgacccttttcccatgctcagtatgtataatcaagcaactgctttgtgacaggaagtactgcaacccatgatttgccatcttggggttattggatgtagcagcaaaactgttgaagcaaataccagtggttagggaacagtgtggctgaggatataatatgccttctggcctttctcggagacactgttcattcagacttcctggctcaggcatgtctggctaggctgagccagyatttgggggtaattaagatgtcctcttgatgtatgtcacatttccccaaccatacctgagccttcattgctggtgtctaggttctcagaacaaaacttacagacgaacctatttgcaattgaaactcatgcaaagacagaaacttaaaatgggatttgatcccttgagagttagtataacataggagttgagtttactcatgtcccatcatctttttgaaactgatgtcaaagaacattggatataaaaacatgttgggttaatttgaggaacattttgctgccttctgcctccttggat

SEQ ID NO: 23713 - DNA, 601 bp, Human
agaaagcattttttagaaagtactgatgagaataatccaaatggccaaaaatatatcctatatcatatgacagaaaagagacagatgacagcagtctggaaaaactttacagggaagagaacgtttccaaacatgttcgtggctatgatattatgtatttctctcaacatttccttgcaatgggatgaacagtgattatttatcatcaatttaaaagtaaggaaactgggctgggcatggtggctcatgcatgtaatcccagcactttgggaggccgaggtgggaggatcacttgagcccrgaagttcaagtccagcctagacaatatagtgagactccatttctaattttaaaaagtaaggaaatggcagcatagagaggttcatgacttacctatgattctacaactaggcagtaatggacccaaaactcgaacctaggctctctgccttctatttctgtgtattttctaagccttaatcaaggtatgaagcagacagagaataacctctggaggaggtttgctaaggctgaattgggatgtggaagggaacagtcctagaagggcttaaataacccatatacaaagataagtatcata

SEQ ID NO: 23714 - DNA, 601 bp, Human
tagaaagtactgatgagaataatccaaatggccaaaaatatatcctatatcatatgacagaaaagagacagatgacagcagtctggaaaaactttacagggaagagaacgtttccaaacatgttcgtggctatgatattatgtatttctctcaacatttccttgcaatgggatgaacagtgattatttatcatcaatttaaaagtaaggaaactgggctgggcatggtggctcatgcatgtaatcccagcactttgggaggccgaggtgggaggatcacttgagcccagaagttcaagtcsagcctagacaatatagtgagactccatttctaattttaaaaagtaaggaaatggcagcatagagaggttcatgacttacctatgattctacaactaggcagtaatggacccaaaactcgaacctaggctctctgccttctatttctgtgtattttctaagccttaatcaaggtatgaagcagacagagaataacctctggaggaggtttgctaaggctgaattgggatgtggaagggaacagtcctagaagggcttaaataacccatatacaaagataagtatcatagtagattccacag

SEQ ID NO: 23715 - DNA, 601 bp, Human
tatgacagaaaagagacagatgacagcagtctggaaaaactttacagggaagagaacgtttccaaacatgttcgtggctatgatattatgtatttctctcaacatttccttgcaatgggatgaacagtgattatttatcatcaatttaaaagtaaggaaactgggctgggcatggtggctcatgcatgtaatcccagcactttgggaggccgaggtgggaggatcacttgagcccagaagttcaagtccagcctagacaatatagtgagactccatttctaattttaaaaagtaaggaaayggcagcatagagaggttcatgacttacctatgattctacaactaggcagtaatggacccaaaactcgaacctaggctctctgccttctatttctgtgtattttctaagccttaatcaaggtatgaagcagacagagaataacctctggaggaggtttgctaaggctgaattgggatgtggaagggaacagtcctagaagggcttaaataacccatatacaaagataagtatcatagtagattccacagagacttagagataatttttagatgatcagatgttttgaattagcttctcttt

SEQ ID NO: 23716 - DNA, 601 bp, Human
actggggagtgggggagggaagggaggttgcaggaagggtgggaagaagggaaggaggactacgagctaggcttttgatctgaagtacgcagatgcaagggagtttattgggatggaacaacagggcagagggttctctgggctctagaatcatagtcctgttagggagggtgtcagctcaactagcacagggcagaacgtgaacatctctggagaacaggccaacccagcccctgctggttctcctgcccctctgagggctgccattctagggataagacactttgggcctcagtcattsccattggtcttcttgtttccgtagagcaccgggaagccagtcattgaagcatcccagttcctggagtgggtcaacctggagccccagtccatggtgtggctggctgttctgcatcgggtcaccattgctgagcaagtgaagcatcagaccaagtgctctatctgtaggcagtgccccatcaaggggttcaggtagggaaaacaatacctgctgggatgataataataaatatgtcatgtgacatataactcagatattaaaaaataaagtgtcacctaattattatataattacagctag

SEQ ID NO: 23717 - DNA, 601 bp, Human
ccagcagagcttctccctcaccaggcctggccacagctggcccaggacactctcagccatttaaagggcactcactgttttactgcagagaaaagtctcaggaaaaacaaaacaaagcaaaacaaacaaacaaacaaactaaaacagagagagcaaggcagttccaggtgattcgccttccattgctcacttgagtttttcctggctagcttcctatattgcttctgtactgggtcactcagtctttccctgatgctttgtcattatttctaccccttctagtcagtaccaaagcttatgytcaaattaattattcatcccttggagggaaaaaagaaaggtatgtcctttacctggacccccaaactccacttggttttccctggtaaccatgtcctccatacttgccttagcccagttcagtcagcatccctgaactccagccacagagttgctcctgtgctgtgtctaaaacccacagctccatgcttagcttccagcactgactctgctccctactcatctttatccttttctgtccccgcagatgctcccaaagccctgatcatatccccagctcccaccactgctctctctcccc

SEQ ID NO: 23718 - DNA, 601 bp, Human
tcactgttttactgcagagaaaagtctcaggaaaaacaaaacaaagcaaaacaaacaaacaaacaaactaaaacagagagagcaaggcagttccaggtgattcgccttccattgctcacttgagtttttcctggctagcttcctatattgcttctgtactgggtcactcagtctttccctgatgctttgtcattatttctaccccttctagtcagtaccaaagcttatgctcaaattaattattcatcccttggagggaaaaaagaaaggtatgtcctttacctggacccccaaactccayttggttttccctggtaaccatgtcctccatacttgccttagcccagttcagtcagcatccctgaactccagccacagagttgctcctgtgctgtgtctaaaacccacagctccatgcttagcttccagcactgactctgctccctactcatctttatccttttctgtccccgcagatgctcccaaagccctgatcatatccccagctcccaccactgctctctctcccctattctgtctatttttcttttttttttttagaatttttttttaattttactttcacctttttttttttttt

SEQ ID NO: 23719 - DNA, 601 bp, Human
tgattcgccttccattgctcacttgagtttttcctggctagcttcctatattgcttctgtactgggtcactcagtctttccctgatgctttgtcattatttctaccccttctagtcagtaccaaagcttatgctcaaattaattattcatcccttggagggaaaaaagaaaggtatgtcctttacctggacccccaaactccacttggttttccctggtaaccatgtcctccatacttgccttagcccagttcagtcagcatccctgaactccagccacagagttgctcctgtgctgtgtytaaaacccacagctccatgcttagcttccagcactgactctgctccctactcatctttatccttttctgtccccgcagatgctcccaaagccctgatcatatccccagctcccaccactgctctctctcccctattctgtctatttttcttttttttttttagaatttttttttaattttactttcacctttttttttttttttttttttttttgagacagagtctcactcttacccaggctggagtgcaatggtgcgatcttggctcactgcaacctctgcctctgaggttcaagcgat

SEQ ID NO: 23720 - DNA, 601 bp, Human
cccttggagggaaaaaagaaaggtatgtcctttacctggacccccaaactccacttggttttccctggtaaccatgtcctccatacttgccttagcccagttcagtcagcatccctgaactccagccacagagttgctcctgtgctgtgtctaaaacccacagctccatgcttagcttccagcactgactctgctccctactcatctttatccttttctgtccccgcagatgctcccaaagccctgatcatatccccagctcccaccactgctctctctcccctattctgtctatttttcttttttttttttagaatttttttttaattttactttcacctttttttttttttttttttttttttgagacagagtctcactcttacccaggctggagtgcaatggtgcgatcttggctcactgcaacctctgcctctgaggttcaagcgattctcctgcctcagcctcccaagtagctagtgtctcctatttttcaacctgtttccccacaatccatctgtccaagctttcatctcttcaaatcctgttgacacagaaacgtgtggcctggtgggaacagggaccatgccctttacttttc

SEQ ID NO: 23721 - DNA, 601 bp, Human
atcctctaccacctgctcgtcctctacatccttagaattcatagaaaagctattttaaaaattaacaaacatatgctcattataaaatattggaatcatataaaagcgtttaaagtataaaaaaaaggctgggtgccatggctcacacctgtaatcccaacactttgagaggccgaggtaggaggatttcttgagcccaggagttcaagaccggccttggtaacacagtgagacccctgtctctacaaaattaattattattattattagttttgcttttagaggaactgagacaattaawtttttaagtataaaatgaaagtcctcctgtctcctcaccctggcccccacccctccagttcaacttcccagaggcaaccagtgttgagtttggcatatatcctcccagaccttcttctaggagcagggtatggtgggcatgagcaagagtggattacccagcaggctgtctgctctagcagagcagccacacctgcccagtatatctggaagccattagggtaagttcctctgccctgtctcctcctcagaccacatccagtgagaacatgagggactttgccacaaccttaaagaacaa

SEQ ID NO: 23722 - DNA, 601 bp, Human
ggagggtagagtaggggaacagcacagaaagggaaatgatttgctcattgtttcccggggaggggggtgggctgtaagtagaacccagatacctgcatcctgaaaacactctctcaatacccccaaccacagcctctgcctcctttgaacactttcatccctctcaagcctcagtatatgtcctttccctctcgatgtgacttagaagtgaatcctccagcatgcatttcctggggcctgagctgagagctgagttgtttctctgttcaacaactggtcacctactctgctttccccacayccatgcagagacgaggaccagtacctgctgcggcactccagccccatcacagaccgggagccagcctttggacagcaggctccatgcagtgtggccacagaaagcaaaggggagctacagaagatcctggcccacttggaagatgagaaccggtgggtgtgatgatagcagaaatctgtgtgggttcttgaggcagacagattgaatttaagtccaggcacttctacatcctagctgtctgaccttgagcaagttacttatattctgtaatcctctatttccttatctgtaaaacgggga

SEQ ID NO: 23723 - DNA, 601 bp, Human
ctacagaagatcctggcccacttggaagatgagaaccggtgggtgtgatgatagcagaaatctgtgtgggttcttgaggcagacagattgaatttaagtccaggcacttctacatcctagctgtctgaccttgagcaagttacttatattctgtaatcctctatttccttatctgtaaaacggggatgatgatcatcaaacctgcctcctagggtcacttgtgaagaccaaatgagatcaggcatataatgtgtttggctcagtgcctggcttatagtaagggttcaataaatgctagctmttataataattatttgaaaacttttaaattttttttttttttgagacagagtctcactctgttgcccaggctggagtgcagtgtcgtgatctcggctcactgcaacctctggctcctgagttcaaacgattctcatgccttagcgtcccgagtagctgggactacaggcatgcaccaccatgcctggctaattttttttttttttggtatttttagtagagacggggtttcaccatgttggccaggctggtcttgaactcctgacctcaagtgatctgctcaccccggcttcccaaagtg

SEQ ID NO: 23724 - DNA, 601 bp, Human
tggggtcaaagagccaggatgtcagcctgtgcttggaggacatcatggagaaactccgtcatgccttccccagtgtgcgaagttctgatgtgactgccaacaccctgctggcctcttgatggagccagatccccatcctatagttcatagtcctctcctggttccggtcaaagcctttcctcagccttcacccaacctttccagtttccactggccccacattcctcaactagtattatttgggctctgggcagcagcagggatctggtggtatgtgaggtgcatgcgggcagtgatgggrgaaggggaggcatgattcttctgaccctagaaatgttccctttaatcttcaagttcgagatcagccctttaagtacctttctgttgcagcccaggcaaatatcacttggccattcagatggggagcagagaagctgccttgcagagctaagcggtacatgttggcccctcttccttctccgtggaattatggaaagagagaagcctaattaccccaaggttccatccagcattatgaatccacagggtttacccctactctctggcgcaactcagggaggcaaaagggtatccccgagac

SEQ ID NO: 23725 - DNA, 601 bp, Human
ggcacttcccattagggaaggcaatgggaaaaattagtttcctcttgacaaagaatagtagtagtggttaaactttttttatgtctataatattcaatgcagtaggttattcatgaacaatgttttcacactgaattgagcagtaaattggctaaatatcaaataattttattttacagatctgctttaacgttggaagtggacttcacttacaggtgaggaaacaaagggattatttctgccttctgactcaggagggttaattccatggcaaacaggttgactgggctttactagattraagacacatgttgtattagacccagccattcccattcaaacaagtgcagaggagcttatccaggggtattcagtgcagcagtttttgacaatgtaaatatccaccaataggtgaatgttaaaaccatttatggtacatgaaagaatgtccatgacgaggtgctgaatgaaaatcggggcaaaataagatatatagtgtaagtccatttttatagcaaaaagacctttatgcatctgtgtatatatgtgcaactgtatagttatgaaaaatcataaaagatattaatcaagctgttaatga

SEQ ID NO: 23726 - DNA, 601 bp, Human
aatgggaaaaattagtttcctcttgacaaagaatagtagtagtggttaaactttttttatgtctataatattcaatgcagtaggttattcatgaacaatgttttcacactgaattgagcagtaaattggctaaatatcaaataattttattttacagatctgctttaacgttggaagtggacttcacttacaggtgaggaaacaaagggattatttctgccttctgactcaggagggttaattccatggcaaacaggttgactgggctttactagattgaagacacatgttgtattagacycagccattcccattcaaacaagtgcagaggagcttatccaggggtattcagtgcagcagtttttgacaatgtaaatatccaccaataggtgaatgttaaaaccatttatggtacatgaaagaatgtccatgacgaggtgctgaatgaaaatcggggcaaaataagatatatagtgtaagtccatttttatagcaaaaagacctttatgcatctgtgtatatatgtgcaactgtatagttatgaaaaatcataaaagatattaatcaagctgttaatgaatactttgtgaggtataaatga

SEQ ID NO: 23727 - DNA, 601 bp, Human
ggatcatgtacctgctcatgttactttctttgtattggctactaatactattataaacaaatctgtgcccttatacagcaatttttcaggactctaccctcagccttgccttcatcttgtttttactattgttatatcccattcacgcttatgtcctcatccagttaaatgttatattgtggtcaactgtatgtgattttgataagcacctgaaatcttttttggaacaagctaaaattataaataaaataacaggtaaatatgcttaaagttgaatttcatcttagacatctttatttcwaatgccagatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggtaagttaatatgttatgttgcccatctttaaactctctatcctttccagtttctcctctctttttcttttctaattttcttattttgttctgtattccttatccataggataactcttggaatt

SEQ ID NO: 23728 - DNA, 601 bp, Human
ttagagaataaaagtatctgtaaaggagagaattactctaaatcccaaattgaaggaaagtttgagtaggtttactaggaaggcatttctctcgaacatttcactttattatttctaactgaaagggaaatttttaaataaaaaggggagatagaagattttttaaatgctgtatacataaaggttttaacagcgtacaagagtaaaatgtggttgatcataaagtacactctttgtcatcagatataaatcatcatccaagtgcactacgttcagtatttcttagagaaatgattggccrggcgtggtggctcatgcctgtaatgccagcactttgggaggctgaggcgggcagatcacaaggtcaggagatcgagaccatcctggctaacacggtgaaaccccatctctactaaatatacaaaaaattagctgggtgtggtggcgggcacctgtagtcccagctactcgggaggctgaggcaggagaatggtgtgaacccaggggacagagcttgcagtgagctgagatcgcgccactgcactccagcctgggcaacagagcaagactccatatccaaaaaaaagaaaagaaacatgat

SEQ ID NO: 23729 - DNA, 601 bp, Human
acacatactataagaatcaaatctctggggaattctggacaaagttcacccagttttgccttcactaaccaagtttatttaggaccagcttctcctcactgagaatgaagtgcaggacagaaagaaccaattcctacagttccacctcactttcagtagagaataagctacattttcaatagtggctcctttgtgcagactatctcctgataatatcaccaatgacttattgaagaatttgactatctacaactcccgaggcttttctgttcttctgcaaaagctctgactgcaagtaaayagtatcttcacacaaataatagcagatcataaaacagatttgtaaataaaatatactgtggtacgtgataaactggactaaaaccagaaagccagatgtaagagtgactcttttcacccagctggacatttttcattgctctgcaggaacacagcagctacactttgacagtagaagcaagagatggcaatggagaagttacagacaaacctgtaaaacaagctcaagttcagattcgtattttggatgtcaatgacaatatacctgtagtagaaaataaagtggtaactattattcttc

SEQ ID NO: 23730 - DNA, 601 bp, Human
cattgctctgcaggaacacagcagctacactttgacagtagaagcaagagatggcaatggagaagttacagacaaacctgtaaaacaagctcaagttcagattcgtattttggatgtcaatgacaatatacctgtagtagaaaataaagtggtaactattattcttctaataactgtacctatttatttatatttcagtcctaattaaaaatatatcacttatatttgtatttcattgaaataaaaatcatgtgttcatgttttgcagcttgaagggatggttgaagaaaatcaagtcaaygtagaagttacgcgcataaaagtgttcgatgcagatgaaataggttctgataattggctggcaaattttacatttgcatcaggaaatgaaggaggttatttccacatagaaacagatgctcaaactaacgaaggaattgtgacccttattaaggtaagtactaagtattcaaaactggcgtgggccaagttggtgctggaaaggaatctaatatattttgagccctgaacacttaaaagtgctttacatattcaattaactagcactacagttgtttgagaaaggagccatccctatttg

SEQ ID NO: 23731 - DNA, 601 bp, Human
cacagcagctacactttgacagtagaagcaagagatggcaatggagaagttacagacaaacctgtaaaacaagctcaagttcagattcgtattttggatgtcaatgacaatatacctgtagtagaaaataaagtggtaactattattcttctaataactgtacctatttatttatatttcagtcctaattaaaaatatatcacttatatttgtatttcattgaaataaaaatcatgtgttcatgttttgcagcttgaagggatggttgaagaaaatcaagtcaacgtagaagttacgcgcrtaaaagtgttcgatgcagatgaaataggttctgataattggctggcaaattttacatttgcatcaggaaatgaaggaggttatttccacatagaaacagatgctcaaactaacgaaggaattgtgacccttattaaggtaagtactaagtattcaaaactggcgtgggccaagttggtgctggaaaggaatctaatatattttgagccctgaacacttaaaagtgctttacatattcaattaactagcactacagttgtttgagaaaggagccatccctatttgcccaagttctgtggtt

SEQ ID NO: 23732 - DNA, 601 bp, Human
ggttgcagtgagccaagatcgtgccattgccctcaagcctgggcaatagagtgagattccgtctcaagaaatataggtaaggaataatatcagtgtattttaagtagcttatattagaattgccttaccagattttaaaataaaatgcaaagctacagttccaaaatactatttcattaaattacacataggcaaaaattgattccagaagtttcgaaattcttatgaaaacttaatatataacagactgggtaaaactctgacagtggaaagaggaataatggtgatataaatgtataayagaatagggaagaattaacttgaggtttcatgataattgagcaccacttattgacagctactatatgcatttaagctacctttttaaaagcagagtaaaattgagtagcattacctcatgtttaaagagaagaactcatgattattgaagaaatggatcatgtcattcgagacaaaatcagtttatctgcttgtgtcatcaatttttaagccatcaatttataggtatgaccacgccagatacctgagatagaaaagccaattatacacgcaaggagaaacagtcagatattgatgaatg

SEQ ID NO: 23733 - DNA, 601 bp, Human
gcaaatgttcatagcagcattattcatgataataaaaaaaactaatagcagtccaaatgtccatcagctggtgagtagataaacagaatgtggtgtattcatatgatggaatactaatgagcaataaaaaggaatgaagtactgatacaagctacaacacggatgaacctcaaaaacattatgctatgggctgggcgcggtggctcccgcctgtaatcccagcactttgggaggccgaggttgggggatcacctgagctcaggagtttgagaccagcctgggcaacatggtgaaaccctgwctctactaaaacaaaaaattagccaggtttggtagtgcatgcctataattccagctgcttgggaggctgaagcaggagaattgcctgaacccgggaggcagaggttgctgtgagccagcatcacgtcacttcatcccagcctaagagacagagcaagactccatctcaaaaaaaaaaaaaaaaaaatttgctgattatgccatgtataaggagccagacacaaaatagtacatattacatgattccatttacttgaaatttctagaaaaggtgaaacaatggggatagaaagcagactgg

SEQ ID NO: 23734 - DNA, 601 bp, Human
ggctcccgcctgtaatcccagcactttgggaggccgaggttgggggatcacctgagctcaggagtttgagaccagcctgggcaacatggtgaaaccctgtctctactaaaacaaaaaattagccaggtttggtagtgcatgcctataattccagctgcttgggaggctgaagcaggagaattgcctgaacccgggaggcagaggttgctgtgagccagcatcacgtcacttcatcccagcctaagagacagagcaagactccatctcaaaaaaaaaaaaaaaaaaatttgctgattatgcyatgtataaggagccagacacaaaatagtacatattacatgattccatttacttgaaatttctagaaaaggtgaaacaatggggatagaaagcagactgggattgcttggagtggtgagtctgagtggggactgactacaaacacatgtaaaggaacttttgggggtgatggagtgttctaaaactggaccatagtgatgattgcaaatccagaactcatcatgctgtacacttaaaatgggcaaattttattgtatataagttatacctgaatgaagctgtccaaaaaggataaaggaga

SEQ ID NO: 23735 - DNA, 601 bp, Human
gaaattcaaaactaattgtgaaaatcaaaatgtattattatttactggtagcagtattaagaggcagaaaaatttagttcaagtgtataattggaaatagcactaaaaataaatattgctataaattagccactcattcctgtgtgcctcgaagccacttaatagaaaataaattaacaatttgattgagcaaaccaagatactcatatgtttggttggtactggtatttttatgttaaactcattggtattcattaactaattacatacatttcttttttttctttttttttttttttttgagactgagtcttgctctgtcactcaggctggagtgcagtggcacgatctcggcttactgcaacctctgcctcccgggttcaagcagttctgcttcagcctcccaaatagctggaattacaggtgcccaccaccacacccagataatttttgtatttttagtagagatggggttttaacctgttggtcaggctggtcttgaactcctgacctcaggtggtccatccaactcggcttcccgaagtgctaggattataggtgtgagccaccatgcttggccagttacatacgtttctgaaaa

SEQ ID NO: 23736 - DNA, 601 bp, Human
ctcattggtattcattaactaattacatacatttcttttttttctttttttttttttttttgagactgagtcttgctctgtcactcaggctggagtgcagtggcacgatctcggcttactgcaacctctgcctcccgggttcaagcagttctgcttcagcctcccaaatagctggaattacaggtgcccaccaccacacccagataatttttgtatttttagtagagatggggttttaacctgttggtcaggctggtcttgaactcctgacctcaggtggtccatccaactcggcttcccraagtgctaggattataggtgtgagccaccatgcttggccagttacatacgtttctgaaaacataatatggacatttgccttgctctcccagcattggctccttccacactaattctccttgctttgagggaagaaacccagaaacgattttatcggcattgtttccacttttaaccagttctgcctgaaagaaaattattaccccaataatcaacagtatcagaaaatttgtagatgcttccgtttaaaatgatcattgattttttttttttttttttttgagatggagttttgctctgt

SEQ ID NO: 23737 - DNA, 601 bp, Human
agctgggcatggtggcatgcatctgtagtcccagctactcaagagactgaggcaggagaattgcttgaacccaggaggtagaggagcggagatcgcgccagacaaagggagactccaactcaaaaaaaaaaaaacaaaaacaaaaacctaatctcaccccagcacagttgcttgtgtctgtagtcccagctactcaggcaactgagatggttggaacacttgagcccaggagtttgagaccagcctggacaaaaaagcaagacaccatcttcaaaaaaaaattgaggggtagataaaattwaaaaatagatgtctaaaaaaattttttagtaagatgaaataagcacctaatttctccagtagataaatctcacatttctacttggtaagtggattaaaagatattacttggtccaaatttgaaacatatctaggatagaaaatgtcctaagtggttagtaccttctccactccaaattggcaagggaattcaaactatgtctgttgtcagcaataggaacagaatgtacatactttttctctcttatttttaagattatcctagaaaaaccatcactggcacagtccttatcaatgttga

SEQ ID NO: 23738 - DNA, 601 bp, Human
gattaaagctgaggataccttggtttaactgggggtaagtaaagctcaaacctagaacatgatagaaacaacataacaggggagttatctgattccccccttccccatgtcagtggacatgtccatatgtccacatccaggacatctagacacatggaccatatgatgtgttgatgtgagttttcagatgtccttcagggtggttctgaatgcagaaaagtctatccagaaaactattttgttttaaacaactagggttcatttcagtaaaatttcaaagacaatagtcagttttttttttaatttacagctttattgtgttaagtctagcaaatgtttgaaatcattttaagagggtttgaataatgtttagtccaattaacaaattaaacaccatcaatatttcaaactgtatttacagatttaatatatttagtttccttatatatttcagtgatctgaattaacaaaacctcccagccaggtgcggtggctcacgcctgtaatcccagcactttgggaggccaaggcaggcggatcatgaggtcaggagatcgagaccatcctggctaacacggtgaaaccccgtctctactaaaaa

SEQ ID NO: 23739 - DNA, 601 bp, Human
tcatttcagtaaaatttcaaagacaatagtcagttttttttttaatttacagctttattgtgttaagtctagcaaatgtttgaaatcattttaagagggtttgaataatgtttagtccaattaacaaattaaacaccatcaatatttcaaactgtatttacagatttaatatatttagtttccttatatatttcagtgatctgaattaacaaaacctcccagccaggtgcggtggctcacgcctgtaatcccagcactttgggaggccaaggcaggcggatcatgaggtcaggagatcgaraccatcctggctaacacggtgaaaccccgtctctactaaaaatacaaaaaattagccgggcgtggtggcaggcacctgtagtcccagctactcgggaggctgaggcaggagaatggcatgaacccagaaggcagagcttgcagtgagccgagattgtgccactgcactccagcctgggtgacagagcaagactctgtctcaaaaaaaaaactccctatgatccttatactctaaaattctaataaatttaacttacaaatacactgagttgtatattacagaatattatcaataacaagt

SEQ ID NO: 23740 - DNA, 601 bp, Human
aatgtttgaaatcattttaagagggtttgaataatgtttagtccaattaacaaattaaacaccatcaatatttcaaactgtatttacagatttaatatatttagtttccttatatatttcagtgatctgaattaacaaaacctcccagccaggtgcggtggctcacgcctgtaatcccagcactttgggaggccaaggcaggcggatcatgaggtcaggagatcgagaccatcctggctaacacggtgaaaccccgtctctactaaaaatacaaaaaattagccgggcgtggtggcaggcrcctgtagtcccagctactcgggaggctgaggcaggagaatggcatgaacccagaaggcagagcttgcagtgagccgagattgtgccactgcactccagcctgggtgacagagcaagactctgtctcaaaaaaaaaactccctatgatccttatactctaaaattctaataaatttaacttacaaatacactgagttgtatattacagaatattatcaataacaagttgaagccgggcatggtagctcatgccttaatcctagcactttgggagggtgaggcgggtggatcacttgaggtc

SEQ ID NO: 23741 - DNA, 601 bp, Human
ttaaacaccatcaatatttcaaactgtatttacagatttaatatatttagtttccttatatatttcagtgatctgaattaacaaaacctcccagccaggtgcggtggctcacgcctgtaatcccagcactttgggaggccaaggcaggcggatcatgaggtcaggagatcgagaccatcctggctaacacggtgaaaccccgtctctactaaaaatacaaaaaattagccgggcgtggtggcaggcacctgtagtcccagctactcgggaggctgaggcaggagaatggcatgaacccagraggcagagcttgcagtgagccgagattgtgccactgcactccagcctgggtgacagagcaagactctgtctcaaaaaaaaaactccctatgatccttatactctaaaattctaataaatttaacttacaaatacactgagttgtatattacagaatattatcaataacaagttgaagccgggcatggtagctcatgccttaatcctagcactttgggagggtgaggcgggtggatcacttgaggtcaggagtttgagaccagcctggccaacatggtgaaactccatctctactataaat

SEQ ID NO: 23742 - DNA, 601 bp, Human
gacagagcaagactctgtctcaaaaaaaaaactccctatgatccttatactctaaaattctaataaatttaacttacaaatacactgagttgtatattacagaatattatcaataacaagttgaagccgggcatggtagctcatgccttaatcctagcactttgggagggtgaggcgggtggatcacttgaggtcaggagtttgagaccagcctggccaacatggtgaaactccatctctactataaatacaaaaattagctgggcatggtggtgggcacctgtaatcccagctactcagraggctgaggcaggtgaacctgggaggcagaggttgcagtgagccaagatggcagcacagcactccagcctgggcaacagaacgagactccatttcaaaaaataagaagaagaagaagaagtgtaagagtgctaatgttccttgatcttagaaggtgcatgctgaagaatgtcgtgctatctgtaacttaccttgaaatagttaagaaactttaaaaaaaagaaaaagtgggtatatagagggcaaagaaagcattgttgcaaaatgtaaacagttagtaagggtttgttaatattcacta

SEQ ID NO: 23743 - DNA, 601 bp, Human
actttgagggtgaatagggaaacaactgatgattggcaaatcaccaaagcataatataagactcttcagaattttgttttataaatgtatatccttttctggtttcagtaacttaggaactattggcataaacttcactggtattcccattttgatgagctctgtgagggcagcatgctgtctgttctcttcactgctgtattcccagtgtgtggaacagagccttgcatgtagtaagcgctcaaaaaagatgtgttgcatgactttgggttatgggcacaaggttttttacaaacccagyttattccaatcaatcctgctttgtacattcaacttatcagagctccgcctccctgatattccccgcttgccttgtttcttcgtcagcaccaaaagtaggcagaccctctgagcacttcctgtccttcctgaccgtaagatgttctcaaccagtcctgcctgccctacccacgctccaaagacctcgggtttccttttataaaagaacaagggactgcatcctgaggtcacatgaaatatcactctacttgaccactgaatatggacagagggccgcctccaaggcagcctaggctagtgc

SEQ ID NO: 23744 - DNA, 601 bp, Human
gtccccacattctaaccagcacatgggagaaaagtgaagaaccctctttaagcacacttcccggaacttgtgtacaccatttctgcttcattcacattgaccacagtttagtcaggtggctatacctagtggcatcagaggcttagaaatatagtctttattttgggtggccatggatccaggtcaaaacaaagttaagaattctgtaactatagaagaaggtatcaaactgtagagggaggttgaaatgccattggtcgcatagagtaaaggagctgagactgtttgggctttgttttcyctttgggttctatccacctataaaacaagaagagagaagaaaggagatcttcataagacttacataagttattcaactcaaaatactttttctaactggcctcagtggaaatagcttataccttcctatgcccacttgactcagatccttctaccaaggatgaaggattccctccatcctcctgactcagttctcagctgtgtttgctctcacaggtggtgccatcatttctgccagtggatcaagggggcagtctagtaggaagaaatggagtaggaggtatggccaaggaagccacga

SEQ ID NO: 23745 - DNA, 601 bp, Human
gtagcaaaaatggctatattagaagatggttctcaaatcagtgacctaagcttccaccctcagaagttagaagagcaaattaaacccaaaacaagcagaaataagataatgatgaattttagagcagaaatcaatgaaatatttagcaaaaagtaataagaaaaaaaattgaagccacaagcttattatttaaagaggtcaataaaattgataaacattttaccagactaattaggatattaagagattaagcacaaactatggatgttagaaataaaataaagaactttactacagatcytacagacatagtaagaataattttttaaaaagtaggactgggtggttttcttgagaacaaggccctgtgctcccatgagaatggacagagttggaatataaggcatctgaagggccctagagaggagtaaggggaggggcttccattgaggaaagcaagttacttctgtccccctcttctaaatttgcaaattattagcgtgctttcccactttctgctcctttttaacctcccatctttcataccatccttcacccaccttcaagtattagcttaacagggatgtgggtggtgtcaagc

SEQ ID NO: 23746 - DNA, 601 bp, Human
tttgcaagaataatagaaattttgaacccaataaacattttgccacatttgctatttgcttttccattttctctgtctctctctcactgacacacattcacacacattctcttacattactatagtacagttaacaaatgtagaactttaatattgacatagtccatatttcagtttagccaactatcacactatcttttacagcaattttgtttttctcaggatcctgcattccatttagttgtcctgacactttagtctcctttaatctgaaacagtcccctctgcctttctattttttccctgatattaattttttttaagaatacagtccagttgtgtcgtaggatctctctcaatttgtgtttccctgatggttccttgtaattaaattcacattactgcattttgaacaggaatatagagtcttgttttaaaatgaatttatattgctaattatttgtctgttttgtgtttgttttgttttgttttcattttagaaagcggcctcttacactgaggaagatgaaaatcacacagccaaagattgccttctggtttattctcaggaagaaactgaatcgctgaatgcttctattgg

SEQ ID NO: 23747 - DNA, 601 bp, Human
tcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagtyaccaagcatagcactgtacagcattcttactcctaaacagcagtcagccacaaactgacccagagtttaattagcagtgactaatttcatgtttccaatgtacctgatttttcatgagccttacagacacacagagacacatacacattgatcttaaaatttttctcagtcactgatatgcaaaggaccacactgtctctgcttccaggagtattttagaaatgttccacaatttactgaagacatagagatgatgctgctgcttaggtgccttttagcaagctatgcaaacaatcctga

SEQ ID NO: 23748 - DNA, 601 bp, Human
agtagaggtaccaagtcctgcctactcagcagagggcttttgaaaaatcccaggaaactatatctctccagctcctaaagtagtgtctgccaccaaataggggctcaacatacttgggctcaactcatattatatataaacactgaaactctgggacaaaggagatatgacatcattatagttatcactatccctagggaccactgggaaggtggcctgggcacccatatcaggttctctgggtttaggtggtcatccgagtccagctctccaggagggcaaccttataaggcctctcaaycacacagtgcaagccccacatccatccaccaaaatgcccaggaccaatctggtatagacagattcctgacctcaatccaccttgactacttgagtcaccttcttcaccctgtactaatgatgccattttacaaatttaagatgaacatttcccaccctgtcccaagaccttgggaaggataatatgggggctttctatgccactcttaaacaactccctctaataccaagctcctgacaaggatgttataggaaaggatgcacaagtgactgtggacatggtggggagtgatgggtctgt

SEQ ID NO: 23749 - DNA, 601 bp, Human
agaggttgcagtgagctgagatcacaccactgcaccccagcatgggagacagagtgagactctgtctcaaaaaaaaaaaaaaaaaaaaaaagaaagaaagaaagaaaagaacaaagaaaaagaaaattctgcccaagaagttaatgtaaagttttcaaatcagattgctgtgctgttagactagtaaaagaataagagacctctaggacaacagctgccctctgccctctataaaatgctgctccaactctataaggacagatacaggaaagaaagatgaaagccaacacccagtacagcytgagggcatgaaaagcatgttggactaggagtcaggtactgagactctgtcttatttccaactacttatttagctattgacctcaggcaaattacttcctattttctggctccagtttcatcacctttcaagtagaggtaccaagtcctgcctactcagcagagggcttttgaaaaatcccaggaaactatatctctccagctcctaaagtagtgtctgccaccaaataggggctcaacatacttgggctcaactcatattatatataaacactgaaactctgggacaaaggagatatga

SEQ ID NO: 23750 - DNA, 601 bp, Human
ggtaggcaactagtcaggaatcccaggaaactactcttttatttatttattattattatttttttgagatggagttttgctcttgttgcctaggctggagtgcaatggcactatctcggctcactgcaagttctgcctcctgggtttgagagattctcctgcctcagcctctctagtagctgagattacaggcgcccgccacaacacccagctaatttttgtatttttagtagagacgggggtttctctatgttggccaggctggtctcgaactcctgacctcaggcgacccacgtgcctyggcctcccaaagtgctgtgattacaggtgtgagccactgtgcccagcagaaactactctttgagggcaacttttggctggtgacacaaaaagggttttcctgttcatggtggctgcagagggctagtttaggaagccagctagcctcaggctcaccacagcagcctggacacaccctggctagtggttcctgggtctggagtcaaacaagagccacaaagatccccagatgaacgtgcacagatgtcacattcccccaaaccaggatttctgtcttcttgctgctttctgccctgagtag

SEQ ID NO: 23751 - DNA, 601 bp, Human
tacctccccctccctttgcagacaactcctggcttccccagagaaggaggggggatgagtacattccaagcatcccagggtaggggcaaaattttgtgtcttgtccagagccagccacccaccagactaggacacattcttcccacccacgtctgtgacccatttcagaacttgtattacaacagatgcaagaaccctctagggtccagagacatcttccaaactggatttctccacctttaccccaggaggtggaggggacacgtctggatggaggagactgagtgcatgagttccagaytggttctgctgctatttctagccaggtaattttgggcaagtcacgttacctttctaaacattggtttcctcatgtaaaacacagggataagaaatgcctacttcactagagtattgtgaaaagataaaatgaggtaatacaaatgaaagggctttataaaggccaagtcccacattgtgtgagttattacataatcagactccagaggttactgcccatggcctgaggaatggggcacccaagtcagatggagacaagagaagcgggatcaccattccttcttagcacctgggcagtgag

SEQ ID NO: 23752 - DNA, 601 bp, Human
ctgccttttctttttctttttctttttttttttttttttttgagacagagtcttgctctgtctcccaggctggagtgcagtggcgcaatcttggctcactgcaacccctacctccggattcaagtgattctcctgccccagcctcccaagtagctgggattacaggtgcccgccaccacgcccagctaatttttgtaattttttagaagagacggagtttcaccatgttaactaggctggtctcgaactcctgacctcaggtgatccacccgcctctgcctcccaatgtgcaaggattacrggcatgagccaccacaccgggctggcaactgccttttctaacacaaagcatttccttgaagctcttagaaagactcagacgtgcttacagttgaagaagcacattcacatcctttcctttatctgagcatcccagagatcctttgatataagtaggagccctgttttacagaaaggtggagtggttttcccaaggtcacacagtaagacagaaatgaagatgtagatgtagattgtctgactctgagctcagtgtgctgcccactcacacctgacaactgcctaccatccagccaggggg

SEQ ID NO: 23753 - DNA, 601 bp, Human
atataatttaagaggcatttacaaacaacaacaacaaaaatagttgttatttttccatctgggtagaagtcccaaaattcagttctcaggcttgtggtatttcacagttaactcatcaaatccagcactggagggtcccaatggcagatcccttggtggtacttgagtacatggcttctcaatctttgttgctttcttccagttcacaaatctttccttcttgctctccttcttcttcttctttttttttttcagtcaaagatcctggagcatatggaatttaaccggcattctaatccaraagataagtgtttaaacaaacttatgaggggaagtggggtttggtggaggggaatcagaagggcatgaaggtcccttgcttttgctttcttcttacccagataccatcggacatactctgtttggcacttgaaggctctggtattttggcaaagcaattatgggaggcccaatcctagacggcaactggggacgaaggagtctttgtgactagatggaagtctttcccctctgcagtctgaaatcaccttgtgtcttctcagaggtagcagtccccagccgattcctaaagcacaaaagg

SEQ ID NO: 23754 - DNA, 601 bp, Human
aagtacaaattcctatgaaagtagttcttgctctcaaggacaggtaaagagttaggaagagattaatacaagacagtatgcaatgtgtgccaaatgagtaatagcttgagggagaaagtaagatttgaattttaagagcgaaaacccaatatccaagagagcaagggaacacccaacacaggagtgacacagaggcccagaaaggtgtgttcagggaaagctgaggggcctgactgaaatagaggatttgggagatagaaacattgggaaggtcaaattttacagagcactgagaagaaaaaaggtttcagaagagggtgctggtttgtaacttacttccactggatactgttttttgactttttttcaatcaagtcaattccctctaagacattggtgatatcataaattctccttttttgcctcacagccaaagtatcagcagcctgttcaggaaagacaacgagaacagtgaaataaagggcaagtcatattttaaagccaaaaagggttgattattaaatccacaacaagtccaatctcaaatttgacccactcagttgcttggggacaatagctgagcatgttcaaagcatctccc

SEQ ID NO: 23755 - DNA, 601 bp, Human
tttaatgttttggtggaattttggcgaaaacaaaacaagacaaaaactatggtcaaaggggacacattagaagaacagaaattgttacattcaaacgtataaccaggccacaattaatgacaacatgcgtttcaattaattactatttacaaagtacaaattcctatgaaagtagttcttgctctcaaggacaggtaaagagttaggaagagattaatacaagacagtatgcaatgtgtgccaaatgagtaatagcttgagggagaaagtaagatttgaattttaagagcgaaaacccaayatccaagagagcaagggaacacccaacacaggagtgacacagaggcccagaaaggtgtgttcagggaaagctgaggggcctgactgaaatagaggatttgggagatagaaacattgggaaggtcaaattttacagagcactgagaagaaaaaaggtttcagaagagggtgctggtttgtaacttacttccactggatactgttttttgactttttttcaatcaagtcaattccctctaagacattggtgatatcataaattctccttttttgcctcacagccaaagtatcagcagcctgt

SEQ ID NO: 23756 - DNA, 601 bp, Human
ttctttagtattacagccagcacctacacctcttaaaaacatatgagaattaatatcctcagtatcagatctaggttaatatcacttaatttttactgtaataaaactgacttatttagtaatatattcaagacagaagtctttacactcttaaaatcaagcactaaaatccttaaaaattttaaacaccatacttcttgcttagaaaatttattgacaagaacaaccaaattacaaaaattctcaatcttccctacagtgtttttttgtcatctggaaggccagactggttggtgactgrgtaccaaaagagtgtgctcagcagtcacacctagcagtctcaggatgtgactgaggtgctggtaaaataaattacaacattttaatgttttggtggaattttggcgaaaacaaaacaagacaaaaactatggtcaaaggggacacattagaagaacagaaattgttacattcaaacgtataaccaggccacaattaatgacaacatgcgtttcaattaattactatttacaaagtacaaattcctatgaaagtagttcttgctctcaaggacaggtaaagagttaggaagagattaatac

SEQ ID NO: 23757 - DNA, 601 bp, Human
cctgttctccagtaggaactattttggggttcatgttaggcagaaagtatcaaggattgattgtggacacatcatatctcatctttaaatgaaaaattttcaaaactttgagagctgctgaattttatacttcagaacactgaacataattatttaaaaatacaaatgtacttaacaatggcttctaatattcacagatttcctaagcacactggctagcatactgcattctatcaattggtagaccaaaagttggctaatctctttttccccctcagtgcaacacaggaataacgctaayggatctgtactatataacttaaaaaggtaacatttagaaaatattagtatataagaatataataaaattaaaatgtcatatttacttataaaacttaactgtctaaaaacaaagtgaatgatctttagactgaaatgatttatacatacatattccaaagctatatgtatatgcataacttatttaaaaggatatctattattaatggaatcgtccatcacatttttgatgctttgctgtagccacaacttctgctgatcaagttctctttccttcagttctagatcttcaatttcagct

SEQ ID NO: 23758 - DNA, 601 bp, Human
ggtaagttcataaactaagagaatcacagatacctgagagaagacggtggtttgtaagaaacacatggatatgtgtttttatatatataataatgtttttatatattatatataaatatattttatatattatatatgatattatatgtattatatataataatgtttttcccccaatatatattgttgataggcacacacgacttagacccctgttctccagtaggaactattttggggttcatgttaggcagaaagtatcaaggattgattgtggacacatcatatctcatctttaaaygaaaaattttcaaaactttgagagctgctgaattttatacttcagaacactgaacataattatttaaaaatacaaatgtacttaacaatggcttctaatattcacagatttcctaagcacactggctagcatactgcattctatcaattggtagaccaaaagttggctaatctctttttccccctcagtgcaacacaggaataacgctaacggatctgtactatataacttaaaaaggtaacatttagaaaatattagtatataagaatataataaaattaaaatgtcatatttacttat

SEQ ID NO: 23759 - DNA, 601 bp, Human
gcgcgatttcggctcactgcaaccactgcctcctaggttgaagcaattctgctgcctcagcctcccaagtagctgggattacaggcatgcaccaccatgcccggctaattttgtatttttagtagagatggggtttcaccatgttggtcaggctggtcttaaactcctgacctcaagtgatccacctgccttggcctcccaaagtgctgagattacaggcatgagccactgcacccagcccaatgtggtcattttaacttatttttatagattattggccatatgattagtcatttcttgwcatcctctaacttaaaaaattcaaatttaaaataatttaatcaaaatgttaaatcattttaaatcatttggttacttggggatagatatcttagggataggacccaagtctaaacacaatattcatttgtttcatacacaccttattcacatagcctgaagataattttatacaatagttttaatttttgtatgaaacaaaaatcacttgataaagcattctgattactttttaaaaattgactttgagctaaatgatatcaataaatgactaaggatatagccaataatctttaaaatc

SEQ ID NO: 23760 - DNA, 601 bp, Human
tctgccaggcatggtggctcatgcttataattctagcactttgggaggctgagtgaggtggacggattgcttgagctcaggagttcagaccagcctgggcaacatagtgaaatccgtctttacaaaaaatacaaaaaaattagccagacattcatggcacgtgcctatagtcccaactacttgggagactgaggtgggaggatcacttgaggctgcagtgagctgagatcgcgccactgcattccagcctggctgacaaagtgagaccctgccaaaaaaaaaaaaaaaaaaaaaaaaaaamcaccaccaaacctcatcatcattctaccaaaactgactcagttttagtcagtagtttcataattctcccagttattcaaccttaaaacttcaacatcactttccattcctgttaactttatctccagatctcacacatcaaatgttattttgcctacagtgtttctcaaatctgttcgttatttctcttcctgatctcactgtaatcactgttttagcctttttatttatttatttattttgagacaggatctcgctctgtcactcaggctggagtacattaagtgctgtcagggctcac

SEQ ID NO: 23761 - DNA, 601 bp, Human
aaaaattaaattgaataacagcttatataagtcatttgtctgctattgttgtctgtgtttttaaatataatactttctcctttcagattcctcagcagcgtcatgaaagcaaaccagttaatgttgatgaagctacaagattaatggctctgttgtaatatactggtgatgcatctaattctccacaaagaccaataaattgaatgttttatacaattttatttttaaaaatcttgttaatgtacaggcattggcacattttaaaaacaaactacataaacagatctttcctataacctargaaagtggaatgtcagaagtcaacaaaatgtgataaacttaaagtgctaaaacagaaggcacttcacaaaatctgttcactgaaacagttatatatcctcgtttacatccttcactttacaagtggcagtgaacgtctgtttggatagaaggacatacagaaatacaggcagtttagtggcagtaaaaatataagacaagtaatgagtccttggccaacttgtttttgatgacctgtagtgtcctttaactttcctccttaagaagaaaaaacagaaggattcacaattagaagaaaagt

SEQ ID NO: 23762 - DNA, 601 bp, Human
ccttggcgctgccccagcctgtctctgggggttatagaggaaggcgtggggcgtgtgccagttacaaaagactgtcttgaatcccagggtagtgcctattcactgggtggtctcagaagacttcccccaaagcgcggctgacaagggtgacagcgcctggaccgcgggaactgtccgcggagctggtgctgaatagggcgtgtgcggcgggcgcttcaaggaaactggaagcgggaccggaggccggccctcgggcgtgcgaggaggagttggaagaagagcggggaggggaacggcccgraactcgtgcgcgccgaacggcggcgccccaacccataaacccatctcttgctcagagagaagcgaaggagaggcccagcgagtaaaagccgaggcccttgagccgctcctcggcgcgcgccttctgcttgaggtgcaccttgctgtgccgtttcttctcatcgctgcgcgcgaagcggcggccgcacacgtcgcaagcaaaaggcttctcgccggtgtgggtgcgcacgtgcgtggtgaggtggtcgctgcggctgaagttgcggaggcagatgcggcactggaagggtttgtggcccgt

SEQ ID NO: 23763 - DNA, 601 bp, Human
tatgctctagctattcagttgctccttccttattcttggttttcactttttctttcttcccttgagccgttgttaagtggttgcttccatcacgttgcccagggtttctccaattctacgccttcccctggagggactcctgcgtcaattctgagctttcaggtcaccttgctgcttcgttccccagttctagctttccctttggaactctgacgcaggatcaaactgcccctacctgccccatcccactctccttgggttccttgagcctccatgctttcatgggttttaacattcttgmtagcacttccctcatcacctcagacttttcctgtctctttagaatttcaacctgattcgttcttgttgaatttcttgtggtgtttttccttaatcagtttttccatcttttgacttgacattgatcttggattattctctggtgtctggatccctctctgtgctcttctggcttccttattttctagctacatagttgtttctgatctccctgcaagtccttttcttcagctctttcacatttcttagtttcttatcctttcccttctaccttccttattccccagtttctcagctcctt

SEQ ID NO: 23764 - DNA, 601 bp, Human
gcgtcaattctgagctttcaggtcaccttgctgcttcgttccccagttctagctttccctttggaactctgacgcaggatcaaactgcccctacctgccccatcccactctccttgggttccttgagcctccatgctttcatgggttttaacattcttgatagcacttccctcatcacctcagacttttcctgtctctttagaatttcaacctgattcgttcttgttgaatttcttgtggtgtttttccttaatcagtttttccatcttttgacttgacattgatcttggattattctctrgtgtctggatccctctctgtgctcttctggcttccttattttctagctacatagttgtttctgatctccctgcaagtccttttcttcagctctttcacatttcttagtttcttatcctttcccttctaccttccttattccccagtttctcagctccttctcctggtgtccggaaaactcttcgaaacttttactcagactcctcccactcccctagactcttagcatcttatcttttatcaaggtaactgtcttctccaagcctgccatgcagttttctattgtgctgtcaaccccaat

SEQ ID NO: 23765 - DNA, 601 bp, Human
cctttggaactctgacgcaggatcaaactgcccctacctgccccatcccactctccttgggttccttgagcctccatgctttcatgggttttaacattcttgatagcacttccctcatcacctcagacttttcctgtctctttagaatttcaacctgattcgttcttgttgaatttcttgtggtgtttttccttaatcagtttttccatcttttgacttgacattgatcttggattattctctggtgtctggatccctctctgtgctcttctggcttccttattttctagctacatagttrtttctgatctccctgcaagtccttttcttcagctctttcacatttcttagtttcttatcctttcccttctaccttccttattccccagtttctcagctccttctcctggtgtccggaaaactcttcgaaacttttactcagactcctcccactcccctagactcttagcatcttatcttttatcaaggtaactgtcttctccaagcctgccatgcagttttctattgtgctgtcaaccccaatctcaacggtggttttttagcctctgttttttttctttaagaggctttactgtttctt

SEQ ID NO: 23766 - DNA, 601 bp, Human
tgtacgtttcttcctgagctcagacatctcttggctatccctcttgcttctccagatcacggtgctgtctgccatgacagaggaggcagctgttgcaatcaaggccatggcaaaataactggctcccaggtgagtgtgacaaatccctcactgtccccttcacattttgttgtcctcagcagagctgctgtagtcttaattgtttcaggcttactttctgcccctagcctggctctgtcctccctatccttcctgttgaaggtattatcctgtcttactaatttctctctcctacctaggrtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtctttttttttttttt

SEQ ID NO: 23767 - DNA, 601 bp, Human
ggggaagggtggggaacagcttccttaatgcaccctgctcccatgggagttcaggtcccctaatccaggtaggcccctgtcacagggacctggttggaccctggccaaatgtgagcttgggtgtgaatgaggggaccctctgccttagggctcagcctccagcctggccctgggtgatggaggctctgccctcagggtctctctgtggtggagcaagagaaactggacaacctgatgctggagttggatgggactgagaacaaatgtgagccggggccgggagaaagtggggaagcgtcasggtggggaggcgtggagcagatagagagctgaagggccagtgctgtagtggcttcctcaggaatgactgtcaggggcattctcctctcaaagccagagcaaggggagatgagtttagctgcagagggaaggaccgacagtaggcagaaggaagaccttctttgcagcatacagaggagggggatggcctgagagagtctgtggtctcagggatatttagaaagaggtgtggctctctgccgtttccaatctcctcctccccacccattcctctccctgctgttttcaagagagcatggat

SEQ ID NO: 23768 - DNA, 601 bp, Human
gagggaggagggggtctcctttactggctccttttggagactacagatggaggcaggagctagaaaggagaaggggacattgtgctcagcaccttcctctataatctcctagccaagtttggggccaatgccatcctgggtgtgtctctggccgtgtgtaaggcaggggcagctgagcgggaactgcccctgtatcgccacattgctcagctggccgggaactcagacctcatcctgcctgtgccggtgagcaataagccaggcctgcggctctcccaggggcgggtgggggagggagcaygcaactcatgaggaatgatgggaggaaagtgaattgagggaggtaaagaggaaggatggggacgtgagacttagtccggaaagctgggggaagtttgggatcttgggttaacactcctggggcgggcagggaggggctctttgacccttctgtctttctgtggctccccaggccttcaacgtgatcaatggtggctctcatgctggcaacaagctggccatgcaggagttcatgatcctcccagtgggagctgagagctttcgggatgccatgcgactaggtgcagaggtctaccataca

SEQ ID NO: 23769 - DNA, 601 bp, Human
ccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctggtgagaggaagtggtgtgagggggaggtctgggggcaggcagggacgtgtcccagcaactctggaccttatggggtgctgactcaggcaccaggtgggggtgtcctaagaagaacctgagaacmagggagagggtgcaggagccacctgcaaagactgggctttgtatgtagtgtaaaaatgcaggtacccgtgaccaatctgttctgtctcagatcctgattaaagtcatgggttctgaaaactactggggtcatggggaaggctctggaaggaaccagggatgatatgagtgtgactggatctagcagagaactagaacatttcagtatctttgattgatgaaattgtggatgctgaatggagctgggactgatgtgtgagtagaaagaaggctgagggggactgaattagcttctgcaagt

SEQ ID NO: 23770 - DNA, 601 bp, Human
tcgtgatggcaaatatgacttggacttcaagtctcccactgatccttcccgatacatcactggggaccagctgggggcactctaccaggactttgtcagggactatcctggtgagaggaagtggtgtgagggggaggtctgggggcaggcagggacgtgtcccagcaactctggaccttatggggtgctgactcaggcaccaggtgggggtgtcctaagaagaacctgagaaccagggagagggtgcaggagccacctgcaaagactgggctttgtatgtagtgtaaaaatgcaggtaccygtgaccaatctgttctgtctcagatcctgattaaagtcatgggttctgaaaactactggggtcatggggaaggctctggaaggaaccagggatgatatgagtgtgactggatctagcagagaactagaacatttcagtatctttgattgatgaaattgtggatgctgaatggagctgggactgatgtgtgagtagaaagaaggctgagggggactgaattagcttctgcaagtctgcccagggcctttatctcaggatggaggcagttggtcgccatcttcctgacacagagcgaaagaa

SEQ ID NO: 23771 - DNA, 601 bp, Human
caccaggtgggggtgtcctaagaagaacctgagaaccagggagagggtgcaggagccacctgcaaagactgggctttgtatgtagtgtaaaaatgcaggtacccgtgaccaatctgttctgtctcagatcctgattaaagtcatgggttctgaaaactactggggtcatggggaaggctctggaaggaaccagggatgatatgagtgtgactggatctagcagagaactagaacatttcagtatctttgattgatgaaattgtggatgctgaatggagctgggactgatgtgtgagtagawagaaggctgagggggactgaattagcttctgcaagtctgcccagggcctttatctcaggatggaggcagttggtcgccatcttcctgacacagagcgaaagaaaatcaacataattgcagaattaaggatttggattagcaatgaggaagggcttgctggcagtgagaacaggaaaatgcaaagctaggttgtgaacccttgttactggaagattttttttggggggggggtggggttgttttttttgttttgttttttttttttgagacagagtttgactcttcttgcccaggctggag

SEQ ID NO: 23772 - DNA, 601 bp, Human
tttttttttttgagacagagtttgactcttcttgcccaggctggagtgcaatggcgccatctcggctcaccacaacctccacctcccggattcaagcgattcttctgcctcagcctcccgaatagctgggattacaggcatgtgccaccatgcctggctaattttgtatttttagtagagacaggggtttctccatgttggtcaggctggtctccaactcctgacctcaggtaatctatccaccttggtctcccaaagtgctgggattacaggcgtgagccaccacgcctggctggtttgmttttaattaactttttttttttttttttttttttgtagagacagggtttagccatgttgctcatggctggtctcaaactactgggctcaagtgatctgcatgcctcggcctcccaaagtgctgggattacaggcatgagccactgtgcccagcctatggaagtggcgtgagatctctgctcactgcacgattctcttagcctcccaagtagctgggattacaggcgtgcaccaccatgcctggctaatttttgtatttttagtagagatggggttttactatgttagccagggaactcct

SEQ ID NO: 23773 - DNA, 601 bp, Human
tttttttgagacagagtttgactcttcttgcccaggctggagtgcaatggcgccatctcggctcaccacaacctccacctcccggattcaagcgattcttctgcctcagcctcccgaatagctgggattacaggcatgtgccaccatgcctggctaattttgtatttttagtagagacaggggtttctccatgttggtcaggctggtctccaactcctgacctcaggtaatctatccaccttggtctcccaaagtgctgggattacaggcgtgagccaccacgcctggctggtttgcttttaattaactttttttttttttttttttttttgtagagacagggtttagccatgttgctcatggctggtctcaaactactgggctcaagtgatctgcatgcctcggcctcccaaagtgctgggattacaggcatgagccactgtgcccagcctatggaagtggcgtgagatctctgctcactgcacgattctcttagcctcccaagtagctgggattacaggcgtgcaccaccatgcctggctaatttttgtatttttagtagagatggggttttactatgttagccagggaactcctatcc

SEQ ID NO: 23774 - DNA, 601 bp, Human
tttttttttttttttttttgtagagacagggtttagccatgttgctcatggctggtctcaaactactgggctcaagtgatctgcatgcctcggcctcccaaagtgctgggattacaggcatgagccactgtgcccagcctatggaagtggcgtgagatctctgctcactgcacgattctcttagcctcccaagtagctgggattacaggcgtgcaccaccatgcctggctaatttttgtatttttagtagagatggggttttactatgttagccagggaactcctatcctcaagtgatccrttcacctcagtatcccaaagtgctgggattacaggcatgagccactgtgcctggcctctccatgtaaggttttatgaaataagaatcaggagccaggcgtggtggctcatgcctgtaatcccattactttgggaagccgaggcaggaggactgcttgaatccaggagttcgagactggcctggcaatacagtgagacctcatctctacaaaaattttaaaaattagctgagtgtggtgccacacacctaaagtccctgctactcaggaggctgaggtggcaggatcacttgattggggag

SEQ ID NO: 23775 - DNA, 601 bp, Human
gtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtcygtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtg

SEQ ID NO: 23776 - DNA, 601 bp, Human
gggctactcactatttagttttcaggtgaatataaatccagtttttgttttgtttttttgaaaaagataaagctactatttaaaaaaatcatcacttaaatagtgggttgtggaagcaaactccagggaacactttgcccatagactcctttggtgagtgggaagtgcttgttaaatgtctggagaaaaaaaaaaaacaggctataaaaaaggatgagttcatgtcctttgcatgaacgtggatgaagctggaaaccatcattctcagcaaactaacacaggaacagaaaaccaaacaccrcatgttctcactcgtaagtggaaattgaacaacaagaacacatggacacaaggaggggaacatcaacaccaaggcctgtcaaggggtggggggctaggggagcgacagcatttggagaaatacctaacgtagatgacaggttgatgggtgcagcaaaccacagtggcacgtgtatacctatgtaacaaacctgcacattctgcacatgtatcccagaacttaaagtgtaataaacaaataaataaataaataaaattaaaaaaagaaaaaagagaaaaaattttaaaaggctgataattt

SEQ ID NO: 23777 - DNA, 601 bp, Human
cctgctttatgaccctaaggaatcagcctcatcaaaccaacagagggtggccactgtggttgcccatgaacttgtgcatcaggtacagaatcttagcactgaatcagcttgtttttttaaagtggcttaagaccacaggaataattcaaattatttatgacttagcaaataaaaaatagccaactcagaaaaacttgcatgaaaatctttcttggtactaataaacatttagccataaagagactttgaaccacattgttttgcctttaggaaatatgcacgaggccttcatataaatttrtgtaccccagtaataactaaataaaggcaataaactaaagacaatttaatatcatttaaataatcagaataaagcaggaaataaatgttaagtacaatgcctgccacttctgtcacagtgacaacattggcacggacaaataaatgttttgacattttctaggcctctctaccatacccataagaatgtaattatctctttattgcttataatttcagtggtttggaaatattgtgaccatggactggtgggaagacttgtggctaaatgaaggatttgcttctttctttgagtttctgg

SEQ ID NO: 23778 - DNA, 601 bp, Human
gcctttaggaaatatgcacgaggccttcatataaatttatgtaccccagtaataactaaataaaggcaataaactaaagacaatttaatatcatttaaataatcagaataaagcaggaaataaatgttaagtacaatgcctgccacttctgtcacagtgacaacattggcacggacaaataaatgttttgacattttctaggcctctctaccatacccataagaatgtaattatctctttattgcttataatttcagtggtttggaaatattgtgaccatggactggtgggaagacttgtrgctaaatgaaggatttgcttctttctttgagtttctgggagtaaaccatgcagaaacagactggcaaatggtgagtcctaaacacataaacttgaaatctctcttttcctcatgcaaagcagatggaagcctttggactatgataatggtcccgagtcagatggcaagtacagtggtgagcggggaattccactgtgaggatagggtggagccagctgacttccactgactacaccttgccccagtacctagaagggcagctgatcatcacaatctggggatatccttgacagagtcact

SEQ ID NO: 23779 - DNA, 601 bp, Human
cactcaaaacacattatcaaggcaggaaaaaaaaaaaaaaaacaggtggcatagaaaatgttaactctgtgttccagaaagtatctatagcactaaccctttgaaaaaatgtcggagtctcatttgtgaacgacttactttatttcagacagattgcagaaacagtgtgatgaagagataacataaatttagtagttagattagttagattgaagttcaaatcctgaacacatcatttcttagatgcatgacagggaatatgaccttgagcaagttacataatatctgagtccattttctyctttatgaaatagaacattattttctatcttgtaagcttaaaagctcccaaatgtgcatgtaatgactattaacaggtagtgtgtccctcagaggcctggaatagaaacttttatgaaccctaaaattttttttcagaaaagctaggtatagttgttatttatatttatatcatgggagtattcttgattgcatatatgaatgtgcaaataggtggatgtgtctaattacaagaggttttgtactgtgtaaaatactgccctctactggacagaacaaaaaagttaaatgcttgaagccc

SEQ ID NO: 23780 - DNA, 601 bp, Human
tcttatctacatctggatttttttcaactatggaactattgacattttggagtagataattctttttttgtgcgggactttcctgtgcgttataggatacttagcatcccagacttctattaactaaatgccagtaacctgccagcccctgttgtgacaactaaaaatgtctccacatatttccagctgtctcgtgggggacaaaaatctcctccagttgaaaactactcatctacatggaaaattgctgattttataatttattgaaaataaactgtataaatggaaaattgtgttgtcstttattttctcccatacagtatactgaggcccttatagcaaactgttataagaaattataacattttaatattgtctaatattccaagtactgtgtttcaaaagcaatggctaaattccagaagaatttgctgtgcacttcttaagtgaaatttaatcacatcgttcaacacaacaattaattcattccttcatctattcattcattcctttttttttttttcctttttgagatggagtctcactctgtcacccagactggagtgcagtggagcaatctcgggtcactgcatcctccacc

SEQ ID NO: 23781 - DNA, 601 bp, Human
gtaacctgccagcccctgttgtgacaactaaaaatgtctccacatatttccagctgtctcgtgggggacaaaaatctcctccagttgaaaactactcatctacatggaaaattgctgattttataatttattgaaaataaactgtataaatggaaaattgtgttgtcctttattttctcccatacagtatactgaggcccttatagcaaactgttataagaaattataacattttaatattgtctaatattccaagtactgtgtttcaaaagcaatggctaaattccagaagaatttgctrtgcacttcttaagtgaaatttaatcacatcgttcaacacaacaattaattcattccttcatctattcattcattcctttttttttttttcctttttgagatggagtctcactctgtcacccagactggagtgcagtggagcaatctcgggtcactgcatcctccacctcctgggttcaagcaattctcctgcctcagcctcctgagtagctgggactataggccctcgccaccactcctggctaatttttatatttttagtagagatggggttttgccatgatggccaggctgatcttga

SEQ ID NO: 23782 - DNA, 601 bp, Human
ccctgttgtgacaactaaaaatgtctccacatatttccagctgtctcgtgggggacaaaaatctcctccagttgaaaactactcatctacatggaaaattgctgattttataatttattgaaaataaactgtataaatggaaaattgtgttgtcctttattttctcccatacagtatactgaggcccttatagcaaactgttataagaaattataacattttaatattgtctaatattccaagtactgtgtttcaaaagcaatggctaaattccagaagaatttgctgtgcacttcttaartgaaatttaatcacatcgttcaacacaacaattaattcattccttcatctattcattcattcctttttttttttttcctttttgagatggagtctcactctgtcacccagactggagtgcagtggagcaatctcgggtcactgcatcctccacctcctgggttcaagcaattctcctgcctcagcctcctgagtagctgggactataggccctcgccaccactcctggctaatttttatatttttagtagagatggggttttgccatgatggccaggctgatcttgaactccttacctca

SEQ ID NO: 23783 - DNA, 601 bp, Human
aatattgtctaatattccaagtactgtgtttcaaaagcaatggctaaattccagaagaatttgctgtgcacttcttaagtgaaatttaatcacatcgttcaacacaacaattaattcattccttcatctattcattcattcctttttttttttttcctttttgagatggagtctcactctgtcacccagactggagtgcagtggagcaatctcgggtcactgcatcctccacctcctgggttcaagcaattctcctgcctcagcctcctgagtagctgggactataggccctcgccaccaytcctggctaatttttatatttttagtagagatggggttttgccatgatggccaggctgatcttgaactccttacctcaggtgatctgcctgccttggcctcccaaaatgctgggattacaggcgtgagccaccgagcccaacccattcattcattcttcattcagcaaatggaggactccaaaatgaataatgaataaaatacacttcttgcccttaaggagttctcaatttaaggtcttgtggatggaagggtcagatagataaagatattttataagcgagctcaataaataccacaa

SEQ ID NO: 23784 - DNA, 601 bp, Human
ctttttttttttttcctttttgagatggagtctcactctgtcacccagactggagtgcagtggagcaatctcgggtcactgcatcctccacctcctgggttcaagcaattctcctgcctcagcctcctgagtagctgggactataggccctcgccaccactcctggctaatttttatatttttagtagagatggggttttgccatgatggccaggctgatcttgaactccttacctcaggtgatctgcctgccttggcctcccaaaatgctgggattacaggcgtgagccaccgagcccarcccattcattcattcttcattcagcaaatggaggactccaaaatgaataatgaataaaatacacttcttgcccttaaggagttctcaatttaaggtcttgtggatggaagggtcagatagataaagatattttataagcgagctcaataaataccacaatcatggaatacctcgtttcactggtgaaaaatcggaaggccaggaaaatgatagaattttccaacatcacagagataggtggtagcaaaatccaaaatcacacacacagctggtagcaaaatccaaaatcacacacacagc

SEQ ID NO: 23785 - DNA, 601 bp, Human
aaacatttaaatccaactcagaaggaaatacttttattcctttttagaagatgtaaagatgaatttgttagcatattgtaggtgaggattttttcttcactaatattttatgaaaagttgctggaaatctgtaactccaagatttatgtgacacattctgtcccacaatatttcatatagtctctccttcaaacatattccacatctgtatgtaacataatttaaattttattttagtcattttctacttcagcttctcatgggtttcccactacactgagatgcttagaagctactgcawgctaatacattttgttatcctgagtaatacctaaagtcttatttgagtcaaaaatattataattattaaaatgaatacttgagtgaaaaagcttctatgtattagcatttgaaattcttagcatcatatttttgactttccctctcatatgattcccatggtgtatgttcagccttcttgtattcatttttctttgatattatgaatgattccttttatctttatgtcgaaatgaaaatttcgaatccacttatagcctattctaattattcacatgggagaagtttaaatttattcaat

SEQ ID NO: 23786 - DNA, 601 bp, Human
aaatacttttattcctttttagaagatgtaaagatgaatttgttagcatattgtaggtgaggattttttcttcactaatattttatgaaaagttgctggaaatctgtaactccaagatttatgtgacacattctgtcccacaatatttcatatagtctctccttcaaacatattccacatctgtatgtaacataatttaaattttattttagtcattttctacttcagcttctcatgggtttcccactacactgagatgcttagaagctactgcatgctaatacattttgttatcctgagyaatacctaaagtcttatttgagtcaaaaatattataattattaaaatgaatacttgagtgaaaaagcttctatgtattagcatttgaaattcttagcatcatatttttgactttccctctcatatgattcccatggtgtatgttcagccttcttgtattcatttttctttgatattatgaatgattccttttatctttatgtcgaaatgaaaatttcgaatccacttatagcctattctaattattcacatgggagaagtttaaatttattcaatcatttttccccttagtcctagatac

SEQ ID NO: 23787 - DNA, 601 bp, Human
attcccatggtgtatgttcagccttcttgtattcatttttctttgatattatgaatgattccttttatctttatgtcgaaatgaaaatttcgaatccacttatagcctattctaattattcacatgggagaagtttaaatttattcaatcatttttccccttagtcctagatactcctcaggtttaagatattatgtccaagataaataaatgtttctaggcctttagctttctaaataggtataaaattaatttagaatgcttaataacttacaataaaaattactaatttaagtgggggcagtgttcttttttcattcagttacttgaaaattgatttaaaatattacaaattgtgcatttcagtactaaccttataacacataaaaagaaagtacagagccaagatgttcatcagattcttcagatgaaaggaaagcaaatgagatagactactgagaagagaaagattatatgcctaaattatgtatccatgtatattaagctatttgaccagataattccttgactatctacttccctctgctaaatataattcttattttcaaatatgaaaatatatttaataagttggcagaat

SEQ ID NO: 23788 - DNA, 601 bp, Human
catggagaagttgaaacagattacttagttatttttgaaactccttacatgtgtcttagtcagcttgggctgccataaggaaataccatagactgggtggcttaaacaatagaaatgcatttttcttgcagttatggaggctggaaagtccaagatcaaagtgctggctgattccgtttctggtgaagcctctcttccgggcttgcagatggtagacttcccactgtgtcctcatagcagagagagagagagggagagagagagagcactctggtgtctcttataaggatactggttccaycataagagtcccagcctcacgatatcatctaaatgtgacagctcccaaaggcttcgtttctaaatactatcacactgggggttagggcttatatgaatttcagggaatacgattctttccatagcaacatgatataaacatctaaatttatctataaaggtcattccttatactgagtacaagacttttcccttattattagattagaaaagatcaatattagtatgcttattacaatggagtcagtgaataaagaggcttgcttccttttggtaacagaaatgacaataaactttctga

SEQ ID NO: 23789 - DNA, 601 bp, Human
ttagttatttttgaaactccttacatgtgtcttagtcagcttgggctgccataaggaaataccatagactgggtggcttaaacaatagaaatgcatttttcttgcagttatggaggctggaaagtccaagatcaaagtgctggctgattccgtttctggtgaagcctctcttccgggcttgcagatggtagacttcccactgtgtcctcatagcagagagagagagagggagagagagagagcactctggtgtctcttataaggatactggttccatcataagagtcccagcctcacgatmtcatctaaatgtgacagctcccaaaggcttcgtttctaaatactatcacactgggggttagggcttatatgaatttcagggaatacgattctttccatagcaacatgatataaacatctaaatttatctataaaggtcattccttatactgagtacaagacttttcccttattattagattagaaaagatcaatattagtatgcttattacaatggagtcagtgaataaagaggcttgcttccttttggtaacagaaatgacaataaactttctgaaacatttcacacatcccacttaag

SEQ ID NO: 23790 - DNA, 601 bp, Human
cccaaagtgactctttattagctaacctggtgtggaactaaatctggggctggccatttgtctattctctttcatgctcatcaccttgccccaaactcaacctcaaacagcaaaataggtgcaggatgggggaaataagagcaaaattatcaactggaaaatctttaaggctatacatgtacataaaagatgtaatagagaaggggacattcataacaatatgtggtcatgaaatagaaaccgagaatatattcttcctttctttttcttctagtatcagtagtactgtcaataagacagkaatgggtcagctggaaaatgtcttttcccttcttgggatactagtaacagaaacattgttcgtttccttttgtgctcactgattccaactaataatgaactgtgacctaggtcatcgtgtaattttgacttgaatgattacatgattattcaaggtgaagagggaagtgtcttaatatagaatattcaaaagcactaatctagacaatataaaattagtaccttttaatatgctgattacataaatttccattcagcctgtggttcatgagaagcaagaaactgcaattttaaaagcagt

SEQ ID NO: 23791 - DNA, 601 bp, Human
ggttttatcgtgtaaattatgaagtagcaacttgggactcgatagctacagcgctctccttgaaccacaaggtaagagatagcaatggttggaaacttttatttttgttctaagaacagcatcttaatgatattaatttttttcaacatgctttgccttaagaattgtgtttttatctctctttctccctcttcccagacattttcttcagcagatcgtgcaagtcttattgatgatgcttttgccttggcaaggtgcgttttagaatgagactaaattacttaaaatactgtgggttttstcataaatcttttaaaaatgaattaaacattgcagtattaatcaattttagcttaaaatatccaaagccactatttaaaacattattgttttccttaactctcttttcaaaagttcacatgagcctaatagtcaaaatactgacattagcccttaaggtatacacaaaaacaaacctaacttattgactttgagtatggtttgtctatatcaggatccttgagctaattagaagtgacatttgcaaatgatcaaaaatgtaccttcataatttgatttaatataaagacaaacaatgtat

SEQ ID NO: 23792 - DNA, 601 bp, Human
atggctagaattgtcaaatcttgttcaggtcactggggtaagaagaatgagctatggtgctttagaactgatcagaattaggggaccatttggaaaatttgactctttttctcatagtctgaaggtaacctgctctttagaaaaagtgtagattggaagaactaagtagtatccatggtacctctattttttttttaattcacatagtctaacaccagtaatttaacaagcatttattgagttcctggcactttgcagaagctgaggacacagccaattttatttctctggctttgtagtygcctcattctagatatgagcaatgtgctaagaatgaggagccacttccctcagtagcctcccatggcctctttctctgggttgggtatccttcttatgggaccctatatttcctcataatattttattgttattgtttattaattgtgcatttcacccatcaaactgaaggttcatgagggtaggcacccaaacccagctcctgactgtacgttgccaataacagttgataataaatactgactaaatagagaggtggaagaatagtatagtagtactaaaggcatggggaaactatttt

SEQ ID NO: 23793 - DNA, 601 bp, Human
ctacagtttaatttgcaccacaatgtaggaggtcctttctattccaagatgaagtgaaagaaagcctcttgaacagctctctctgaggaactgagtataaagcaaataacttacactactgaaagacttgctcacatttgctcagctccttggccacagccccataaaattgtgaagagctgtggagaggaagaaaatgaaacaaatttgaaattcaaaacatatgtaggatcacacaagagagctagaaaatacctgtgctatcacctggctcaatgaggttctgcagcacatgaggaaratgggactcggagagaaacagattcaacgagcattggttagagccaagagggcagcttcaaagaccacataagctaagaccattatgaaactttggtggagggggtggaagagagaagaaatgcgtagttaaataggtgagcaactgtggcaggattagaatttaaacaagtctactgaggtattcaaaggaatgtagtaaccattatatttaataatcagaactaaatgatacatctgaaaataaatgaattttttattcccctgtctcttccaacttgatgtgaagaggtagtactcc

SEQ ID NO: 23794 - DNA, 601 bp, Human
agattctgcagcaagtccaggctgcagtacgagcttccttggaatccctttcttatttgaaacatgtgattgatatgttgtattttcataaaagtagatttacccacacaactgcaagtgcaaagaaaatgtaggaccttgattttctatctgattattcccaagagttctcacactgctgagtgatgagccagtgagagggagaacaactgatgttgactatctttgtctgccagtctagtttttaaatgagttgttaaactagaattctcattgaaatagtctcttggagtaaatgttsagtcttctagagttccttcccttcctcatggtccttctgcacagggagacatgccacccttgtggtgatggagaaagagacctctgatttttgctgctttggccttaaggtgtttacctattttggtctgggacagagtctgctgagttttcattgatcatattttaccttctggtgcactatctgtcatccagagatgaaagcagtggtcccagtcacttgcttctgttcatgaagtacctgtgctgtatgtatggtatttttgttttcccatcaggtcttccagtgtccctgcctctt

SEQ ID NO: 23795 - DNA, 601 bp, Human
gagtaaatgttcagtcttctagagttccttcccttcctcatggtccttctgcacagggagacatgccacccttgtggtgatggagaaagagacctctgatttttgctgctttggccttaaggtgtttacctattttggtctgggacagagtctgctgagttttcattgatcatattttaccttctggtgcactatctgtcatccagagatgaaagcagtggtcccagtcacttgcttctgttcatgaagtacctgtgctgtatgtatggtatttttgttttcccatcaggtcttccagtgyccctgcctcttattgctaggctgaagaaactgatagcttcccataaacaggacccacaagtcgaaggaaccaggatcattaccttaaactcagtcatatattcacctcaccttgcctacgatgtactatcactctcccatgccattttggcatagcacaaaagtacatgctgaactatagacctgttcttaaggggttgtgttttccagtttcacatgtggcatggactttatttaagcttgagttttctccagtctcatttagggtaaatttctacttcaagtatgctaagggtcttga

SEQ ID NO: 23796 - DNA, 601 bp, Human
gttttcattgatcatattttaccttctggtgcactatctgtcatccagagatgaaagcagtggtcccagtcacttgcttctgttcatgaagtacctgtgctgtatgtatggtatttttgttttcccatcaggtcttccagtgtccctgcctcttattgctaggctgaagaaactgatagcttcccataaacaggacccacaagtcgaaggaaccaggatcattaccttaaactcagtcatatattcacctcaccttgcctacgatgtactatcactctcccatgccattttggcatagcacaaaagtacatgctgaactatagacctgttcttaaggggttgtgttttccagtttcacatgtggcatggactttatttaagcttgagttttctccagtctcatttagggtaaatttctacttcaagtatgctaagggtcttgatatattaataaaagcatacataatttagaaataccttttctgtttgacaaaggctgactctcaaaggctcacaactcaagttgaacagtgatccctttgttgtagttattatctcaatatcttcctaaagatataaatgaattaagccaatgggtagg

SEQ ID NO: 23797 - DNA, 601 bp, Human
atttgtcatatttaattaactttgtcagttgatacctcaagaattgaattgctggcatgaaaactattttgtattggaatttagctaagggtgaacattaaaagttcactttgaattgtttttctgtttggcttctcttaggtatttggatttgctcaaggacacgaaccttattaaaactcaggatgtgtttacagtcattcgatatatctcatataacagctatgggaagaacatggcctggaattggatacaactcaactgggactatctagtcaacaggtgggatgatctgatgatrgtctgctgttttctttgtttcatactatctactggttccttcatttttctttgggccactgtctctgacatctatacaatatctaaaatggcattattagaggtaaaggatcatggtattatccttccagggaagcaatgtactagttaattttaagaacaatttttttctggaaattattgtttcaactgacctataggattctgagatctggaagactaaattgcattatttttagtttggttaaaacaagttaatacaattctgcctgttgtgctagtacctagcataatgccaggc

SEQ ID NO: 23798 - DNA, 601 bp, Human
atgaaaatgactatacttttgatatagtctgtatctataagacatacatagtctgaattattaacatttcaaaaagtggatttttggataaagactactcagctgacatcacactactttcagaccatattggtagatgaagtcaggatttccaggactcttttcagtctgaaagaagatgtacttcataaaagcagacttctaatccgagattcagctgaacaagaattacacaggactgaatgaactgttgaggaaaatttaattatagttatttacttggaatactgttggtattatyttaatgttctattttctaatagctatgtgcataagccctttctgagaccctcaacttagtagcctctgcttttgtaaaccaaatgaaatagttttcttttattattattattattattatactttaagttctagggtacatgtgcacaacatgcaggtttgttacatatgtatacatgtgccatgctggtgtgctgcacccattaactcgtcatttacattaggtatatctcctaatgctatccctcccccctccccccaacccacaaaaggccacggtgtgtgatgttccccaccctgt

SEQ ID NO: 23799 - DNA, 601 bp, Human
agggaaaacctttctttcaagtggtacaacatgggaaaaatcatgcactcagcaaaaaagaaaaacatggcctaatccttcaaatttggaataagaggaagtataaggattgggaaacctgcctgtagaattcttcagaactccttttctttgcctacttcctgatcagcatacaaaacaaatatccatacccaacacagcctactaaatatagaagcattcaggggaaacattgatcaaactcttatgaaatcattatgtactgtatcccaattaagaattttactatcttccattcttytggttaccctaataatataaacatttagtctttgtcatctacaggcagtttctgaggtattctgctgcttgcctaaaggctctgccataggcaaagccagaagctataggccagaagctgatatatcttcaacaaagagtcttagagcctcatgaaaatgactatacttttgatatagtctgtatctataagacatacatagtctgaattattaacatttcaaaaagtggatttttggataaagactactcagctgacatcacactactttcagaccatattggtagatgaagtcaggat

SEQ ID NO: 23800 - DNA, 601 bp, Human
ttgtaacatcaacacatatcttctatagctgtcatttaaattccaattaaatggcactaggaagaaaggagcagcatttcctacagaggtcttctgacaaatgggaatagttgcacatgttatgtgcctcttcaaacatctttcaatcatcaactttcacttttatacctactcttaggaactgcagcactttaaaacaaatcaaagcaatagcagctctaaaaccagcagtgattccaaaataaacttgaagaaacctttttaaagctgttaagttcctaaaacatattagggaacataycattttaactgaccagggactttcctttaagacagaatgaggtcacaagaacagaaacaaacaaacaaacaaacaacaacaacaacaaaaacaggaaaaaaaagactcatttttgtaaagatttcctaaagttccatttgtaaaaatgaaaagtacattttaaaaagtcatgggaaaggtaacaggataatagtatatttgtgagatatctgtttttccagtttagttaaaagattaagtttactgtaaacatatactgtacaaagcattctagacagtccaatcctagcaaagaagcaa

SEQ ID NO: 23801 - DNA, 601 bp, Human
ttagtgcaacccttcacaaagatactaaggcccaatgagggtaagtgacttagctcaagaacattcaaggcaccagggaaagaagtgaagcctaagttctaacttccagtcacatgcctttttcattaatccaagttctaactctgagaccaatgctctttctactagaatgtacatactattcttgattttggatccttaagatattcttttctatgtgcaagttgagatgattgatatttgtgaataattaaattattgtgattatttttcaggattctgaatatatatcaatatcacrtataaggagtagacaggggaggggctttccacctctttgtgctctttttaaaaagcctctcatcccccagtctatttaccacacattaaacagagacagttataacagaggaagtagggatagagccaagtctttgagtgtgtggcaagattcccagtcttcactgtttctccccaccaaatgtacttattacttcctcattttatcctattaaaaagtagtttgtttctaaaaatctgaaaaacaccttacttttcaagagggtaaatcactacgctacaaattcccttcatcctacta

SEQ ID NO: 23802 - DNA, 601 bp, Human
taagtaaaaaatttattatactgtaaaaccttaagacagtgaccacatctatcatgttaacctctgtatttctaaagcctggctcatcataggtactcaacaaatatttgctgactgactacatggcacctaggtgggcccctatgaattttgttttcctatacctccaatacaccaaagtagcccttctacccagagacatgaacagggactacaatctagccccgaaatcttaattaaaagactggatattctgaccctctcatcaaatttctccaatatctggctttgatcctgcttyagctatgccgggggtggggaggaagcctaactttgagtagtggcactcagcaaacttggaattcaatccttatacaactctgaaatccatccccaacaatcagaacttcagagtacactgatggtgttcaacacccttggccataaccacttttatgtattctggtcaagaatttacttctggtttataaatcattttttggtttatatatcaggagtaagatctagaccagaatactcacatctcacatgtgattaaccaagagtttcctttcaaatcttcaaatctactagacaatac

SEQ ID NO: 23803 - DNA, 601 bp, Human
gctgaggcagcagaatcacttgaacatggaaggcagaggttgcagtgagccgagatcgggctactgcgctctagcctgggtgacagagcgagactgtctcaaaaaaacagacaaaccaaaaaaaaacaaataatatttaatgatattaagagatgtattttatcatttaaatgagaaaaaaagaattagagaaaaatcccaaaagaaaataatacctaaaatgttatgaaaagtcatctctggattgtgagattataaattttgaaactggaacagtaattcaaatgacttaatgactgcrattccagaaaaactacagaaaataactgtgcaacatcaaaaaaaattatgtaacggtttaacttcaaaataattataaatctctcccaaaagtccttggatttttagcagttgaagtcttagtccaaaacttaataaataaatgcaaagaagctgaagcaactggttttcagctgttttgagttagtgtcatagacatgataacaaaagcctttactccagctacaatttgtccaacctgtcaataccctagtatagtcgctgatgtaatcaacccttcactacttctctgaaatcccgt

SEQ ID NO: 23804 - DNA, 601 bp, Human
ggaaaatacatacagatagtggaaatcatacagaatactcatgtttaaaataatacttagggccaggcacagtggctcacacctgtaagctcaacattttgggaggccgagacgggcagatcacttgaggtcaggagtatgagaccaacctggccaacacggagaaaccccgtctctctactaaaaacacaaaaattagccaggtgtggtggcgtgcacctgtagtcccaactactcaggaggctgaggcagcagaatcacttgaacatggaaggcagaggttgcagtgagccgagatcgsgctactgcgctctagcctgggtgacagagcgagactgtctcaaaaaaacagacaaaccaaaaaaaaacaaataatatttaatgatattaagagatgtattttatcatttaaatgagaaaaaaagaattagagaaaaatcccaaaagaaaataatacctaaaatgttatgaaaagtcatctctggattgtgagattataaattttgaaactggaacagtaattcaaatgacttaatgactgcaattccagaaaaactacagaaaataactgtgcaacatcaaaaaaaattatgtaacggtt

SEQ ID NO: 23805 - DNA, 601 bp, Human
agaaaaataacatggcaaagggggctaaggatagatatgaagctgtagaccaaaagacagggaataaagttttacttttacaggaggaaaagaattcatggcgatggatattggggatagttgcataataatgtaaatgtagttaataccactgaattgtacacttaaaattggttaagatgttaaatttcatgatatgcatatttatcacagtaaaaaaattgaaaaaaagaggaaaagtaaaaaagtcagattttttttttttttttttttttttctaagacagtcttgcttgtcgccyaggctggagtgtagtggtgcgatctcggctcactgcaaccactgcctcctgggttcacgcgattcttctgcctcagcctcctgagtagctgggaccacagactgcgcaccaccacgcccggctaatttttgtatttttagtagagatggggtttcaccatattggccaggctggtctcgaactcctgacctcgtgatccacccgcctcagcctccgaaagtgctgggattataggtgtgagccaccatgcccagccaagaagtcagatttaaaggtcttagtaaaaccagtcaaagaatt

SEQ ID NO: 23806 - DNA, 601 bp, Human
cccatatggcctcccagcactttgagaggccaaggcaggaggatcacttcagcccaggagtttgagacagcctaggaaacataacgagatcccatctctacaaaagataaaaataaaaaattagctgggcatggtggcatccacctgtaggccaagctactcaggaggctgaggtaggaggatcccttaagcctaggagatcaaggctgcagtgcactatgatatgccactgcactccagcctgggcaacggagctagacactgtttcttaaaaaaaaaaaaaaaaaaaaaaaaaagtgtmctgttgagagttaaaaatggagataagcaagtgtctggttataattgccttgaaaggagtttgggctttattctaagtgcaatggaaagctactaaaaagttaggtttaagtaataaaataacaacagtgtatttatagtttagaaatttcacactgatcacacaggggagaaataattagtgggaaacaatactaaaaaatggcatttaaataaatatttattgagcatctaaaatctatataacattgatccagtagtagtaataatatggtggtatggtggttgtcatcatcatagc

SEQ ID NO: 23807 - DNA, 601 bp, Human
cttatttcttcttataaccttggctaagttttttaacctctccaaatcttagtttcctcatctataaagtggagatgataacacccatcttgcgaaattactatgagaattaaagacaggatatataaaaagcttaggcataacattaagcccgtgacaactgccatttattgagtatagtgcctaccctaggcactcaatagtggcagctactactagttatgcatatttaatctttcccagtcttgggttcttgtttcttttaaggcagatctacttactgtctgcctcccttcttttmtaagtttctctttacaaccatgtggccccacttgtgacgtttctgcctcttgaaaacctgaagataacctctggtatcgttaggtggattggcggcagacaaactataaagcattttcatatacattatctcattttctgtgaaattcattaaagacactagggtttgccttttcaaggaccaagtatgttattcctatgtgaaggtatgaaagtatacatatacactataaaattatgcaggtatgccttgaagatactgttttttacattgtttaaatttcagatatctggattctct

SEQ ID NO: 23808 - DNA, 601 bp, Human
gaaagataaaacaatgcaagttttcatttttaaagttaaaattttgggttaatagataagatagcagtgataaattcccatttcaatgaataatactggtatctgacataaatagacaaacgtatctatgatctagtgaatgaacttcagacaaatctactaaattaaaaactatacctcatgcaacttcaagcatctactaacatagacttcaaacttttaatttgcttcagaaatttctgtcatatctaaaatttgtgttggtaggcaattgaataggttataaaatgaagaaggcagraaaaaaaaaagcagtctgcataggtgaaagaaagcatgaaacaacacagtattccataactgaggtacagttatatagcaaagagcaaaaatgcatattcagtaacctttatccttctgggtggcatcactttcagccttttccacaacttaagggactcatgtcatacatcataaggaatcaaaaaattcacaaaaaggccccccccataactcacaaagcagataataaaatatttattttattacaaataaggacaaaaacttctataagtaactctccatacctggtagctataaa

SEQ ID NO: 23809 - DNA, 601 bp, Human
ccttgagagagagtagagttaagaaactgacagtacaagaaaggcgaaaagcagagtgctgcagaatggaaaaaatagtccaaactagaaaaaacacagaaaggaaagcaacattcaaaaaaggattagtcaaagctgcaaaaaatgcagtactaaaaaaaccagattaaagagaaaagaggttatttgaaagataaaacaatgcaagttttcatttttaaagttaaaattttgggttaatagataagatagcagtgataaattcccatttcaatgaataatactggtatctgacataaayagacaaacgtatctatgatctagtgaatgaacttcagacaaatctactaaattaaaaactatacctcatgcaacttcaagcatctactaacatagacttcaaacttttaatttgcttcagaaatttctgtcatatctaaaatttgtgttggtaggcaattgaataggttataaaatgaagaaggcagaaaaaaaaaaagcagtctgcataggtgaaagaaagcatgaaacaacacagtattccataactgaggtacagttatatagcaaagagcaaaaatgcatattcagtaacctttat

SEQ ID NO: 23810 - DNA, 601 bp, Human
tatataacaggtgacaaaaaaacctattgtataaaatgactgaaaaatgaacagtaaactaggcaagaggttgaaggagcagaagttggaaagtataactgactaaaggacacagaggatccatttgaatatatttcttgctttacaaagacttactgaactaatttcctgttgtgaatcttgtaggtgctgctgaagaggttccaactgagccttccctgactctacactctcctccaattctgctgtttcttgctgtagacggctcagctcttctctagcttttgccaattcttcttcrtaagtggagatctgcgattcctgactagttaattcagctttcagagaagagatctataatgtgaaagtgaatgagaagaaatggggattaaaagaagagatgtcattaaaatgttccaaaatgcaatacatttatttgtttagtttactattttggtgttttttttgacagcaatagcaaataatttatttaatttaatttttgagagagagagtcttgctatgttgcccaggctggattcaaactcctgggctcaagtgatcctcctgagtagctgggactataggaacatgcccagcc

SEQ ID NO: 23811 - DNA, 601 bp, Human
tcttctccatcctcactgtcactatcaatcacttatagtactatcatctttggttccaattactatagcagtcttccttccaactgctttcctgcctccaatacatgtatttccaatctcttctccttattgtagccaaactaatagctctaaaatgtggatgtgatcgtgacccttctggttaaaagtccttcaatggcttcccattgtcttcttcatttagacgagtgggtgaaagacttaagaagtagtaggggcaggccggatgcagtggctcacacctgtaatcccagcactttgsgaggccgaggcaggcagatcacaaggtcaggagatcgagaccttcctggctaacacggtgaaaccccgtctctactaaaaatgcaaaaaattagccaggtgtggtggcacacgcctgtagtcccagctactcgggaggctgaggcaggagaatagcttaaacccgggaggctgaggcaggagaatagcttgaacccaggaggcagaggttgcagtgagctgagattgcgccactgcactccagcctgggcaacagagcgagactccgtctcaaaaaaaaaaaaaaaagtagcagggcaat

SEQ ID NO: 23812 - DNA, 601 bp, Human
aagcaaggacaatattcctttagaaaactgggaataaaagtcagtaaaacaaatggtagaaaaatctcatgggggacaggacaagaggaatgtattcatttttaaattagaagagctaatttagctttcttgctctttagatgataggagaatgagaggctagaataagaaggtgagaggagaagaattccagtagcagcaattttagaagaatttggcaaatgggtccacattgcaaactaagtgctataggaaaacagagtatccagcagcccagggaaacgaaaaatattcagtcacraaggtatctgtccagtttttattcaatggaaaacaccagttcttagccaagcagctctttactgaatacaaaaaagaagcaactttcaataatacaaaacctattatctttaaaataatcaattacattttaaaggaaatattcttaatctaatagtactagaagacaaattttttgcttcaaatgcttctcagttaactggtcctttataggttcagtttacctacagacatgaaactgtggtctcaaaaacgaagtctcaaaatacaaattaaaaagcaaaaccaaaaacctgcaaaa

SEQ ID NO: 23813 - DNA, 601 bp, Human
agcatccctcatctctatccactagatgtaagtagcatctcctattcaattgtgaaaaccaaaaaggtctctagacattgccaaatgttcctctggtggcaaaataaccctcagttgagaaccaaggaaccaacaatctaatcctccttttctcttagcccgaatcaatatcacagccacagtggaaagtaaatagtggacatttagtactggactttgtgtattaattaccttaatactggccctaacaacctcagaacataaaatcaagtaaccaatacagagaggacgaaataaaaamccagattttacacctattgacccagacagtcaacagggggaaaatgtggttcaattgggagaaacatgtttaaaaagacagaagactaaatatgaagttgttaagcaaacatgccaacagaaaattataattacctctaccatcaatacagtctagttatataaagaaatatgtctactttaactatatgttatctttcatttctatctgaaatcaacatttgctgtgatttactgaaatcaagttgcaactttgtgagaggactatataattgaaaggaggattgttcttttggtggaa

SEQ ID NO: 23814 - DNA, 601 bp, Human
gaggagtgattctaacatcattacttattaagattaacagatcaaaccaaaaacagctcaatctagattaaaggtttgtcaagcttcaggaaatattcaatgcaaaaaccacctgaggcccattttaaagggactgtatgcctttccgcaaacgaatatctgatctaaatggtaatcaaaggaaaaaaaatggattccatacgtcctaatgaacttaaatataagatttaatactaatgcaaggaaaatggcatcttgacaaactataaggacaacttgaaagtcaattttttttttttttaatttaaaaggcaggagtctcccaagctggagagcagtggcacaatcatagctcactgcagccttgaacccctgggctctagggatcctcctgcctcagcctctcgaatagctaggactacaggtgtgtaccaccacgcctagttatttttttaatttttattttgtagagatggagtttcgttatgttgcccaggctggtctcgaactcctgggctcaagcaatcctcccatctcagcctcccaagatgctgggattacaggcttgagttactgcacccagcctgaaagtcaatttttt

SEQ ID NO: 23815 - DNA, 601 bp, Human
tggccaggtgcagtggctcacacctgtaatcccagcactttgggaggccgaggtggacagatcacttgaggtcaggaggtagagaccagcgtggccaacatggtgaaaccccatctctgctaaaaatacaaaaattagccaggcatggtggatcatgcctataatcccaactactcgggaggctgaggcaggagaatcccttgaatccgggaggctgaggttacagtgagctgagatcatgccactgtactccagcctgggcaacagagcgagattccatctcaaaaaaaaaaaaaaaaaagaggaatattttaagttagctaaaataccattttccttcaagaaaaccaatactttgtttcaaatcactgtattgctgaattctggatactaaagaggccatatattctcacattaaaggatttaaggaagactttatactttacaggaaaaggactttgaaacaatcttctcttaaataaattataattaaaacaccaaagtacaggaaactgctattcaaatggataatcaatgagtttccaaaaggcaaaaagattttcttgacactttcccttttccattgattgcctctctgaaa

SEQ ID NO: 23816 - DNA, 601 bp, Human
atagaacaggcaatgataacgaaggttattttgcctgaaaaaactgtgaaactgaaaatttgttacccggtctaagaattttattaaaaaataactttttttactgaataatgatggaatatatgacattgctttatgtctctctagactgatacctccatggttggttgccccatttctgtgattttataggccctgcttatgctgttatcatggcacccttccactgtttctaacgatcttcctattttagacatctctgaaagaacgcagagtaaacatgagaagttagtgaattagrgccctccaaataaagattgtttaaatcctgacaaccatttatttatttatttcataaaactggcatttacatttttaaaaagctactgtgtaagtttaatagttttactttctattcaaagaatctctggctctatcctctcatataatatttgctgactggtctccagaaatcattaaaactttatacacaaacacacatacacagctgcaaatacacaaacttattactggcattattcatctagtgggcagagagcaatgactctgtaattgttcattaaatcaccatcacccataa

SEQ ID NO: 23817 - DNA, 601 bp, Human
actagatctatttccaaaatcatctcaagggcataaggtgataaatagaagaaaatctctgttttatagaacaggcaatgataacgaaggttattttgcctgaaaaaactgtgaaactgaaaatttgttacccggtctaagaattttattaaaaaataactttttttactgaataatgatggaatatatgacattgctttatgtctctctagactgatacctccatggttggttgccccatttctgtgattttataggccctgcttatgctgttatcatggcacccttccactgtttctamcgatcttcctattttagacatctctgaaagaacgcagagtaaacatgagaagttagtgaattagggccctccaaataaagattgtttaaatcctgacaaccatttatttatttatttcataaaactggcatttacatttttaaaaagctactgtgtaagtttaatagttttactttctattcaaagaatctctggctctatcctctcatataatatttgctgactggtctccagaaatcattaaaactttatacacaaacacacatacacagctgcaaatacacaaacttattactggca

SEQ ID NO: 23818 - DNA, 601 bp, Human
acagcttacttcacagtctatttcaaattcagcttgtccactaggtcagttttacaggagatggtcttttaacatgaagaggtctgataatctggcaggtctcttctctcccaattaaaaaaacaagagtttttttgctagcttgacaattttataggtgaaaaacatgaagtgagtaaataaactaaaccacaaagatggacaaaaagcaatatgatataaaacacatcactttttctatttgtattcagtgaaagtttttacatttcaagtaaatgagccttcattaaaaaaaaaaaaacaaatatatatgaaaaattaaagtaccttccagttctagcttgctgaagtttcttctgcaaaagtacaaaaattaacccactaagaactaaacaggacagggccacggcaaaggcagaatggctgccatgttaagacttttgcttgccttatactgatgggtatattttaggtgataaattttctccactatctatcacttaaaatgaacattttcttacaaactttatttgtaagaaactgatttttattaattagcaaacacactgagaggtatctgttgatctaaaattctctaaat

SEQ ID NO: 23819 - DNA, 601 bp, Human
gaaaatccttaggtcactggattcgtttatcaaaattaagccttgtgattatgattcagcccttgcttcatatgtatgacttttatgcagaaatgtttctatttacaaaggtagaaaaaagttagcagtgcaagatagtggtttaaagtttgttttaaactgtaggagtctaattgtgtaatggaaagaaaacaaaacaagcaccatttcaagaagaaatgaattggatattttggaatttatttataggctaggcaataagttactcagattaacacagatcaataccaccttgacttgktgacccagagaattctaattagattttaggtgcatttttctttatcttggtatttaatacatcatctaagtcagtaaccgtgttaaacaaaattaaaatgacaagttacagcttacttcacagtctatttcaaattcagcttgtccactaggtcagttttacaggagatggtcttttaacatgaagaggtctgataatctggcaggtctcttctctcccaattaaaaaaacaagagtttttttgctagcttgacaattttataggtgaaaaacatgaagtgagtaaataaactaaaccac

SEQ ID NO: 23820 - DNA, 601 bp, Human
tctctcagtgtgtgtgtctctctgtctgttttcacactctcctccccaatcgagcgaggcccacacctggcgcatcactgccgagccattagctgcgggtttcctttcatcttcgctgtggcagacgtttctatttatccacttgcgctcgccgagtggcgtcaccagcggtactgtaatgacgattgcagcaggaggatgacagcttagaaagaagagggcaatggggcttcctcccagaggcggtgcggcacagaggagcgctcgcttcacaaggtgaccctagctcccaccgccaccrccgcggtcgcggtccagaccgcgctccagcagctccgcgccctcccaggcacccggcctttctttctccctcttgcaaccaagatccgtccggccgctggagacccagggagccggggttaggaactcacttggggctttcccctcccccaccggagagccccgggatggagagccgaaaggacatggttgtgtttctggatgggggtcagcttggcactctggttggcaagagagtctcaaatttgtccgaagccgtgggcagcccgctgccggagccgcccgagaaaatggtgccccg

SEQ ID NO: 23821 - DNA, 601 bp, Human
ttccctatttagacagaaaaataaaatcaaaagaaattcatgcaaaaatcatcctattatagaattaaaagtataaaataagattaattctgtgtctttcacttttataattttaattatagatgttttggtagaaaatttatagttaactattcaactaaaacacagttaaaacttatgtatttaatttcaacaaattcccaaaaatgtttattttagaaaagctgtattgctgtagcttccttctttgtatgttcactcttgctaatgctaagtgtcctccctggattcttcatcctayggcctgataatattgataatgttcctgaacaacatacccatgtacactgcctagcttccactcgcacactaatcttacacattgggcaatctgactataaagctttctaatagggagtccataggtattggtttgtttggaaagtcctgatttacatgtgttgtccaaacagttattaatagagcccctcttttactctctaagtgtccctgtttgtacaagcaattatatggttcacctactaatcactacttaatgtctccaacaaatgaataattcattgtgataaaaatcaaagtc

SEQ ID NO: 23822 - DNA, 601 bp, Human
ctcttttaaacgaaactggctcaaccaaagccccttactctgggtcacctgccctagtggaagatcattgatagtttgatgatagtgtagcctgatataaaataatgaaatgagtcaattagattaccttctcacaactttgaactcaaactttcaattcaaaattgaaaaacacatttttcaatgggtatcatgagagaagttggcacatgaagagagatgagtcttacaaatgataaagcattagagtagcaatcttgcccttccagaggccagagtttcaagcatttttctggcatcytatgcttaattatcaaaataagtttcttgttacttaaagtaaattacctctctttgccttgcaatatgataatttcagttattaccctattcccttcaacagagtattattaaaaacagatacagaaaataacattttaatgtaaaagcattatttactggatttcaaattatgccttcattttgtagaaagacagattgctagtgattttgttcttatctactaaaaggtttaaccgctttccatttttattggacccctatttttatatacaaatttctttgagtattgaaacattga

SEQ ID NO: 23823 - DNA, 601 bp, Human
ttgtagggattgagaacatttggattaaggaatcacctagtacttgagaaaagcaatgtaatatcaacttcctgcattgtagacataatgaaaaataaattctattaaataatagatatcaatataagcttcaatatattcaatataagcttgataagcacttatcttcagttttaggaaatgattcttataccatgttctttcctacaggttggttgagaagaccatccatcagagagacattgaaccacttcttcatccttccctccagtggttttgtaccctgaagcgcaaccataaygcatgttctcttgaattttatacaataactttacatcagagatgtaaccattactcaggtcaggcttagtgcatttttctatgggaaaaaaaattatttaacttaatgatgaaactaagcttgtcttttactaaattgtaaaattaagccaaaagtataatgttattattggcgatttcattttggaaatatctgcataatttttttgaaaatggattcaatttaacactgactctctttgtatttactaattttagttcttatagtaatttctacccctaccacatctacttctagata

SEQ ID NO: 23824 - DNA, 601 bp, Human
tatacatatatttaaattattgaactatttttaagtatatctgacattggttcacaatataaaataatgtacatgatcttaaattcttctgtaataaaggaaatagtgacatataaagaaaaagcttctttcattttattccattccaattccttttattgatgcaaagtaggaactattggcgtaggtgggttgtagggattgagaacatttggattaaggaatcacctagtacttgagaaaagcaatgtaatatcaacttcctgcattgtagacataatgaaaaataaattctattaawtaatagatatcaatataagcttcaatatattcaatataagcttgataagcacttatcttcagttttaggaaatgattcttataccatgttctttcctacaggttggttgagaagaccatccatcagagagacattgaaccacttcttcatccttccctccagtggttttgtaccctgaagcgcaaccataatgcatgttctcttgaattttatacaataactttacatcagagatgtaaccattactcaggtcaggcttagtgcatttttctatgggaaaaaaaattatttaacttaatg

SEQ ID NO: 23825 - DNA, 601 bp, Human
aatgagaacctactggtacattttggtgtgagagaccatccgtatgtgagacattctacctcctctgtcttctttcctccagctgtgtagtagccagtagcacattcgtattgtactttgtccttcactttgaatgttttctgtgttgtggaataatttccattatataattcaggagccaaacacgtttctaaaattataaaaattatttattttataaactttttaataacctagattataaaaaatctcaaaatatggttttacaaatcttaagaatacatggtaaaatcaactcttrgcaaaattgaaaaatagccccaatttttctttgcctctattctcttcttcatacaccttgtgacctaactctaccagttttctgtttttaaaattctagtctacaagtgcttgaccaaaggccaaaattcaactaaaggcttgtgcagtagcaattgtgaaagtatgtgctgtctatgcatttttacaatttaaacaacttactaacaaagtatacatatatttaaattattgaactatttttaagtatatctgacattggttcacaatataaaataatgtacatgatcttaaattcttc

SEQ ID NO: 23826 - DNA, 601 bp, Human
gaaacataatgagcatgacaacttatatacacttctctatgagaaaaagctttcagagtgagagtagattttattccaaatgagaacctactggtacattttggtgtgagagaccatccgtatgtgagacattctacctcctctgtcttctttcctccagctgtgtagtagccagtagcacattcgtattgtactttgtccttcactttgaatgttttctgtgttgtggaataatttccattatataattcaggagccaaacacgtttctaaaattataaaaattatttattttataaactttttaataacctagattataaaaaatctcaaaatatggttttacaaatcttaagaatacatggtaaaatcaactcttggcaaaattgaaaaatagccccaatttttctttgcctctattctcttcttcatacaccttgtgacctaactctaccagttttctgtttttaaaattctagtctacaagtgcttgaccaaaggccaaaattcaactaaaggcttgtgcagtagcaattgtgaaagtatgtgctgtctatgcatttttacaatttaaacaacttactaacaaagtatacatatat

SEQ ID NO: 23827 - DNA, 601 bp, Human
cataattaaaaataaaggcaaaaatgcatgaaaaggtgaaacataatgagcatgacaacttatatacacttctctatgagaaaaagctttcagagtgagagtagattttattccaaatgagaacctactggtacattttggtgtgagagaccatccgtatgtgagacattctacctcctctgtcttctttcctccagctgtgtagtagccagtagcacattcgtattgtactttgtccttcactttgaatgttttctgtgttgtggaataatttccattatataattcaggagccaaacaygtttctaaaattataaaaattatttattttataaactttttaataacctagattataaaaaatctcaaaatatggttttacaaatcttaagaatacatggtaaaatcaactcttggcaaaattgaaaaatagccccaatttttctttgcctctattctcttcttcatacaccttgtgacctaactctaccagttttctgtttttaaaattctagtctacaagtgcttgaccaaaggccaaaattcaactaaaggcttgtgcagtagcaattgtgaaagtatgtgctgtctatgcattttt

SEQ ID NO: 23828 - DNA, 601 bp, Human
ccattttcacttctgggcattattcttctgcttttcctgctttctctgctttctacctcactattttggagattaatttttacatctggaaatatgtggcaaattaagagaaaatatccttgcaaagctgccagattggggtaattagtcctaataattcccaataagaaaagttattcgttataataagggatttaaaatgtataatagatattttaaaataataaatttaaaagatatagtcatttacaaactaagacaaaacaagatttattcaggtgggatatattaaagattgctraaaatagcactgatttaaaagataatatttattttaaaaataggactcaggaaaaaaaatagatatgaccacaggaattttgtcagagctaatagagattaaagctgataaagacatggcattttgcgagtattaaatttaaaaatttaccttcgcatacaggagattctgggtaccaaccaaagttatagcattgaattaaatcagatccacttagataataattttcatgacagaaaaactgaacgacatctccttcttcataggtttgctttacaggatgaaaataaccattttcaa

SEQ ID NO: 23829 - DNA, 601 bp, Human
ggactccatctcaaaaaaataaaaaataaataaggaataatagactttaaaaaaatttgcttaaaaaatctacttctctactactataccaaggatgtcgagcacaaatgaaaaatcataaaatctttaaagttactgtacagtgcatttagggaattatgatagttctggcaatcccactgcatacccatggtcagagccctcatttgtttcccctagcacctgtttcaaatcttcaccactttcctccaagttctaccttcatgtctttcacctgcctgtcaatagaccttatatcccrtattacagaaaataaaaaatgactatcaaaccctttgcctcaccctatcctcccaattctcaaactgctacttatctcttaagacccaacttaaatattgtccatcacttctgtgaatgctattccacagcataccaatcagaatctctaatgtttattcctgcactttgtacctgagttgattgtaccatttgtcacattatagcaattatttttttcatatctgcaattactgttttcatatcttctgctagtataggaccctcctcatattaaattgtaggtttgtttaaataacta

SEQ ID NO: 23830 - DNA, 601 bp, Human
aatcgagatatcaggagagccacattcctgctggaggctttggaggagaatcagctactttgccttttctagcttcttgaaatcacctgtattccttggctcacaaccccttcctcaaaacatttcaacctgtggcttccattgtcacatctcctgcttcctcttctgcagtcaatctccctctgcctcccttttataaaagcatttgtgattatatttagagtctggatagatagttccagataatattcctaccttaagattgttaacctcaaagtgtcttgtaccgtgtaaggtaacrtttaatggttctcagtattagaatgtggctatattttgggaggagtaagagagatataattcagcccacaactgaattatattgttgtgggctgaattatattagccattgtatgcctaatgactgtttaccggaaaaaacaggcatgttgtcatgctggctaatttggaagaggagaagggtataaaaggccttaagtaggtctgccatttatttttgaagtagcactttgagaggctgaggcaggctgatcacctgaggtcaggagttcaagaccagcctgaccaacgtggcaaaacc

SEQ ID NO: 23831 - DNA, 601 bp, Human
ccttatggaaaaaattaatcagcacctttagtcatataattacaaaaaataataaagattaaattaaaatattcatcatgtcaagcatcatagagagaatggcagactgattctaggagcattcctttgatcctcacctcctgatgttaacttccttgtgtgatacccctttccatgagtaggacctgtgacttgcttctagcccacaaaatacagcaaaggtgatggattagtacgtgattatgcacacataattatgtaacatcagtttttaacgccattcttgccaagagactctctmtccttgctggttttgaagaaacaagaggctacatcatgagcttccaaagcagaacggctgcaaggcaaggggcagagggctgccttcagttaacagccacaagaaacagaggctctcagttcagcagtctgcaaagcactgaatgctgccaataactacagtgagtttggaagaagtcttgcccagtcaagcctcagatgagactgcagtccagctaacatcttgattgcagctttgatagccatcgatgcaaggagtcggttaagccgcacccagacccccaacctacacccaatggga

SEQ ID NO: 23832 - DNA, 601 bp, Human
atgcagatttcattttagcaaagcttcttcaaggtgttactaaccaatgcattttggaggttctgtccattttccatcttcacaacgtatttctgctgacccatggatctcaaaattaagttcacattctatatgaactatttctccatgacgataagttgttgaatgtgtttgaattttggagtttatgggcagaggtggaggaggacatctgtttcttcttccttatggaaaaaattaatcagcacctttagtcatataattacaaaaaataataaagattaaattaaaatattcatcrtgtcaagcatcatagagagaatggcagactgattctaggagcattcctttgatcctcacctcctgatgttaacttccttgtgtgatacccctttccatgagtaggacctgtgacttgcttctagcccacaaaatacagcaaaggtgatggattagtacgtgattatgcacacataattatgtaacatcagtttttaacgccattcttgccaagagactctctatccttgctggttttgaagaaacaagaggctacatcatgagcttccaaagcagaacggctgcaaggcaaggggcagag

SEQ ID NO: 23833 - DNA, 601 bp, Human
tttatataatcaacaagatgtaacaaacgtgtccattcagatgaggatgcggtggtaaaatttagcaatatactctatataatatactctataatatattagcaatatactctaccaaggaaagaataggactaattattcttcttgaaatgacattctgagggcaatacaagcagagatattgagggctgtataccagggagggaatttcagctaggagaaagacaacccaaaagctaattggtcacaaaaatgttaatatacttaatgccactgaattgtacacttaaaaatagctacrgtggtaaattttatgttatgtatattttaccacaatagaaaaaatacactaatattttagggactttctacttaaagaaatgagagagaaaacacttgtgaaaaaagatttgtacaaaatcatcattttcatgatataaaacactgtaagaaaatcacataaaagtacaaacgtagacattccatgtgttctctttcttacccaagcaaacaggtggggatgaccattttccttgttcgcaacgagatatttttgatcccctcagtaagtaatattcattgcatctatattccactgagg

SEQ ID NO: 23834 - DNA, 601 bp, Human
agactcttaatgtctggaataataattcctacagagaaaattctacgctttatcatactgttgtgaatttgtactgatagcctttccagtttcaatagttaccaagatatacaaagcccctttctcttgccctgataacaatgattaatcttcatttggtatttgctttgattcattaggaccaaacctaactctcttgaggcagttgttccagatatagaatgatgtatttccttaaatgttgttatttccttatgagcttgtttcattaccagctttgccataaatattttaatctagkctttgtccttagagattactatatctccactcaatgcaatatcaaccaaagcatcaaaaacttaatatcaaaaacatttataaaaatatgagaccaatagcaaaattctatgtgaatatgtatctgtatctgaatttgaatgggaatcgactcctaagaattacttgaaaggtggaaactactaacaaaaggttgaaagagctcaagacttaaaacatacacttatatatacttaaaaacactataaataaaaataaattaaaaataattgcaataaacatgattctcaattggataaaa

SEQ ID NO: 23835 - DNA, 601 bp, Human
tgagaacagactaacacagtagccatctttaaactacagcataagataaattagatgaaaaaaagagtactggagcaggagggggtaacaaaagagctaggtgaagagaagttgcacttttcagtaaggtgattagggtaggcctaaataagaagtaaaaaagcttgaaggggactttgcacaaaagcttgaaggagactgagtgaaccatgtcattttcttatgaaagagtgtcccaagcaaagggaacaaccagtgcaaaggccctgaagtgagagcattcttggcttgtttgtggaaragtaaggagaccagaaagactggagtgattagagcagggaagagagtatggagaggttagagagactcttaatgtctggaataataattcctacagagaaaattctacgctttatcatactgttgtgaatttgtactgatagcctttccagtttcaatagttaccaagatatacaaagcccctttctcttgccctgataacaatgattaatcttcatttggtatttgctttgattcattaggaccaaacctaactctcttgaggcagttgttccagatatagaatgatgtatttccttaa

SEQ ID NO: 23836 - DNA, 601 bp, Human
tgattgaagtttggaagttggatcactcctctcaactttatagattagaatatgatggtggtgaattggggtcataggtataaattttctctaaagatcagcgatgttgagctttttcctcatatgtttgttggccacataaatgtcttcttttgagaagtgactgtttatatcctttgcctactttttgatggtgttgttcgtttttttcttgtaaatttgtgttaagttccatgtagattctggatattagacctttgtcacatgggcagattgcaaaaattttctcccattctgtaagtttcctgttcactctgatgatagtttcttttgctgtgcagaagctctttaggttaattagatctcatttgtcagttttggctctcatcgcaattgcttttggcattttcgtcattaagtatttgcccatgcctatgtcctgaatggtattgcctaggttttcttctagagtttttatggtttggggtttttacatttaaatctttaatccatcttgagttaatttttgtataaggtgtaatcacaatgagacaccatttcacaccagtcagaatggcaattactaaaaagccaagaaaca

SEQ ID NO: 23837 - DNA, 601 bp, Human
agttctcaaatatttttaaaatattgaagatgtttttgcaataatattataccatacaatgtatttttataattagaatcccacgttatagtgtttacatgcatatttaaaactatgagagtattaacaatcatgattttatttctccctaagtgtatatgggatttttctagaagccatgatttctgtatatattattttccttttcttccttattaaaagtaatagtccctatagccagtgagtactgagacaatgggtccccagaaagccctaagtagagcaatgctttacagtgttkgttgttgagtgctcacaagaaggtgatcaattctctgatagtctggcaacatttataaaacctcttgattttttcccttcataaaattgacttattggaattaaaagatgtcagcatggccatcctatataggtatatatgctgattgaagtttggaagttggatcactcctctcaactttatagattagaatatgatggtggtgaattggggtcataggtataaattttctctaaagatcagcgatgttgagctttttcctcatatgtttgttggccacataaatgtcttcttttgaga

SEQ ID NO: 23838 - DNA, 601 bp, Human
actcttaaaattataaaggaagaaatagcatcaatccagagaaccagaaaagacggaacacttcccattcatgggatgaggtcagcacagacttgatatcaaaccagaaaggaaaataaccaaccagtctttctcatgaaaatagatgagtaaaatattgataaataaaaatataacatataatatgcataatttatcacaaccttgtggaatttcttatgggaatagaatcatgctttaacattcaaaagaagcaatataattcattaaatttgcaggggaaaaaacaaaagtaataatyatgtaattatttcaacagatattgctaaaaattaaacacagattgaagattctttaaaaatactttcggcaaaatagaaagaaaggtttttatacctttaacttgatttttaaaaaaatatttataacaacacatagaggtgaattatcaaaggttttacttatgagaatgggaagcaaataaagatatccactacctcttccattcaacattgtactgaagtcctagccagtgaaagaagataagagaagtaaataaaagtcagaattggaaataaaaaatattttcttattatttaca

SEQ ID NO: 23839 - DNA, 601 bp, Human
ttaaaattagacaatgccaatacaccaagatacgaagatttagtgtctcaatttgtgtgtgtacctaatgaaatagtatcaaaatacaaaagcaaaaatggacagaactaaaattagtaatgttttaaaatgccaagtgagactttaacatgcttctctcagtgattgatagaaaacaaacacacacaaatcagtacagctttggattaacttaaacatcaaaaacaaaactcaatccaattcacatatataaaacagtgaacccaacaatgacaaagttaacttttcaatgaaaagaacrtttacctaaagcaaatacatgcttgttataaagcaaatatcaacaaattttaaagtgcagatataattcaaagtatgtcttaattgaattaaactagaaatcagtaaccaaaagaaaactagaaaatcccctaaatattcagaactttaaaaagaaacttctaaatgattcagagcacagagaatatatcaaaatgaatactataaaatttttgagctgaatgacagtaaaaatccaagatataaaaatggtttggatgaagttaaagttgtgctcagagagaaatttctatttttaaat

SEQ ID NO: 23840 - DNA, 601 bp, Human
aggaggtcttttaaaattagacaatgccaatacaccaagatacgaagatttagtgtctcaatttgtgtgtgtacctaatgaaatagtatcaaaatacaaaagcaaaaatggacagaactaaaattagtaatgttttaaaatgccaagtgagactttaacatgcttctctcagtgattgatagaaaacaaacacacacaaatcagtacagctttggattaacttaaacatcaaaaacaaaactcaatccaattcacatatataaaacagtgaacccaacaatgacaaagttaacttttcaaagaaaagaacatttacctaaagcaaatacatgcttgttataaagcaaatatcaacaaattttaaagtgcagatataattcaaagtatgtcttaattgaattaaactagaaatcagtaaccaaaagaaaactagaaaatcccctaaatattcagaactttaaaaagaaacttctaaatgattcagagcacagagaatatatcaaaatgaatactataaaatttttgagctgaatgacagtaaaaatccaagatataaaaatggtttggatgaagttaaagttgtgctcagagagaaatttct

SEQ ID NO: 23841 - DNA, 601 bp, Human
tatatgaaggaggtcttttaaaattagacaatgccaatacaccaagatacgaagatttagtgtctcaatttgtgtgtgtacctaatgaaatagtatcaaaatacaaaagcaaaaatggacagaactaaaattagtaatgttttaaaatgccaagtgagactttaacatgcttctctcagtgattgatagaaaacaaacacacacaaatcagtacagctttggattaacttaaacatcaaaaacaaaactcaatccaattcacatatataaaacagtgaacccaacaatgacaaagttaacttttcaatgaaaagaacatttacctaaagcaaatacatgcttgttataaagcaaatatcaacaaattttaaagtgcagatataattcaaagtatgtcttaattgaattaaactagaaatcagtaaccaaaagaaaactagaaaatcccctaaatattcagaactttaaaaagaaacttctaaatgattcagagcacagagaatatatcaaaatgaatactataaaatttttgagctgaatgacagtaaaaatccaagatataaaaatggtttggatgaagttaaagttgtgctcagagaga

SEQ ID NO: 23842 - DNA, 601 bp, Human
agttgatgggtgcagcaaaccaacatggcacatgtatacctatgtaacaaacctgcacattgtgcatatgtaccctagaacttaaaatattatatatatatatgtgtatatatatatacacacacacctatatggagagagagagagaaagagggagatgaccaatgggatatacatggagtatagtaacatacacctagtatagaaagttggtagggttggtaggtataaacagaaatatattagtaattacatgaatatgtaaatagactattccattacaagggaaaaaattataaaytgcataagtatattttaaaataaggtatatattgcttataagagaggcacactaaaagtaaaaacccagaaggttgaaagttaagggatggaaaaatgtgtactacatgaatgcttgtcaaaagccccttggtgcagctaaaggagacctcaaggcaaaaaaaaaggcaaagcattactatatatgaaggaggtcttttaaaattagacaatgccaatacaccaagatacgaagatttagtgtctcaatttgtgtgtgtacctaatgaaatagtatcaaaatacaaaagcaaaaatggac

SEQ ID NO: 23843 - DNA, 601 bp, Human
tacactgttggtgggagtatgaactagttcaatcattgtggaagacagtgtggcgactcctcaaggatctagaactagaaataccatttgacctagtgatctcattactgggtatatacccaaaggattataagtcattctgctataaagacaaatgcacagatatgttttttgcagaactattcacaatagcaaaacttggaaccaacccaaatgtctatcaatgatagactggattaagaaaatgtggcacatacacaccatggaatactatgcagccattaaaaaggatgagttcatrccctttgcagggacatggatgaagctggaagccatcattgtaagcaaactattacaaggacagaaaaccaaacactgcatgttctcactcataggtgagtgttgaagaatgagaacacatggacacagggcagggaatatcaaacaccagggcctgtctgtgggggtctgggggagggatagctttaggagaaatacctaatgtaaatgaagagttgatgggtgcagcaaaccaacatggcacatgtatacctatgtaacaaacctgcacattgtgcatatgtaccctagaacttaaaat

SEQ ID NO: 23844 - DNA, 601 bp, Human
aaatgagagaaaatatagatttaaagagacaatggcatagcaaaaagatgtaatatatgtaatatggcatcacagaagaggtgagaaatgtacattttaaaagatattagccaaacatttctaaaacccatgaaggatatcaagtacatcaaggttcaaggaatgctactaacttgaagaacaaaatgtacaaagagagtctcattgtgttgcactgatctccctgggagctgcagaccggagctgttcctattcggccatcttggaactaactcatatatatatatatttatatatatakagagagagagagagaaagagagagagggagagatttgtttctgatttgtttctaaggaactccagcctgggcagcacagtgagaaatggtacactcctgaccaaatactgtgcttttcccaaggtcttagccaccgacagaccaggagataccctcccttgcctggctcagcagtttccacgcccatggagccttgctcactgctagctcagcagtctgagatcaacctgtgacacgacagcgttatggggggagggtcgtctaccattgctgagcaggggttacaatcctagtctctga

SEQ ID NO: 23845 - DNA, 601 bp, Human
caccagcttttccctaaggtactgcttatccttgacttgtatagaggcataggatgagaagccaagcagaaagtaaataaaaagttacagtgggcatttggcagtctcccagtaatatcagagacagtcaaggagaaaaagctttaatacacacaacaaaccctctgtaaagagccctggagagttacagtctgtgagaaaaggcaaacagaggtctgaaaacaaacatagagaaagctttatttctaattgtattaaaaccaactgcctctacactaatcatcagccagaggatgagatragtcttctttggagtaagctgacatcatccaaacatcctgaaattttccacgtataatatttggaattcaatcaactgttaacaaaaatatcaagaatttggggctaaaaaatagatccagatattggagtttgcagacaagccttaataaaaagtatgaattatatgttcaagaagttgatgttaagctaggatctttcatcagataactcaaatctacaaaaagaaaatataaaatagaaatgcaaagatgataactgaaattgagaactcaaaagatgagtttaaagcagattggat

SEQ ID NO: 23846 - DNA, 601 bp, Human
tgagcagggatcgcaccactgcactccagcctgggcaacaaaaggagactgtctaaaaaaaaaaaaaaattctatgtgccatttttttctcttgaggtgtttgttgactctaagtctgacctgagaggttagatgatagagaatggtaagcttaggcatacagccagcagaacttctgaaaatctcatggagttgaagatagaaaaatgagaatttcggtaaaccaaagcagccaggacttgaagaataaagaatttagaaggataggaagtgtagagatatgagtttgaggctctgcacyagcttttccctaaggtactgcttatccttgacttgtatagaggcataggatgagaagccaagcagaaagtaaataaaaagttacagtgggcatttggcagtctcccagtaatatcagagacagtcaaggagaaaaagctttaatacacacaacaaaccctctgtaaagagccctggagagttacagtctgtgagaaaaggcaaacagaggtctgaaaacaaacatagagaaagctttatttctaattgtattaaaaccaactgcctctacactaatcatcagccagaggatgagatgagt

SEQ ID NO: 23847 - DNA, 601 bp, Human
atggtggcatgcacctgtaatcccagctactcgggaaagctgaggcagaagaatctcttgaacctagaaggtggaggttgcagtgagcagggatcgcaccactgcactccagcctgggcaacaaaaggagactgtctaaaaaaaaaaaaaaattctatgtgccatttttttctcttgaggtgtttgttgactctaagtctgacctgagaggttagatgatagagaatggtaagcttaggcatacagccagcagaacttctgaaaatctcatggagttgaagatagaaaaatgagaatttcrgtaaaccaaagcagccaggacttgaagaataaagaatttagaaggataggaagtgtagagatatgagtttgaggctctgcaccagcttttccctaaggtactgcttatccttgacttgtatagaggcataggatgagaagccaagcagaaagtaaataaaaagttacagtgggcatttggcagtctcccagtaatatcagagacagtcaaggagaaaaagctttaatacacacaacaaaccctctgtaaagagccctggagagttacagtctgtgagaaaaggcaaacagaggtctgaaa

SEQ ID NO: 23848 - DNA, 601 bp, Human
agcatacaaagtatagttgtgtcctttcccatgtatcgtaaaccaaagagaatggtaaagtatgtattaaaatacacaaaaaaacctcttcgattttttttacagaataaaaacattaatatttctaaaatatcaaatatcaaattatttcagaaaatgggatttcttatgtccttatttgtctcctggatgacctagcattaaggaataacttctgagacaggtaaaaaggtccagagttgctaatatggcatatcaatcatatacctgtagtacattaacaaacttacttacagtatgccctccctgattgcctacaggggatacatttcaagagccccagtgcatgcctgaaaccgcagataatgctaaaccctgttgtcattcttttggaacatgtttctgttcatgtcttctgcccacaaatttaatgcctcttccacctcaactaaacatttattatacactgtggcttgtaacttttgcagtttgaggtgcaacaacgaaactagcatggatttctttttccttcttcacactttcatagacagaagactcattgttaccatggatcttagcaacctcagcatacatttatttt

SEQ ID NO: 23849 - DNA, 601 bp, Human
aggtatttggggggaagcattgacagttactaatggtcattgatatcatgctcttttcccttttccttcttcagaaagttcaaataaaattctcatgagacaaattattaattgctgtataaataacattttatggaaatgtagattctcaacactgacccaagctttataacctcatgccatccaaaatggttgacagttacttctctttcaaatttctagttaagaaatatcaagactggattaagacgttttaaattctaagcatacaaagtatagttgtgtcctttcccatgtatcrtaaaccaaagagaatggtaaagtatgtattaaaatacacaaaaaaacctcttcgattttttttacagaataaaaacattaatatttctaaaatatcaaatatcaaattatttcagaaaatgggatttcttatgtccttatttgtctcctggatgacctagcattaaggaataacttctgagacaggtaaaaaggtccagagttgctaatatggcatatcaatcatatacctgtagtacattaacaaacttacttacagtatgccctccctgattgcctacaggggatacatttcaagagc

SEQ ID NO: 23850 - DNA, 601 bp, Human
tgtttgtttggtgtaaaaaaaatgaagaaaatattattattttttctttgcaattgccataaagtatgagtggtatagaacataacatttctgaaatgttgaataacaatctgaccaaaaaaaataatctgaccaaaaaaaaaaaacttcttacctttgtcttggaatacatcttggatattttaactgccctctgtcacattgcattctaagtatagatccagtaatatataattcagctggataagtatctcctctacaaataaactcaatatattcaccatgcaaaatgtgtggtctrttgtcaaaatcccatttcagaagtaaattattcttttccatttcagtaaaagataatgtgcatggctctgggaacaacaatttaaaaaaaaagaaagaaaaagaagaaaactatcttgttacatcttggtaagaacaggaatcgttgtgttgcctactcatgaggaccttaaaattctcaggcctaagagcagcaagtcagttaatcagaattaatatttgagtcagaaaatatgttcaaatctcacagaaaacagtgagccatttctctctgtggtcctggatttggagaaaaggtatt

SEQ ID NO: 23851 - DNA, 601 bp, Human
gaggctgaggcaggagaatcacttgaacccaggaggtgtaggctgcggtgagccaagatcatgccattgcactccagcctgggcaacaagagcaaaactccgtccaaagaaaaaaaaaagtgcacaagtctgggcatggtggctcacacctgtagtcccagtgctttgggaggctgaggcaggagactcacttgaggtcagaagtttgagtccagcctgggcaacatagcaagaccccatttctaaaaagcaaaatagaactgcacaaagcctcagggctgggagagagcagaggtagtcrtggctctgcaggaagttcagtatgacctgagggccctatacaggaggcctgggagggacagaggctggaaaggaggtatgctggatatcacagggtttcttacactacagttaataattaagggtaatcccatgagccaacatttcccaagtatctttaacagaacactgccatcctgggatgtcagtatttctttctcaaaatatgggtctcatggtcaagtaagcatgaaaaatgccggattgggcccagttcaacagacctctttattgcaggaaacgtcagagcctattgtgcact

SEQ ID NO: 23852 - DNA, 601 bp, Human
ccatgcccggccaataggcacttcttgagtgcatattacatgcaacctatcatgagggatagagccagcaataccacatggttcctgaccgtaaaaagattacaatgtagctagcagtggcccaaataaaagctaagcatcagaggatttaaataacaaagcacagattccaagaccatttttagacaagtacctggtataagcaaaaatgaagtggctaaaatagaaagaggggtggagaaaccagaggtactccctccttcactgaggatgcattagtggggcgctcactgtgtgccargcactgtcagtgctgtgaaaagagatgactgataaccaccctgttctcaaggagctcgggctaggggggcagaatgccaggtgaacacctctgtgccatcaggagttatgcagaaggaatataacatgctgggagggaaaagggaagaaatgcttcactcagaggtaggggatgaaaatgatagactaggaaggttttagagaaaaggtgaaatgcagtgagttttgtaagattaaagaatacatcaagcacccaggctgggggtagaaagaggctttatgatcaagaaaaaaaagtgca

SEQ ID NO: 23853 - DNA, 601 bp, Human
gacccttaactggaataaacaggtaaatatcttatttttatcaattgttcctaaatgtctgtatcgctcacatttatttcatgtttaacataagaagcgtggtctttatttagaagtttggtgatgtttttgtgactagaaatacgctgtgggaatgtaactcctgttcgtatcaattagcctatgggaaaaactggtttcattatagtggttttcaagttacagtttccaagaacccatcaaagacattaactgaggacttaccgtatatgtgctctgtggtggtggcaaagcacacacrcacacacacacacacacacacacacacacacactgtttcatgtgccatatgttaggctgatccacctgatggatatttactatcacagacaaaccctgaccttgacaccaactttgagaatgttcataaattaaataatacacaagtaagcttgcttttcctttgtaatagggcttaatgcacgtgctatgggaacactgggacaaactcgccaagctgagacatccaatgttaccagtgtcaagtaaaaaacaataggcactttctttttttttttttttttttgagacggagtctcgc

SEQ ID NO: 23854 - DNA, 601 bp, Human
acgacccttaactggaataaacaggtaaatatcttatttttatcaattgttcctaaatgtctgtatcgctcacatttatttcatgtttaacataagaagcgtggtctttatttagaagtttggtgatgtttttgtgactagaaatacgctgtgggaatgtaactcctgttcgtatcaattagcctatgggaaaaactggtttcattatagtggttttcaagttacagtttccaagaacccatcaaagacattaactgaggacttaccgtatatgtgctctgtggtggtggcaaagcacacrcacacacacacacacacacacacacacacacacactgtttcatgtgccatatgttaggctgatccacctgatggatatttactatcacagacaaaccctgaccttgacaccaactttgagaatgttcataaattaaataatacacaagtaagcttgcttttcctttgtaatagggcttaatgcacgtgctatgggaacactgggacaaactcgccaagctgagacatccaatgttaccagtgtcaagtaaaaaacaataggcactttctttttttttttttttttttgagacggagtctc

SEQ ID NO: 23855 - DNA, 601 bp, Human
ccacgacccttaactggaataaacaggtaaatatcttatttttatcaattgttcctaaatgtctgtatcgctcacatttatttcatgtttaacataagaagcgtggtctttatttagaagtttggtgatgtttttgtgactagaaatacgctgtgggaatgtaactcctgttcgtatcaattagcctatgggaaaaactggtttcattatagtggttttcaagttacagtttccaagaacccatcaaagacattaactgaggacttaccgtatatgtgctctgtggtggtggcaaagcacrcacacacacacacacacacacacacacacacacacactgtttcatgtgccatatgttaggctgatccacctgatggatatttactatcacagacaaaccctgaccttgacaccaactttgagaatgttcataaattaaataatacacaagtaagcttgcttttcctttgtaatagggcttaatgcacgtgctatgggaacactgggacaaactcgccaagctgagacatccaatgttaccagtgtcaagtaaaaaacaataggcactttctttttttttttttttttttgagacggagtc

SEQ ID NO: 23856 - DNA, 601 bp, Human
cccacgacccttaactggaataaacaggtaaatatcttatttttatcaattgttcctaaatgtctgtatcgctcacatttatttcatgtttaacataagaagcgtggtctttatttagaagtttggtgatgtttttgtgactagaaatacgctgtgggaatgtaactcctgttcgtatcaattagcctatgggaaaaactggtttcattatagtggttttcaagttacagtttccaagaacccatcaaagacattaactgaggacttaccgtatatgtgctctgtggtggtggcaaagcacacacacacacacacacacacacacacacacacacacactgtttcatgtgccatatgttaggctgatccacctgatggatatttactatcacagacaaaccctgaccttgacaccaactttgagaatgttcataaattaaataatacacaagtaagcttgcttttcctttgtaatagggcttaatgcacgtgctatgggaacactgggacaaactcgccaagctgagacatccaatgttaccagtgtcaagtaaaaaacaataggcactttctttttttttttttttttttgagacggagt

SEQ ID NO: 23857 - DNA, 601 bp, Human
ctgtgaaatgaagatgtattcccacgttccagcttctgagtttttctagtacccctcaagtggagagaaataatgctatgccgccagggggaccgggagagtttctagaattttatcttaaaaattatacttgacttcacaatgtatccacatcagctttgaaatacaatgctttgaaccacctgttaaattccttaacttgttctccccaaacctttgtgtcaagtttctccttggatgccccatgcttacggcaaggctctgagctggtccagcacatacactctggagaaaccttccrgctccaagaatgcacatacagaagcacccctgcttgcaagaggagtccacagagcctgtctcatacaaactcacctgtttatatgaaagccattcatagggttggtctggtttccgagagcctaaacaagggccattatctaaaaaaagagaaaaaacaacagatgggctgaacgtacataaatattcctagattttaatttgtatcccaaccgcactctaatactaaacatcagctagactctactttagtcctcagataagaaatggtggcttcagattggaaatgttttctccctca

SEQ ID NO: 23858 - DNA, 601 bp, Human
gcacacccatacccgtaggaaataagaccatacctactcctggcctggaaccctactggttctgggccttggcaccatcctggccctgcctatggggaacagactgatcgtggtaaggtgacaataggatgacacaaacaggctcattactactctctccttcacagacgagttcaaaagtcttggttgcatttaaggaatcagagcctgagaaaagcctgcaattggatgctatatagctggtaaatatgattgaataatacacgcacatttatatttctagatcggtcatacattcttaaaaaaaaaaaaacaaccctttaaggcattcctagccaccaaaaggtcatattcattggatgactgaaaaaaaaaaaaagatttgaatgtacaaatccaaagttggcttcagttttgtatcttcacctgcttccaaatgaagtgtgcaagtcatagattcacaccttcagaaaccccagtgattttcaatctgccttgaaaacgcctatctgcaatggacgtgtcttctctcttccagccactaaacaacagaagtaacccaggaggcacagaggattccatgatgcctcaggaccatcac

SEQ ID NO: 23859 - DNA, 601 bp, Human
ctttttgagacatagtctcactctgttgcccaagctggagtacaagggcatggtcttggctcactgcaacttcctcctcacgggttcaagaaattctccctgcctcagcctccagaatagctgggattacaggcacctgccaccacactcagctgatttttgtatttttcagtaaagacagggttttgccatgttggccaggctggtcttgaactcctgacctcaggtgatctgcccccgtcggcctcccaaagtgctgggattataggcgtgagccataccgtgcctggcctggagttaytttctttattctcagttcgcaaattctcaagagtactcttaaagcacacccatacccgtaggaaataagaccatacctactcctggcctggaaccctactggttctgggccttggcaccatcctggccctgcctatggggaacagactgatcgtggtaaggtgacaataggatgacacaaacaggctcattactactctctccttcacagacgagttcaaaagtcttggttgcatttaaggaatcagagcctgagaaaagcctgcaattggatgctatatagctggtaaatatgattgaa

SEQ ID NO: 23860 - DNA, 601 bp, Human
ggtattaggactggtctttgaaataggatgtattaaaaaaacagcagccaaaatctttaccatgcatttctggtccccacttccacttcttattagggcctttaataaagccctgttcttaaccataacgagatactgcagatactccgtaggttcctcaaatcagagcacagcactacctcacccccacattctgcacaactgacatctgcaatctgggaagaagaaaaatcaatctctgctcgattgaaatgctaggcattttggagaggctcaaatatctgctcaaatatctcccctcgtagagtggagataggatttgggagcccccaattataaaacaggccacagcagaccctctaagactccttcctgaatggacttgaaggttaagaatgacagaagcattgcgcggggacagcatttcccagcggcaggcttccagtcactaccactgatggggttcggtttactgcattagggcagtcttggtggccactttaatatctattaattttaacaaatgaactatttatattcttttcctattcaaatggaacagcttgaatgaggatatggaatgaacatgccattgaacacg

SEQ ID NO: 23861 - DNA, 601 bp, Human
caggtccttaattagaagagaaaaaaagtcttaaatggaaacgttttctaactgtaaaggataaggtcacatcgagtcacttaaagctggctttactgtggggttcattcacacctggctcgaaaacagcataattttctaattaaagaaactatggcagttttaattaaccagaaccaaaatatttattcattgttctgagaagccattttccagttacctcttctcttacataaaactacataaacggtattaggactggtctttgaaataggatgtattaaaaaaacagcagccaaartctttaccatgcatttctggtccccacttccacttcttattagggcctttaataaagccctgttcttaaccataacgagatactgcagatactccgtaggttcctcaaatcagagcacagcactacctcacccccacattctgcacaactgacatctgcaatctgggaagaagaaaaatcaatctctgctcgattgaaatgctaggcattttggagaggctcaaatatctgctcaaatatctcccctcgtagagtggagataggatttgggagcccccaattataaaacaggccacagca

SEQ ID NO: 23862 - DNA, 601 bp, Human
gaggacagagcagggtctgacacggtgtgcttaccttgggcttccgtctgttggctcttcccaggtccttaattagaagagaaaaaaagtcttaaatggaaacgttttctaactgtaaaggataaggtcacatcgagtcacttaaagctggctttactgtggggttcattcacacctggctcgaaaacagcataattttctaattaaagaaactatggcagttttaattaaccagaaccaaaatatttattcattgttctgagaagccattttccagttacctcttctcttacataaaacyacataaacggtattaggactggtctttgaaataggatgtattaaaaaaacagcagccaaaatctttaccatgcatttctggtccccacttccacttcttattagggcctttaataaagccctgttcttaaccataacgagatactgcagatactccgtaggttcctcaaatcagagcacagcactacctcacccccacattctgcacaactgacatctgcaatctgggaagaagaaaaatcaatctctgctcgattgaaatgctaggcattttggagaggctcaaatatctgctcaaata

SEQ ID NO: 23863 - DNA, 601 bp, Human
agaaagatatcaaagtatcatctgggcaaggattgactgtattctgtaagcaaagacaccagcaaggcagaaaagcattaagactcccagtgaaggggaacatcgcacaccagggacggttgtggggtagggggaggggggagggatagcattaggagatatacctaatgctaaatgacaagtttatgggtgcagcacaccagcatggcacatgtacacatatgtaacacacctgcacgttgtgcacatgcaccctaaaacttaaagtataataataataaaattaaaaaaaaaagactcygagtaaacttccattttatttctgagcacatagtacctcaacactgaggagaaacggcttttgcttatggtctgcaatttcttctcaccaaagaataaaatgaaaaacaaggggcatggtggctcacgcctgtaatcccagcactttgggaggccaaggcaggcagatcacttgaggtcaggagttcaagaccagcctggccaacatggtaaaaccccatccctactaaaaatacaaaaattagccagacatggtggcacatgcctgtaattccagctactcaggaggctgaggcagcag

SEQ ID NO: 23864 - DNA, 601 bp, Human
cttgcctagagtccaagtttgttaaagtctcactttcttttgtttgaatctaactagaagtttctgaaaggccaccaagtatgatgaatttgtgacaccagggtatctaataccagagtggcttgccattcagctagaatacactgcatgatttttttcctgtctagtacaaaccatgctggcaagccatatggacctgacagtttgcctattttaaaatttaaaaagaaaagattcaaaagatgacacaagggaagtacaaatgttctctgtcttagaagcagaaaccacgagaaaggtrcaccatggttcactgtttaacaattacagctcagaaagcttttgttcagcgtggcctgccttctaggcacacctctaaaactcgttaggtacagcaactcatgtgagattgctttataaacccagaagactctgaggtgtgcaggaagtagaaggaacagatggcagatgggatctaatcgccttcgatcctttgggatgagcaaatccgacagggcagctgtcatccaaagcatcggctgatagtcacctctgtctccaacacagcagagggcacacagctagagctcagtaactactc

SEQ ID NO: 23865 - DNA, 601 bp, Human
ccattagcaacttttggagacaaacagtaggagagaagaggtaaacagtccgtgttacacatgaggaagcagaggctcaaagtgtttattgtaaaaataaaatgacctcccacattatgcttgtgttgtgaccatggtttacaaagtgtgttcatgcattttctcttataatccttatcagccactctgagaggtaaacgcattctaactttacagatgagtaaactgaagttctgtaagattgggaggattgtccagggtcatacagatggcacatggcacagcccaattcaagcccaaccccctgcgtccaagtcagtgctcagtcctgggacttcgctgcttggaacttactcggtcaaacatccggttcagcagtcttggaaccacggggaagacagtgggttgaagcaccttgaggtcatccatgagcagcctgatatctccttggaaaaatccgattttagctccatgacacagcattacacactataggggtaatggaaaaaacaaacattttatcaccacagcaggggttacacaacatatggacaacatccaacatttcagttttagcatttcaggccagtttccagaaatc

SEQ ID NO: 23866 - DNA, 601 bp, Human
acaaaagtcctgcctcaaaataaagagtaagtgaacactctttctggagattgctcatgcccctcgcgcctggccctggctgtgcggtccacgcaatgatacccaccgcagaggggctggtgttctcttgggctctgctgtggcttagtcacttctttcagtgtggccaattaagtaatgttttacatgtccatgcaaggagctttacaatgaagaaaaccatttcatagttactattcttacgtgatcccattagcaacttttggagacaaacagtaggagagaagaggtaaacagtccrtgttacacatgaggaagcagaggctcaaagtgtttattgtaaaaataaaatgacctcccacattatgcttgtgttgtgaccatggtttacaaagtgtgttcatgcattttctcttataatccttatcagccactctgagaggtaaacgcattctaactttacagatgagtaaactgaagttctgtaagattgggaggattgtccagggtcatacagatggcacatggcacagcccaattcaagcccaagcccctgcgtccaagtcagtgctcagtcctgggacttcgctgcttggaactt

SEQ ID NO: 23867 - DNA, 601 bp, Human
aaggaatggataaataaaatgcgttatacccatacagtggaatactatttggccgttaaaaggaatgaagtgctaatacgtgctacatggatgcttgtgaaagacgccagtcacaaaggagcacatatggcatgattccatccacagaaaagtccagaatagagaaatacacagatgagcggatgctgaagggtggagggggtcggggagctgataaagaataggtaagggtttctcttggaggtcatgaaaatgttctaaaattgattgtagtgatggctggagaactgtgaaagtactyaaaacctttgaattacacactttaaatcagcaaattatacagagtattatatgttgataaagttgtccttttaaaaagaaccattaaaaacataagaacgttctgagagataacaaaagtcctgcctcaaaataaagagtaagtgaacactctttctggagattgctcatgcccctcgcgcctggccctggctgtgcggtccacgcaatgatacccaccgcagaggggctggtgttctcttgggctctgctgtggcttagtcacttctttcagtgtggccaattaagtaatgttttacat

SEQ ID NO: 23868 - DNA, 601 bp, Human
tttcctcttggaggcaaagtccaagagccatcgcttcagcgtggtgtttgcttgtccgaaaatctaatgaggcaagacatgagaaagttttcacacctactaggatggccagagtcaaagagtgtggagaaatcagaaccctcacacacagctggggaacacaaaatggcacagctgctctgacagcctggccggtcctctaacggccccacatggtcagcacaggacagcaattccacacctcggtatacacccaggagcaatggacacatacatccccaaatgcccatcgagtaggaaygtgtaggccaggtgcggtggcccacgcttgtattcccagcactttgggaggctgaggtgggcagatctcctgagctcaggagtttgagtccagtgtggccaacatggtaagaccccatctctacaaaaaatacagaaattagccgggcatggtggcacatgcctgcggtcccagctactcaggaggctaaggtgggaggactgcttgagccctggaggtggaggctgcagtgagccatgataacaccactgcactctagcctggatgacagagagagagaccctgtctcaaaaaaaaaaa

SEQ ID NO: 23869 - DNA, 601 bp, Human
cttttccccctagatggctgcaatactattgatcttagaaactgaggcctccttaatggctttgccttagtttttaaatgtgtgccagaattaacaaaaacatgttattctctcccttaccttcatctctccctctcacaaaaaaggccctcccagaactctgaaaagcgaagtcggtttccatgggagcagtggctgtgagtcacgtgttacctgtactttgtggaagatcagccggtcccacaggctgttgtttctgatgatgccgctgcgaagctctgcttctttcctcttggaggcraagtccaagagccatcgcttcagcgtggtgtttgcttgtccgaaaatctaatgaggcaagacatgagaaagttttcacacctactaggatggccagagtcaaagagtgtggagaaatcagaaccctcacacacagctggggaacacaaaatggcacagctgctctgacagcctggccggtcctctaacggccccacatggtcagcacaggacagcaattccacacctcggtatacacccaggagcaatggacacatacatccccaaatgcccatcgagtaggaatgtgtaggccaggtgc

SEQ ID NO: 23870 - DNA, 601 bp, Human
tgtcaattaagaaagaacacacacacacacacacagtacagatgacttttggtgcagaagaggactgggcatcctagtgtgggagaatcaggcgccgtgacatccacctcacctgacagcccagggctgctctgaggaacgtcagcacagtggcagacaccggggcggctcctgtcaccatcagccggactcttccgcccaggctcgactttcagggagggagagtgggagaaggtgagggttacacacctggaagtcggcggcctctccgccaagggggcctgcttgggaccccgttccytaacccatagctgcagaccacacggaggccacacggagaactcacagccctcatgatggcagcacagggctacggtttgtttccacccgtgactgccctgttccctcccaatggggatggaagtcagccccacctctgcagaagctatttcagggaattagaacacaactgggcagatctgtggcaactaccacaattctggccttctggggggcatgatattgttacacgttatcactcatgcttgaaaaattacctcaagagtgacacgcttgttccggaaaaacgcaacaaaatgga

SEQ ID NO: 23871 - DNA, 601 bp, Human
gggtgggaaggataggggtgatgttggtgaaaggacacaaagtctccatcaggaggaactggttcaagagctccatagcaccacgtggtgactagagctaacaacaatgtatcatatacttgaaaactgcccagagggtagattccaagtgttctcaccacgtgggaaaaaaaagtatgggtggtaagacacatgttaattagcttcatttagccattccacaatgtttacatattacatacatcaaaacatcatgttgttacgccataaatatagatacgcttgtcaattaagaaagaaaacacacacacacacacagtacagatgacttttggtgcagaagaggactgggcatcctagtgtgggagaatcaggcgccgtgacatccacctcacctgacagcccagggctgctctgaggaacgtcagcacagtggcagacaccggggcggctcctgtcaccatcagccggactcttccgcccaggctcgactttcagggagggagagtgggagaaggtgagggttacacacctggaagtcggcggcctctccgccaagggggcctgcttgggaccccgttccctaacccatagctgcaga

SEQ ID NO: 23872 - DNA, 601 bp, Human
gcctagggtaaaaaatatacatatggttgcttctccaagcaacctaataataacatatcttccaaacaaacataacacacacacacaaagtagggggtgggaaggataggggtgatgttggtgaaaggacacaaagtctccatcaggaggaactggttcaagagctccatagcaccacgtggtgactagagctaacaacaatgtatcatatacttgaaaactgcccagagggtagattccaagtgttctcaccacgtgggaaaaaaaagtatgggtggtaagacacatgttaattagcttsatttagccattccacaatgtttacatattacatacatcaaaacatcatgttgttacgccataaatatagatacgcttgtcaattaagaaagaacacacacacacacacacagtacagatgacttttggtgcagaagaggactgggcatcctagtgtgggagaatcaggcgccgtgacatccacctcacctgacagcccagggctgctctgaggaacgtcagcacagtggcagacaccggggcggctcctgtcaccatcagccggactcttccgcccaggctcgactttcagggagggaga

SEQ ID NO: 23873 - DNA, 601 bp, Human
cttctaaaggttgtcttgcacctgatcctagagaaaattcaacaaatggcagacacacacattcccctgcctagggtaaaaaatatacatatggttgcttctccaagcaacctaataataacatatcttccaaacaaacataacacacacacacaaagtagggggtgggaaggataggggtgatgttggtgaaaggacacaaagtctccatcaggaggaactggttcaagagctccatagcaccacgtggtgactagagctaacaacaatgtatcatatacttgaaaactgcccagagggyagattccaagtgttctcaccacgtgggaaaaaaaagtatgggtggtaagacacatgttaattagcttcatttagccattccacaatgtttacatattacatacatcaaaacatcatgttgttacgccataaatatagatacgcttgtcaattaagaaagaacacacacacacacacacagtacagatgacttttggtgcagaagaggactgggcatcctagtgtgggagaatcaggcgccgtgacatccacctcacctgacagcccagggctgctctgaggaacgtcagcacagtggcag

SEQ ID NO: 23874 - DNA, 601 bp, Human
cacagtgccctgacttacaagagtgtttgcccccagagcctaatgatcagaaacatagcacttttgtttaagatggttaatgaaccagtcagtgattaacccaattccagacataccaataacccagtatgaataacaaaattccaaaaaggagcctcctacagccatacctgcggtccagtctccaggcatggtcaggcagcacccggcagtgcactctgtctgtccgtatccttcataaaactggggcaccaagagatgcaacattattaaggagagcacaatcacacctttactggargtgcacaagcaatgaagtctcactaactcccaagtcatggctgactggtgaaatctcatttcaaatggtctgttcagtaagttcattcaatggtccagtgtgctttacgccaacaccagccgtcacccaggtacaccttctatttaacttccagtggccaagcgagggagaacccctatgtgactggtcaccacccagcagcagtgaactcccttggccaattcacaggacatgtaccccacacatgccccgtctgccaccaaatcctcctttctccctttactacaggttgtcagcatg

SEQ ID NO: 23875 - DNA, 601 bp, Human
gctctgcagtcaggccggggttgaaatcctggctccaaagcataatgccgcgtaaattctcatacatcatttatgtgttacttaagcaacaatctataatttcctctgagaagtaccagaacttatctcacagggacactgttggggttacactgacattaggtacatcctaagcacccatcacagaggcttacccatgacagatgctcaattatttttgtttgtcctcctcctttttccttttgagaaatgactttttgagaaaaaggacttgtatttattcctattggtagtcccaacrcctagcacagcacacagtacaaattcaataactatttgttgtttaaaatgaccagcaaataacgagaccctactcaattactaggaagctctgttgggccagacactctcaatctggaacacagggcccctctcagatgtcactagtagagtctaggcaagtctctgctgccaccagctttacagtcagatccccagcgccacccctcagttgcaggaggtgttctccccacagtgccctgacttacaagagtgtttgcccccagagcctaatgatcagaaacatagcacttttgtttaa

SEQ ID NO: 23876 - DNA, 601 bp, Human
tccagccaggacagttgttcttatttttaaagggaacacttccctctagtgcactgtactctttagagcagcagacagctgcagaatttgcagcaagtagcagacatctcagagatagcaaagtcctaaccccttgattagagaaacagggagacagaagatttaaaacccactttttaaactgaggaagtctcaaataacttagcacatttatagtatcccctttacaatttttaaggctcattttggaaagtgtgtattaccataaacatggtctgcaacatgaggtgactgtaaggcrgtgttctgtttcctctagcattcctatgagaagaaccccgaatggacaagtcaaacacgaacgcttccttccctacacttgctgtattcaaaattaacaacatgaaggccatcagcaggagaagagattgtggaactgtgccatttcctctgagctttcttcttcacactaaaccttgatagtggaatagaggtcatctatctgcgacctgaaatagttccgcagctctggccttttcgccttcattgttggagtcagaaggccattgtcgatagaaaataattcagggtgcaatgtgat

SEQ ID NO: 23877 - DNA, 601 bp, Human
ttcaacaaagatattatccagaagttttctgtttttgttgtatctctgccacattttgttatcaggataatgttggcctcatagaatgagttggggaggagtccctcctccaggatttttttcaatagtttcagtaggaataatactagctcttcttggccgggcgcagtggctcacacctgcaatcccagcactttgggaggccaaggcaggcggatcacaaggtcaggagatcaaaaccatcctggccaacatggtgaaaccctgtctctactaaaaatacaaaaaaattagccaggcrtggtggcgggcgcctgtagtcccagctactcgtgcggctgaggcaggagaatggcatgaacctgggaggcagagcttgcagtgagccaagatcatgccactgcactccagcttgggcgacacagcgagactctgtctcaaaaaaaaaaaaaaatgccagctcttctttatatatctggtgggattgagctgtgaatccatctggtactggtctttttctggtctgtcattacagagggtgatttgtcgtaaaggttggaaatggaagcttgatttttcataaatctctctcttccagtgc

SEQ ID NO: 23878 - DNA, 601 bp, Human
ggaataatactagctcttcttggccgggcgcagtggctcacacctgcaatcccagcactttgggaggccaaggcaggcggatcacaaggtcaggagatcaaaaccatcctggccaacatggtgaaaccctgtctctactaaaaatacaaaaaaattagccaggcgtggtggcgggcgcctgtagtcccagctactcgtgcggctgaggcaggagaatggcatgaacctgggaggcagagcttgcagtgagccaagatcatgccactgcactccagcttgggcgacacagcgagactctgtstcaaaaaaaaaaaaaaatgccagctcttctttatatatctggtgggattgagctgtgaatccatctggtactggtctttttctggtctgtcattacagagggtgatttgtcgtaaaggttggaaatggaagcttgatttttcataaatctctctcttccagtgctctgtctgggccagaggattcaggcacaggaaggtaagtgtcctgtaaatctctcccagcccctttagaccctcttgggagctctaggataaagaaattgaagaatagcctgaagcaccattcttattttaatccc

SEQ ID NO: 23879 - DNA, 601 bp, Human
gcactccagcttgggcgacacagcgagactctgtctcaaaaaaaaaaaaaaatgccagctcttctttatatatctggtgggattgagctgtgaatccatctggtactggtctttttctggtctgtcattacagagggtgatttgtcgtaaaggttggaaatggaagcttgatttttcataaatctctctcttccagtgctctgtctgggccagaggattcaggcacaggaaggtaagtgtcctgtaaatctctcccagcccctttagaccctcttgggagctctaggataaagaaattgargaatagcctgaagcaccattcttattttaatccccattctagttgtttctgctgtgcttctcttgcataatttctatctcactttgttatctccaaacccttcagactcattaatgctcaggcctggatttatagttagtccttgcctgtgttagactgtccatgaaggatctgtaatttactgaatgctcaaactgcaagaatgaggaagtcaggagtcatctgcccaatatccttccttatgctgattctattttgttttagcaacccacttcctcccgtcacttcatttaaaaggat

SEQ ID NO: 23880 - DNA, 601 bp, Human
ctgtctcaaaaaaaaaaaaaaatgccagctcttctttatatatctggtgggattgagctgtgaatccatctggtactggtctttttctggtctgtcattacagagggtgatttgtcgtaaaggttggaaatggaagcttgatttttcataaatctctctcttccagtgctctgtctgggccagaggattcaggcacaggaaggtaagtgtcctgtaaatctctcccagcccctttagaccctcttgggagctctaggataaagaaattgaagaatagcctgaagcaccattcttattttartccccattctagttgtttctgctgtgcttctcttgcataatttctatctcactttgttatctccaaacccttcagactcattaatgctcaggcctggatttatagttagtccttgcctgtgttagactgtccatgaaggatctgtaatttactgaatgctcaaactgcaagaatgaggaagtcaggagtcatctgcccaatatccttccttatgctgattctattttgttttagcaacccacttcctcccgtcacttcatttaaaaggatgctgccatagtctaaccctactgaacactc

SEQ ID NO: 23881 - DNA, 601 bp, Human
gctaaagttgtttatcagattaagaagtgtttgggcagagactgtggttttctaggtatagaatcatatcacctgcaaacagggatagtttgacttcctttcttcctatttggatgccttttatttctctcttgcctgattgctctagctaggacctccagtactatgttgaacagaagtagtgagagacggcatccatgtcttttgccagttttcaaggggaatacttccagcttttgcccattcaatatgatgttgactgtgagtttgtcatacatcattcttattattttgaaatatrtttcttcaatgcctagtttgtcgaggttttttagcataaagggatgttgaattttatcaaaagctctattgagaggattatgtgtgtggggagggttgttctatttatgtgatgaatcatatttaagatttgtgtatattggccgggcactgtggctcatgcctgtaatcccagcactttgggaagccaaggcttgtggatcatgaggtcaggagatcgacaccatcctggctaacacggtgaaacctcgtctatactaaaaaacacaaaaaaattagccaggcgtggtggtgggcacct

SEQ ID NO: 23882 - DNA, 601 bp, Human
agctttttgaagtgggagtttagtgctataaacttcccccttaacactgccttagctgtgtcccagagattctgctatatttacccaaaaattccagaacagactgcttaatttccatgcattgtacagttttgagtggttttcttagtatttattcctatttttattccactgtgctctgatttcgcttttctggatttgctaaggattgttttttttttttttgaaatggagtcttgctctgtcgcccaggctggagtgcagtggcgcaatctaggctcactgcaagctccgcctcccrggttcacaccattctcctgcctcagcctcctgagtagctgagactacaggtgcccgccaccccgcccggctaattttttttgtatttttagtaaagacggggtttcactgcgttagccaggatggtctcgatctcctgacctcatgatccgccagccttggcttcccaaagtgctgggattacaggtgtgagccaccgtgcccagcctgctaaggattgctgtatgtctgattgtatgattgactttagagtatgtgccatgaggcaatgaaaacaatgtagattctgttgttttggggg

SEQ ID NO: 23883 - DNA, 601 bp, Human
tgctaaggattgttttttttttttttgaaatggagtcttgctctgtcgcccaggctggagtgcagtggcgcaatctaggctcactgcaagctccgcctcccgggttcacaccattctcctgcctcagcctcctgagtagctgagactacaggtgcccgccaccccgcccggctaattttttttgtatttttagtaaagacggggtttcactgcgttagccaggatggtctcgatctcctgacctcatgatccgccagccttggcttcccaaagtgctgggattacaggtgtgagccaccgygcccagcctgctaaggattgctgtatgtctgattgtatgattgactttagagtatgtgccatgaggcaatgaaaacaatgtagattctgttgttttgggggtggagagttctgtagatgtctgtcaggtccatttgatccactgctgagttcaggtcctgaatatctctgtttgcctcaatgatctaatactgtcggcgggatgttaaagtctccccctattattgtgtggttgtctaagtctcttcgttggtctctcagaacacgctttatgaatccgggtgcttccatgttaggtgca

SEQ ID NO: 23884 - DNA, 601 bp, Human
tcttataggcagcataatgttgagtcttgcttttttttttttttttttttttgagatggagtctcactctgtcacccaggctggagtgcagtggtatgatcttgactcactgcaacttctgcctcccaggttcaaatgattctcctgcctcagcctcccaaatagctgggattacaggtgtgtaccaccacgcccagctattttttttttttattagagatgggatttcatcacattggccaggctaatgtcgaactcctgacctcaaatgatccacccacctcagcctcccaaagtgccrgggttacaggcgtgagccactgcacctggcctcttgcttctttatccaacttgccactctctgcattttaattaggacaattagtccatttacattcaaagttagcatttacatgtgcagattttttcctgtcatcatgttgttagctggtttggttattatgcagacttgtttgtgtggttgttttatagtgtcactggtttatgtacgtaagtgtgttttctattggctggtgatggtcttttctttccatatttagcgttcctcttaggacctcttgtaaggcaggcctgatggtaa

SEQ ID NO: 23885 - DNA, 601 bp, Human
acctcaaatgatccacccacctcagcctcccaaagtgccagggttacaggcgtgagccactgcacctggcctcttgcttctttatccaacttgccactctctgcattttaattaggacaattagtccatttacattcaaagttagcatttacatgtgcagattttttcctgtcatcatgttgttagctggtttggttattatgcagacttgtttgtgtggttgttttatagtgtcactggtttatgtacgtaagtgtgttttctattggctggtgatggtcttttctttccatatttagcrttcctcttaggacctcttgtaaggcaggcctgatggtaataaattccctcagcatttgcttgtctgtaaaggatcttatttctccttcacttatgaaacttagtttggctgggaatgagattcttggttggaaattcttttcataagaacattaaatataggcccccaatctcttctggattgtagagtttctgctgaaaggtctgctgttagctcgatggcattccctttgtaggtgacctgccccttcttttttgctgccttttcacattttttttttttttttgagactgagtcttg

SEQ ID NO: 23886 - DNA, 601 bp, Human
ttatgtacgtaagtgtgttttctattggctggtgatggtcttttctttccatatttagcgttcctcttaggacctcttgtaaggcaggcctgatggtaataaattccctcagcatttgcttgtctgtaaaggatcttatttctccttcacttatgaaacttagtttggctgggaatgagattcttggttggaaattcttttcataagaacattaaatataggcccccaatctcttctggattgtagagtttctgctgaaaggtctgctgttagctcgatggcattccctttgtaggtgacmtgccccttcttttttgctgccttttcacattttttttttttttttgagactgagtcttgctctgttgcccaggctgccaggctggagtgcaatggcgtgatctcggctcactgcaagctccgcctcccggattcacgccattctcctgcctcagcctccccagtagctgggactacaggtgcccaccaccacgcccagctaattttttatatttttttagtagagatggggtttcaccatgttagccaggatggtctcaatctcctgacctcgtgatccgcccgccttggtctcccaaag

SEQ ID NO: 23887 - DNA, 601 bp, Human
ggtgatggtcttttctttccatatttagcgttcctcttaggacctcttgtaaggcaggcctgatggtaataaattccctcagcatttgcttgtctgtaaaggatcttatttctccttcacttatgaaacttagtttggctgggaatgagattcttggttggaaattcttttcataagaacattaaatataggcccccaatctcttctggattgtagagtttctgctgaaaggtctgctgttagctcgatggcattccctttgtaggtgacctgccccttcttttttgctgccttttcacattttttttttttttttgagactgagtcttgctctgttgcccaggctgccaggctggagtgcaatggcgtgatctcggctcactgcaagctccgcctcccggattcacgccattctcctgcctcagcctccccagtagctgggactacaggtgcccaccaccacgcccagctaattttttatatttttttagtagagatggggtttcaccatgttagccaggatggtctcaatctcctgacctcgtgatccgcccgccttggtctcccaaagtgctgggattacaggcgtgagccaccgcgc

SEQ ID NO: 23888 - DNA, 601 bp, Human
atgagattcttggttggaaattcttttcataagaacattaaatataggcccccaatctcttctggattgtagagtttctgctgaaaggtctgctgttagctcgatggcattccctttgtaggtgacctgccccttcttttttgctgccttttcacattttttttttttttttgagactgagtcttgctctgttgcccaggctgccaggctggagtgcaatggcgtgatctcggctcactgcaagctccgcctcccggattcacgccattctcctgcctcagcctccccagtagctgggacwacaggtgcccaccaccacgcccagctaattttttatatttttttagtagagatggggtttcaccatgttagccaggatggtctcaatctcctgacctcgtgatccgcccgccttggtctcccaaagtgctgggattacaggcgtgagccaccgcgcccggccgacatttctttctttcatttctaccttgaagaatctgatgattttgtgtcttggggatgctcttcttgtgtagtattttgcaggggttctctgtttcctgcatttgattcttggcctctctagtgacgttggggaagt

SEQ ID NO: 23889 - DNA, 601 bp, Human
tagctcgatggcattccctttgtaggtgacctgccccttcttttttgctgccttttcacattttttttttttttttgagactgagtcttgctctgttgcccaggctgccaggctggagtgcaatggcgtgatctcggctcactgcaagctccgcctcccggattcacgccattctcctgcctcagcctccccagtagctgggactacaggtgcccaccaccacgcccagctaattttttatatttttttagtagagatggggtttcaccatgttagccaggatggtctcaatctcctgacstcgtgatccgcccgccttggtctcccaaagtgctgggattacaggcgtgagccaccgcgcccggccgacatttctttctttcatttctaccttgaagaatctgatgattttgtgtcttggggatgctcttcttgtgtagtattttgcaggggttctctgtttcctgcatttgattcttggcctctctagtgacgttggggaagttttcatgaacaatacactgaaatatgttttccatgttccttgctttctccccatctctttcggggatgccaatgggctatttggtctcttttcatg

SEQ ID NO: 23890 - DNA, 601 bp, Human
gctgggattacaggcgtgagccaccgcgcccggccgacatttctttctttcatttctaccttgaagaatctgatgattttgtgtcttggggatgctcttcttgtgtagtattttgcaggggttctctgtttcctgcatttgattcttggcctctctagtgacgttggggaagttttcatgaacaatacactgaaatatgttttccatgttccttgctttctccccatctctttcggggatgccaatgggctatttggtctcttttcatgatcccatatttcttagaggttttgttcattawtttttattctttttcttcatttttgtctgactgaattagttcagagagccagtattcatgctctgagattctttccttattttgctttattttgccattaatacttgtgatcgcattatgaaatctcgtagtgtgtttttcagctccatcagatccgtttggttctttcaaaatgaccatctcatagattagcccctctgtcattttattgtaatctttaggttccttgcattgggtttcaactttctcctgaatcttgatgaccttaatttctatccatattctgaattctatttctgt

SEQ ID NO: 23891 - DNA, 601 bp, Human
atgatgcttcagcacaacggccagtaggtcattcctcatgattgccgctgtgctccctctcacgctctgaaagtgcgggctcctctcccacccaagtgctggctgcagatctgggctcggcactcccaggctgcacatcacagctctggggtgagctcagactttatgttccctccgtggcttgggggcagcaggggaagggaccttagcagcggttgtggcagacggcctttcacttgtcccttggaactccaccccagagagatgtggagccactatcagtgcgatgagccaagagtgrggcgactgcactgtgggtccaagctaggggccctgcctagtgatgagcaggggggacaggtgggtcacaggggtgacagactggcctcttctccttagggcagtttgctggaggtgtggttgaagcactcagagtctttgctccttccccagtctgagggcagcaaggccagtaccaccgcagtggcagcggcagagtgaccttccgttgcctctgggagctccgccacagagaaacgcagactcacagctgctgggaacgctccgccagagggtggggctgttgtgccgcggaatcaag

SEQ ID NO: 23892 - DNA, 601 bp, Human
agctccgccacagagaaacgcagactcacagctgctgggaacgctccgccagagggtggggctgttgtgccgcggaatcaagctggggcttggtgaagagcagggggttgagggctcacagggagaggagactgagctcctctccgtatggcgactgcggtgtgctggaagcatgaatgaaggccgggcgcggtggactcacgctcggaatcccagcactttgggaggccgaggcgggcggatcacgaggtcgggagatcgagaccatcctggctaatctggtgaaaccccgtctctactraaaacacaaaaaatgagccgggcgtggtggcgggcgcctgtagtcccagctactcgggaggaggatgaggctgaggcaggagaatggcgtgaacccgggaggcgcagcttgcagtgagccgagatcgggccactgcactgcagcgtgggcgacagagcgagactccgtctcaaataaataaataaataaatagaagcatgaatgaaggccccaggctccttgcttcttccccagatcacgggcagcagaggcagaacccttgccatggcagtggcagaggggctgtcagttgcctctggg

SEQ ID NO: 23893 - DNA, 601 bp, Human
gctcacagggagaggagactgagctcctctccgtatggcgactgcggtgtgctggaagcatgaatgaaggccgggcgcggtggactcacgctcggaatcccagcactttgggaggccgaggcgggcggatcacgaggtcgggagatcgagaccatcctggctaatctggtgaaaccccgtctctactaaaaacacaaaaaatgagccgggcgtggtggcgggcgcctgtagtcccagctactcgggaggaggatgaggctgaggcaggagaatggcgtgaacccgggaggcgcagcttgcrgtgagccgagatcgggccactgcactgcagcgtgggcgacagagcgagactccgtctcaaataaataaataaataaatagaagcatgaatgaaggccccaggctccttgcttcttccccagatcacgggcagcagaggcagaacccttgccatggcagtggcagaggggctgtcagttgcctctgggagccactccccagggaaacacgagccaccaccagtgagtgtgctgagggcggggcagctgctctgcactcccgagctgggggctctgcctggtaaagtgggggtgggagctca

SEQ ID NO: 23894 - DNA, 601 bp, Human
gcggggcagctgctctgcactcccgagctgggggctctgcctggtaaagtgggggtgggagctcacggggaagagagactggactcctctctgtctgatggctgtggcataatgaccgggcccccacacatgaaaaagaattctgggaactcaaaaagccagtgtgtccccaccatggaccccttggattgtgtttcaaatttctcctcaatttcgaagagcgtcctggccatccagattctgaattctataaccctcgtttcattcatctcaatgtagctaagaaccagatttctggggractatcgagttgccagagttcttgtgttgattcttttttttttcttttttgtggcagagtcttactctgtcgcccaggctggagtgcagtggcacgatctcagctcactgctgcaaccttcacctcccgggttcaagcgattctcctgtctcagcctcctgagtagctgggattacaggtgtgtgccaccacgcccggctaatttttgtatgtttagtagagcccgggttttgtcacgttggtcaggctggtctcaaactcttgacctccggtgatctgcccacttcagcctcccaaagt

SEQ ID NO: 23895 - DNA, 601 bp, Human
ttctgaattctataaccctcgtttcattcatctcaatgtagctaagaaccagatttctggggaactatcgagttgccagagttcttgtgttgattcttttttttttcttttttgtggcagagtcttactctgtcgcccaggctggagtgcagtggcacgatctcagctcactgctgcaaccttcacctcccgggttcaagcgattctcctgtctcagcctcctgagtagctgggattacaggtgtgtgccaccacgcccggctaatttttgtatgtttagtagagcccgggttttgtcacrttggtcaggctggtctcaaactcttgacctccggtgatctgcccacttcagcctcccaaagtgctgggattacaggtgtgagccaccgcgcccggccttggtgttgattctttctcttgtgtgagggctggtgttcctttaactgtgatgtcggttgagtacagtcgcttggcttcatttctgggtgttttcagatgccaggactctgcacaggatctttatttgtggctgaatttttcccttcattgtatactggcaaaatttttcagtgttgtattttgaagtgtgatccagtaggtg

SEQ ID NO: 23896 - DNA, 601 bp, Human
ctgggccactatgctggaaactggccttgagccttgtggagtaacggcaggtggagccatctcactgctcccacgcaccatgcccgtggcctctgcgggggctgtggtaacggcacccgactgctctggggtcaatgcctgcggaggtccccctggcttcagtgttgcctctgcaaaaaccccagttgcagccaggtgcggtggctcacgcttgtaatcccagcactttgggaggccgaggcaggtggatcacttgaagtcaggagttcaagaccagcctggccaacatggtgaaaccccrtttctactaaaaatacaaaaattatccaggcatggtggtgggcacctgtaatcccagctactcggaaggctgaggcagcagaattgcttgaacccgggaggcggaggagctgagattgcaccactgcactgcagcctgggcgacaaaacaagactctgtctcgaaaaataataacaataaaaaataaagatggcaaccatagacactggagactactagatgggggggaagaaagggggttgaaaaactgcctattgggtactatgctcagtacctgggtgacaggatcaatcgtactcc

SEQ ID NO: 23897 - DNA, 601 bp, Human
ggttcacgccattctcctgccccaatctcccgagtagctgggactacacgcgcccgccaccacgtcctgctaattttttgtattttcagtagacacggggtttcaccgtgttagccaggatggtcttgatatcgtcaccttgtgatccacccgcctcggcctcccaaagtgctgggaatacaggcgtgagctaccgcacccggcctaaatttttttttaaataaagaatggtaggttcttcacaccctaatgtatttttacttctcccacagagaaggaaaggaatggcttccccatggcragccacctcagtctgggctttcttttcttccaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtg

SEQ ID NO: 23898 - DNA, 601 bp, Human
gcttccccatggcgagccacctcagtctgggctttcttttcttccaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagrttccggtacagtgacaccctggagctggtagtgacaggtaaggaaacatccagggtccacagccctggtgtgatttttttcttatttttaatagagtatttttcaagaagttttagatttacaaacaaaaaaaaattgatgattgcttcagagagttctcagccatctggcaccccacttcccccagagttaacatcttacattagtatggcacatttcttaccattaatgaacaaatatcgacacattcccagctacagtctacagtttatttacattttcttagtttttacctgatag

SEQ ID NO: 23899 - DNA, 601 bp, Human
gagccacctcagtctgggctttcttttcttccaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtracaccctggagctggtagtgacaggtaaggaaacatccagggtccacagccctggtgtgatttttttcttatttttaatagagtatttttcaagaagttttagatttacaaacaaaaaaaaattgatgattgcttcagagagttctcagccatctggcaccccacttcccccagagttaacatcttacattagtatggcacatttcttaccattaatgaacaaatatcgacacattcccagctacagtctacagtttatttacattttcttagtttttacctgatagtctttctctgttc

SEQ ID NO: 23900 - DNA, 601 bp, Human
ccctggagctggtagtgacaggtaaggaaacatccagggtccacagccctggtgtgatttttttcttatttttaatagagtatttttcaagaagttttagatttacaaacaaaaaaaaattgatgattgcttcagagagttctcagccatctggcaccccacttcccccagagttaacatcttacattagtatggcacatttcttaccattaatgaacaaatatcgacacattcccagctacagtctacagtttatttacattttcttagtttttacctgatagtctttctctgttccagratcccattcaagatttcacattgcggctgggagtggtggctcacgcctgtaatcccaacacttagggaagccgaggcgggtggatcacccaaggtcaggagttcgagaccagcctggccaacatggtgaattccccgtctctactgaaaatgcaacaatcgccgggcgcggtggctcacgcctgtaatcccaacactttgggtggctgaggtgggtggatcacctgaggtcaggagttcgagaccagcctggccaacacagtgaaacctcgtctctactaaaaatggaaaaaattggcca

SEQ ID NO: 23901 - DNA, 601 bp, Human
tcccccagagttaacatcttacattagtatggcacatttcttaccattaatgaacaaatatcgacacattcccagctacagtctacagtttatttacattttcttagtttttacctgatagtctttctctgttccagaatcccattcaagatttcacattgcggctgggagtggtggctcacgcctgtaatcccaacacttagggaagccgaggcgggtggatcacccaaggtcaggagttcgagaccagcctggccaacatggtgaattccccgtctctactgaaaatgcaacaatcgcygggcgcggtggctcacgcctgtaatcccaacactttgggtggctgaggtgggtggatcacctgaggtcaggagttcgagaccagcctggccaacacagtgaaacctcgtctctactaaaaatggaaaaaattggccaggcctggtggcacacgcctgtaatcccagctacttgggaggctgaggcaggagaatcgcttgaacccaggaggcagaggttgcagtgagccaagatcacaccactgcactccaggctgggcgacagggcgagactccatctcacacacacacacacaaaaaga

SEQ ID NO: 23902 - DNA, 601 bp, Human
gtctcaatcttctgacctcgtgatccgcccgcctggcctcccaaagtgctgggattactggcgtgagccaccacgcccggcccccgaaaatgctgggattacaggcatgagccaccgcacctggcctcccaaagtgctgggattccaggcgtgagccaccgtgcccggcaggtgtcatgtatctttaggtttgtcttggctgtcacagcttctcagatgttgctggttttccatgaccttgtcagttttgagggtagtggtccattattttcaagggtactcccactactggaaattgtcygatgttttgctcatgactagactgagttatgggtcattgcaggcaagaccacagaagcaaagtgccatttcatctcctcatagcaaaggtttaaactgtccatgggaacatgactgtggatgttgagctggctgttgttgaaagcctggctgaagtagtaactgtggccagacaccgtggctcgtgcctgtaatcccagcactttgagaggccgagatgggcagatcacttaagcccaggagaccagcctgggcaacatagtaagaccccatctgtacaaaaaatcaaaaaattagctgg

SEQ ID NO: 23903 - DNA, 601 bp, Human
gccaccgcgcctggccaggctgcacacattcttattaggattccaccttgttctggtgttgtagagatgtgattaggtatttagtgaattcaccaagtgaggagagaatgaaaagaaaacacaacctgcctggccgggcgtggtggcgtgagcctgtcgtcccagctactcaggaggctgaggcaggagaatcacttgaacccaggaggcagctgttgcagtgagccaagatcacgccattgcactccagcctgggtgacagaacgagactccacctcaagaaaaaaaaaaaaaacacggytgggcacgatggctcacgcctgtaatctgagcacattgggaggctgaggcaggtggatcacctgaggtcgggagttcgagaccagcctggccaacatagtgaaaccccatctccactaaaaatacaaaaattaaccaggcgtggtggtggtgggcgcctgtaatcccagctacttgggaggctgaggcaggagaatcacttgaccagggaggcggaggttgcagtgagccgagatcacgccactgcactccagcctgggcaacagagtgagactccatctcaaaaaaaaaaaaaaaaaaa

SEQ ID NO: 23904 - DNA, 601 bp, Human
attcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttytgattttttatatcctgtttaatttcttccttcattgttcttctctttttttatttattttatttatttttatttttatttttatttgagacagagtctcactctgttgcccaggctggagtgcagtggcacgatctcggctcactgcaacctctgcctcctgggttcaagtgattctcctgcctcggcctcccaagtagctgggattacaggctcccaccatcacgcccagctacttttacagtatttttagtagagacggggtttcatcacattggccaagctggtctcaaacttctg

SEQ ID NO: 23905 - DNA, 601 bp, Human
gcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttktatatcctgtttaatttcttccttcattgttcttctctttttttatttattttatttatttttatttttatttttatttgagacagagtctcactctgttgcccaggctggagtgcagtggcacgatctcggctcactgcaacctctgcctcctgggttcaagtgattctcctgcctcggcctcccaagtagctgggattacaggctcccaccatcacgcccagctacttttacagtatttttagtagagacggggtttcatcacattggccaagctggtctcaaacttctgacctcgtg

SEQ ID NO: 23906 - DNA, 601 bp, Human
tgctacttaaacaggtatttatttctcccagttctaaaggctgggaagtccaaaagcaagatactcacacacagatacttaacttcatgtttataaagtggaaataggttgtcttttctaaaaaagtattctgtttagcgaatggtcttatgtctctcaaaataagagaatcacagacagatgcttaacttcatgtttacaaagtggatgtaggttgtctttgtcttaaattctactctttgaagttaattagattatgtacacactggtttttctgtcctattacttcttagcatatctrtgtagatactaactttttaatttttaaaatgttttgttttttgtgtaagtcatgttggtaagtatttttgtgtcattatgataagatagaatttagttgaaaatcaattcttttacacagtgattttcaaagagaagacacttctttaactagcgtggggttatccaagtggggagctgggcttagtgtcctctccaaaaccccagggatgctgggactctaaggacatgctctgtgatctgatctgtcctctgccttctaccctttgtctacaggcattctggaatttatcagtatagc

SEQ ID NO: 23907 - DNA, 601 bp, Human
acactggtttttctgtcctattacttcttagcatatctatgtagatactaactttttaatttttaaaatgttttgttttttgtgtaagtcatgttggtaagtatttttgtgtcattatgataagatagaatttagttgaaaatcaattcttttacacagtgattttcaaagagaagacacttctttaactagcgtggggttatccaagtggggagctgggcttagtgtcctctccaaaaccccagggatgctgggactctaaggacatgctctgtgatctgatctgtcctctgccttctaycctttgtctacaggcattctggaatttatcagtatagcagtgggcctggtcagcattcgaggcgtggacagtggactctacctcgggatgaatgagaagggggagctgtatggatcagtaagtactggagggacttcatccagctttatctccatgtttgatttgaacagctgtcttttctctggattaaaaagggccagaaatgcaactgagtctgtttggaaggcgagtgtaagtttttactttttgaggaaagccattttatttttattaatagataaacagctctgcaccttcact

SEQ ID NO: 23908 - DNA, 601 bp, Human
cctattacttcttagcatatctatgtagatactaactttttaatttttaaaatgttttgttttttgtgtaagtcatgttggtaagtatttttgtgtcattatgataagatagaatttagttgaaaatcaattcttttacacagtgattttcaaagagaagacacttctttaactagcgtggggttatccaagtggggagctgggcttagtgtcctctccaaaaccccagggatgctgggactctaaggacatgctctgtgatctgatctgtcctctgccttctaccctttgtctacaggcrttctggaatttatcagtatagcagtgggcctggtcagcattcgaggcgtggacagtggactctacctcgggatgaatgagaagggggagctgtatggatcagtaagtactggagggacttcatccagctttatctccatgtttgatttgaacagctgtcttttctctggattaaaaagggccagaaatgcaactgagtctgtttggaaggcgagtgtaagtttttactttttgaggaaagccattttatttttattaatagataaacagctctgcaccttcactagaccaaagttgctaa

SEQ ID NO: 23909 - DNA, 601 bp, Human
cctctctgtgcctcagttgactcatcggaaaaactgaggacaaaacatccacatcccagggatgttgcatggattcacgagcagccacagaacccctggggccccgggaaccctgcggccggcggggtcccccgtcgcacgctctccggccctaggaggagcccgaggctgcggagggcgggtccgcgaggccgggtgccggggccgggggaaaagcgccggggtggacggcggcaggtgaccttccccatttggccatgccttcctggggaccgcggcctggaaaaagggacgtaggctrcgcggcctcggcggcggaaaggccgcgcgggccggtaagtcggggggcagcaacaggaggccactcaccaccacatgcgccccgggcagggcgaggggcttggggctgatgagcggagacaccatgtacagcagcagcacgaaggccacgaggaaggcggcagccagcagcagcatcgctccgcggggccaggggcccggagcggccgggcgggggccgccgggcaaggcgcgcagggctgggctgcggcgaggcgagaatcacgcgcggcgggcgggcgcctggagtgtttgggtttgc

SEQ ID NO: 23910 - DNA, 601 bp, Human
gagtcacttcctggaatcctctggcagcggctcttcccgtcactcgcacaggccatcttccagttccgagctgcctcggcgggtcccggcggctgggaccccacttccccgctgtctgcccccgcccggggccgcgcgccgcaccctgcacaccaccgaccgctgtgtccttggcaaagtttctcagcctctctgtgcctcagttgactcatcggaaaaactgaggacaaaacatccacatcccagggatgttgcatggattcacgagcagccacagaacccctggggccccgggaacccygcggccggcggggtcccccgtcgcacgctctccggccctaggaggagcccgaggctgcggagggcgggtccgcgaggccgggtgccggggccgggggaaaagcgccggggtggacggcggcaggtgaccttccccatttggccatgccttcctggggaccgcggcctggaaaaagggacgtaggctacgcggcctcggcggcggaaaggccgcgcgggccggtaagtcggggggcagcaacaggaggccactcaccaccacatgcgccccgggcagggcgaggggcttggggctgatgag

SEQ ID NO: 23911 - DNA, 601 bp, Human
ctaaaaacaactttggcaagacaaaaacaaaccctgacaaaaaataaaaacagattctgtgttgacttaatacagaaaaacacattttgctaaacttctaaggagggacgaggttcctctatggtgtatagatttcactagagatatatatcatgtcctaagcaaatcgtagtgaaaaattatagagaaacacctacacaccttcaggtatcagctccagaatcactgcttccagcacttctgacctggccaagggccctccctggcttccaatggccaggtgtgctccttcaactagacmttggcctctcccatctcaggatctgcagtatctatgatgatgttgcctaatatgccaatggtactaaataaatacttgtggggccgacctgatttcaacagagaagtgtttggcctaaatactagagagaatcagtagttcaggaaacacatctcacatcaaggaagaagcgctttctaggtgtgaatgctaagatgtttagcacagcctctttgactaatttcaagtcgaagaagcaagtcagtaataatgaacctagaagccttacctcatttcgtgcaaccagagttataaaagctc

SEQ ID NO: 23912 - DNA, 601 bp, Human
tgggtgaatccaagatccccatggaagtatgccatgctgacattcccaggcactccatcattcctcccttcatttcttcattcaacaaacatgtctgagcatgtactacgtgtcaagcactagaattgctgcagcggacgagccagctgtgtggtcactttcctccagtccccatatggggagcaagaggacgtcatgacagttcacgtgcacagtgtcactgctttgtgctctaaaaacaactttggcaagacaaaaacaaaccctgacaaaaaataaaaacagattctgtgttgacttratacagaaaaacacattttgctaaacttctaaggagggacgaggttcctctatggtgtatagatttcactagagatatatatcatgtcctaagcaaatcgtagtgaaaaattatagagaaacacctacacaccttcaggtatcagctccagaatcactgcttccagcacttctgacctggccaagggccctccctggcttccaatggccaggtgtgctccttcaactagaccttggcctctcccatctcaggatctgcagtatctatgatgatgttgcctaatatgccaatggtactaaa

SEQ ID NO: 23913 - DNA, 601 bp, Human
tgaagtgagaggattggttgagcctgggaggcggaggttgcagtgagccgagattgtgtcactgcactccagcctgggtgacacagtgaggccgggcgcagtggctcacgcctgtaagcccagcactttgggaggccgaggtgggtggatcacttaaggtcaggagtttgagaccagcctggccaacatagtaaaaccctgtctctactaaaaaaaatatatatatatatataatatatatatataaaatatatatataatatataatatatataataaaaatatatattttatatatatrtaaatatatatacacacacacacacacacaaatcagccaggtgtggttacacacacctgtaatcccaggtattccggaggtggaggttgcagtgagccaagacagcgccactgcacaccagcctgggttacagagcaaaactccgtctcaaaaaaaaaaaaaaaaaaaaaaaaaaaagaatgaattactcaacaccacaggttcttcattcagttcattcatttctagcaatgcaagggccccatatgagctcctgggggcctgaaatgctggccttctctgcctccacttttatttact

SEQ ID NO: 23914 - DNA, 601 bp, Human
aagcatggtggcgagcacctgtggtcccagatactcaagaggctgaagtgagaggattggttgagcctgggaggcggaggttgcagtgagccgagattgtgtcactgcactccagcctgggtgacacagtgaggccgggcgcagtggctcacgcctgtaagcccagcactttgggaggccgaggtgggtggatcacttaaggtcaggagtttgagaccagcctggccaacatagtaaaaccctgtctctactaaaaaaaatatatatatatatataatatatatatataaaatatatatataatatataatatatataataaaaatatatattttatatatatataaatatatatacacacacacacacacacaaatcagccaggtgtggttacacacacctgtaatcccaggtattccggaggtggaggttgcagtgagccaagacagcgccactgcacaccagcctgggttacagagcaaaactccgtctcaaaaaaaaaaaaaaaaaaaaaaaaaaaagaatgaattactcaacaccacaggttcttcattcagttcattcatttctagcaatgcaagggccccatatgagctcctgg

SEQ ID NO: 23915 - DNA, 601 bp, Human
ccaagcatggtggcgagcacctgtggtcccagatactcaagaggctgaagtgagaggattggttgagcctgggaggcggaggttgcagtgagccgagattgtgtcactgcactccagcctgggtgacacagtgaggccgggcgcagtggctcacgcctgtaagcccagcactttgggaggccgaggtgggtggatcacttaaggtcaggagtttgagaccagcctggccaacatagtaaaaccctgtctctactaaaaaaaatatatatatatatataatatatatatataaaatatatatataatatataatatatataataaaaatatatattttatatatatataaatatatatacacacacacacacacacaaatcagccaggtgtggttacacacacctgtaatcccaggtattccggaggtggaggttgcagtgagccaagacagcgccactgcacaccagcctgggttacagagcaaaactccgtctcaaaaaaaaaaaaaaaaaaaaaaaaaaaagaatgaattactcaacaccacaggttcttcattcagttcattcatttctagcaatgcaagggccccatatgagctcct

SEQ ID NO: 23916 - DNA, 601 bp, Human
aaatacaaaaacttagccaagcatggtggcgagcacctgtggtcccagatactcaagaggctgaagtgagaggattggttgagcctgggaggcggaggttgcagtgagccgagattgtgtcactgcactccagcctgggtgacacagtgaggccgggcgcagtggctcacgcctgtaagcccagcactttgggaggccgaggtgggtggatcacttaaggtcaggagtttgagaccagcctggccaacatagtaaaaccctgtctctactaaaaaaaatatatatatatatataatatatatatataaaatatatatataatatataatatatataataaaaatatatattttatatatatataaatatatatacacacacacacacacacaaatcagccaggtgtggttacacacacctgtaatcccaggtattccggaggtggaggttgcagtgagccaagacagcgccactgcacaccagcctgggttacagagcaaaactccgtctcaaaaaaaaaaaaaaaaaaaaaaaaaaaagaatgaattactcaacaccacaggttcttcattcagttcattcatttctagcaatgcaaggg

SEQ ID NO: 23917 - DNA, 601 bp, Human
caaaaatacaaaaacttagccaagcatggtggcgagcacctgtggtcccagatactcaagaggctgaagtgagaggattggttgagcctgggaggcggaggttgcagtgagccgagattgtgtcactgcactccagcctgggtgacacagtgaggccgggcgcagtggctcacgcctgtaagcccagcactttgggaggccgaggtgggtggatcacttaaggtcaggagtttgagaccagcctggccaacatagtaaaaccctgtctctactaaaaaaaatatatatatatatataatatatatatataaaatatatatataatatataatatatataataaaaatatatattttatatatatataaatatatatacacacacacacacacacaaatcagccaggtgtggttacacacacctgtaatcccaggtattccggaggtggaggttgcagtgagccaagacagcgccactgcacaccagcctgggttacagagcaaaactccgtctcaaaaaaaaaaaaaaaaaaaaaaaaaaaagaatgaattactcaacaccacaggttcttcattcagttcattcatttctagcaatgcaa

SEQ ID NO: 23918 - DNA, 601 bp, Human
taccaaaaatacaaaaacttagccaagcatggtggcgagcacctgtggtcccagatactcaagaggctgaagtgagaggattggttgagcctgggaggcggaggttgcagtgagccgagattgtgtcactgcactccagcctgggtgacacagtgaggccgggcgcagtggctcacgcctgtaagcccagcactttgggaggccgaggtgggtggatcacttaaggtcaggagtttgagaccagcctggccaacatagtaaaaccctgtctctactaaaaaaaatatatatatatatatattatatatatataaaatatatatataatatataatatatataataaaaatatatattttatatatatataaatatatatacacacacacacacacacaaatcagccaggtgtggttacacacacctgtaatcccaggtattccggaggtggaggttgcagtgagccaagacagcgccactgcacaccagcctgggttacagagcaaaactccgtctcaaaaaaaaaaaaaaaaaaaaaaaaaaaagaatgaattactcaacaccacaggttcttcattcagttcattcatttctagcaatg

SEQ ID NO: 23919 - DNA, 601 bp, Human
tctaccaaaaatacaaaaacttagccaagcatggtggcgagcacctgtggtcccagatactcaagaggctgaagtgagaggattggttgagcctgggaggcggaggttgcagtgagccgagattgtgtcactgcactccagcctgggtgacacagtgaggccgggcgcagtggctcacgcctgtaagcccagcactttgggaggccgaggtgggtggatcacttaaggtcaggagtttgagaccagcctggccaacatagtaaaaccctgtctctactaaaaaaaatatatatatatatataatatatatatataaaatatatatataatatataatatatataataaaaatatatattttatatatatataaatatatatacacacacacacacacacaaatcagccaggtgtggttacacacacctgtaatcccaggtattccggaggtggaggttgcagtgagccaagacagcgccactgcacaccagcctgggttacagagcaaaactccgtctcaaaaaaaaaaaaaaaaaaaaaaaaaaaagaatgaattactcaacaccacaggttcttcattcagttcattcatttctagcaa

SEQ ID NO: 23920 - DNA, 601 bp, Human
cgtctctaccaaaaatacaaaaacttagccaagcatggtggcgagcacctgtggtcccagatactcaagaggctgaagtgagaggattggttgagcctgggaggcggaggttgcagtgagccgagattgtgtcactgcactccagcctgggtgacacagtgaggccgggcgcagtggctcacgcctgtaagcccagcactttgggaggccgaggtgggtggatcacttaaggtcaggagtttgagaccagcctggccaacatagtaaaaccctgtctctactaaaaaaaatatatatatatatataatatatatatataaaatatatatataatatataatatatataataaaaatatatattttatatatatataaatatatatacacacacacacacacacaaatcagccaggtgtggttacacacacctgtaatcccaggtattccggaggtggaggttgcagtgagccaagacagcgccactgcacaccagcctgggttacagagcaaaactccgtctcaaaaaaaaaaaaaaaaaaaaaaaaaaaagaatgaattactcaacaccacaggttcttcattcagttcattcatttcta

SEQ ID NO: 23921 - DNA, 601 bp, Human
cccgtctctaccaaaaatacaaaaacttagccaagcatggtggcgagcacctgtggtcccagatactcaagaggctgaagtgagaggattggttgagcctgggaggcggaggttgcagtgagccgagattgtgtcactgcactccagcctgggtgacacagtgaggccgggcgcagtggctcacgcctgtaagcccagcactttgggaggccgaggtgggtggatcacttaaggtcaggagtttgagaccagcctggccaacatagtaaaaccctgtctctactaaaaaaaatatatatatatatataatatatatatataaaatatatatataatatataatatatataataaaaatatatattttatatatatataaatatatatacacacacacacacacacaaatcagccaggtgtggttacacacacctgtaatcccaggtattccggaggtggaggttgcagtgagccaagacagcgccactgcacaccagcctgggttacagagcaaaactccgtctcaaaaaaaaaaaaaaaaaaaaaaaaaaaagaatgaattactcaacaccacaggttcttcattcagttcattcatttc

SEQ ID NO: 23922 - DNA, 601 bp, Human
gccccgtctctaccaaaaatacaaaaacttagccaagcatggtggcgagcacctgtggtcccagatactcaagaggctgaagtgagaggattggttgagcctgggaggcggaggttgcagtgagccgagattgtgtcactgcactccagcctgggtgacacagtgaggccgggcgcagtggctcacgcctgtaagcccagcactttgggaggccgaggtgggtggatcacttaaggtcaggagtttgagaccagcctggccaacatagtaaaaccctgtctctactaaaaaaaatatatatatatatataatatatatatataaaatatatatataatatataatatatataataaaaatatatattttatatatatataaatatatatacacacacacacacacacaaatcagccaggtgtggttacacacacctgtaatcccaggtattccggaggtggaggttgcagtgagccaagacagcgccactgcacaccagcctgggttacagagcaaaactccgtctcaaaaaaaaaaaaaaaaaaaaaaaaaaaagaatgaattactcaacaccacaggttcttcattcagttcattcatt

SEQ ID NO: 23923 - DNA, 601 bp, Human
aagccccgtctctaccaaaaatacaaaaacttagccaagcatggtggcgagcacctgtggtcccagatactcaagaggctgaagtgagaggattggttgagcctgggaggcggaggttgcagtgagccgagattgtgtcactgcactccagcctgggtgacacagtgaggccgggcgcagtggctcacgcctgtaagcccagcactttgggaggccgaggtgggtggatcacttaaggtcaggagtttgagaccagcctggccaacatagtaaaaccctgtctctactaaaaaaaatatatatatatatataatatatatatataaaatatatatataatatataatatatataataaaaatatatattttatatatatataaatatatatacacacacacacacacacaaatcagccaggtgtggttacacacacctgtaatcccaggtattccggaggtggaggttgcagtgagccaagacagcgccactgcacaccagcctgggttacagagcaaaactccgtctcaaaaaaaaaaaaaaaaaaaaaaaaaaaagaatgaattactcaacaccacaggttcttcattcagttcattca

SEQ ID NO: 23924 - DNA, 601 bp, Human
gccaaggtgagtggatcacccaagctcaggagtttgagaccagcctgggcaacatggtgaagccccgtctctaccaaaaatacaaaaacttagccaagcatggtggcgagcacctgtggtcccagatactcaagaggctgaagtgagaggattggttgagcctgggaggcggaggttgcagtgagccgagattgtgtcactgcactccagcctgggtgacacagtgaggccgggcgcagtggctcacgcctgtaagcccagcactttgggaggccgaggtgggtggatcacttaaggtcargagtttgagaccagcctggccaacatagtaaaaccctgtctctactaaaaaaaatatatatatatatataatatatatatataaaatatatatataatatataatatatataataaaaatatatattttatatatatataaatatatatacacacacacacacacacaaatcagccaggtgtggttacacacacctgtaatcccaggtattccggaggtggaggttgcagtgagccaagacagcgccactgcacaccagcctgggttacagagcaaaactccgtctcaaaaaaaaaaaaa

SEQ ID NO: 23925 - DNA, 601 bp, Human
tacagttctaataaatgtcttattatttagttgtgatataagacaagaacaactctattaatatgtactgctccccaaagttgagggtatgtgtgactccctgtcaatactgctttttgtccaatattttcttcttctactataaacccaaacatagtaagaatcactttctggatagactgggtaaactaggcctggctactataaaatactcttaagcaaggttacctgtgtaattatgtaattcttccaaggtcctaattttgtttgttttacttagtctcaagaaaacagatatcakattatcttaatttgctgtaaaaagtaacttaaataatatcatgcaatagagaggaaccaaaggagaggcgaattcttccaaaaggcatgcagagtttctaaacctgaatatgtctataatgaaataatattgtcctatgactaaagatacatacagcttgactttgcaaagactggaattaaaaattacattagaaaagaaagaatttctcagccaggcatggtggctcacccctgtaatcccagcactttgggaggccaaggtgagtggatcacccaagctcaggagtttgagaccagc

SEQ ID NO: 23926 - DNA, 601 bp, Human
tgcttgagcccaggaggtcgaggctgcagtgagctgagatcgcacccctgcactccagcctggatgacagattgagacactgcctcaaaaaaaaaaaaaaaaaaaaaaaggaaagaaaaaagaaaagaaaaagaaaggattaacaccaaaaatcgggttggcatttgcccctctaggaacaagaaaagagggacaaggctgctgtgggggcttcagagaccctgatcatttctacttcttaggctgggtgatgggtgtgtgattattaatttgctattatgttttatactgaaatataaayagcattttattcatcaaaaattccataaccaaataaattttaaatattcctttcctcttaagcatttgtataaagttcattaaaaaaaaaattaaaatgaaattatttgccagtaaaacattctgttatttgaccatttgtagatatgaatgtgtgtgggagtctattcattttgcgtgtgtgtgatattctgagttactagaccattcaaacaattccaccttttaaaaaacagtacatatatgctttcaattaactattcacaggtgaagtaactctgtttttcctttatacagctgt

SEQ ID NO: 23927 - DNA, 601 bp, Human
ctactagggaggctgaggtgggaggactgcttgagcccaggaggtcgaggctgcagtgagctgagatcgcacccctgcactccagcctggatgacagattgagacactgcctcaaaaaaaaaaaaaaaaaaaaaaaggaaagaaaaaagaaaagaaaaagaaaggattaacaccaaaaatcgggttggcatttgcccctctaggaacaagaaaagagggacaaggctgctgtgggggcttcagagaccctgatcatttctacttcttaggctgggtgatgggtgtgtgattattaatttgytattatgttttatactgaaatataaatagcattttattcatcaaaaattccataaccaaataaattttaaatattcctttcctcttaagcatttgtataaagttcattaaaaaaaaaattaaaatgaaattatttgccagtaaaacattctgttatttgaccatttgtagatatgaatgtgtgtgggagtctattcattttgcgtgtgtgtgatattctgagttactagaccattcaaacaattccaccttttaaaaaacagtacatatatgctttcaattaactattcacaggtgaagt

SEQ ID NO: 23928 - DNA, 601 bp, Human
aaattgattttgatgacagttgcacaactctatgaatacattaaaaatcattgaattatatattttaaatgggtcaactgtatggtatataaattatatctcataaagctgttaaaaaataagaatgatataataaaagaagtagaactaagtatattggccaggcatggtggctcacgcccataatcacaggactttgggaggccaaggcaggcagatcacctgaggtcaggagtttgagactagcctgacaaacatggtaaaaccctgtctctactaaaaatacaaaaaaaattagccrggtgtggtggcacacacctgtaatcccagctactcaggaggctgaggcaggagaatcgcttgaacccgagaggtggaggttgcagtgagccaagatggcaccactgcactccagcctgggtgacagagagagactctgtctcaaaaaaaaaaaaaaaaaaaaaagaactaaacaatatattattatttagagttatgtgcatatatggtaaaattaaaaagaaaaagaggcagggcacagtggctcactcctataataccagcactttgggaggcagaggtaggcggactgcttgagccc

SEQ ID NO: 23929 - DNA, 601 bp, Human
ctccatctcaaaaataaataaataaataagaaataaataataataatattgagtgaagaaatcaagttgcataagaagcataaagaaggaagttatacaaatctatagagaaagaaagtagatgagtgactgcctagctgagaagaggctgggaggaaatggcaagtgactgctaatacacatggagattcttcacggggtgaggaaaacattctaaaattgattttgatgacagttgcacaactctatgaatacattaaaaatcattgaattatatattttaaatgggtcaactgtatgrtatataaattatatctcataaagctgttaaaaaataagaatgatataataaaagaagtagaactaagtatattggccaggcatggtggctcacgcccataatcacaggactttgggaggccaaggcaggcagatcacctgaggtcaggagtttgagactagcctgacaaacatggtaaaaccctgtctctactaaaaatacaaaaaaaattagccgggtgtggtggcacacacctgtaatcccagctactcaggaggctgaggcaggagaatcgcttgaacccgagaggtggaggttgca

SEQ ID NO: 23930 - DNA, 601 bp, Human
caatctctgctcacctcaagctttgcctcccagatccaagtgattctcctgcctcagcctccctcctgagtagctggggttacaggtgcagctaactttttatatttttagtagagacagggtttcaccactttgtccaggctgatctcaaacacctaccttcaactgatttgcccgtctcggcctctcaaaatgttgggattacaggcatgagccaccgcacctggcctaaagaataatattgagtggtctgggcatggtggctcacacctgtaatcccagcactttcagaggctgaggygggcggatcacgaggttgggagttcgagaccagcctgatcaacatggtgaaaccctgtctctactaaaaatacaaaaattagctgggcgtagtgacgcgcgcctgtaatcccaactacccaggaagctgaggcttgaacccaggaggcagaggttgcagtgagctgagattgtgccactgcactccagactgggcaacagagcgagactccatctcaaaaataaataaataaataagaaataaataataataatattgagtgaagaaatcaagttgcataagaagcataaagaaggaagt

SEQ ID NO: 23931 - DNA, 601 bp, Human
cattctcgcctgccccagccctatctcccttccttgatgtgaaaggtaagttttccacctgacctaaagtcctttggtagatgaagaggtagaaggtgtcatgatgaggaagcccagagcggagacagtgttggcagcaggcaagactggccttggccctgaacactgactccatgacttcacaccatactccttcgtctatcagatattacaggaatacgggaaaaaacggggcaatttacagagctggtgtttttccaatgcttgtgggcttcagagaagggggtaaagaccacagtcytagagaaaaactcacatgtgcagaagatatacacaaggatttttacttgcagcacagactgcaattgcaaaaataaaaatacaaaataaaataaaaagaatggaaacagctcaatagcagggacctgacggaataagctctggtgtacttcaatcctaggctgcagcaatttaaggcaaatttacttaatgcacatggaaagatctctaacattctagaagggaaaaagtcaatgaataccacagtgaaatactattcaaaactcatcagaaaggcaaaaagtaaaaagtctgtcaatac

SEQ ID NO: 23932 - DNA, 601 bp, Human
acaatttaccagcatgtccactggacccagtttctcctgtgcctagaaaaatgtagcagagcaggcattaagaaacagagaagaaaaaccactcagcagcaaatccatgctgataaataaaatttacaaaactattaaacctatagagaagttgtgtccattccaagccacatagcaaaatggcaagaacaaatcaaaagtcaagcacattggtgaattccaattagcccaacctcttacttgttttatgacattctctacttggttatagtcttgagatacatcaactgatatgcaaagyaccacctgttaaaaaagaaaaaaagtgatcaaagttttgcaggtaccaaactatttcttaaagatattttttaaagaaaagacagttcattgaatacagaaggaagccaatattgaatgaacagatttcagtgtttgctgatgatgcaattagcagaatctaattttcttggcagcttttggagttaaaactctgaggaatctttttaaaaatatataaatgctcctcttgaaatgccactaatctatagtgacagaaggcagatcaggggttgcccacagccaggcatggaggatggaa

SEQ ID NO: 23933 - DNA, 601 bp, Human
gacatctgaatgcattcatctaattgattcttaaagcttttacccgtagcttgctctgcttttagcatatgtgctactgcagtgagcaaacatttttacttacttcaaaggtactaacttcaagatcttcaaattttcctgacactgccattcctgcacaatttaccagcatgtccactggacccagtttctcctgtgcctagaaaaatgtagcagagcaggcattaagaaacagagaagaaaaaccactcagcagcaaatccatgctgataaataaaatttacaaaactattaaacctayagagaagttgtgtccattccaagccacatagcaaaatggcaagaacaaatcaaaagtcaagcacattggtgaattccaattagcccaacctcttacttgttttatgacattctctacttggttatagtcttgagatacatcaactgatatgcaaagcaccacctgttaaaaaagaaaaaaagtgatcaaagttttgcaggtaccaaactatttcttaaagatattttttaaagaaaagacagttcattgaatacagaaggaagccaatattgaatgaacagatttcagtgtttgctgatg

SEQ ID NO: 23934 - DNA, 601 bp, Human
cacttgaacttgagaggtggaggttgcagtgagctgagatcacgccactgcactccagcctgagtgacagagtgaaattccatctcaaaaaaagaaaaaataaaaatttcaaatctagtgttcatttctttggtgctgaaataaattaccaagagaagttccttggtaaacctgattaaaaatagaaacatcaataagatgcagtatctttttatcttgatttgagaactctagtgagtctgtccttcaacttttttggtttctccttgttaataatactgatgtttgataggaacatccrgcatctcttaggttacaaagtgttctcttgaaaatatgacctcagtgaactgctacagtaatctgtgtcagattagaaggtccattcccattttagctggttttctcagctgtaaaatgtctaaactcttaagcttcaatggtcctgacactgggatgaaaaccttgttcagcttcaccttgttcagccttcctctagagtcttctaaagcttccatggacatctgaatgcattcatctaattgattcttaaagcttttacccgtagcttgctctgcttttagcatatgtgctactgcag

SEQ ID NO: 23935 - DNA, 601 bp, Human
aggcggagggggtgggtgcacctcattgtgaatatgctgaatccctctgcatggctcactttaaaaacagttaattttatgttatatgaatttcacttcaaattaaaaaaataatgtaggacaatgaaaaaaaaaggcagttagatcttagatgtttttcccctctccacagggtagatctgtacccctcttccagcctggcaggagactggaggttctgtttctagggatagtaagtctagataaagagagaggtttaagggaaagtctgtctagacggcgcacacgaagacaccaacayactccccagcttcatcctcacaggaggctggaggacactccgcttgagcccgggaggcagaggttgcagtgagccgagatcgtgccactgtactccagcctcagcgacagagcaagactctgtctcaaaaaaaaggaagaaaaagattgttgatgcgatggcaactaaaaaacgttttccattttaaaaacatttcaggccgggcctggtggctcatgcctgtactcccagcactttgggaggtagaggtgggccagtcacctgaggtcaggagtttgagaccagccgggccaacgtggc

SEQ ID NO: 23936 - DNA, 601 bp, Human
atttgtaaaaatattagatcatcatgtaaataaaaactaaatacctcaattgtggaacttgagatcaatcataattttttttcatattatgaacagaacatgaacatacaatcataatatcttaattcaagagaatattagatttttttattgttgtttgtttgtatttgtttgaaatggagttttgctcttgtcacccaggctggagtacagtggtgtgatcttggctcactgtaacctctgcctcctgggttcaagcgattctcctgcctcagcctcccaagtagctgggattacaggygccagccaccatgcctagctaattttttgtatttttagtagagatagggtttcgccatgttgggcaggctggtctcgaactcctgacctcaagtgatctgcctgcctcggcctcccaaagtgttgggattacaggtgtgagccactgtacttggcctagataattgttttaaatgatgaccagaaacactgggagtgacagggaaaaatatctatgctatttaagtttaaaaagcagaagctagactgtatatatgctgtaactgtaattacttcaaaggttaagtaaaagtacacatgc

SEQ ID NO: 23937 - DNA, 601 bp, Human
ctgcccacccggcgctccttcatggtggtgatcacggcccggctggggtacacgctgcccaggtaattgatgctcattaacctctgcagggaacaaagaggccacatgaggtcaaaagcctcaaggctgtgcacatggagaatttagtctgctttctggatttcagttcttcaatgcaagctcaagtgactgggaagcccaacaggcttgctgaatgaatgaatgatgacatgatgatataaatgaaatgtgatttgagacctagcatttgaagactcaggacctaccatttgaagactgtttcagtctagtcttgcattctgaccatgacagcagttaatgtttttcctgaaaactggtcaaagttagttttctccttataaaaagtatactgcatgtttgtgggtagtactttctgaaagacagttttaggaaagaggttccaagtatttgtagccctattagttctaagctataagaaaaacacagagtaggagggtgatttaaagttttggtttcaagccttgggtctcccatttattgcctatttgatgatgaataagaaagtcagacattctacttattttcttggctgtaaaca

SEQ ID NO: 23938 - DNA, 601 bp, Human
agccaaggagctcagggctgcagtgagctatgattgtgccactgcgctccagcctgggcaacaaagagagacgctgtctctaaaaaaaaataataaaataaaaataaataaaacagttattcacaaaaggacttttcaaagttaaaaacttcaaaagaaacaccagtattcttgtttgaaatttcacagacatcagtgtcctattggctaagcatattatcacgatatattattaagagtattaggccagttgataacaataaaatctgtggctggttcctatggtatgagaatggcatgrtctatcagtccctacgcggcacatcaggactgtcgctgtcccagcagctcatctgtactgcaacgctcgtcccatatctcaccaatgtggtgctctatcacacaccatcaaggtctcttatggggtcttctaaacaggggtcagcaaattatggcctatgagccagatctggccctctgcctgttttttataagtaaagttttattggaacacagtgacaattgttcatttacacattgtctagtaaggctgctttcctgctatcatagcctacttaagtagctgtattaggcaccattc

SEQ ID NO: 23939 - DNA, 601 bp, Human
ctcctgtaatcccagaactttgggaggccaaggcaggtggatcacctgagtccaggaggtcaagaccagcccaggcaacatagcgagcgagaccccatgtctacaaaaaataaataaataaaaaataaacaaaaaaacggtgaggcatggtagtacacacttgtagtcccagctacttgggaggctgaggtgggaggactgcttgggcccaggaagtggaggctacagtgagccaagatcaaaccactgcactccagcctcggcaacaaagcaagactctgtcttcagaaaataaaaattaaaaaaaaaaaaaaagtatctggagtttgagcaattacataagatttcattgacagaaaacacacctaccttgaccaaattatccaggtttcaaaaaaaatgctactataattactgtagggacacaataattggtttgatgcaagttctactacgaacaaactacattttgatgactgcgttcgttttccccagaacctatttttcatgggataagttcattttattttcttttttttaagtgagggtatttttaatagagtccaaataaggacagaagtcatacagacttgagcgtgca

SEQ ID NO: 23940 - DNA, 601 bp, Human
gaagtctgctttccaaaagagtaacttttaaaatctttacctttcttcctaaaagactgagtaaaaaaaaaagactaaaaaatgccaacaaagcattcttttaaaattactcatagtacccttaacaatgccagggtcctaccttagtttgggggcaaagggaggtggacagggagacttcaaagttaattaaaccaaagaattgtcaaaaatatttacaggccagacacagtggctcacacctcctgtaatcccagaactttgggaggccaaggcaggtggatcacctgagtccaggagrtcaagaccagcccaggcaacatagcgagcgagaccccatgtctacaaaaaataaataaataaaaaataaacaaaaaaacggtgaggcatggtagtacacacttgtagtcccagctacttgggaggctgaggtgggaggactgcttgggcccaggaagtggaggctacagtgagccaagatcaaaccactgcactccagcctcggcaacaaagcaagactctgtcttcagaaaataaaaattaaaaaaaaaaaaaaagtatctggagtttgagcaattacataagatttcattgacagaaa

SEQ ID NO: 23941 - DNA, 601 bp, Human
ttactttcagaccacagaaggaagagatgggaggagaggggcatgatcagggtaagaaaagcagaaaagggagcatcagtttgttttttttgggcttggtctctgctaccacatctttagctataacccacctcagaagtctgctttccaaaagagtaacttttaaaatctttacctttcttcctaaaagactgagtaaaaaaaaaagactaaaaaatgccaacaaagcattcttttaaaattactcatagtacccttaacaatgccagggtcctaccttagtttgggggcaaagggaggyggacagggagacttcaaagttaattaaaccaaagaattgtcaaaaatatttacaggccagacacagtggctcacacctcctgtaatcccagaactttgggaggccaaggcaggtggatcacctgagtccaggaggtcaagaccagcccaggcaacatagcgagcgagaccccatgtctacaaaaaataaataaataaaaaataaacaaaaaaacggtgaggcatggtagtacacacttgtagtcccagctacttgggaggctgaggtgggaggactgcttgggcccaggaagtggaggct

SEQ ID NO: 23942 - DNA, 601 bp, Human
ccacataggatgtgctgttccctattccatcaaaacaaagacaggggatgctggaaagaagatcacagctgtttacatgaaactccagaattcaagctttagcttactttcagaccacagaaggaagagatgggaggagaggggcatgatcagggtaagaaaagcagaaaagggagcatcagtttgttttttttgggcttggtctctgctaccacatctttagctataacccacctcagaagtctgctttccaaaagagtaacttttaaaatctttacctttcttcctaaaagactgagtaaaaaaaaaagactaaaaaatgccaacaaagcattcttttaaaattactcatagtacccttaacaatgccagggtcctaccttagtttgggggcaaagggaggtggacagggagacttcaaagttaattaaaccaaagaattgtcaaaaatatttacaggccagacacagtggctcacacctcctgtaatcccagaactttgggaggccaaggcaggtggatcacctgagtccaggaggtcaagaccagcccaggcaacatagcgagcgagaccccatgtctacaaaaaataaataaataa

SEQ ID NO: 23943 - DNA, 601 bp, Human
ataaggttaagattctagtttcctgaaactcttggtcaaataatttgctaaaatctgaatatactaaaccacatctacatcttcttttaatctaccaatctcataaccctgtcataaacaaaaatgagggtaggctggctttacttgttcttatgagacaatgctagctccctgagatcaccactctttctaagaatggatgagccaggtcctcactaactgagtcccctgctgcccggccactgcttctcctcatccctgttgcctgaccattctctgtgcccccgactctgccccacayccatcctactattacttcttcccttctccctggcctcaacctcaaacagaaagacaactgaccacttgttcaagaaccgatttgtgggccgggtgcagtggctcacatatgtaatcccagcactttgggaggccgaggcaggcagatcacctgagttcaagaccagcctggccaacatggtgaaaccccatctctactaaaaatacaaaaattagccgggcatggtggtgggcacctgtaatcccacccacttgggaggctgagccaggagaatcgcttgaaccagggaggcagaggttt

SEQ ID NO: 23944 - DNA, 601 bp, Human
tccagtcgcttcctagattagtattctcgctatgccatccaaccaaatgactctcccagtctctggctggatacctccagtggctagtcacctcaccatttacatattattttatttattcatgcaacaacgagcacttactgaattacttctacatgccagtatcgttctaagaacaaagcataaggttaagattctagtttcctgaaactcttggtcaaataatttgctaaaatctgaatatactaaaccacatctacatcttcttttaatctaccaatctcataaccctgtcataaamaaaaatgagggtaggctggctttacttgttcttatgagacaatgctagctccctgagatcaccactctttctaagaatggatgagccaggtcctcactaactgagtcccctgctgcccggccactgcttctcctcatccctgttgcctgaccattctctgtgcccccgactctgccccacatccatcctactattacttcttcccttctccctggcctcaacctcaaacagaaagacaactgaccacttgttcaagaaccgatttgtgggccgggtgcagtggctcacatatgtaatccc

SEQ ID NO: 23945 - DNA, 601 bp, Human
ccctttttcgccctggttccttcagtgaagcacagttttgagggctttaaggggagcttcaaggggaaggagaagcacgcacaggcctgcaagcagaagatccaggccagccatcctggaaagtgcagtcgtgaaagtgagatgtctttgtgggttccattccagcacaattagggtgtgggacagcccatccaccgggcattgccagggcatgcagcttcacggcccagccatgctcataaatagctctggatcggggccaggtagtaaggcagatgagccagaaactcgcttccacttgtttttgagatagtgacttataaaaaccttgtctcccccagccttgccctctgctgtgcatagaccagagaaaaacaccacaaaaaatccaacgagtggtcattaggcagcccacataaagactgacatcgactgcccagaaactcacgtctgtgctgcccctctgccttctctctcatggtaaagaaggatgctggctccaaagctaatggaagacaggatttcagagcagtgcttctcaaactcaaggttacggctgcattgccaaaggttaaaacagagcttttcagaacagcttcct

SEQ ID NO: 23946 - DNA, 601 bp, Human
cacacgcactgcacagcatccaagccctttatcaaggcaatgggaccagtctgcccctcctttcttcaccagactgtacatctgtttttccttcagactgcttctgatactcttgtgttgatttcatccacaaaatacattggggtcattaaaatctgctgccctatccctttcttgtgccctactccaaacccagtccagaactgtccctgagaagtctgcttattccagagctccctgtataaccggcctctgcacattaggaggtcaagagtcacttcctcctccactgaaccaacargaaccactgggtagaacctccaagtcagaccagccaagtacctcccctgtggacaacctcaacctgcattcacatagggaaagccctctgccttatctgaaactctatgtggctcctctaaatctgacacttggagcaggttgttacacttgtgtgcctcaccaccatgcctgcacacttcacgcttcacgaccccactcatacacacacccccaacaattccagcagattcttctgctgttggccaggacaccccctcccacagactgctcagccacagccctgctgcacatgcttatc

SEQ ID NO: 23947 - DNA, 601 bp, Human
gtaggatactgacctttgttctgttttcttcggcaaagccaggtgtgtctgtgtctggtgggtaagcaactgtgatgtagacattatatggcttcacctgcatttcaaaacaacacgtgtaccttcagtaaacaagacacactgaggtcctacactgccaacctgcactggctgccctgattcccaaaaagcggtgagaacaatggggtgattctgttaggcggggaactacaccaattgcattgagaaacccctctccatgatgattccagaatgtaggcaaaaagctcaccctaacctrgaccccagaaaacagctggccctaaagtatggcaagtcacctcctttgcagtgtcttccactcctgctgcccagacagaggccctgggagccgtccgacgagggcagtgttttaaaaagagtccagttcccacacgcactgcacagcatccaagccctttatcaaggcaatgggaccagtctgcccctcctttcttcaccagactgtacatctgtttttccttcagactgcttctgatactcttgtgttgatttcatccacaaaatacattggggtcattaaaatctgctgccctatccc

SEQ ID NO: 23948 - DNA, 601 bp, Human
aggcactctacccaacaaacattgttgattggtgaaaacgagtgtgagctgaagagtagaaagaaaatcagaaaagcagtaaacattagaggttcaaattgggacatgtaggatactgacctttgttctgttttcttcggcaaagccaggtgtgtctgtgtctggtgggtaagcaactgtgatgtagacattatatggcttcacctgcatttcaaaacaacacgtgtaccttcagtaaacaagacacactgaggtcctacactgccaacctgcactggctgccctgattcccaaaaagcgktgagaacaatggggtgattctgttaggcggggaactacaccaattgcattgagaaacccctctccatgatgattccagaatgtaggcaaaaagctcaccctaacctggaccccagaaaacagctggccctaaagtatggcaagtcacctcctttgcagtgtcttccactcctgctgcccagacagaggccctgggagccgtccgacgagggcagtgttttaaaaagagtccagttcccacacgcactgcacagcatccaagccctttatcaaggcaatgggaccagtctgcccctccttt

SEQ ID NO: 23949 - DNA, 601 bp, Human
ttacgtgtaaattacccaatctcaggcatttatttatagtaatgcaagaacggactaatacactatccttccaccttagcctcctgagtagctggaacaattctaattttgcttatttttttgtagggaaagggtcttgctatgttgcctaggctggtctcgaactcctgggctcaatcaatcctcctgccatggcctcccaaagtactgggattacaggtgtgagacaccatggctggccttaaatttttatttttttatttttaattttaattttttttttttttagatattggttctygctctgtcacccaggtcgaaatgcagtactacaatcatggctcactgcagcctcaacctccctggctcaaatgatcctcccacctcagcctcctgagtagctggaactacaagcatgtgccaccatgcctggctaatttttaaattttttgtagagacagggttttgttatgttgcccaggctggtcttgaactcctggcctcaagtgatcttcttgcctaggcctcccaaagtgctgggattacaggcatgagccacactgtgcctggcctggtcttaaattttatcttccacggtaga

SEQ ID NO: 23950 - DNA, 601 bp, Human
accccaggagaaatgtctgaggaaaaaagaatgaatctaatagaatgtccaatgtgctcacatggatcaaaaggagaatctcagttctgtttgaatctgggactgaattagttatagataattacaaagctaagcaaatgaaaaggcaagaaaggaaatgtcactatagaatggtccaagtgtgcataatattaatatgagcactaaacctgatttaactaaagagatgggaggagtacacagggaatggggaacagatatgagtcttaatgtttttgttttgaaacaaggtcttactctrttgcccaggctggagtgcagtggcgcaatcttggctcactgcagcctcgacgtcctaggctcaaactatctgatatggttcggatctgtgtccccatgcaaatctcaggtccaactacaatccccaatgttggaggagggacctggtgggaggtcactggatcatgggggtggatttccctcttgctattctcgtgatactgagtgagttctcacgagatctggttgtttaaaagtgtgtggcacctcccctctctctcttcctcctgctccgaccacgtaagacgtacctgctttccct

SEQ ID NO: 23951 - DNA, 601 bp, Human
cgagaatctcttgaacccaggaggcagaggttgcagtgagccaacattgcaccactgcactccagcatgggtgacagagcaagactctatcacaaaaaaaaaaaaaaaaaaggttaaaataaaaataaaggcattttcagacatgttgtttctaaaacaatattacctctgatgtgccctttctcagaaaattggtggaaaatattatagctccaccaaaatgagcagataaaccaaaaaagtgagagtcatgggctccgtcaaagggaggggagaagggaacgtgcagtgtgaggtgaakacaagtcctgacaccaccgctgggtggcagaactagaacagaccaggaacggggacgaccccaggagaaatgtctgaggaaaaaagaatgaatctaatagaatgtccaatgtgctcacatggatcaaaaggagaatctcagttctgtttgaatctgggactgaattagttatagataattacaaagctaagcaaatgaaaaggcaagaaaggaaatgtcactatagaatggtccaagtgtgcataatattaatatgagcactaaacctgatttaactaaagagatgggaggagtacacag

SEQ ID NO: 23952 - DNA, 601 bp, Human
cccgtctctactaaaaaaaaatacaaaaaatcagccgggcttggtggcacgcacctgtaatcccagctactcaggaggctgaggcacgagaatctcttgaacccaggaggcagaggttgcagtgagccaacattgcaccactgcactccagcatgggtgacagagcaagactctatcacaaaaaaaaaaaaaaaaaaggttaaaataaaaataaaggcattttcagacatgttgtttctaaaacaatattacctctgatgtgccctttctcagaaaattggtggaaaatattatagctccrccaaaatgagcagataaaccaaaaaagtgagagtcatgggctccgtcaaagggaggggagaagggaacgtgcagtgtgaggtgaagacaagtcctgacaccaccgctgggtggcagaactagaacagaccaggaacggggacgaccccaggagaaatgtctgaggaaaaaagaatgaatctaatagaatgtccaatgtgctcacatggatcaaaaggagaatctcagttctgtttgaatctgggactgaattagttatagataattacaaagctaagcaaatgaaaaggcaagaaaggaa

SEQ ID NO: 23953 - DNA, 601 bp, Human
agaaagtaggaggaaataaataatacaagatatagaagaaattttcaaacaaaacaacagcaacaaaaaaacaaggctaaacatccagagtgaatatccttagacataagagaaaatatgaaatccatgaaataaggcaagaagctatttttaaaaactgttttaaatattcagagaaaagagatctaaagtaatttttatgtaacccagtagaaataaagatttcaacaaaaaggtttaaggataaagcgaataaaaacctagaagggagaacaaaaggcccaagagattaaaaaaaaaragagagagaaaatagaaggaaattagaggatcagtccagaaagttcaaaaatctgaataataaatgctccagagagaatgaacacttgaaatactttgggaagaaagaagtgataaaaggagtaatataataaaatgtcccagaacaaaagttgataaaataaaagggctcatatgaaatgagaagatttcatgccaaaatccattaaataaggataaaaagggacacaaggtttccaaaaataaatggaaaaacaggttctatacaaaaggttgggaatcaaaatagcactggattcca

SEQ ID NO: 23954 - DNA, 601 bp, Human
ccattctgaccatattcccaggtcagcagagggctgatccctggggatgaacctggcgcccaaggcagggacagtcgcaacccagcccccattcaacaactgcagatgcttcttaaaggacttgctgaggaggcaaatgcacaggacactgaaacagaaggagccacttaggagataaccctgagtggtccctagatgggctgcatgctagttaccaggctggagctgcagaccccaaatcttagccttttcttcctcaaaaggtccatctcaactcttacctaactcaaaaagccttccytaaatacctaactggcagtaacctctctctttcttctgtgaacatttctgttttaatacacattatagctacttgtgcatttgcattttacctcctaagtttcttgtgggcagggccttttttgtaagaaattatttatctttggcttttctttgcgatgtcttgcatatgtgtgctcaaaaattatttcagttagtttcaattagaagtgtcaaataatttcaagtagaagtgtcaaacaaaagccttaaactgcatgagactgtaaactttaccacgtaagcttgaaggaattaaaga

SEQ ID NO: 23955 - DNA, 601 bp, Human
ctacaaacacaaatagtacagaaaacaaggattttacttactatggcatctttaacaatttgtttggccacctgttctggtttgcacacagatgtggtctctgaaataagtcgagtctccaaaggctaaaagtggaaaaacatgtacataacaatatcatgattgcccattacattaaaaataaattattcttacagcctcctgatttacaaataattccaattttctacctttgggcagattcctatttctagaataaggtccatctggattctaaatcagtgtctacctagttactacrtaaaattctacccagtagctaacacaagacaaggaggcctttgccattctcttagaacatacggagtcttggctccactgaggaccatcaaagctagagtgagaacacatcactggatacaagttcagaaagaccccctttgactcctcagtgctggccggacacctgaatgatggtgcttttctgtagaggctagacctgtgtccagagcaagcctgctcccaagaccagcaactccattctgaccatattcccaggtcagcagagggctgatccctggggatgaacctggcgcccaag

SEQ ID NO: 23956 - DNA, 601 bp, Human
gtgtgacaaatgagaatgcgcccaacgcgcttccgcagcactgcattccagggcgggacaactgcctggaacaaaagtccttgtgcagctcctgaagtcaagggctaaactgccacttctttcatggagcatcatttgtattgtttatttatttattttcgacagaatctcactctgtggcccaggctggaatgcagtggtgtgatctctgctcactgcaacctctgcctcccaggttcaagtgattctcctgcctcagactcccaagtagctgggattacaggcatgcaccaccacaccygggtaatttttgtatttttagtagagatggggtttcaccatgttggccaggctggtctcaaacccctgagctcaagcgatccagccgcctcggcctccaaaagtgctgggattacaggcatgagccaccgtgcctggctggagagcataatttttatatgaaagaccattgacaggaaatctatagtaattcagacttaggtatgtggcagatgtgcagaaagcgaagcaagcaagtgtgtcacttcaggaaaaacaactggccacgtgtcatcaatgtgaaatctgagccttcaagaaa

SEQ ID NO: 23957 - DNA, 601 bp, Human
agcctaggctggagtgcagtggcttgatctcggctcactgcaacctccacctcccgggttcaagtaattctcctacctcaacctcccgagtagctgggattacaggcgtccgccaccatgcccagctaatttttgtgtttttagtagaaacagtttcaccatcttggccaggctggtctcgaactcctgatctcaagtgatctacccacctcagcctctcaaagtgctgggattacaggcgtgagccaccgcgcccggactactatcacctttttggtcagtgcattccacttgactgtawgcccctgaagctggagaggtcgccttccatctgattccccatgagcaagtacagtgcctagcacaccaatgaaacactgtgtatcttggacaaaataatacattctataagcgaagcaactgtttaatccatgattcgtgtctcactaaatttagctgtgtgtgacctgattcacctagaaaaggttttctagtctaatatcccagtactttttaagcaaggctaccccttactctagaggagtattccattttcaaaacacattggagcagtggttcttaggtgaaaatccaggttaac

SEQ ID NO: 23958 - DNA, 601 bp, Human
ccacctgtgcttgctgatgactgccaggtaagaatgcagactctgtgcagctaaaccttctgattttccaagaaaagtctgaaatctggaccttttatataaaacctaattttaaaactattttaaaatcttaaacacacacactcacaccagatggacccaacaaaactgctttacaggcccatgggaatcgtttacaacctctggctcaaaaagtgtgtaactcaagcagggggcctgctgcggcaacccaggcctgggctccagaagcactgccagaattgcagagaatggaagaatktgaagaactgagtgacaaggatgacaatgatctctgacgtgagggacagaagcaggggagtccaggacaacacgccaggtgtgagccaccatgccagcccaaaaattaaaacataaaagaattcatgcatttgttcagctcagggattctggagttcctactaagtgccaggcgctggctgttaggggtacaacggcaaacaagaggtgtgggcctggtcctcaaagagcttacatctaacacagtgtcaacctctaagagaatggcaaagacagtaggtacattacagaatgaaaagaa

SEQ ID NO: 23959 - DNA, 601 bp, Human
atgggaaaaacaagtagatgctaaaatgggataggtgaacttcaggtcatcatggttattgaaggaactgtaaattcttaagcttctagattttaccgctcttcagaaaacatttaaggaggctgcctttccccatgaatgagaaatgaaacgttccctaagcatttgagtctaaagacaagaaagcattgcttttcctactggaaaatatctctttacttcccattgcactgccctctcccgtccccctcgtagctttatgggatcaaagagagagagaagccatgagtttccaccagcrgcagagtgagtcctgagcacaacacagggctgtcagtgacattcagactcactggcaatgggtccaactcatcttgaataaaatacacaaagaaagaaagagagagagagagagagacagagagacagagagacagagagacagagagacagagagacagagagagagagagagagaacccgagaaaccgaaaattgtttttttatggaaggtttaaacaaagtcctcaagatttctttatgtgccagaaagtacatttctggacttaatctctaggggggcaaaaaagaataaatagaa

SEQ ID NO: 23960 - DNA, 601 bp, Human
aggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcatttkgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaacttgcggctctaaggctcctttttcaacccgaatat

SEQ ID NO: 23961 - DNA, 601 bp, Human
ctcctcctgttcgacagtcagccgcatcttcttttgcgtcgccaggtgaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgtgtgtcggccggggccactaggcgctcactgttctctccctccgcgcagccgagccacatcgctsagacaccatggggaaggtgaaggtcggagtcaacgggtgagttcgcgggtggctggggggccctgggctgcgaccgcccccgaaccgcgtctacgagccttgcgggctccgggtctttgcagtcgtatgggggcagggtagctgttccccgcaaggagagctcaaggtcagcgctcggacctggcggagccccgcacccaggctgtggcgccctgtgcagctccgcccttgcggcgccatctgcccggagcctccttcccctagtccccagaaacaggaggtccctactcccgcccgaga

SEQ ID NO: 23962 - DNA, 601 bp, Human
tggaaagtaactacaccatattcattgtttaaaactctttactgatgtacatgttttaataaaacaaataaccaaaaaaaatacacaaatccatagttatttaaaaacttaggatttttaaaaaacatgtctataaaaatacaacgtttaaggcagtttggaaatgcatttgtacatttctacaacgtccataaattctcttgaaaataagaatgttaacttcaattctataaaatacactgtacattttaagactgttctaaatatagcacacttcacaatggactgtgggttttgattsctgatgacaaatggattctatacatttcaggggggaaaggtgtaatatggatgtgagtttaaaacttttaatttctttttaaaaataaattatttctgaagcatacaatttataaaaattctatatacaaagtacagcaactggtaacaaaccccagttttaatacattttatatacgatgtaccagggtttagcaaccctgataggagcagaggcaatatacattctccgcatatttaaacataaaatttcttgatgtaaagaacaaaaatgacaaaaaaacaaacatcataaagagac

SEQ ID NO: 23963 - DNA, 601 bp, Human
tcccagcgacacgcacacacccacacttggcgccagatacacatactgatctcaaccccgaaaacatgcacacgcagccccctgagcgcagtactaagcggcacaatcaggacctctcaacaaagcacaccaaagcagtcgcccgcagcctggccccccgccctaagtccccccagagtcccctcaaagctaggagcgccccaggcccccagccggctctcaaaccccaaacttacacacgcagccgtggggaggggagggactcggcctctgagagtgaaggagttccggcgggagcccmgagggcgacgggcccagggacagcacgtccggaggctggcggggcttacagggtaggagctgggggtagagtgcgcctcggcctcgggcccgcccggctccggcccctcggcatcctccggccgccctggcgccagctgccgactcctgcacagacatgaagcgggggccgcgcacgcctaagaagcccaagccagccaatcaacgccgcgcgcctcccagcctccgcctcccattggctgcgtccgcaattcccgaaccgctggactccgggactgacccgcgggccggcccccctcag

SEQ ID NO: 23964 - DNA, 601 bp, Human
caaagagagagaggatcagggtgggcagaaagatcagggtaggcagagctagggacgcccctgacagacattgagatcacgactcccagaaccagcagtcatcccctccccaaagaaagccagaaacataataccccaccggtaataatcaggaatgtcagtccaagctgaaggacaagtggcatagaaggaaccccaccggacagaccctacagggaaccctcacaggccagctggaagtgggcagaaaccctgtgggtcccagaccctccccaatcggccgctgctcccacctctcccrccccaatttttcagcagctcgattcctgcggatcctacatccgggaagcaagcagacgggccctcctcccctccctcgcctggcgcgcggcgcctgggttctcatcaccacgggcccagtgctcaccgtgcgcggggctgtaggagacgcgcgcccgcgcgtgagcggggttggcatagtaggggttgccctgcgagtcgaggtgattgaagaagacgtccacctcgtctggaggcagcagctgcgcgggttccatgtagttgtgcgccaggcccgggtggtgtgagtcggggtgctgcg

SEQ ID NO: 23965 - DNA, 601 bp, Human
ctcaacctggctgggcccaggaggctctctccttcccgctctggcgcgtctctccccctctcctcttttgtccctctcctttctacccaactgtgtctgccccaccccgtctttctgctctaagtccagaagcatttccctctttctccccaacttttctcctcttccaccaaagctctagaatttttctgagtcctggaaataatggatcgaagttgttgttctttaaaataaaataaataataagctctttcttttttagataagtggcctgggttttttttgtttgtattttttttttcaattaaaagaccatctggaattcaaataaaatgcaaaacaaacaggagaaaggaccaagaaaaggcaagctgacgggtctgagcagaactaggaccctgagccggggctcagcgggtgctggggccagcgggggctggggctggggaccaagttgagcaggatcactggctggcatcgtgttccccaggaagttgttcttgatttagtttaaactaaatgaggagtacagactggcaagagaaggtggttcctgcactcaggagtaactgttttaaaaaccttccccctctgtggctca

SEQ ID NO: 23966 - DNA, 601 bp, Human
tctgcccattcatcttgtggtagaggccacaggcattgcacaggtagtggccggtgccgtcccgccgccagagaggggtggctgtggccccacagttgacacactcccggccttctgcaggggaacagggagagacacgggggcctgcttaaccggcaagttctcgggagggagtccagggcaggaaagcagccagccgagcagtgccggtgcctctcaggcacacggttggcctgggcctggctgcaacagcctgggcaggaagagggactagagggtctcccacatgggagggggcacrggtccagagtcgtttaaagccaaatcccctgcttccaatcctcaccaggagggatggaaacgaaggaggaggggaggaggggcccagggccccaggcgttctggagcaaccaggagggtatttactgcaaactttgccgagggtagggtggtggcaggagtcacccagctcaacctggctgggcccaggaggctctctccttcccgctctggcgcgtctctccccctctcctcttttgtccctctcctttctacccaactgtgtctgccccaccccgtctttctgctctaagtccagaag

SEQ ID NO: 23967 - DNA, 601 bp, Human
tcttcgcttgggcttgatgagtggtcggttctgcccattcatcttgtggtagaggccacaggcattgcacaggtagtggccggtgccgtcccgccgccagagaggggtggctgtggccccacagttgacacactcccggccttctgcaggggaacagggagagacacgggggcctgcttaaccggcaagttctcgggagggagtccagggcaggaaagcagccagccgagcagtgccggtgcctctcaggcacacggttggcctgggcctggctgcaacagcctgggcaggaagagggackagagggtctcccacatgggagggggcacgggtccagagtcgtttaaagccaaatcccctgcttccaatcctcaccaggagggatggaaacgaaggaggaggggaggaggggcccagggccccaggcgttctggagcaaccaggagggtatttactgcaaactttgccgagggtagggtggtggcaggagtcacccagctcaacctggctgggcccaggaggctctctccttcccgctctggcgcgtctctccccctctcctcttttgtccctctcctttctacccaactgtgtctgcccc

SEQ ID NO: 23968 - DNA, 601 bp, Human
caaaattaaaaacccagttccctcaattgcacgagccacatttcaagtgatcaatattcacatgtggccaggggctaccacagtgggcagtgcagacacagaacttttccatctctccagctgatgtgagtgctgatcccccccatccagccccccataccccaacccttagagctttaaccaccccgcagcccctctgagtcctagtccctcaggaaatgcctggcagaggtagggtctggaaatgagcgcctggtccttgcagagagaagctagagggaggctttacccaagaaaacasatcccctctcccggttccaccaacgccagccccacagtgacagagggggtcccccaacacttcccagagaactgcaggcgggagtgcaccaggtggtgagtgtggggggctgggggctgaggcctgcagagcctggaacagccccaggcccaagcctggtcacagaagggacagagggactgcagccgcgggggcagggaggggtgagtaagcagcctgaagctggaattctgactcaggggccaacgccgcgtcctccacctctacccccacccgggcctcaccccgccctcgctccag

SEQ ID NO: 23969 - DNA, 601 bp, Human
tgagtcagtgtcgctgaggccagcgcaggtttacagagtgcagagctgcaccgtccaacactgtagcagctggccacaggcagccatttaaataagatctaactacaaattaacaaaattaaaaacccagttccctcaattgcacgagccacatttcaagtgatcaatattcacatgtggccaggggctaccacagtgggcagtgcagacacagaacttttccatctctccagctgatgtgagtgctgatcccccccatccagccccccataccccaacccttagagctttaaccaccccrcagcccctctgagtcctagtccctcaggaaatgcctggcagaggtagggtctggaaatgagcgcctggtccttgcagagagaagctagagggaggctttacccaagaaaacagatcccctctcccggttccaccaacgccagccccacagtgacagagggggtcccccaacacttcccagagaactgcaggcgggagtgcaccaggtggtgagtgtggggggctgggggctgaggcctgcagagcctggaacagccccaggcccaagcctggtcacagaagggacagagggactgcagcc

SEQ ID NO: 23970 - DNA, 601 bp, Human
cacccctcttacgggaagcccttctggcgctcactcagggcagcagcttcccaagccaagccaagctggatattgtggctggggcctcttgcctggcagcacaaagcgcagaggtcccctgggaggggcggggtggccggggcggggcgcactcacattgtgcagcttgtagtagaggccacaggcgttgcagacagggtccccgttggcgtttcggcgccataaggtggtggttgtcgtctgacaatttgcacaacaggtgccggctcttctggcggccgactgggagggcaaggcagcrtcagcaggctggactcccacgcccacctcgacccccctccctgaccctcgctccacccccagtccccaccagctcagtcaaggagggctaaatctcacatgggaatcaaagcatctcagaaccatggaattttagaatttgagaacgaaataagtcaagactcacagaactttggaataaagaactctcagaagcctgatgttagaatcaacgggattgcaagagctacagaggagaattagctacctcccccaactaccctgcgctctaactccataaatggggaaactgaggccctga

SEQ ID NO: 23971 - DNA, 601 bp, Human
tggaccagaggcaggtcaagctgagggtcccaggaagccaggaattgtgcccgaccttcatagtcccatcaccagatggctaccattccaggaagggcgggttctggcatatggggctgacccacaccctccctggctctgcccaccgcatgccagcactgcccagccaactgaagtcctcccccccaccctgaccctttttaagcagagaaaccacttccctagcccgagaccctgtcctagccagctccacctcctgagcagaggcaaggcacccctcttacgggaagcccttctggcrctcactcagggcagcagcttcccaagccaagccaagctggatattgtggctggggcctcttgcctggcagcacaaagcgcagaggtcccctgggaggggcggggtggccggggcggggcgcactcacattgtgcagcttgtagtagaggccacaggcgttgcagacagggtccccgttggcgtttcggcgccataaggtggtggttgtcgtctgacaatttgcacaacaggtgccggctcttctggcggccgactgggagggcaaggcagcgtcagcaggctggactcccacgcccacct

SEQ ID NO: 23972 - DNA, 601 bp, Human
tcagagagggaagccagaggagaagagggtgcaggctgaggtccccacaaatctgcccccagagccctggcaagtggacccgccaatcccgaggaagaaccggaggacttgggacagctcagaccaccaagtctccaagtccttgttagaaacaagagcaaaataaattatttttgcctaatcctttttccttctaaaaatggttgccttcgtctgtcccgtcccctccttttctctacataaagttgtccttgttgttctccaaacaactgtccatgcaggaaaccccacctgggcagcrgtcaggtgcggaggcagcctctcagcggtggggaacattcacagtaactgctggcaggctgctgggcgccctccaggagagggggtgctgggccgagccgggctggcaggagtggtgtcggccttcgggaaatgctgggctgctaagggtttggtccacccatcccgggagtgcccggtcctcgacgtccatctgttccctagcccatggcggtcaccatgctggacgggtgggggtggccgaaggagaggctggaggaggggtggatgggcgtcggagtgggcaggatgtgtccggagt

SEQ ID NO: 23973 - DNA, 601 bp, Human
agggtccacctgacaagacaggctgtggcttgcgctcagtaaggggacacagtcacagcagcttcggcctcaaagccaagggagcgatctgggagacgtttcccctttcaagaaaatgttgtttccttcctgtgacccagccctggcctgggaatctgtgcaggaccgcccgtgattgtctctgccctccagggcctggcccgtcaaagcaggcaccagctcaccctccctgggccgtggccactctggctttggctcagcccagcctggagttcggctatttcagagagggaagccagargagaagagggtgcaggctgaggtccccacaaatctgcccccagagccctggcaagtggacccgccaatcccgaggaagaaccggaggacttgggacagctcagaccaccaagtctccaagtccttgttagaaacaagagcaaaataaattatttttgcctaatcctttttccttctaaaaatggttgccttcgtctgtcccgtcccctccttttctctacataaagttgtccttgttgttctccaaacaactgtccatgcaggaaaccccacctgggcagcggtcaggtgcggaggcagc

SEQ ID NO: 23974 - DNA, 601 bp, Human
ccagaatccaatctccctcatggacatcaaccttctccgcttccaactcctcctttatatggacacaggctcagaataggtgagctcgctgcccacagtcacaaagcccagccatgaatgaaacacaggggccccgctgctcctgcactgctttccccagtagggaggtgctgaggggaccctggactcctggcagaaggcatgcgggcatcagatccccggggccctgggcctgtttctggtccctcccatcatgttggggggcaaggatagtgccccatcaagaggtagggaggcccakggagcagggaggttcggcccctccctgagacttctcgggcactccttcttggggattcagccccttctgctcacaaggccccccttccccatcccctcctcacttctgcctcacagtggccaggtcctgtgccagattgtccctctcaacctccagccgggcgctgttggcggtgagttgatcgagccgcagccgcagctctcgcagctcagcctggtagacgtctgccagcttggtgggctccttggcccgcagctggttcagctcagcagccagcgccttgttttgctgttccaggaa

SEQ ID NO: 23975 - DNA, 601 bp, Human
ctctggtgaaagtcagtcacctggagaggatattctcccagcttcctccaccctccttcccccattctcttgtacagagcaagaagggctgcctggaggaggcaggctggcccacaggcagggctaccttggagcggtaccactcttcggcttcatgcatgttgctggacgccattgcctcatactgcgtgcggatctctttcagggctgcggtgaggtctggcttggccacgtcaagctccacatggacctgctgtcgggccagctgctcctggagttcccgaacctcctgaccagggtragagaagcggtaccagggctcagggtacaggccacagctggggttccccacgccattgtgtcctcttctgcctgcccctcggccaggagttcgaatgctctcttgtctctttccgtctcccttagtgtctttctgtttgtctttcatttcctgtctctacctgccaatctctgtttctctcctctctctgagtgtctctctcagtctcagcttctctgtctctgtctctccctctctcagttgcaatctctgtgttgagctttcctccctctgccctggcctcacctcctcgtggatctt

SEQ ID NO: 23976 - DNA, 601 bp, Human
tcagtcccagtctggagcaacctacaggccctggaggagggggcaggactccagtgcccttcccacgaggccctgctgtactgacctcgaatctgcaggttggagaaggtctgcacgggaatggtgatcctgaaagaaagcagagggagagggctgcccgggctgcctgggacacccctaggctgggtcttggtgcggggccatcatgacaacttgaacgcccttttccttgccaggaaagtctaactccatctcctagctttttccccagcagccaacgtgctatctggagttccaaacrtctgcaaggggcttgagtgttatctgggaggggcgcatgtctatctgaaggaagatggaaaagggaggggaaagtggtgaagaaagttccaaggaggcagaagagatgggtgaggtgaggagtccaatcttggctgggaagatggggagtatgcctcttagtttggagggtgacccaagtccttggccttgaggcctaatcaatattggttgaatccatccatccattcagtcatcaaacatctagtgactgcctgctatgtgtgaggcaggcactgtgctgggcattgaggtgggaagg

SEQ ID NO: 23977 - DNA, 601 bp, Human
aaaattagtcaggcatggtgacaggtgcctgtagtcccagctactcaggaggctgagagaggagaatcacttgaacctgggaggcggaggttgcagtaagctgcgatcgtgccactgcactccagcctgagcaacagagtaagactccgtcgaaagcaggcaagcaagcaagcaagcaagcaggaaagagaaaggaaggaaggaaggaaggaaggaagaaagaaagaaagaaagaaaaagaaagattagccaggtgtggtggctcgcacctgtaatccccttactcgggagtctgaggcasgagaattgcttgaacctgggaggtggaggttgcagtgagccaagattgcactactgcattccagcctgagtgacagagggacgctctgccgaaggaaggaaggaaagaaggaaggaaggaagaaaagaaggaaggaaggaaggaaggatcaggagaccagagctcaagaagtcccaacttagccaccaaccagccacatgactctgggcaagttaattgacctctcccagcctcagtttcctcatctgtaaaataaggatgatggggcctacttctctaggtgggagagaggagacaatt

SEQ ID NO: 23978 - DNA, 601 bp, Human
atgtggggagaggaggcctctcatggactttcagggcatgagccatcctctcccatgcccggcttccccatcgcacccccctccccatcatgagtatgagaacctatgcaaccgagcagagagagcctaggctcttccaaacgggctggagagcccccaaatcccaatagtgctgctgcccagagtcctggctgctctgtcttctggcctggcttcatttcagcccctctgcaagccctggcctggcacctggctttctgaaaacccagcacggtattgaaatcaggagaccaggaggggygcggtggctcacacctataatgccatcattttgggaggctgaggcaggtggatcacctgacgccaggagttcgagaccagcctggccaacatagtgaaacctctactaaaaatacaaaaaataggccaggcatggtggctcacacctgtaatcccagcactttgggaggccgaggcaggtggatcgcctgaggtcaggagtttgagaccagcctgactaatatggtgaaaccctgtctctactaaaaatacaaaaattagtcaggcatggtgacaggtgcctgtagtcccagctactcag

SEQ ID NO: 23979 - DNA, 601 bp, Human
tcttgaggtggccttctgacacagacttggtgtccaggctggtttctgcagatgtggggagaggaggcctctcatggactttcagggcatgagccatcctctcccatgcccggcttccccatcgcacccccctccccatcatgagtatgagaacctatgcaaccgagcagagagagcctaggctcttccaaacgggctggagagcccccaaatcccaatagtgctgctgcccagagtcctggctgctctgtcttctggcctggcttcatttcagcccctctgcaagccctggcctggcacytggctttctgaaaacccagcacggtattgaaatcaggagaccaggaggggtgcggtggctcacacctataatgccatcattttgggaggctgaggcaggtggatcacctgacgccaggagttcgagaccagcctggccaacatagtgaaacctctactaaaaatacaaaaaataggccaggcatggtggctcacacctgtaatcccagcactttgggaggccgaggcaggtggatcgcctgaggtcaggagtttgagaccagcctgactaatatggtgaaaccctgtctctactaaaaat

SEQ ID NO: 23980 - DNA, 601 bp, Human
tactgacggagcctagggcagcaagctgacctagggacagaggagggaggggagcagctggggtggtggggagctcaggtctggggaaatgtgccagcagaggcggagcaactatcctgcttctgctcgggcccctcatgagacggggcagaggccaccaggtgggtcctgcctcacatcacatccttgtgctcctgcttggactccttaatgacctgcaggggacagggaacgtgcacagtgcaacagttaggagttcacacagaccccaggtccaccaccacgaggctgtgtaaccttrggaagtccccgacttcccaggtcttacttttcttgatagtaaccacagctgccttgcgtggtggacagagggggtggtgagataacactgggaaagcatttagcgtcatgcctggcgagtggtaagctgctggagtaagatgagctcccactgtggttggagtggcgtggcggatacgccaaatcccctcttcccattcccctggtagtttccttttaccaagctggaaatggaaagccctccccatccccaactgtgtctgctagagttggaagtgaaagctactaactttaattctct

SEQ ID NO: 23981 - DNA, 601 bp, Human
atgtagtaggtgccccccgccctcctccccttctctccttcctcctcattctaacgcaagctgctggccatgcccctccagactgccccttgggggtgagtttcttgttagttggagttgctgggtgctgggtgggtgccgtctggcaggcctgatactgacggagcctagggcagcaagctgacctagggacagaggagggaggggagcagctggggtggtggggagctcaggtctggggaaatgtgccagcagaggcggagcaactatcctgcttctgctcgggcccctcatgagacgsggcagaggccaccaggtgggtcctgcctcacatcacatccttgtgctcctgcttggactccttaatgacctgcaggggacagggaacgtgcacagtgcaacagttaggagttcacacagaccccaggtccaccaccacgaggctgtgtaaccttgggaagtccccgacttcccaggtcttacttttcttgatagtaaccacagctgccttgcgtggtggacagagggggtggtgagataacactgggaaagcatttagcgtcatgcctggcgagtggtaagctgctggagtaagatgagc

SEQ ID NO: 23982 - DNA, 601 bp, Human
tgtctgagtctcagttttcctccagcagcctgaggaaactcaaaggcacagttcccagatactccgagagaacctccatctctggcaacagtttccataacaacaggaatcagggatatggagggcgatgtagtaggtgccccccgccctcctccccttctctccttcctcctcattctaacgcaagctgctggccatgcccctccagactgccccttgggggtgagtttcttgttagttggagttgctgggtgctgggtgggtgccgtctggcaggcctgatactgacggagcctaggggagcaagctgacctagggacagaggagggaggggagcagctggggtggtggggagctcaggtctggggaaatgtgccagcagaggcggagcaactatcctgcttctgctcgggcccctcatgagacggggcagaggccaccaggtgggtcctgcctcacatcacatccttgtgctcctgcttggactccttaatgacctgcaggggacagggaacgtgcacagtgcaacagttaggagttcacacagaccccaggtccaccaccacgaggctgtgtaaccttgggaagtccccgacttccc

SEQ ID NO: 23983 - DNA, 601 bp, Human
gagctgggcatggtggctccaatctataatcccagctacacaggaggctgaggtgggtagactgcttgagcccaggagttcaaggtcagcctaggcagcatagggatatcccacctcataaaaaccaaaagacaaaacaagcctctggccagggctaccttgtctgtggggccttccctttcctgtctgagtctcagttttcctccagcagcctgaggaaactcaaaggcacagttcccagatactccgagagaacctccatctctggcaacagtttccataacaacaggaatcagggatrtggagggcgatgtagtaggtgccccccgccctcctccccttctctccttcctcctcattctaacgcaagctgctggccatgcccctccagactgccccttgggggtgagtttcttgttagttggagttgctgggtgctgggtgggtgccgtctggcaggcctgatactgacggagcctagggcagcaagctgacctagggacagaggagggaggggagcagctggggtggtggggagctcaggtctggggaaatgtgccagcagaggcggagcaactatcctgcttctgctcgggcccct

SEQ ID NO: 23984 - DNA, 601 bp, Human
atcccctttctctcctgtttcagcatcttcaagaggatgagtcacttccttaattcccacaatccagaggccaagtgcaactggtcacccacaacccctacttgtatgcctagcgccatcccaattgcctcctcctccatctctaccagcgtcccctccagtctgcacggggcagtcctcctgggcttgacctctctgtacccacagctgggggccaggcagcccccctctatccctcccagcacctcatccctctccacgtacacaacagatcccccaagtgctgagaatcaagctcccwcctgcccacagcgtgcccacagatggcatccctggatggcagctcaggtggactgagacacttgagtcatcgctcaggaggtccttctgggatctgggcaggtgactgccccaggtggcaggacgtccccacccatcttagactgatcagggtcagtctaggagaacaaccctctgagctgggcatggtggctccaatctataatcccagctacacaggaggctgaggtgggtagactgcttgagcccaggagttcaaggtcagcctaggcagcatagggatatcccacctcataaaaac

SEQ ID NO: 23985 - DNA, 601 bp, Human
tgggccccagagatgatcagtaataagaaatgagttggtcttgtcaaaggctacatcttggccccagtcccgccctctcatgaacagatcagagtccactctggggaagggcgcagcatttgtctttatttttcctcagcgactaaaggcagcagcagtgccctgaagattagcagcagcagcagcagcaggtggcaggaaggagtggagggaaaggacaccaagtcttggggagagggaaggacccttcttcggccttagaggggagaggagaaccctgaagtgggccctcccagtcccrtctctgggcacagatcccaccagtctgctcaccagtctgctcagtcaaagcagagtgggtgcactggggtggacgtgtcagccctgagcacccggcctccaggctgcaggaatatgagccagtgtcttcactttgctcgtgcctcagttttacaattgtaaaatagggcactacctagaatactgggtacattttgtgtgtgagtaagaagggaccgcaagaggcccttggcttagggaaaagcagccggtcactatggggtggagagggtcagacgtgtggcagtggcttactggggtt

SEQ ID NO: 23986 - DNA, 601 bp, Human
ggagccctgagcaaaacaatttgaatgaggttaagttttcctggagccagtatttatttctcagttgattactacactcacatactgtttacccggccagaccctgggcgtctggtcacggatgtgcactgacaaaaagcaaggcaaaattgggtaaagacagatgtctaacccccagggaggcaggcaggtgcctgccacggcagtttggatctcactccctcaggctacctccagccccgcccgtgctttggactgtcaaagaaaggaaggatccaacatctctcccatttgacagcarggaaactgagccctagagaggaggagcgacttgtccaaggtcgcgcagggaggaatcccggaaccctaggctccagactcccaggccggggcagcccgcctccgcccccactctcaccctttcagcaccccggtgccgccccccgccttggggctcgggcaaccctgaccgggccgctgtggggacagaccgaggccactgggagaataaggggcctgctcgcattcccggagtcctggcccgcgcacctgcctctctctgggaagccagcaaagccccgcctcccgggcctctcgtgag

SEQ ID NO: 23987 - DNA, 601 bp, Human
aaaaaaaaagaaagaaaaaagaaaaaaagcaacatactgtaatcactggggccatctttccaacaatcgtcccaatacaacaatgcactcttgctaaccccataccacaactcagagaccttgttaagcagcaatgacttagttgttatataagtatatatgtctgcaatgaaaacaggcccagacattttcagaaatgaaatgcaaaagaagatgtataaggtatatagacggaaaaacagtacaagaggacactggagagaatatggagaggaactcacagaaaaataaggaaaaaaatatagagtaccttaacatttacaaaccaaacattaacaaaaaggtacctcagagtaagaagaatcagatgtacaggctcttgtacagctataaaccatgaaaggtatgaaataatcaagcaatttaaaatatttattggaagaataccctgcaaaagtatctttatttcttaagtaaaggtacttacaaagtcatctcctgagtcagctcccattgaggcaactgattccttgctcacagaccgtgggatcctagtagcacctcctggcctctgagcaacagcagtctcttctgcaatttt

SEQ ID NO: 23988 - DNA, 601 bp, Human
aaaaaaaaaaaaaaaagaaagaaaaaagaaaaaaagcaacatactgtaatcactggggccatctttccaacaatcgtcccaatacaacaatgcactcttgctaaccccataccacaactcagagaccttgttaagcagcaatgacttagttgttatataagtatatatgtctgcaatgaaaacaggcccagacattttcagaaatgaaatgcaaaagaagatgtataaggtatatagacggaaaaacagtacaagaggacactggagagaatatggagaggaactcacagaaaaataaggaaaaaaatatagagtaccttaacatttacaaaccaaacattaacaaaaaggtacctcagagtaagaagaatcagatgtacaggctcttgtacagctataaaccatgaaaggtatgaaataatcaagcaatttaaaatatttattggaagaataccctgcaaaagtatctttatttcttaagtaaaggtacttacaaagtcatctcctgagtcagctcccattgaggcaactgattccttgctcacagaccgtgggatcctagtagcacctcctggcctctgagcaacagcagtctcttctg

SEQ ID NO: 23989 - DNA, 601 bp, Human
ctggctgacagagtgagactctgtctcaaaaaaaaaaaaaagaagagaaaagaaatttatctaacttaagaggatcctgtcatatgcaaaagccacactttattttttaagcatgacatttccctcatatagcaacatcttcattttttgaaatcttatagtcacaaatgtattttactaataagaaacatattgtaggctgggcatggtggctcacgcctgtaatcccagcactttgggaggccaaggtgggcggatcgcctgagctcaggagtttgagaccaccctgggcaacatggtraaaacctgtctctactaaaatacaaaaaattagccaggcatggtggaacacacctgtagtcccagctactcgggaggctgaggcacgagaattgcttgagccccagaggcagaggttgtggtgaaccaagatcaggccactgcactccactttgggctacagagcgagaatccatctcaaaaaaaaaaaaaaaagaaagaaaaaagaaaaaaagcaacatactgtaatcactggggccatctttccaacaatcgtcccaatacaacaatgcactcttgctaaccccataccacaactcag

SEQ ID NO: 23990 - DNA, 601 bp, Human
agtcccaagctactcaggaggctgaggcaggagaatcgcctgaacccgggagatggaggttgcagtgagccgagattgtgctgctgcactccaccctaggtgacagagcgagaccctatctcaaaaacaataaactaaaaacaaaaaaaaattagccgggtgtggtcgtgggcacctgcagtcccagctacttgggaggctgaggcaggagaactgcttgaacccgggaggtggaggatgcaatgagctgagatcatgccactgcactccggcctggctgacagagtgagactctgtctcaaaaaaaaaaaaaagaagagaaaagaaatttatctaacttaagaggatcctgtcatatgcaaaagccacactttattttttaagcatgacatttccctcatatagcaacatcttcattttttgaaatcttatagtcacaaatgtattttactaataagaaacatattgtaggctgggcatggtggctcacgcctgtaatcccagcactttgggaggccaaggtgggcggatcgcctgagctcaggagtttgagaccaccctgggcaacatggtaaaaacctgtctctactaaaatacaaaa

SEQ ID NO: 23991 - DNA, 601 bp, Human
aagcagtattaaataataaattgtttatgaatacatacatatctggtaagatattttaaaaagcaagtaaatgaaaaatacaaaatttagaatagtggttatgctatcctaaattgggtagaggaaattggaagaaacatataagtggcttaacagaattgatagtgttctatctcttcagatgagtgatagatttactttatgctttatactttacatatatattacatacattcttttatatatatatccagcattataaatgagttttaaagaaatttattgccaagtgtggtggctyacccctgtaatcctagcactttgggagaccgacgcgggaggatcacgaggtcaggagttccagaccagcctggccaacacagtgaaactctgtctctactaaaaatacaaaaattagctggacgtggtggcgggtgcctgtagtcccaagctactcaggaggctgaggcaggagaatcgcctgaacccgggagatggaggttgcagtgagccgagattgtgctgctgcactccaccctaggtgacagagcgagaccctatctcaaaaacaataaactaaaaacaaaaaaaaattagccgg

SEQ ID NO: 23992 - DNA, 601 bp, Human
gaaatccaagaagtctacagtgtgcaacttttataacttcaaaaacaagcagtattaaataataaattgtttatgaatacatacatatctggtaagatattttaaaaagcaagtaaatgaaaaatacaaaatttagaatagtggttatgctatcctaaattgggtagaggaaattggaagaaacatataagtggcttaacagaattgatagtgttctatctcttcagatgagtgatagatttactttatgctttatactttacatatatattacatacattcttttatatatatatccagyattataaatgagttttaaagaaatttattgccaagtgtggtggctcacccctgtaatcctagcactttgggagaccgacgcgggaggatcacgaggtcaggagttccagaccagcctggccaacacagtgaaactctgtctctactaaaaatacaaaaattagctggacgtggtggcgggtgcctgtagtcccaagctactcaggaggctgaggcaggagaatcgcctgaacccgggagatggaggttgcagtgagccgagattgtgctgctgcactccaccctaggtgacagagcgaga

SEQ ID NO: 23993 - DNA, 601 bp, Human
tctagtgaagacccactttctggttcatacatgacaccttctagctgtgccctcacatggtggaaggggcaaggcagctttctggggcctcttttgtaagagcactaatctcattcatgagggttcctccctcatgagctaatcatctcggagacgattcacctcctcattccatcactctagtgattaggtttcaacatatcaatttttggagacatacattcagaccacaccactagcagtataagaagctgttatgattattactgttagtgagacataggagacatcctatgtctcmctactgtgctaagcactaggaatagtggtgaaacaaagagctcctatccaaaataacagcagcagcagcaacagaagctaattatgaaatgcttagagccagacgccatgctaagtgctttagattctacgcagaagaactgacattacaggcctcagactgttatccttagaaaggcctgcttttaaggttggtccttggctggcatctgggaacttagattttgggagggttcccatcattctgttaagaatggctcattgtgcctaaaatgtttgtgcaaaaatatgggtttatgct

SEQ ID NO: 23994 - DNA, 601 bp, Human
ttgtcaaatccctaaaacacagcctggcacatattagctttaatatgtgtcatctattactagttgtcttagtctgtttgagtgctataatgaaatgccatagaatgtgtgacttataaacaacagaaatgtatttctcacagttctggagcctaggaagtccaaaattaaggtgccagcagatttggtgtctagtgaagacccactttctggttcatacatgacaccttctagctgtgccctcacatggtggaaggggcaaggcagctttctggggcctcttttgtaagagcactaatcycattcatgagggttcctccctcatgagctaatcatctcggagacgattcacctcctcattccatcactctagtgattaggtttcaacatatcaatttttggagacatacattcagaccacaccactagcagtataagaagctgttatgattattactgttagtgagacataggagacatcctatgtctcactactgtgctaagcactaggaatagtggtgaaacaaagagctcctatccaaaataacagcagcagcagcaacagaagctaattatgaaatgcttagagccagacgccatg

SEQ ID NO: 23995 - DNA, 601 bp, Human
catgaaccactttacaggatgaagctttccaaatgtatccactggcagaaaccaaaataataactcacaattctatcatgaccatgccctcctcaggcaaaggatataatgggagctgtgtaaattgtaaactgcagacaaaagacataatgagagtgacaccttctatgcaggtgctgaagtcagaaataccattgaaaagtggcccaaagacctacaacaacacttacacaggtggtatgagctgcaggaagtggcaacacagcaccaatctctggtgctgatgaatccaatatctgtyggccattccctttaaatactaacgccatccctttccacctgaaagcaggctatgctaatggtggaagatggtcaaatctattgtacatatattattattatcttttatttccatggctagaaacctcaggagcagaaaaaattttttaataaactttcaaattcagttttgaatttatactatttactacactaacaaaagaagagggtatacttgctcctttctaaaaagatcaaaatgatatgtgaaaataactataaagtcatcctatatggctattttataggaagagagtcaagc

SEQ ID NO: 23996 - DNA, 601 bp, Human
agataaaacattttacgtgccttaagtgctttgcacacagtgctcaataaaatgtagctcttattgttactgtgactattatcattactcatactaatactgtaggacaatactcaccacatagtgggcccagtaaatgtcagtgctcttccctgtcccttctctaacgtaagtcaagctcaactattcttcctaccatatggggaaggtatatatattattttataactctctctccaacattaaacaaatgtaaaattactttacctctgttactgatattatttatgggtaggagtarcaggatagcaacaattaagtttaaggcagatggaattaagactctagcatcaaataaatctgggtttggatcccagctctaccacttactacttgtgaggccttaaccttgctaagcctaataaggctctagtgaggacaaaataattaactggtagttgtgagctatgctatgaacctttgataactacataaatacaaatacttcacatacaatttggtgaatttgggtctgatagctacacaaatataaatatttcacataccacttggtgaacttcggtctgctgttttactccaa

SEQ ID NO: 23997 - DNA, 601 bp, Human
tgccaggcacagtggctcacgactgtaatcctagcactttgggaggccaggcaggaggatcactttggtctaggagttcaaaaccagcctgggcaacacagtgagacctcatctctattaaaatttttttaaaaattagctgggcactgtggctcaagcctgcagtcctggctactcaggaagtctaggtgggaaaatcatttgagcccaggaggttgaggctgcactgagctgtgattgtgccactcccagcctgggcaacagaacaaccccttgtctcaaaaaaagttaatgtattctytcagcttgataatcagatttctatagaacagaaagtaaagttaacttggtgttttatggaaaaaaaatagttgacactaatgattattttaaaactaaaatgtttttccaattgtagacttgaaatttcatctcgtttatatgtgggagccaggaatatattacttaaggtacctgtacggtgttatgcaagcaatggtactagaataatcaatttcctcatctacatctagccaagaggttctcatatatgttcaatgctgagccttgagaaatgccttccttccccactgcttcatct

SEQ ID NO: 23998 - DNA, 601 bp, Human
acagagcaagactccgtctcaaaaaaaaaaaagaaaaattttccccaacctctccttcaaaagaacaaaaacaaaacaaagagaaaattccctttgtgaaccttgtgaacctaagtaggttttttagttggttcagtcctatatggataccctttaccaaaattttaaaagataaaaaaacagttcaatgagaatttcaattgccataatcttaagagtttcttttacagcaagaaaaccttaacccaacccatatctccatatttaagaagactgtcattaatagcatatggttgaggattttttttttttttttcaagcacaggtttccttgggacttgacttttctataattctttccttatataaaactgttgccaggcacagtggctcacgactgtaatcctagcactttgggaggccaggcaggaggatcactttggtctaggagttcaaaaccagcctgggcaacacagtgagacctcatctctattaaaatttttttaaaaattagctgggcactgtggctcaagcctgcagtcctggctactcaggaagtctaggtgggaaaatcatttgagcccaggaggttgaggctgca

SEQ ID NO: 23999 - DNA, 601 bp, Human
ctttaattgaattaatcctttaactagagaatttaattctttatttaaaaataaatgtgttttaaataattgtgaaaaaggggaataaaagcaacaattacgtagaacttttttttttttttggtagagacaggatcttgctctgttatccaggctgatcttgaactcctggcctcaagacattctcctgcctcagcctctcaaagtgttgatagatatgagccatcgtgcatggcctatgtagaactttaaagttcttacatctgtttagcaagtccagatatatattttatgtgtctaytctttcgtcgttgttgtttgttttttgacacagagtctcactctgttgcccaggttggtttgcagtggtgagatctcagcttactgcatcctctgcctcccaggttgaagtgattttcatgcctcagcttcctgagtacctgagactacaggcatgcaccaccatgcccggctaatttttctacttttagcagagatgaggtttcaccatgtttgccaggctggtctcgaactcctgacttcaggtgatccacccacctctgcttcccaaagtgctgggattacaggcgtaagccactgt

SEQ ID NO: 24000 - DNA, 601 bp, Human
gatttttagttcattgagggtaaaaagcctgtatcacagtcattcattcacgtatatatttactgggtgctccttattgtgaggcagcaaagtgcagtagaataagcatgagttctggagtaagacttgggttagaatccaactctgtcacttacggttataactgtgaacaaggtcaataacctcttagtttccacttaggtatctgtaagtatgataatacttagctaagacctctattgacaaaatcttactgtactgtaattatgttgtaaggctctgtctcacttgagatcagcawttctgaaagatgagggtagggtggatggcactgccgaatagggggtggttctgtgatgtgaggggaagggctggatgtcaatgactgaaggatgctattggcattcagaacccagaggccaggaatgctaaatgtcgcgcaatgcaatggacaatcatacaatacgagttgttctgctcaaaatgccaataataaattatgtcattgggaaatactactttattttatttatatttatttatttatttatttattttattatttttttaagacagagtctctctctgtcacccaggcagg

SEQ ID NO: 24001 - DNA, 601 bp, Human
tgtcaaagcctccatcatcttacggtcgaacaactgcaaaagcttcctaagtggaagaccctctcagtctcctaacggccagagtaatctgttattctctcttattctgtatgtcactggctttcttctagttccttgaatgtgctaatccttttatttgcctcagagtttttgttcatgctgttccctgcttgaaattctctcccatcatccctttctctccagcctgagcactgtatcgagtgttacttccttaagtgttctacggctccaactggatctgatctgatatatatatatwttttttttttgagacggagtttcgctctttttgcccaggctggagtgcaatggtgcaatctcggctcactgcaacctccacctcctgggttcaagcgattctcctgcctcagcctcccaagtagctgggattacaggtgtgtgccaccatgcccagctaattttgtatttttagtagagacagggtttctccatgttggtcaagctggtctcgaactcccaacctcaggtgatccacctgcctcggcctcccaaagtgctgggactgcaggcgtaagccaccaagcccagccctgatctg

SEQ ID NO: 24002 - DNA, 601 bp, Human
cttgtcaaagcctccatcatcttacggtcgaacaactgcaaaagcttcctaagtggaagaccctctcagtctcctaacggccagagtaatctgttattctctcttattctgtatgtcactggctttcttctagttccttgaatgtgctaatccttttatttgcctcagagtttttgttcatgctgttccctgcttgaaattctctcccatcatccctttctctccagcctgagcactgtatcgagtgttacttccttaagtgttctacggctccaactggatctgatctgatatatatatwtattttttttttgagacggagtttcgctctttttgcccaggctggagtgcaatggtgcaatctcggctcactgcaacctccacctcctgggttcaagcgattctcctgcctcagcctcccaagtagctgggattacaggtgtgtgccaccatgcccagctaattttgtatttttagtagagacagggtttctccatgttggtcaagctggtctcgaactcccaacctcaggtgatccacctgcctcggcctcccaaagtgctgggactgcaggcgtaagccaccaagcccagccctgatc

SEQ ID NO: 24003 - DNA, 601 bp, Human
cagagggctcattgccttattatactttctatcatactcatattttataaatatgtttttatatatactcaataaagacaagaaaaaaacaaattccaaatttacaatcttcacacaataccagcccttcttttgcccaagccagaagcccataaatcacccataaaaatacagacttttctcttcctgtcctcccatatctattacattagtaagtctgtcaatctcttcaatagttcttacatttgtctacccattattatcttcaccaccacacttgtcaaagcctccatcatcttayggtcgaacaactgcaaaagcttcctaagtggaagaccctctcagtctcctaacggccagagtaatctgttattctctcttattctgtatgtcactggctttcttctagttccttgaatgtgctaatccttttatttgcctcagagtttttgttcatgctgttccctgcttgaaattctctcccatcatccctttctctccagcctgagcactgtatcgagtgttacttccttaagtgttctacggctccaactggatctgatctgatatatatatatattttttttttgagacggagttt

SEQ ID NO: 24004 - DNA, 601 bp, Human
aaatcttcacaagccaggcaaagtggctcatgcctgtaatcccaggactttgggaggctgaggcaggaggattgcttgtgtcctggaattcaaaactagcctgggcaacatagtgagaccttaactataaaaaaatttttttttaattagccaggtgtggtagtgtaagcctgtagtcccagatatatgggaggctgaagtaggaggatcacttacacccaggaatttgaggctgcagtgagccatgattgcaccattgcactccagcctgggtgacagagtgagaccctgacacccaaamaaaaaaaaaaaaaaaaaaaaacgaaaacaaaaaaaaaacccaccatcgacaaaaattaaaattttggtatgtccctactatattactatataattgagaaaaaataaattatagctccaggtatcatatgaatgtttttcaggagtgcaatgttgagcacaaaaagtaagtttagaaaaatacctacagaatgatttatataacattaacaagcatgggaaactaaagaagatagtttagggataaaactgacaacattagaaagcaaagtagacaatgaagcaatctccaaatagtact

SEQ ID NO: 24005 - DNA, 601 bp, Human
aaaaatcttcacaagccaggcaaagtggctcatgcctgtaatcccaggactttgggaggctgaggcaggaggattgcttgtgtcctggaattcaaaactagcctgggcaacatagtgagaccttaactataaaaaaatttttttttaattagccaggtgtggtagtgtaagcctgtagtcccagatatatgggaggctgaagtaggaggatcacttacacccaggaatttgaggctgcagtgagccatgattgcaccattgcactccagcctgggtgacagagtgagaccctgacacccamaaaaaaaaaaaaaaaaaaaaaaacgaaaacaaaaaaaaaacccaccatcgacaaaaattaaaattttggtatgtccctactatattactatataattgagaaaaaataaattatagctccaggtatcatatgaatgtttttcaggagtgcaatgttgagcacaaaaagtaagtttagaaaaatacctacagaatgatttatataacattaacaagcatgggaaactaaagaagatagtttagggataaaactgacaacattagaaagcaaagtagacaatgaagcaatctccaaatagta

SEQ ID NO: 24006 - DNA, 601 bp, Human
ctattatgtctagtccttacaaatgctctttatcacatccatttacaaggaaactgaagcttagggactagcccaaaggcatatacctattagcgatagatgaagaatttaaatccaggtcttctggatccaaagtctgcatttgttcccctacacatcaatctgaattcaagaggtatagatgacccattccagttaaaaccaaaacaacacatcttacacaggtcactgtgttaggcaaagttagggacagaaaaagaatcagtggccaagttccacttatgcctcttgtgcaacataytgatatgcgatctccttctccaggctggctgatttacttcaggccctctacacctcatgtggactacgggaacagttaccaagccatactccctgacatcaaacctgcccctttcctaatgatcaccctcttcacctactccctcccgagtctgggtctcacagttatagtcccagaatatggactgcatcaattctgggtggtggtcacttgattcagacagacatgagtctgaatcctggctctgtcattgactccagctgtacggtcttgacaaatcatttagcctttgatgtcaga

SEQ ID NO: 24007 - DNA, 601 bp, Human
gcagagtacaaaatggtggggaagagggcagtgcagaaagacaaggcagcccaagtggcggaaatcactaggtgtggtttattggtgatgagatgctatccgtttgtatgtatctctgaatacagctctccctttccctgagaaaagcatgtcacccacaggggacataaggctctttctgatgtaagcaggacaagccaaagttggagacacttcttttgttaccatgctgtttgctggccctacagctctgaaactctaggaattgtgaagtcaccagaatcaaccctgcctttccaayaccagccagcccaaagagaacagaagttacctctttcaggagttcttgcacgtgttcttctcctgataagttctgttctagtctcttctccaaggatgcaaccttctcttgcaaatgtgtgataacgtcttctttctcttgagtttcagcagtgacctgcaggtgaaagcagagatcactctatactagaagccctctcttccttccttcctgctttcttttgggccatcacattttcctgcaactctgtcctcaactgtatcctagaagaacaaacagctaagagatcttcctgaaaat

SEQ ID NO: 24008 - DNA, 601 bp, Human
tgtggccaatcactggaacagaaagagagggaagagcagaatgtgtgcagacaatgagctcagcctgatgagaaagttcccttgcaccactggggaagaggccagtctgcacaacagcctcccttgggaaggagagaatgctgcccaaggtaattcttgcttttgccaaggggcagatgtagctatttaccttggccactgcagagtacaaaatggtggggaagagggcagtgcagaaagacaaggcagcccaagtggcggaaatcactaggtgtggtttattggtgatgagatgctatcygtttgtatgtatctctgaatacagctctccctttccctgagaaaagcatgtcacccacaggggacataaggctctttctgatgtaagcaggacaagccaaagttggagacacttcttttgttaccatgctgtttgctggccctacagctctgaaactctaggaattgtgaagtcaccagaatcaaccctgcctttccaacaccagccagcccaaagagaacagaagttacctctttcaggagttcttgcacgtgttcttctcctgataagttctgttctagtctcttctccaaggatgca

SEQ ID NO: 24009 - DNA, 601 bp, Human
ccaggttgcacactccttatgagaatctagggacgatgatgatctgaggtggaacagttttattctgaaaccaccccctcacccgacccaacctgaccccatctgtggaaaaactgtcttccacgaaaccagtccctggtgccaaaagggttgggaactgctgctccaagtcaaagctggtaagcagaagaggcaaaatgcaagcatggacattctgattctagaaatcaatttattccctagaacccacattacacttcctgtagactgttgaagggaattgtagaagatgtttaagagmgtgatatggtcaccagtgctgattaggaggatcagtttggcagtgagcgtgggagactgtgtcagagagtgaaggaagagagactgatgctgggtaggccaatctggagacttctaacatagactaggctagatttgctggaaaccctgaagtacaaccagtggcactggagatggaggtatttagttgaaactgactgaagaaagaaagggagggtctaatctaggagcctcatgacctgggctttgtcacctttgtcacagtgtggccaatcactggaacagaaagagagggaagagc

SEQ ID NO: 24010 - DNA, 601 bp, Human
tcccaggttcaagcaattctcctccctcagcctccggagtagcttgggactacaggcatgtgccaccacgcccagctaatttttgtatttttagtagagacgggctttcaccatgttggccaggatggtctcgatctcctgatcttgtgatccgcccgcctcggcctcccaaagtgctgggattataggtgtgagccaccgcgcctggcctaatttttgtatttttaatagaggcggggttttgccatgttggccaggctggtcttgaactcctgacctcaggtgatctgcccgcctcggmtacccaaagtgctgggattacaggcgtgagccaccacgcctggcctagagatatatactttaaacaaacttcccaagtaatttctatgcacattaaacattataataatgatgatggcacaataataatattgatcatgtttacagctgacatacattgagaccctactctgttccggttatcattctaagcacttcacatattgtaacttatttaaccctaacaacaattctgagtttaatagtataataaaaccaattttattggggaggaagcaaacacaaagagattaaattactt

SEQ ID NO: 24011 - DNA, 601 bp, Human
agactccgtctcaaaaaaaaaaaaaaaaaaagaaatgtagacttagctgagatagctgttactgagatagttgttaatctcagctagttgcacagatttgaggccttgctccaagcctaaggaaatcagaatttctgagggtagggccagagatatatactttatttacttatttattatttttgagatggaatttcactcttgtcgctcaggctggaaagtagtggtgcgatcttggctcactgcaacctccgcctcctgggttcaagtgattctcttgcttcagcctcctgagtagctrgaattacaggcacccgccaccatgcccagctaatttatttatttatttatttttttgagacagagtctcgctctgtcaccaggcaggagtgcagtggcatgatctcagctcactgcaacctcccaggttcaagcaattctcctccctcagcctccggagtagcttgggactacaggcatgtgccaccacgcccagctaatttttgtatttttagtagagacgggctttcaccatgttggccaggatggtctcgatctcctgatcttgtgatccgcccgcctcggcctcccaaagtgctgg

SEQ ID NO: 24012 - DNA, 601 bp, Human
actgcactctagcctgggcaacagagtgagactccgtctcaaaaaaaaaaaaaaaaaaagaaatgtagacttagctgagatagctgttactgagatagttgttaatctcagctagttgcacagatttgaggccttgctccaagcctaaggaaatcagaatttctgagggtagggccagagatatatactttatttacttatttattatttttgagatggaatttcactcttgtcgctcaggctggaaagtagtggtgcgatcttggctcactgcaacctccgcctcctgggttcaagtgaytctcttgcttcagcctcctgagtagctagaattacaggcacccgccaccatgcccagctaatttatttatttatttatttttttgagacagagtctcgctctgtcaccaggcaggagtgcagtggcatgatctcagctcactgcaacctcccaggttcaagcaattctcctccctcagcctccggagtagcttgggactacaggcatgtgccaccacgcccagctaatttttgtatttttagtagagacgggctttcaccatgttggccaggatggtctcgatctcctgatcttgtgatc

SEQ ID NO: 24013 - DNA, 601 bp, Human
atcctccaaattctgctcagcaagtgttttctgtaagttgaaagaagagtaaaagaagactatcattcctcagttgaataaatatttacagattatctacaacatattgtgacttgtgctaggcacaagagacatgaatacatttttaataattcagctaattgagaaataattcacatatcataaagtacacacagataaatttgaaatagtcccttgaccttgaggctggaacaaaagactaataaaaaattacacaatagagtacagtaagtgtccacaaagaggaagaagcacaggrtgggagatactccctgccacagggcaggtaggcagctttagaactcacaaagtcgttagggttcagggagcctcccaggcagggggatgaccaacggctatgtgaacagcctgctacgttgagggaactactactcctcagaagccaaaatgatgatgggtttaggtcaaaaaacaagactagaaagataggcaaaagggccagctcatgagaagcttttgaatgttgcaaaaaggagttagaacttgattctgtaagcaacatttttcaaagtagaaattctaggccgggtgtggtggc

SEQ ID NO: 24014 - DNA, 601 bp, Human
gacaaagttaacagaatgactcaggactgaaactgataaagcattaggaacaagaatatacaatgaaatcctacaaaccaaataagaaaagactgaaacccccaaagaaaataaggaaaggatatgaatgggcaattccaaaagcagaaacccccaggaattaacaggcacatgaagacaaggccaaactcattaatcaccatagcaatgcaaattaaagcaatgaaataccactccacactcagtaaactggcaaaaattgtaaaggcttggaaatgccaatgctggaaaagtcagaaakgcatatataggaacgctcatgcatgctggaggaggagagccaggtgcaggcttgctgggaacaatcttctcctatagtacttagtctctttaggttttatgcatgatctgaggtggcaggaagaaggaagcaatctggatgtctaccacatagataactacaaagtacaatgaagtgggtacagacagaagttgaggcagctaaaagtaatagagaaaacatacccatagctgcatcatttacagaaattaaaaacccagtgctacatattttaaggcaacccaacaaaaagagcatcta

SEQ ID NO: 24015 - DNA, 601 bp, Human
agcaaaaatgtgatgaatctggtaacactgaacttaagaaagtctattcaacaaaggatacatggacaaagttaacagaatgactcaggactgaaactgataaagcattaggaacaagaatatacaatgaaatcctacaaaccaaataagaaaagactgaaacccccaaagaaaataaggaaaggatatgaatgggcaattccaaaagcagaaacccccaggaattaacaggcacatgaagacaaggccaaactcattaatcaccatagcaatgcaaattaaagcaatgaaataccactcsacactcagtaaactggcaaaaattgtaaaggcttggaaatgccaatgctggaaaagtcagaaaggcatatataggaacgctcatgcatgctggaggaggagagccaggtgcaggcttgctgggaacaatcttctcctatagtacttagtctctttaggttttatgcatgatctgaggtggcaggaagaaggaagcaatctggatgtctaccacatagataactacaaagtacaatgaagtgggtacagacagaagttgaggcagctaaaagtaatagagaaaacatacccatagctgcat

SEQ ID NO: 24016 - DNA, 601 bp, Human
ttagcctatacatttaatgcaatcccaataaaaattcaagttgaattttttagtaactcaaaaacttaaaaattttaaaggcccataaatagttaaagtcaacctttgaaaaaaaaagagaatttgtcttattgggtgttgagatatagtacagatatcactatagtaataaaaacattgtagtgtttacacaagagcagacaatcagaccaatggacagagaatgcagagacaaacccatgtgcagacggaaacaatacgtgataaagttagcaagaggaatcaattcagaaaggacagrctgtttagtaaatgattttgagaaatatgcagaatttctccatatttagatccctacctaagaccatacagaaagacagtttgtaagtgaattagagatttattatgtgaaggaaaaattataaagttaatagggaaaaaacagtagatctctgtgacttaggaacaggaatagattttctaaatggaacttcaaactccacagcaaaaatgtgatgaatctggtaacactgaacttaagaaagtctattcaacaaaggatacatggacaaagttaacagaatgactcaggactgaaact

SEQ ID NO: 24017 - DNA, 601 bp, Human
tcccagctacttgggaggctgaggcaggagaatcgctggaacccaggaggcagaggctgcagtgagccaagatagtgccactgcactccagcctgggcgacagagtgagactccatctcaaaaaaaaagaaagattaaaaataagataccatcacaggccgggcgcggtggctcacgcctataaacccagcactttgggaggccaaggcaggcggatcatctgaggtcaggagtttgagaccagcctggccaacatgatgaaaccctgtctctactaaaaatataaaaaaattagctgggygtgatgctggacacctgtaatcccagctactcggcaggctgaagcaggagaatcgcttgaacccgagaggtggaggttgcagtgagccgagattgtgccattgcactccagcctgggtgacaagagcaaaactctgtctcaaaagaaaaaaaagataccatcacagtatcaacacaaactctaaagtttctaggaattagcaacttaggcaagaaaataagacatctattgagaaaaatgtaaaattttaataaaacacacagaaaataatctgaataaatggaatatatttacattgtt

SEQ ID NO: 24018 - DNA, 601 bp, Human
gcttgaaccaggacacaggaggcagagagagcagtgagccaagattgcaccactggacgccaacccaggctacagagccagactctgtctcaaaaaaaaaaaaataaataaaataaaataaattaaaaaaatacaaaaaaaaaaatgagccgggtgtggtggtacacacccataattccagctctttgggaggttgaggcaggagaatcgcttgtgcctgggaggcggaggttgtggtaggctgagatcaggacactacactacagcttgggtgatacagcgggagtccatctcaaaaaaaaataataaaataaaataaaaataaataaataaataaatatatggtgctgtattcccagtactttgggaggctgagatgggtggatcacttgaggtcaggagtttgagaccagcctggccaacatagtgaaaccccgtctctactaaaaatataaaaattagccaggcgtggaggcaggcatcttttaacccagctacttgggtgggtgaggcaggagaattgtttgaacctgggaagcggaggttgcagtgagccgagatcatgccactgcactccagcctggatgagagtgagactctg

SEQ ID NO: 24019 - DNA, 601 bp, Human
atcctaccactttgggatgctgaggcaggtggatcacgaggtcaggagttcaagaccagcctggccaacatggtgaaaccttgtctctaccaaaaatacaaaaattagctgggcatggtcacatgcctgtaatcccagctacttgggaggctgaggcaggagaactgcttgaaccaggacacaggaggcagagagagcagtgagccaagattgcaccactggacgccaacccaggctacagagccagactctgtctcaaaaaaaaaaaaataaataaaataaaataaattaaaaaaatacaaaaaaaaaaatgagccgggtgtggtggtacacacccataattccagctctttgggaggttgaggcaggagaatcgcttgtgcctgggaggcggaggttgtggtaggctgagatcaggacactacactacagcttgggtgatacagcgggagtccatctcaaaaaataataataaaataaaataaaaataaataaataaataaatatatggtgctgtattcccagtactttgggaggctgagatgggtggatcacttgaggtcaggagtttgagaccagcctggccaacatagtgaaaccc

SEQ ID NO: 24020 - DNA, 601 bp, Human
tcttggtcaacatggtgaaaccccatctctactaaaatgcaaaaaattagccaggcgtggtggagcgtgcctgtaggcgcgcgcctgtagtcccagctactcgggaggctgaggtaggggaattgcttgaacctaggaagcggaggttgcagtgagccgagatcgtgccactgcactccagcctgatgacggagcaagactccatctcaaaaaaattctaaaaaaaaaaaaaattctgttaaaaaaaaaaaaggaatgaaagtctgacatatgctacaacatagatgaacactgaagatgyatatactaagtcaaataagccagacacaaaaggacaaacattgtatgattccaccaacaggaggtatctagagtgtccaaactcaaagagacagaaaatagaatggtggttcccagactggggtaggaggaattggggagttactgtttaataagtatagagtttctgtttgggaagatgaaaaagttttggagatggatggtggtgatggttgtacgacaatgtacactgatcaaaaaggatattcagaaacagaattgaaattataataaaacagtcttttcagaaaaatatagttta

SEQ ID NO: 24021 - DNA, 601 bp, Human
taatcccagcactttgggaggccgaggtgggcgggtcacaaggtcaggagattgagaccatcttggtcaacatggtgaaaccccatctctactaaaatgcaaaaaattagccaggcgtggtggagcgtgcctgtaggcgcgcgcctgtagtcccagctactcgggaggctgaggtaggggaattgcttgaacctaggaagcggaggttgcagtgagccgagatcgtgccactgcactccagcctgatgacggagcaagactccatctcaaaaaaattctaaaaaaaaaaaaaattctgttaaaaaaaaaaaaggaatgaaagtctgacatatgctacaacatagatgaacactgaagatgtatatactaagtcaaataagccagacacaaaaggacaaacattgtatgattccaccaacaggaggtatctagagtgtccaaactcaaagagacagaaaatagaatggtggttcccagactggggtaggaggaattggggagttactgtttaataagtatagagtttctgtttgggaagatgaaaaagttttggagatggatggtggtgatggttgtacgacaatgtacactgatcaaaaag

SEQ ID NO: 24022 - DNA, 601 bp, Human
cattttggaaggccaagacgggtggatcacttgaggccaggagttcgagaccagcctggccaacatggcaaaaccctatctctgctaaaaatacaaggcgtggtggtctatatgtgtagtcccagctactcagaaggcttaggcacaaaaactgcttaaacctgcggggtgggggttgcagtgagccaagatcgcaccactgcactccagcctgggcaacagagcgagattttgtctaaaaaaaaaaaagctatgcctttgcctccctaagtactgggcttacagaacgggggctcgtgcytgcaagccaagcacttagggaaacaaaggtatagcttgagcccaggaattggagacctgcctgggcaacatagggagaccctgttctccacaaaaaggggagaaaaagaccaaaaaaaaaaaaaaaaaaaaaagacaaatggaattcaagtgttcatcaatgaatgaatggagaaacaaaatgtggtctatacatataatggaatattattcagtcttaaaaaggaataggccaggcacagtggctcatacctgtaatcccagcactttgggaggccgaggtgggcgggtcacaaggtca

SEQ ID NO: 24023 - DNA, 601 bp, Human
cagcctcctgggtagctaggactacaagcgcatgccaccacgcccagctatttttttttttttttttgagatggagtctcactctgttgcccaggctggcgtgcagtagtgcaatcttggctcactgtaacctccacctcctgggttcaagtgattctcctacctcagcctcctgagtagctgggactacaggcacatgccaccacacccagctaatgttttgtatttttagtacagacagggtttcaccatgttagccaggatggtctcgatctgctgacctcgtgatccgcccacctcsgcctcccaaagtgctgcaattacaggcatgagccaccgcacctggttgctaatttttgtatttttaatagagacggggtttcaccatgttggccaggacacacagtatttttttaactggtttgaatcacttccttaggacagattccttgaagtggaattactgttcacaatacaaattcaggatttactcattccacaaatactgagcaagactgactccataccaggaactgcacctgggcacgaggccagtgccgtgagtgggacagatgtagactggccctcagggactcactgt

SEQ ID NO: 24024 - DNA, 601 bp, Human
aattttttgtatttttagtacagacagggtttcactgtgctagccaggatggtcttgatctcctgacctcgtgatccacctgccttagcctcccaaagtgctggggctacaggcgtgagccaccatgcccggcctatttttttttttttttttgagatggagtgtcactctgtcatcaggctggagtgcagtggcgtgatctcagctcactgcaacctccgcctgctgggttcaagcgattctcctgcctcagcctcctgggtagctaggactacaagcgcatgccaccacgcccagctatttttttttttttttttgagatggagtctcactctgttgcccaggctggcgtgcagtagtgcaatcttggctcactgtaacctccacctcctgggttcaagtgattctcctacctcagcctcctgagtagctgggactacaggcacatgccaccacacccagctaatgttttgtatttttagtacagacagggtttcaccatgttagccaggatggtctcgatctgctgacctcgtgatccgcccacctcggcctcccaaagtgctgcaattacaggcatgagccaccgcacctggttgct

SEQ ID NO: 24025 - DNA, 601 bp, Human
ccgctaccatgcccagctaattttttgtatttttagtacagacagggtttcactgtgctagccaggatggtcttgatctcctgacctcgtgatccacctgccttagcctcccaaagtgctggggctacaggcgtgagccaccatgcccggcctatttttttttttttttttgagatggagtgtcactctgtcatcaggctggagtgcagtggcgtgatctcagctcactgcaacctccgcctgctgggttcaagcgattctcctgcctcagcctcctgggtagctaggactacaagcgcaygccaccacgcccagctatttttttttttttttttgagatggagtctcactctgttgcccaggctggcgtgcagtagtgcaatcttggctcactgtaacctccacctcctgggttcaagtgattctcctacctcagcctcctgagtagctgggactacaggcacatgccaccacacccagctaatgttttgtatttttagtacagacagggtttcaccatgttagccaggatggtctcgatctgctgacctcgtgatccgcccacctcggcctcccaaagtgctgcaattacaggcatgag

SEQ ID NO: 24026 - DNA, 601 bp, Human
ctgcaaggactaaacgaaaacacgtgcatagcactgagcacagtgcctgggacatggcgaatatgaaatacacgctggctggtttgatttccctatcttctaactccacaccacgcttggcctgtcatcacaggccatcctccccagagtctggacttgttctccccgcccctgattgcaagttgaggcttgactcctagcggagctgccacctctgacagccccaggaccaggctggaccagaaggtgggatgtaaggtggaaaggagctgctggtgcacctcccaggtaactcaggccsaccattaggtcctgactccctccaccccctgctgctggcctgctcacatccagcacaagaactgtatctatgggcaggtccaggtaccgttgccgaagttcggaatgagtttggagcatctgcaaaggcctggagagaaagcattaagggcctggaatgcagcagctccaataagcacttacgagctcctgtatctgagtttcctgggcagccacaatgcccttgctctgttggagctgctcctcagaggcctgcaaggtctgctccagttctctcacctgagagggaagcagaagcatt

SEQ ID NO: 24027 - DNA, 601 bp, Human
ttgacaggagaaagatgtggattctgccatttactggctgcgagcctgtgggctactgagccaatctttctgagcttgcctcgtctacaggatgaggatgacagtgcataattctcaggtctcctgcaaggactaaacgaaaacacgtgcatagcactgagcacagtgcctgggacatggcgaatatgaaatacacgctggctggtttgatttccctatcttctaactccacaccacgcttggcctgtcatcacaggccatcctccccagagtctggacttgttctccccgcccctgattkcaagttgaggcttgactcctagcggagctgccacctctgacagccccaggaccaggctggaccagaaggtgggatgtaaggtggaaaggagctgctggtgcacctcccaggtaactcaggccgaccattaggtcctgactccctccaccccctgctgctggcctgctcacatccagcacaagaactgtatctatgggcaggtccaggtaccgttgccgaagttcggaatgagtttggagcatctgcaaaggcctggagagaaagcattaagggcctggaatgcagcagctccaataagca

SEQ ID NO: 24028 - DNA, 601 bp, Human
ggtgagaagatgagtatccaacagaaacaactctctcctgaccccatcccccctggcgttgctgaggtcccccctgcaggctctgcctgttgctcctggaccctggcctgtccagaagatggagtcttgatgtcatcactccatcctcaaggtgtgtggggacagctctgggcaccagccagcccttagacacaggcctccttcacactactcagtgttgcctcagtggctgcggctttccctggggagaaattatactggggaggcagtataatacagcaatgaagaacagggctttgasaggagaaagatgtggattctgccatttactggctgcgagcctgtgggctactgagccaatctttctgagcttgcctcgtctacaggatgaggatgacagtgcataattctcaggtctcctgcaaggactaaacgaaaacacgtgcatagcactgagcacagtgcctgggacatggcgaatatgaaatacacgctggctggtttgatttccctatcttctaactccacaccacgcttggcctgtcatcacaggccatcctccccagagtctggacttgttctccccgcccctgattgcaag

SEQ ID NO: 24029 - DNA, 601 bp, Human
cacgcctgtagtcccagctacttgggaggctgaggtggcaggatcacttgagtctgagaggtcgaggctgcagtcagttgtaatcatgccactgtgctccagcctgggtgacagagtgagaccctgtctcaaacaaaaaaaaagctgccttctaaagtggtttcctagtgcagaggcggtgccacactgtcaagcacgaggctgacttcgctgtgggggaccctggtgctcctgggcccaccctctcttagctcttcactcaccatcccttgctctgcggtggtctggtcagctgcccgcrttctctccagggccactatctgggcttctagcgcctgggtgcgctccaagaactgctgctccagagcaagggcctgctgctgcacatggctgctctcctggttggcggcagcctgcggggagaccaaaggacggtcagtcagggtgacaatggtttccagtgggggatcttagtctggccctaggtgagaagatgagtatccaacagaaacaactctctcctgaccccatcccccctggcgttgctgaggtcccccctgcaggctctgcctgttgctcctggaccctggcctgtccagaa

SEQ ID NO: 24030 - DNA, 601 bp, Human
gcactggctcattgctatttaatacatcctagcacttacagtgatgcctggcacttacaggactcaaatgtttattgaaggaatgcatgaaaaaaaaatctgactccaaagtccatgcttctcatgatgcaatgctactacattagtacctatgtcactcatcagatctgattactggaagcttactaggtgcaggcattcatctatggacactctcagagaagactgctgccaagggatcaataagatctttgagtcatgaccaagctgggcaagtactacaatgtcccattatccaagktgctttgaaaggggccacgggagtctgggggcatataagaaagtgacagaatctttcctcctttttatccagttatgtttagggaatgaaagaggcatcctctgattaaagctccaagtttgcagaagagaaagtttaacaatccagcagattgtttcttcatttctgtacatggtccctgatataaacaagcaaaacaaaggtccttatcatcttttaaggccttgctttaaggtctccctggaaatatcagcaagagcagtgttttgacagcatgactttcaagcagctgttgattcc

SEQ ID NO: 24031 - DNA, 601 bp, Human
aacagagaacctctacaacagagaaccatccggcctcaaacgtcaatagcgctgaggtggagaaactctgagttatacaaaccaaacctaggtgtcatctacaattcctatttttttctcattcctaagtcctaaaagctccatctcaggcagggcatggtggctcacgcctgtaatcccagcactttgggaggccaacgcaggtggatcacttgaggtcaggagttcgagaccagcctggccagtatggtgaaaccctgtctctaccaaaaatacaaaaattagccaggcatggtggcaygtgcctgtagtcccagctacttgggaggtggggcatgagaactgcttgaacccaggaggttgaggtaacagtaggccaagatcgttccactacacaccagcctgggcgacaaagtgagactccgtctcacatacaaaaaacaaaaagcaaacaaaacagctctatctctaaaataaatcctgatctgaatacttcttcccaagtccaccactaatgtgctagtcacttctggcctagattcctaaaaagtctcctaaacagtcttcttgcttctgctcatgcctcccttaccaaacattc

SEQ ID NO: 24032 - DNA, 601 bp, Human
acccacccacaacagagaaccatccacaacagagaccctccacaacagagaccctctataacagagaaccatccacaacagagaaccatccacaacagagaacctctacaacagagaaccatccggcctcaaacgtcaatagcgctgaggtggagaaactctgagttatacaaaccaaacctaggtgtcatctacaattcctatttttttctcattcctaagtcctaaaagctccatctcaggcagggcatggtggctcacgcctgtaatcccagcactttgggaggccaacgcaggtggrtcacttgaggtcaggagttcgagaccagcctggccagtatggtgaaaccctgtctctaccaaaaatacaaaaattagccaggcatggtggcacgtgcctgtagtcccagctacttgggaggtggggcatgagaactgcttgaacccaggaggttgaggtaacagtaggccaagatcgttccactacacaccagcctgggcgacaaagtgagactccgtctcacatacaaaaaacaaaaagcaaacaaaacagctctatctctaaaataaatcctgatctgaatacttcttcccaagtcca

SEQ ID NO: 24033 - DNA, 601 bp, Human
tacgtaccctattcattcagttaccccagtggttctctgccagcagtgcttttgcccccacgagacatttggcaatgtctggagacactgtggttgtcctaagtggggctgctactgacatctagtgggtagatgctcctaagcatcttatcatgcatatttgcagcaaatacaacaaagaacttccacaacagagaacctccacaacagagacccatccaaaacagagaaccatccacaacagagaccctccacaacagagacccatccacaacagagacccatccacaacagagaaccmtccacaacagagacccatccacaacagagaaccatccacaacagagaccctccacaacaaagaaccacccacgacagagaccctccacgacagagagcctccacgacagggagcctccacgacagagagcctccacgacagagaaccatccacaacagagaccctccacaacagagaaccctccacaacacagaaccctccacaacacagaaccatccacaacagagatcctccacaacagagaacctccacaacagagagcctccacaacagagaaccatccccaacagagaccctcca

SEQ ID NO: 24034 - DNA, 601 bp, Human
tctttgtctcctttcttgaccagttggcagcatatcacagagttcactactcaatccttcttgtagcgctttctgccctgtacttccagagccccacatgcacctgcttttactgctaccctacctgcggctcctttggcgtcttctctgtcggcccctccttttgttctgagcctgtgcttgtgggtgtggccctggccttcattttggcctcttttctatctgcactcattgatagccatttggctgtaattttgcctatgagctatgctgattgatggtttcctaatttaaagttttgtgtgtgtgtgtgtgtgtgtgtgtgtgtgtgtttgaaataggttcttgctctgtcatccaggctggagtgcagtggtacgatcttgcacactgcaagctccgcctcctgggctcccaagcagctggaactataggcacacaggcttcctaatttatatgtctactcagaatctgctccaattttccagacttgtcagcctacagactactagatatgcctgttgggtaggcctctgaagctcaacatgcccaaaatggaatccactcttgacatacctcccaggacccccatctcagtgaa

SEQ ID NO: 24035 - DNA, 601 bp, Human
tctgactcccgggttcaaacaattctcctgcctcagcctcccaggtagctgggattacaggcatgtgccactatgcccagctaatttttgtatttttagtagagatggactttcaccatgttggtcaggctggtcttgaattcctgacctcatgtgatccatccgctttggcctcccaaagtgctgggattacaggggtgagccaccacgccgggcccattttattttctatttcattaatttctgtgcttatatttgttatttcttccttgagtttgatttgtgccttcttctgactttytgagatgcatacatggctcaattttcaggctttcttcctaagagatgccactgagactgaaatttccttccatgcactgctttagttatacttgaccaattttgatccacagtatttacaaaatcatttatttcaaaatattataattatttttttgagacagagttttgctcttgtcacccaggctggagtgcaatggcacaatctcagctcactgtgtgagccactgtgcccaactttatttcaaaatattttaaaatttccattgtgatttttttctttgacctatgggttatttga

SEQ ID NO: 24036 - DNA, 601 bp, Human
aggtgggaggatcgcttgaacccaggagttcaaggccatcctgggtaacacagtgaggatctgtctctataaacaataagaaaaattagccgagcatggtgtcacatgcctgtagtgccagctactcaggaggccgaggcgagaggattgcttgtgtccgggaggtcaaggctgcaggaaaatggattccttcaagcatcagctagtgaggggctaggctgacaagacagaactgagtctctgtggctccaaagtctgccctagcgcctcagagccacgtaagatccagcactgtgggagstggggttgacagtgcctgctcaggttcactgtggcacaaagcagggcctgcagcttgcagaagccaccaggccacccatgcacggctgcctctgcgatgattctccaggatgggcttagggaacagctgctttgaagagcgtggatggagaaaaacaattctaaatgtatgtgcacctaatagcagcacttcaaaatacatgaagcaaagacagacagaactaaaggaagaaagagacaaatctaccatcgtagtggaagactgagcacacccttcttagtagctgatggaacaagtaga

SEQ ID NO: 24037 - DNA, 601 bp, Human
gcaaaaactcaacccaaccttacgtggcctctggggcaggtgggcaatgataggtcacctcacagaattagagcccactaggcccgtggacatggaccactttccaggtaattatagttgaaaaatcagaaaagggcatcctatggggtaagagtttctttataacatttgtctcccagcttcctagagagcacaggggcccacgcagctgactgcattccctgagtcctgagtctactaccctaccctggagagacaggccctctccaacagtctcacggcaggatgggcctgctgcctrtgggactgcagggggacatcgcccctcagcgtgaaacagggcccacctgttgctggaactcttccctttgcttccgcacctcctccagggcttgagccatggccacgctcacaatttctctttggctccattcttcctacaatgcagaaaaccactgagccccaaaacttagttcacagttttttagctgtatgccacgcaagaagcccagcagacagggcatggctttgcagagccagaccaacatgctccccacttcccaggctcccagcctggcccctccctgccatgccctcagta

SEQ ID NO: 24038 - DNA, 601 bp, Human
gccatatgagtgccctactttatttatttatctatttatttatttattgagacggagtcttgctctgtcacccaggctggagtgcagtggcgcaatctcggctccaccaagctccgcctcccgggttcacatcattctcctgcctcagcctcccgagtagctgggactacaggcactcgccaccacgcctagctaattttttgtatttttagtagagactgggtttcaccgtgttagccaggatggtctcgatctcctgaactcgtgatccacccgcctcggcctcccaaagtgctgggawtacaggcgtgagccactgcgcctggccaagtgccctacttcaaagaaaggaccctacatgcaggggagcgtcgtgtccaccatgtgtccccactgctgcctccttaggggcactctcggcacctgccctgcatcttgctgtagcacccatgcaggtgcagctgggacttacgtgcgactcattgactgagagtgcttcggcctgcaatgggccccgcagcctcagcaggtcctcctgctccgcgaccactgcagcctcctccgccttgagggtcctcagggcctccagctcggcctgcag

SEQ ID NO: 24039 - DNA, 601 bp, Human
caccatttggtgttcttcctgcagttggaagctggaacacagggtcctgcatggccctcgaggtcacctacaaggtggcagcagcaaattgagagccaggacaggtcaggtgaagctgagccacaggtacacagggaaggggagctagactcgtcccttaggtatgggcgttgtgctccaacaggcaactggccaggaagcaattcctggagaagatccaatgcccaatgcccacaactaatcacacgactagtctttgctgggatgaaggggcttgctctcccctgcctaccgacagggstgccatctgtgatgggctcttcaggactcatggcctcctagccatatgagtgccctactttatttatttatctatttatttatttattgagacggagtcttgctctgtcacccaggctggagtgcagtggcgcaatctcggctccaccaagctccgcctcccgggttcacatcattctcctgcctcagcctcccgagtagctgggactacaggcactcgccaccacgcctagctaattttttgtatttttagtagagactgggtttcaccgtgttagccaggatggtctcgatctcctga

SEQ ID NO: 24040 - DNA, 601 bp, Human
gaagtgtgttttccgatgttttgagtttcagacaccttagagctcatgtggagacaggtttgtgaggctagtgtccgtggagctgtctgggcgggaggtagggaggggagtcagctgcgcagggcatggctgagatcgcagaggagggcgcacagtgcagagaagagctgtgagggctgcccttgtgcacggcgggtggcagtgggaaggagactggcctgtcagaggagacggagaaggagcaggccatggatgggagcttcaggaggaggaagagacgcctgtccaaggctgccaacaggccaatcagagggaaaattaggaactgccttctggatttagcagtgcagatgttactgatgagcttgacaagagtgtttttctgtggagtggtggaggaaaggttgagagagaagaggagtgggaatggagatggcagatataggaagttttaacatgtcagcacggcaggtgagcagagacgcagcagcagggcaaaggggtgcaagccgagggctttcataaggtgcctgcacaacggcgcacctctcagtagatgggacgattccaagaaaaaacgacctaggcaagaagggggagg

SEQ ID NO: 24041 - DNA, 601 bp, Human
agggtggcataaagaaagtgaggatgaccagggaaaggcacttccaaacggaaggctcagcaagtgccaaggccctgaggttggagggtacttgatgggagtgaggcccctgtggctgagagggagtgacgaggacaggaggggctcagctggcaggggtaatgaggggccacaccacacagggctttgcgggcctctgcaaggactcaggctttcataagagatcaacagagacaggctttcatcagagggctaagacaagagtgccagggaaaccagttagaagtctgataccatcttycagagaagagacaatggtaacctgaagcaggtggcagcgatgtgaagtggtggattctgggaaatgtgtgaagggggtgctgaaggaatctgctaacagcctggatgctggtagagaaagaaccaaggcagataggacaactccaaggcttttgccgtctactgagatgggaaaggtggcatggcagccagggaacacagtgaagccgaagtgtgttttccgatgttttgagtttcagacaccttagagctcatgtggagacaggtttgtgaggctagtgtccgtggagctgtctgggcg

SEQ ID NO: 24042 - DNA, 601 bp, Human
gaggctgaggcaggaggagaattgtttgaacccgggaggcggaggttgcagtgagctgagatcgcgccactgcactccagcctggcgacagagactccatctcaaaaaaaaaaaaattagccaggcgtgatcgtgggcacctgtaatcacagctactcgggaggttgaggcaacagaatcgcttgcaccgaggaggcagaggtcgcagtgagccaagatcacgccattgcactccagtctgggtgacagggggagactctgtctcaaaaaaaaaaaaaaaagaaatcaataatcaaatccrcagtgtatcagagggtatgaagaggcatggagaagaggcagcatggtgagggagggtggggttctggtggtgaggctggtcagggtggcataaagaaagtgaggatgaccagggaaaggcacttccaaacggaaggctcagcaagtgccaaggccctgaggttggagggtacttgatgggagtgaggcccctgtggctgagagggagtgacgaggacaggaggggctcagctggcaggggtaatgaggggccacaccacacagggctttgcgggcctctgcaaggactcaggctttcata

SEQ ID NO: 24043 - DNA, 601 bp, Human
acagtccctctgtgttgacatgagtgccccagcgctgcctatcccttcccgggggcttggtccaccacacacagcccagctggaaaaggctctggaccatagattttgccctcaaaattcgatttttatgctgtgatccccaagtaggatacttaggcgaggacttacggttctcatcactactgctctcttgaaatacattaataatctgcaatgcttattttgaacaccctaaaaagatcatggtttttctgcacaactcatcaacatccagttttagataaataatttggaaaataatttttttttttttgagatggagtctcactctgttgcccaggctggagtgcaatgacacgatctcagctcactgcaacctccgcctcctgggttcaagtgattctcctgcctcaggctctaggggagctattacaggcacacaccaccatgcccgactcatttttgtctttttcttcttcttctccttcttttttttttaagatggagtttcactcttgttgcccaggttggagtgcaatggtgcaatctcggctcactgcaacctccgcctcctgggttcaaacgattctcctgtctcagc

SEQ ID NO: 24044 - DNA, 601 bp, Human
gtgggtgacgctctggcactctgaagtttggcagcaatgataggttctttcttcccctgcatcctcgggggcctggcaggcttaagggaactgccccagcagctaccctaccctttggcaggacccaggagcgatgggtggattccgttcccggcttccggcctctggcctcagcacccaggccaggatttagaagtggagcctatgtctcccaccaggagccagttcctgcacggcctctcccgccagccgctcactccgcaggccaacgccagcaggagaaatgactgggtgaccacargggcgtcaaaccaggatgtacgaggaaaagagagaaaggggctgggcaggggtccctgcaggacagactgtagggcggggcctcaatacccaaaagacacctcaaaagccctttacctcggattcgcgacaagacatgaattttaaaaccacatgtttaaggtactcaaagttgatctcgcgggcatctgtcaggtcagtgttattcgtgacggaaggcgccatgtttgccatctcaggtccaggtttctcccggacttcgaagagctcattatcgggtctgattttctgaaaaaccagt

SEQ ID NO: 24045 - DNA, 601 bp, Human
cgcttttggaatctgagtgctgagccagacctggggctctcgataaagcgctatcaatgaaaatgctttgaaaaatacgtggcctgttggtcaagtacagcacagacatttgggcacaaaggatgtcatcgctaaaaagtgcttggatcaagttcatccaaaagcagccaagctgatcatgcagctgtgctggtgcctacactcgggtgtgggtctaaggggtcttacactgctactgctgggataactgacaacgtatcttggaagctggaacagtagaccagagaaccctaccttataytccagagtttccttgagcatgttctcctcctcttgggaaaagttcagcaacactgacacagcttttataagatgaaaagcctgaaacacagtaagttttgctgccataggccttggtgaaggtgaggcggggtggggtcgggggagctacgtggcatttcctgcttgctttggttagcaggaccaggtggtgggtgacgctctggcactctgaagtttggcagcaatgataggttctttcttcccctgcatcctcgggggcctggcaggcttaagggaactgccccagcagctaccctac

SEQ ID NO: 24046 - DNA, 601 bp, Human
gtttggacccaaaccatgacatctgcatttgaaacagaaaaggcttctgagatgcaaatcaggacttggtgccagggaaactgaaccgcccctcccctcccgtgagcctgtcactcctgccccccacacatcctgcctctggctctgagcagagcaagaagatggtgccagtaaccagtctgcaggcccgtgctcagtacaggagggaaatgagagaaaaacactgagttgacaggaacaaggtagtggaactgcaggtattttttcctattagagcatttatgcagacgcttttggaatytgagtgctgagccagacctggggctctcgataaagcgctatcaatgaaaatgctttgaaaaatacgtggcctgttggtcaagtacagcacagacatttgggcacaaaggatgtcatcgctaaaaagtgcttggatcaagttcatccaaaagcagccaagctgatcatgcagctgtgctggtgcctacactcgggtgtgggtctaaggggtcttacactgctactgctgggataactgacaacgtatcttggaagctggaacagtagaccagagaaccctaccttatactccagagtttcc

SEQ ID NO: 24047 - DNA, 601 bp, Human
ggtggtctgcatcgcccagcggcagcgcagcacagaatcaagacaaagcacacgagatcccactgcacttcagagggagcagtgccagagtgcgagtgagaagacaaaggaacaggaatcctagttttaggaagaatttcctctggacgctctgattttaagaacaccagttaaatggattttatagtacagaagacatgtttatagtagtgaagaacttcagctataaaaaatagtttaaaatggtttaccagcaacctatccaagacaagtacattcattaaaaaggcaattgagtgtwtttggtactaagggtcttttcatatatttgctagttttcttaagtaaagtggagatactgtcagaaaggtgcattttctcattcatccacaccggcccttaaagatggatcctctaaagttctaggtggtttgagagacagggtgaaagaatattttcttgagaggaagggataaaaagcttctaactcatctgaatttttaaaagccactcccatagagttcccatggagttggctgttcctggcagaggcaggtgggtttggcctgctgggcaccatctcaaagggccgtctctacct

SEQ ID NO: 24048 - DNA, 601 bp, Human
caggacagcttggggactgtggggggctgctggggacgctcacgtccatgtgcttcttttccagtgccatcaagtggaacttcaccaaggtaagggggctgtggggggtaggggaccagcttcccctggccacagccgtggcccagatgggcagcggacaggaagggcagcctcagccccttgcaggggtggccccacagtttggacaccgtctctccacagttcctcatcgacaagaacggctgcgtggtgaagcgctacggacccatggaggagcccctggtaggtcctctctagggascccgcttgaggctcgggggcttgggaggtagctgccctaacccagctttcctccccgacaggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaatta

SEQ ID NO: 24049 - DNA, 601 bp, Human
tggcccagatgggcagcggacaggaagggcagcctcagccccttgcaggggtggccccacagtttggacaccgtctctccacagttcctcatcgacaagaacggctgcgtggtgaagcgctacggacccatggaggagcccctggtaggtcctctctagggagcccgcttgaggctcgggggcttgggaggtagctgccctaacccagctttcctccccgacaggtgatagagaaggacctgccccactatttctagctccacaagtgtgtggccccgcccgagcccctgcccacgccctyggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctggatctttctgcgtaggggcttggggggcccttttgccaggggcccctccatgtcagggccagttgccgtcagctgccaggctgggggtgccatggaggtggcgtgttgttgccccctcttcctccaggct

SEQ ID NO: 24050 - DNA, 601 bp, Human
gtcaggagatcgagaccacggtgaaaccccgtctctactaaaaatacaaaaaattagctgggcgcagtggcgggcgcctgtagtcccagctactcgggaggctgaagcaggagaatggcgtgaacccggaaggcggagcttgcagtgagccgagatcattccactgcactccagcctgggcgacagagcgagactcggtctccaaaaaaaaaaaaaaaaaaaaggcttaatgtttagttttaaggaataaatgtaagcagtgtctaacacatagtagatgctctacagatatcactgcagycaatttcatagaaaaaaaaagagagaagctagctcacaaaggtttactggagatggttttgttgtggtttttgtagacaactttccccatttttccataattccataagcatcacaagcttttacagaaaaaggcagcgtaaagtattgggccaggattcaaatcaattagctcagccactggcagacagcagccatgctgattagcctcccagtctccctaagttaaaggagaagcacaaattgaattaagataaatatgacctaaggaatcaggggctgggtagttaaaaagtgtgca

SEQ ID NO: 24051 - DNA, 601 bp, Human
actaagtatcaattatgacttgctatcacaggaggggactgactatctattaaacccaagcttctggaacaatttttttttttgaaacttgggtttcttgctgtcacccaagatggtgtgcagtggtgtgaacatggctcactgcagcctcaacctcctaggctcaagtgatcctcctgcctcagcctcctgagtagctggggactactgccacctgccaccacacactgctaattttttttttttttttttgaagcagaattttgcttttgttgcccaggctggagtgcaatggcacgaycttggctcactgcaacctctgcctcctgggttcaagcagttctcctgcctcagcctcctgagtagctggaattacaggcgcccgccaccacgcccagctgattttttgtatttttagtagagacagggtttcactatgttggccaggctggtctcaaactccagacctcaggtgattcacctgcctcagcctcccaaagtgctgggattataggcatgagccaccatgcccagcccacacactgctaatttttttattttttatttttgtagacatgggttcttgccatgttgcccaagt

SEQ ID NO: 24052 - DNA, 601 bp, Human
ttaaaagtcacagtaaaagaagagctaacttccccagaacttcactaaaaggctgagaattcaagaactaagtatcaattatgacttgctatcacaggaggggactgactatctattaaacccaagcttctggaacaatttttttttttgaaacttgggtttcttgctgtcacccaagatggtgtgcagtggtgtgaacatggctcactgcagcctcaacctcctaggctcaagtgatcctcctgcctcagcctcctgagtagctggggactactgccacctgccaccacacactgctaattttttttttttttttttgaagcagaattttgcttttgttgcccaggctggagtgcaatggcacgatcttggctcactgcaacctctgcctcctgggttcaagcagttctcctgcctcagcctcctgagtagctggaattacaggcgcccgccaccacgcccagctgattttttgtatttttagtagagacagggtttcactatgttggccaggctggtctcaaactccagacctcaggtgattcacctgcctcagcctcccaaagtgctgggattataggcatgagccaccatgcccagc

SEQ ID NO: 24053 - DNA, 601 bp, Human
tttcagctacagaaaaagaagcaagctttgcaaccaggaagatgccatcttactatccaacgcagaaatactatattttcttctctaccttccccaaattaatacaagttcaattttagaacttttgttcaaatctattgagattggatatcttactgccacacacgtttataatgtcttgggcattggcttggaaaggtaatcctctcatgtggacaaaatgcagagaagacgtagttccaaaatcagcagcctctggaagcttttctggcacctccttaggcaattctgagaggtggarcagaaagcactgttaaaacataacagcttcaagggttattaacagattctaattaggtatgacttttatgtccaaatcctcaattcctcttaagagcattaaaagccaaaatgatctgaaatttctgccactcaacaaatatcacctgaacacccataagcactgaatgcctcagaccattaccagtttaagaacttacccctttttgtaacatcagagagcaggtaaaatgattatgaattaaaccctaaaagagactttctagattacaggcactgaaaaaaaaaaaaaagaacaaag

SEQ ID NO: 24054 - DNA, 601 bp, Human
gatcaaaaccagcctggccaacatggtgaaaccccatctctactgaaaatactaaaattagccgggcatggtggcgcctgcctgtaatcccagctactcggtagaccaaggcggaagaaatgcttgaacccgggaggcagaggttgcagtgagccaagttcactccactgcactccagcctgggcgacagagcgagactctgtcacaaaaaaaagtaataccaagccacacttttcagctacagaaaaagaagcaagctttgcaaccaggaagatgccatcttactatccaacgcagaaayactatattttcttctctaccttccccaaattaatacaagttcaattttagaacttttgttcaaatctattgagattggatatcttactgccacacacgtttataatgtcttgggcattggcttggaaaggtaatcctctcatgtggacaaaatgcagagaagacgtagttccaaaatcagcagcctctggaagcttttctggcacctccttaggcaattctgagaggtggaacagaaagcactgttaaaacataacagcttcaagggttattaacagattctaattaggtatgactttta

SEQ ID NO: 24055 - DNA, 601 bp, Human
ccaatatttaaataacaagctgtttaatattaaagcagaaagtactgccacattgtgacagaagtacagctttatccataaacccttcacacaattatacattaaatgctatttttatttaagcaaggcacccctacttgttctaaaatatgggatgtactactccatttaaaaagcaaatgaggagactgatttttttcctatctagagctggtttaaattcaagtgaagccattaattttcttaccagtctggactgttctgacatgtcacttcacagttttgagactaacaaacaccyttaggtctaccccaaaccaaaaaaagccagggagggacagtttagacaacttttaagttaagactagaatgcccccttaagtagataggcaccaccgttatacgcctttagcacaaggcttagaaaggcaaaacatttctaaagacataaaaccgccaaattgtcatttacactaagctgtggtattttttgttttgatttttaaaaattcctatctctaagtaatcaaatacagcaaaatttaaaactattctgccaaaccataccagttcaaaggtctgaaaccgttctttgctttgg

SEQ ID NO: 24056 - DNA, 601 bp, Human
gaagatgctttaatggctcccaaagtcctttttagagcctctgatggcaggggctctgggaaagcccccagcccagtcccctcccttgcccagataaaccatggccaaaaatgtccaacagtgggcacagcttctaaatgttctcctttaaggagaggcctctggtgggcctaccaaacctaacttacagggacacccaggagctaggcctgggcctttgccatttccgtttttttttttttttttttttttttttttttgaggcagggtcttgctctgttatccaggctggagtgcagtsgtacaatcatagctcactgcagccttgaacccctgggctcaagcgatcctcctacctcagcctcctatgtaggactacagacccacgctatcagccccaactaactttttaatttttttgtagagttggggtcttgctattgtattgcccaggctggtctcaaactcctggccttaagcaagcttcctgcctcagcctcccaaagtgctgggattacaggtgtgaactactgcacccaaccctttgtcatctatcttttcttcacttggagaaaagtgagaaaattaagacttagtgact

SEQ ID NO: 24057 - DNA, 601 bp, Human
ccctcaaacccacagtttgtctccccatagcagccagatcacacacactacaacttcccaattgaagatgctttaatggctcccaaagtcctttttagagcctctgatggcaggggctctgggaaagcccccagcccagtcccctcccttgcccagataaaccatggccaaaaatgtccaacagtgggcacagcttctaaatgttctcctttaaggagaggcctctggtgggcctaccaaacctaacttacagggacacccaggagctaggcctgggcctttgccatttccgttttttttkttttttttttttttttttttttgaggcagggtcttgctctgttatccaggctggagtgcagtcgtacaatcatagctcactgcagccttgaacccctgggctcaagcgatcctcctacctcagcctcctatgtaggactacagacccacgctatcagccccaactaactttttaatttttttgtagagttggggtcttgctattgtattgcccaggctggtctcaaactcctggccttaagcaagcttcctgcctcagcctcccaaagtgctgggattacaggtgtgaactactgcaccc

SEQ ID NO: 24058 - DNA, 601 bp, Human
cactacgggaggccgaggcgggaggatcgccaagttcgagaccagcctgaccaatatggtgaaaccctgtctctactaaaaatacaaaaattagctgggcgtggtggtggcaggcacctgtaatcccagctactcaggaggctcaggcaggagaataacttgaacctgggaggtgtgggttgcagtgagccaagatcgtgctactgcactccagcctgggcgacagagcaagactctgtctcaaaaaaatacaagtaagtaaaataagataacataaataaataaataaataaataaataataaaatcctacagggatggaagtgccagcacttccactgcagcagtgggaatctgaggttcagagagggtaccccacaaagtatgtaagttgaggcctggggatgtggactggtcactaagccggcaccgccaccgccccaccacttacttcctgcctgatttgccgttgacccggagcagccagggctggtcctcgggccggaactccttgaggacgatgccgtacttcttcctccgagcctcctcccgaagcttgcggttgaactcactgcccgcgcccgattcgggcatctcctcct

SEQ ID NO: 24059 - DNA, 601 bp, Human
catttgcctccagctctgctatctgtgggccacacccgggaaactgaggagccaagtgagaagatggggcgggaaggcatggccaaatttttttttttgagatggagtctcgctctggcacccaggctggagtgcagtggcaccatctcagctcactgcaacctccacctcccgggttcaagcaattctcatgcctcagcctcccgagtagctgggattacaggtgtctgccaccacacccagctaatttttgtagttttagtagagacagggtttcaccatgttggccaggctagtttcsaacccctgaccccacgtaatccgcccgcctctgcctcccaaagggctaggattacaggcgtgagccaccgcgcccagccatggcatggccaaatctgaagtggacacctggcccgggccaccatttcctcaagcctaaacaactgcccagcctccttgaggcctctacctcattcttttctaccccaaagttccggacagtctgggtgagtgcctcttccctgcctacagctttccaaggctccgctggacccagcacatcctggcacccactgccctgtgtgagctgcctgtgtctgtc

SEQ ID NO: 24060 - DNA, 601 bp, Human
tctacttgggaggctgaggcaggagaattgcttgaacctaggagtcggaggttgcagtgagctgagattgcgccactgcagtccagcctgggcaacaagagcgaaactcagttcaaaaaaaaacacacaaacaaacaaacaaacaaaaaaacaccaaagagggaaaaaggtgttttatttgttttgttttgagacggagtctcgctctgtcgcccaggctggagtgcactggcaacatctaggatcactgcaagctccgcctcccagttcacgccattctcctgcctcagcctcccgagtgctgggactacaggcgcccgccaccatgcccggctaattttttgtatttttagtagagacggggtttcaccgtgttagccaggatggtctcgatctcctgacctcgtgatccgcctgccttggcctcccaatgtgctgggattacaggcgtgagccaccacacccagccgaaaaaggtgtttttttaacctttgggagccatcgactctttgagcatctgctcatctgtgacctgtgcaaatgccatttgtagatgcgtccagagtgccctccccaccatctgcaagcaccctagggtggt

SEQ ID NO: 24061 - DNA, 601 bp, Human
cctcgaaggcctcgtcgtctgaacccttcttcttcttctttttcctgccgcccttggccagcggcgccttcttcttggccttggggactctgccccctgggaagggaggaaaggaaggaaaggagggaaagtgaggaggaaggcagtgggtatttattgtgtttttcacattttgtgcagttttgacatcctggggggcctcactgactggggagactacacctccagggccagcccaggagctcagctctcctaaacaaactcccggcagaccccacacccccacccaccttctctagcrctcacagaccactccccctctcccagaccacccgggcgaggcacctgataaccagggacacagcccctacagcccggagcgcacaggagttattgaaactggtcaacctagagttgcagtttctcataggaacccccgtaaaggccacagccaggccaggtgcagtggctcatgcctgtcatcccagcactttggcaggctgaggcgggaggatggcttgagcccaggagtttcagaccatcctgggcaacacagtgagtgagaccccagtctctacaaaaaacacaaaaattaggccgg

SEQ ID NO: 24062 - DNA, 601 bp, Human
caacaggctcccgccaccatgcctggctactttttttttttttttgtgccaggatttcattctgtcacccaggctggaatgcagtggcaccatcatagttcactgcagccttgaactgggcttagcctcccaagtagctgggactgcaggcgctcaccatcatgcccagccaaaactgaagacttactgggctatgtggtggataagtcacagctgaagagagacttagggaagtggaagggagaactgtagaagttacccagtgggcagcacaggcccttggtcagtgtgagggaggccragccaggaggaggaggacaataagaaggcctaacaggcatctgaagattccagaaggaagggccagaggaggagatggcttaacttttccagaattgctaactacggggccctgggagtcagggagcaagcaggatgtcgaagggtcactgagagcctgaagttctggagggcagagccatgtattggacagagcctcactctaggatggcgaaggggcagtgagagccttaagttctggggggcagagccatgtattggaccaagcctcactccttgagggagaagtgcattttgtcgt

SEQ ID NO: 24063 - DNA, 601 bp, Human
gatctggggctaattcactatgctacaccatactgaccatagagtctcctatacacataactttgcagtttgggaaatacgaagtacacttggttttctcttttgcttttactatttgattgagtttttttttttttttgttaaaaaaacaaaacaaaacaaaacactttgtgtccaaaggagaatctcactatgctgcagacatttctaaaaagtcaaagaagtagaattaatgagatagaatagaaatgaatcataactggttccctcctccctcaaatcagaaagaagtaactcactrgtttgatttttttttcctaaaaggcaaaaggaactgcaaatattaacaccaacctggattttctatttcaacagaacttaaaggcacgtctgtgtcaggtgaggggagaggttttacatcagatgggcttttctatgaagaaataccataaaatattaataacacaattttctagtcttaagacagtaaaaagtaaaatgcttcagcttaaaaatatttttttctaaaattttttttcttttggttgaaatcccctttgcagagattttgttattgttgttgttactagttactggtata

SEQ ID NO: 24064 - DNA, 601 bp, Human
caataaatattcttttcaaaaagcactatgtggtttaatactgttctggataaacaaaatatatccatggcctttcacatgttttgtatctgcttagcacctgggagtggagatgaaagcatgtgccagatggcttgccagtgtgcacaggaggtcatttgggaatgacactatattgataacatgctatattgatatagcattgatgtcagtgctatattgataacagctaacaggcatgaggacttatgatggccacaaatggttttaaatgctttaccggttgtagctcatttaattctcattaaactttgtgaggttgatactatcattatccccatattaaaagaggtttagtagcttgctcagggttacacagctaataggtgttggagcatggattcaaatccaagtctgatttcagatctggggctaattcactatgctacaccatactgaccatagagtctcctatacacataactttgcagtttgggaaatacgaagtacacttggttttctcttttgcttttactatttgattgagtttttttttttttttgttaaaaaaacaaaacaaaacaaaacactttgtgtccaa

SEQ ID NO: 24065 - DNA, 601 bp, Human
ctctaattactcctttacatcattagttcttgttgagatggtactgtcattttaacctcttatgcctttggcttataaactaatttagagccatattctataaaagtagaaataaagcattttaaataatctttaataatgtgttttcctatgttttctgtgaggtgcagtcagaattcataacttgtctcactaacatactaagacatttaataacttcacttgcacaaatgtggggaaataaagtgagcctaaagtttggttcttctgactttccactgccgttacacatatttgagaygtgaacagagaaccaaagcagcaatcctgctaatgtggaaatgcatacaattctttaagtaaacatattctgtcttccatgcttttactcactcaggctgcccttctgctaaaactaccctgccctaggtaatatctatctgtcttttagggctaatcccaggtgatttcatcttcagaagcctttgatacctgtctcagtctctgggacaagtggagctattgcctccactactgtagaacttgttcactgcaatgacattctgttttttccattagtctctcagcttctaaaggacga

SEQ ID NO: 24066 - DNA, 601 bp, Human
ggttaaaacaatttatactctaattactcctttacatcattagttcttgttgagatggtactgtcattttaacctcttatgcctttggcttataaactaatttagagccatattctataaaagtagaaataaagcattttaaataatctttaataatgtgttttcctatgttttctgtgaggtgcagtcagaattcataacttgtctcactaacatactaagacatttaataacttcacttgcacaaatgtggggaaataaagtgagcctaaagtttggttcttctgactttccactgccrttacacatatttgagacgtgaacagagaaccaaagcagcaatcctgctaatgtggaaatgcatacaattctttaagtaaacatattctgtcttccatgcttttactcactcaggctgcccttctgctaaaactaccctgccctaggtaatatctatctgtcttttagggctaatcccaggtgatttcatcttcagaagcctttgatacctgtctcagtctctgggacaagtggagctattgcctccactactgtagaacttgttcactgcaatgacattctgttttttccattagtctct

SEQ ID NO: 24067 - DNA, 601 bp, Human
ctcctgtgggaaataggctagtgggtcacatatgcatgccacagtggccagctgactcagattcgcttattctcatttttcaccaatcacagatcatgtgcacttttagaaggttaaaacaatttatactctaattactcctttacatcattagttcttgttgagatggtactgtcattttaacctcttatgcctttggcttataaactaatttagagccatattctataaaagtagaaataaagcattttaaataatctttaataatgtgttttcctatgttttctgtgaggtgcagtcrgaattcataacttgtctcactaacatactaagacatttaataacttcacttgcacaaatgtggggaaataaagtgagcctaaagtttggttcttctgactttccactgccgttacacatatttgagacgtgaacagagaaccaaagcagcaatcctgctaatgtggaaatgcatacaattctttaagtaaacatattctgtcttccatgcttttactcactcaggctgcccttctgctaaaactaccctgccctaggtaatatctatctgtcttttagggctaatcccaggtgatttcat

SEQ ID NO: 24068 - DNA, 601 bp, Human
caccaaaccttcccatcccatccccaattttaagaaatccaacatgagccatccatggggtcatggtatcttcacaggaaagatttctttattacaatattttgctgatttaattataaaaatacaagggaaatggtcatttctttccccacgaataccaaatttaactatgaaaatttcattgctgattcgaatgtcacctctggaacctttgttgaaatttaattgccattgtaacagtgttgggaggggcctttaaggtcacgattaggtcatgaggactccattctcataaatgtartaacgccttatagagggaatgggcttctgatgaaaggatgtgtttggcttcatttcctctctcttcatcttacgcttttgcttgccttgctgctttgttatcatgcagtaagaaggttctcatcagttacaaggcagatgtcagtgccatgcccttcgccttcccagcctccagaactaggaagaaaataaatttcttttctttttaaattacccagtctgtcgtattctggttatagtagcagaaaattggctaagacattcatatatagaagtacagagaaattgcttggaaaagttc

SEQ ID NO: 24069 - DNA, 601 bp, Human
aggaaattgttctataaaggtgggacttgggagcagtttcagactttccatattcttcagcagtccctccccaaggcctccaaataaacctgcattctaagaaaagacagaggcttgctctgcagcttcaaagtaaatgcccaaactcaaaacacccccaccccatgagactgctgccccctcactctcaaggtcctgagtgatctgacccctcctgagcagccttacactgtacttccccacccctctggagtcccagcagaagtgaggggtgactgcccctcgcacagccaacaccttrgcattctctgcgttaccctctcccacttcagtcctttgtgtggccaagtcctgctcctcctgcagactcaccccagtcctcaatcgccaggagggaatgggagcagggtaggctgaggagcagtcatcgggccattgaaaaacacaaaccacacaacctgccccaagcacagttaatagcctcatttttccccctgtatagtgtacatacagcaaccagctctgccctgttttctgggacttccctggttttagaatgaataatctccaagcagtgttcttgcaactgttgcaaggacca

SEQ ID NO: 24070 - DNA, 601 bp, Human
caaagtaaatgcccaaactcaaaacacccccaccccatgagactgctgccccctcactctcaaggtcctgagtgatctgacccctcctgagcagccttacactgtacttccccacccctctggagtcccagcagaagtgaggggtgactgcccctcgcacagccaacaccttggcattctctgcgttaccctctcccacttcagtcctttgtgtggccaagtcctgctcctcctgcagactcaccccagtcctcaatcgccaggagggaatgggagcagggtaggctgaggagcagtcatygggccattgaaaaacacaaaccacacaacctgccccaagcacagttaatagcctcatttttccccctgtatagtgtacatacagcaaccagctctgccctgttttctgggacttccctggttttagaatgaataatctccaagcagtgttcttgcaactgttgcaaggaccatgttaaattgctttaaatgttgagacctgcacctggcacctagtaagcgattgttagttgttttaaaggaagaggaaataacagtctcttctaacgctgattgtgttggacaaactgtcctaataaat

SEQ ID NO: 24071 - DNA, 601 bp, Human
aataacagtctcttctaacgctgattgtgttggacaaactgtcctaataaatgctgtcttcacctggaaaatttctgagggcagttctgggtatttgagcttctataaccatccatgcctacttaagcaaggtgttattctttctttctgaactttgaggtgcttgttgattggaaaagtctagaaccccaccactaaatccattcatttatatatgcatgcatttactcatgcattcagtgaatatttattgagtacctactatgtgctagatactaaactggaggctgcacttgttcaytctatataataaagtctagcacccacttgaacttgctacggcccttgcttcaggtcttgctactgagaaacaccgtgaatgctggatcctataccctgcctggttcctggctcccgagacccagatcctgagccagtgttcactgggtccctgggctgcctcagtgccttgtattatcttcttccccacctccaagctccttggtggccccagacacccctagcttggcccatctgtgtcctgctgtggacccctagctgggagtctgttttcccctcacccattatgactcctgactcc

SEQ ID NO: 24072 - DNA, 601 bp, Human
tgtcctaataaatgctgtcttcacctggaaaatttctgagggcagttctgggtatttgagcttctataaccatccatgcctacttaagcaaggtgttattctttctttctgaactttgaggtgcttgttgattggaaaagtctagaaccccaccactaaatccattcatttatatatgcatgcatttactcatgcattcagtgaatatttattgagtacctactatgtgctagatactaaactggaggctgcacttgttcactctatataataaagtctagcacccacttgaacttgctayggcccttgcttcaggtcttgctactgagaaacaccgtgaatgctggatcctataccctgcctggttcctggctcccgagacccagatcctgagccagtgttcactgggtccctgggctgcctcagtgccttgtattatcttcttccccacctccaagctccttggtggccccagacacccctagcttggcccatctgtgtcctgctgtggacccctagctgggagtctgttttcccctcacccattatgactcctgactccagcaggcagttacttataagaaagaggcatctggcagct

SEQ ID NO: 24073 - DNA, 601 bp, Human
tctctccctcagaggtggttttgaatgtggaatggaggagtctagccctgggtaaatatatatatacatgcatacatcgtacgtatctatgtatgtatttattggcctttctcagggcttttgactcacaggaactcaggagctggagaggcagcagttttggtgaaggaggttgagggtggaggtgagatgagggtagactgaccaggctacttagacttctccaccatctccctcatcccacattattttctgccctgggtccatgaccctcaaccctccatcctcaaggaaacttgakcctgcctttgccttgctttgaaccctgggcaaggggctccccatgggtcatggctgtgactgcaaactgtgtttgaagaacaaccaagtttgggaggtgctgtgtgctctgcgaccttctttgagatccacacttctcagcagcttattaataactcaggaaacatctacaatttgaaaagaaagaaaaagcagcagaagcaagcaatcaaagacacctgttggactctgtgtaacctggcattctccaactcattgcaccactgagcttttattcttcctaggtgatattattaacatt

SEQ ID NO: 24074 - DNA, 601 bp, Human
ggaatggaggagtctagccctgggtaaatatatatatacatgcatacatcgtacgtatctatgtatgtatttattggcctttctcagggcttttgactcacaggaactcaggagctggagaggcagcagttttggtgaaggaggttgagggtggaggtgagatgagggtagactgaccaggctacttagacttctccaccatctccctcatcccacattattttctgccctgggtccatgaccctcaaccctccatcctcaaggaaacttgatcctgcctttgccttgctttgaaccctgrgcaaggggctccccatgggtcatggctgtgactgcaaactgtgtttgaagaacaaccaagtttgggaggtgctgtgtgctctgcgaccttctttgagatccacacttctcagcagcttattaataactcaggaaacatctacaatttgaaaagaaagaaaaagcagcagaagcaagcaatcaaagacacctgttggactctgtgtaacctggcattctccaactcattgcaccactgagcttttattcttcctaggtgatattattaacattatgcagatacaagtgttcccctgaaggc

SEQ ID NO: 24075 - DNA, 601 bp, Human
ggaggagtctagccctgggtaaatatatatatacatgcatacatcgtacgtatctatgtatgtatttattggcctttctcagggcttttgactcacaggaactcaggagctggagaggcagcagttttggtgaaggaggttgagggtggaggtgagatgagggtagactgaccaggctacttagacttctccaccatctccctcatcccacattattttctgccctgggtccatgaccctcaaccctccatcctcaaggaaacttgatcctgcctttgccttgctttgaaccctgggcaasgggctccccatgggtcatggctgtgactgcaaactgtgtttgaagaacaaccaagtttgggaggtgctgtgtgctctgcgaccttctttgagatccacacttctcagcagcttattaataactcaggaaacatctacaatttgaaaagaaagaaaaagcagcagaagcaagcaatcaaagacacctgttggactctgtgtaacctggcattctccaactcattgcaccactgagcttttattcttcctaggtgatattattaacattatgcagatacaagtgttcccctgaaggcagtag

SEQ ID NO: 24076 - DNA, 601 bp, Human
ggctggcaatatatagtatgatacactatattataaaatagtctctgggtcagatgattttgcatgactttaggttaatgttaagtgttctgagcctgcttaaggtaggctaggccaagcttcgatgctcagtaggtttggagtattaaatgcatttttcatttacagtatttttaacttattatgggcttacaggaacctggctcccatcataaatcaaggagcatctcttttggttgtggcattgtatctgtcctcacacaacccctgtgggtcttgaccaccatcccaggccccagarcccctgcctcagactgacccttgcacctcttcccacctgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggcgaccctgccctccaagatgctggtgatagcagcagaaaggagtactttatttgagggacaacagacttcacttccctgaatgcctcccccatctccatcaggaaaaatacacccc

SEQ ID NO: 24077 - DNA, 601 bp, Human
gcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaattkgaaatgtaaccgagcattccgagtccaacagtattactgtagttatctggggaaagataaacgccacccagggcttgcttttcacctgtgcaatattatattctctgacggggccaggacagttcatttctggctcttgtgggggccagttcccagagagcacagccagtacaggcggctcccaagcctgccaagggaggaaggacaagtgaccagctttcctttccctacaggggcaccagctgcaggaaacaaaaggaagggtgaaatgtccctctagaaatagccgttcccagtggc

SEQ ID NO: 24078 - DNA, 601 bp, Human
cgccggcctctcggcctggactgcccacctcggccctgcgtcagagcggaaggccaagtcttccagaaggtgctgcggcctccccgcagccccttagcgactcgggatggggcggctgagtcacgaacgccgaggcgggcaggtgcggcgccgccggcctccccccggcaggctcgggtcttccgcgccacggaggtccccgaagagcgcccaagccgcatccggaaggcccgaaccctaccggagggcggacggcggacagggcagggcccgaggccgacgcggcaggcggtgcgggacrggagcgggggcgggcggggactcgaggccgggcggcgaaggcgggcgaggggaggggaggggaagggagccgcggcccgcttgccccgcagtctgaagcggctcagctctttccatgagggcggtggtggcccttaaaaagggctttgtggtggcatggggaggcctggcggccggccgcggcgcgggccctcttagtactcctgggaggcctgggtggccttcttgccgcccgagggcgccttcggccccacggtggcgctggtcttcttgggcagcagcacggcctggatgttgggca

SEQ ID NO: 24079 - DNA, 601 bp, Human
attgccgagttgagtttgctggaagggaaatggggcggcgtcggggggcccgacaggcctggctgccagtcggcttccgcgaaaacgactcttgctgtccacatagccagccgtgaagccaaactgcaggcctctgccctcccctaaatgtcctcctaggaggcagtcactcgggaggaagatgtgcctgttaccaagtgcttcgtcccggccccagcgcagacctatgaatgaagatggagggagagctgatgtgaaaggcctgggtcccggccgcagaaggggcgccagaccgaaatcrgcgatcgcgtctctcccaccaaagcctcccggccagcggccgcgtctgaaagtcctgggctaagcaccacgccgggggggtaccagacaccccggctgcagctgccgagggcctcactcaccttcagggccgccggcctctcggcctggactgcccacctcggccctgcgtcagagcggaaggccaagtcttccagaaggtgctgcggcctccccgcagccccttagcgactcgggatggggcggctgagtcacgaacgccgaggcgggcaggtgcggcgccgccggcctccccccggca

SEQ ID NO: 24080 - DNA, 601 bp, Human
gtccctttcccaagttgaccagatcctccgtggtcagacggtctccatctaactcgatgtactacacaaaagaaggggatctcagtgagtctgaacagcttgattattctaaccagagtagggacacctccaacagaaccaaactgacatttcagagatctgatcattgcgtgaaacatgaatatgctaaataaaaatgcatcttgcataagaggaggcttattggtgcaaaagcataatgcctttccaagccccctttccccactacagagctggataaagccctgtggttggttggttkgtttgttttgaggcagagtctccagcccaggctggagtgcagtggtacaaacatggctcactgcaacctctgcctcctgggttcaagcaattctcgtgcctcaggctcctgagtagctggtattacaggtgcacgccaccatacctggctaatttttgtacttttagtagagatggggtttcaccatgttggccaggctggtttcaaactgatgacctcaagtgaactgcccacctcggccacccaaagtgctgggactacagacatgagtcactgctcccggccagccctgttctaatt

SEQ ID NO: 24081 - DNA, 601 bp, Human
ctcagctgggaaaatgaagggaatcatggtcaaatccttggagggacagaaggaaggcaatgggagaaaccagccagcctgggttttcaataccaactcacatgcaaggtaacccaagcctcatcctctgatctgtaaattggggcaaatgtgaattatttcccttgttgaaaaatatttaaaagatgagggtaggtggaacgtgaacatatgtgtgttttaaacttactgtagcttattgataggaattacagttctggcaaatttcccaaaacctgtagtaataccgtaaacaactagrataaaaagagacattatgcaattaaatgcagggatttttgtttgtttataaaaatatttataacataaagataaaaagatacctgttttctcttttatgatgctatctatgacctccctggatttctgcaccctcttctcagctgttggggtgagctaggaaaatgttgatcagaactgagcacgttaaagacttccacgggcaacaaaaatggccagaggacatctttcccctccctccccatacctttattttgtagcgtccctttcccaagttgaccagatcctccgtggtcagacg

SEQ ID NO: 24082 - DNA, 601 bp, Human
gaagggacaatacctccaatcactgcaaatctggtttccacattagaattttcctatccaagaagaaagctccagagttgagttccctcatatcctgccactacatggcttcttgattacaagggagtcattaacctctttgcatttctgttctacccttgcaagaagttggattttagtgtgcaagtctggccatcacctgggggacattacgatttcagattcccaggcaccaaccagaactactgaattggcctttgggatggacattgatatcatgcaatttttctaaccatattcrtgtaccacttaatccaagtttcttctaggcaggcttgaatgtaagggcagacttaagagtcctgttctagtcttgaagatgacaaatgctagggaaagggtcttgcagaataagttaaagttcataggagtaagcatctctgatcgactttctcctcttcccccatctaactatcctactttttgccaacggcatttcccactcatttcaattatttcatgtcttctcaggtgattcctcagcatctggccaatcaattctaccctgtggtacatgtccagcctccacagaggttccgtc

SEQ ID NO: 24083 - DNA, 601 bp, Human
tttggaaacattggaaaagtaatataaaatgttccagaaggaggtggtgcaccaaagcattaacaaggtttcccaggggaagagaagtcataggcaactgagtcttttcattttgccagtcacccagtctacactccactgccccttatcaatgaacacgtgccattttctaagaaattcccaaaaagttaccaaaaaagaggcttcatttttctgaaataaaatcagattcctgacagcagcattttttccaactgttaaataatgtcagtcgggtatggcagtgccatccacagaccarcttctggctgatagttcacgctggggaattctcagaggtgccttagactcccccataaagtacaggtgggtttaaggttggagtgctactatctgggattttagggctatatagtatggcagaccaaggtaggagtaaaaataggtgttggaatcactactagtctgttcagcacagccctgtatatacaatagactgctcattgaaattgctctccactcattggcagatcctattcacgtgccacttgcgtccataacatggaaactcaagaatgtgttttgctgtttgtgactgcct

SEQ ID NO: 24084 - DNA, 601 bp, Human
ttgtttattataggaaaaatagttagaaattatctaaatatgaaattaaaggacattcatttgaccaagtttagccattcacagctattggaaaatgtttggaaacattggaaaagtaatataaaatgttccagaaggaggtggtgcaccaaagcattaacaaggtttcccaggggaagagaagtcataggcaactgagtcttttcattttgccagtcacccagtctacactccactgccccttatcaatgaacacgtgccattttctaagaaattcccaaaaagttaccaaaaaagaggyttcatttttctgaaataaaatcagattcctgacagcagcattttttccaactgttaaataatgtcagtcgggtatggcagtgccatccacagaccaacttctggctgatagttcacgctggggaattctcagaggtgccttagactcccccataaagtacaggtgggtttaaggttggagtgctactatctgggattttagggctatatagtatggcagaccaaggtaggagtaaaaataggtgttggaatcactactagtctgttcagcacagccctgtatatacaatagactgctcat

SEQ ID NO: 24085 - DNA, 601 bp, Human
acaaaaattagccaagtatggtggtgcatgcctgtagtcccaactactgggaaggctgagatgggagaatcacttgaacccgtgaggtggaggttgcagtgagccgagattgtgccactgcactccagcctgggtgacaaagcaggatcctgtctcctaaataaataagaagaaggaaggaggacacttctggatgcaaagccctcaaaatctgtgtgctctaattcaacctagtacttccacttgtagaaattttagcaatatatcttgaagaagtgatcaggaactagctgttttttttgtttttgtttttgttttacagttcattgtttattataggaaaaatagttagaaattatctaaatatgaaattaaaggacattcatttgaccaagtttagccattcacagctattggaaaatgtttggaaacattggaaaagtaatataaaatgttccagaaggaggtggtgcaccaaagcattaacaaggtttcccaggggaagagaagtcataggcaactgagtcttttcattttgccagtcacccagtctacactccactgccccttatcaatgaacacgtgccattttctaagaaat

SEQ ID NO: 24086 - DNA, 601 bp, Human
gagagagtggggcaaggtctccactggcaccaacggttcctttctctgggacatagggcaggcaggaggctgggagagaagtaggcagcaattagttcaagagtactgcattctgactctccttgctttgccagtgagtgcccccactgcccccgcaaacaccctgcctccaatatctatcactttatggcatagatacctggggaaagacaattcttcaaacccagctaatatgtaagggacctggatgaattgttatagaaagaaaaagaggagtgggggtggagaggaagaagagagraaggtaaagaggagacagggaggaaaggagggctggagggaaagtcagcaagaaggaaagaagggccaggcgcagtggctcaagcctgtaatcccagcactttgggaggccgaggcgggcatatcacttgagcccaggagttcaagaccagcctgggcaacacggtgaaaccctgtctctgcaaaacatacaaaaattagccaagtatggtggtgcatgcctgtagtcccaactactgggaaggctgagatgggagaatcacttgaacccgtgaggtggaggttgcagtgagccgagatt

SEQ ID NO: 24087 - DNA, 601 bp, Human
taaagtaaggatagtaggagctccctcactgggctgttgtaaggactaggtgatacgaagcatgcaagcacagttggtgtccaacctggggcaattgctgcagatagaagctgctacgagtcttacgtatttagcatcagcccagccactcttcggagaccacatcttcccttctccaactagcccaagagcaagatgagagagtggggcaaggtctccactggcaccaacggttcctttctctgggacatagggcaggcaggaggctgggagagaagtaggcagcaattagttcaagagyactgcattctgactctccttgctttgccagtgagtgcccccactgcccccgcaaacaccctgcctccaatatctatcactttatggcatagatacctggggaaagacaattcttcaaacccagctaatatgtaagggacctggatgaattgttatagaaagaaaaagaggagtgggggtggagaggaagaagagaggaaggtaaagaggagacagggaggaaaggagggctggagggaaagtcagcaagaaggaaagaagggccaggcgcagtggctcaagcctgtaatcccagcacttt

SEQ ID NO: 24088 - DNA, 601 bp, Human
agtgtgtgacctccctgctaggcactggaaatgttgtaggtgcaggataaatagttgggattaacagtagcagttatgccttttcaccaaggtgatgaccaaacccagaaggctgacagccgagtatagaagctaacaacagtcttgcctagtctgacttctaagctttcgctgtctcatctgtaaagtaaggatagtaggagctccctcactgggctgttgtaaggactaggtgatacgaagcatgcaagcacagttggtgtccaacctggggcaattgctgcagatagaagctgctacragtcttacgtatttagcatcagcccagccactcttcggagaccacatcttcccttctccaactagcccaagagcaagatgagagagtggggcaaggtctccactggcaccaacggttcctttctctgggacatagggcaggcaggaggctgggagagaagtaggcagcaattagttcaagagtactgcattctgactctccttgctttgccagtgagtgcccccactgcccccgcaaacaccctgcctccaatatctatcactttatggcatagatacctggggaaagacaattcttcaa

SEQ ID NO: 24089 - DNA, 601 bp, Human
caggcttttttgattagccactagggtaagagcttagggaaaaatgaaacctgctttccagaagccatatagtaagtgctatgagccataccactgcacctgtgagaccagctcgtaattaaaattgtgagagtgtgtgacctccctgctaggcactggaaatgttgtaggtgcaggataaatagttgggattaacagtagcagttatgccttttcaccaaggtgatgaccaaacccagaaggctgacagccgagtatagaagctaacaacagtcttgcctagtctgacttctaagctttygctgtctcatctgtaaagtaaggatagtaggagctccctcactgggctgttgtaaggactaggtgatacgaagcatgcaagcacagttggtgtccaacctggggcaattgctgcagatagaagctgctacgagtcttacgtatttagcatcagcccagccactcttcggagaccacatcttcccttctccaactagcccaagagcaagatgagagagtggggcaaggtctccactggcaccaacggttcctttctctgggacatagggcaggcaggaggctgggagagaagtaggcagca

SEQ ID NO: 24090 - DNA, 601 bp, Human
ccagttcacgctcccttgcctccagagcttgacctaaaaagtcctctaacctcattagtgcttcatttaaatactggcaaaacctcagagcagggtttttgtggcacatgtgtgagcaccaatgaagaggggattataaaattccctctactagatggagacagaatcccgagggggcgatgggcagaacaatcttcccttgaaagaaaagaagtagagagtcattaagttaaggtctctctaggaaagaaggaaggggaagttaaggtaagagaaggacagagctggtcccatttactaygtcaatttcacagattcaagtatcagctagaggctggattctgttctgggtgttggggtcggtctaggagtaggcaaaatgaagacaggcaagctcagggcaatctgagtaatagtacattcagtgcttgaggatgtgggaagtgggtggggtgcagtggaaaacaatcatttgctaggagagcatacaggagggtcacaaggaactcgagaggtaggaagtggagcagcggagacggaagcttcttagagggcttttctatttttctttttattttttagacacctgtctctgtaaccc

SEQ ID NO: 24091 - DNA, 601 bp, Human
ttcttgagtttccttacctcttttggttttaaaataactggtttcaatccatgggcttctagcacctatagaatgattaaaaatatgaaaatgggtatcaaatgaaatactagcctatttccaatatcatatggaatccaataatagctctttatgcccaaaagtccatcttataagaaatgagacctacaggaactggctgtattcatgttctctggtctattctctagttctgttctttagtcatgaaagcagacttatctttcaattaatttttgtactgaaatcaggggctccattktctatagaatcaaccctaaattttggtttctacgtccttcgtgttcagtttctaccttagcagttcaccttttttaccactgcctcctgacatgcaggcatctgacacacatacatgcatctgtgttgtgctcaggctggactcctcccagttcacgctcccttgcctccagagcttgacctaaaaagtcctctaacctcattagtgcttcatttaaatactggcaaaacctcagagcagggtttttgtggcacatgtgtgagcaccaatgaagaggggattataaaattccctctacta

SEQ ID NO: 24092 - DNA, 601 bp, Human
taagcacaaatctggcaaatgaaacactcattaagtatccacattcccaaagcagcaatgcagctctggagtgtagactgcacataaaatctttagtgcattaggttgcatttcttccttaaattcttactgttatagatgagacatccaaaaaaacccaattctggtccaagactcttagcttagagcattctaaggaatttgggctgagaacatctatctctcagagatcctaacagaactcgatttgaagttttaagttcctaagagaccccctatgcattgtggcatgaagaatctytttttcttttttgagacagggtcttactgtgttgctcaggctggtgtgcagtggtgcgatcatggctccctgcagccttgacctccagggctcaagtgatcctcccaccttagcctccagggtagctgggattacaagtgtgcgccaccatgcctggctaatttttgtcttttttggcggggcggggggggcgggtagagatgggtttcaccatgttgcccaggctggtctcaaactcctgagctcaggcaatccacctgtctcggcttcccaaagtgctaggattacaggcatccgcca

SEQ ID NO: 24093 - DNA, 601 bp, Human
gctctacagcttcacagcccagggatgtgatcatctgcgtcccattgatgagtgccaggccctgtcgggggagagagcaaagtttcctactgtgattattgtaacgaacctacatacccgtggattttgtatcttttgctttcataagagaaaaattagccagtcataaacataaaaaattatgtttatgttttctaaagtgcgggacagtaatgtttatttaagcccttgaagaataagtgctatcatatgtgaactcgtaagcacaaatctggcaaatgaaacactcattaagtatccmcattcccaaagcagcaatgcagctctggagtgtagactgcacataaaatctttagtgcattaggttgcatttcttccttaaattcttactgttatagatgagacatccaaaaaaacccaattctggtccaagactcttagcttagagcattctaaggaatttgggctgagaacatctatctctcagagatcctaacagaactcgatttgaagttttaagttcctaagagaccccctatgcattgtggcatgaagaatctttttttcttttttgagacagggtcttactgtgttgctcagg

SEQ ID NO: 24094 - DNA, 601 bp, Human
ttgtgccatagcctagatgaagaggcagcacactgggtacgccacaggcacttgggttttctccttccctactacctgcccccaccacttctgtgtctaaagatctcagccaccccgccccaccacctctggttgaatgaataacaaccaaaaggaagaaccctgctgaccagtgtcaaaggctttggtggtgcccttcagcacctcaagggtcagggctgccacaatgtcagcctgccgtgcaatagcactggctcgctctacagcttcacagcccagggatgtgatcatctgcgtcccrttgatgagtgccaggccctgtcgggggagagagcaaagtttcctactgtgattattgtaacgaacctacatacccgtggattttgtatcttttgctttcataagagaaaaattagccagtcataaacataaaaaattatgtttatgttttctaaagtgcgggacagtaatgtttatttaagcccttgaagaataagtgctatcatatgtgaactcgtaagcacaaatctggcaaatgaaacactcattaagtatccacattcccaaagcagcaatgcagctctggagtgtagactgcaca

SEQ ID NO: 24095 - DNA, 601 bp, Human
aatggtgcctgtcacatagaatctgctatcgttattaaaatatcagggaagtcttacatcaggacttaatcttcctgtagatctaatttggcaattcttacccataggtgttttgatctattgctcaataagctagctagaaaagataacttgctgactaaagggaaatgagggtatttattctagggaggactctctattacaccatagactgaaatttggcacagaccaaaatatggtttattgagatgactggctctctaactgtcatatgtaaattacacatctgtaatacagatgyctaatgccaacccaggtcatctgcatttttaatttaaagttaagcatcacaaattcatttaaaataatttatattgcccataaaatgcaagtaaggtataaccattactatgcacctgagtttcaaaatgatataattaagactttcctgtaaacacctctgactatctggttaaagtttcatcttaacagggagaaacagtacaactctactaactggttatgattttattactaagaatttttaaaagttagggcactgaatcaacataagaggttgtctgggccggggacggtcctc

SEQ ID NO: 24096 - DNA, 601 bp, Human
gaagattaaatgaattaataaatgaaagacagtgataatggtgcctgtcacatagaatctgctatcgttattaaaatatcagggaagtcttacatcaggacttaatcttcctgtagatctaatttggcaattcttacccataggtgttttgatctattgctcaataagctagctagaaaagataacttgctgactaaagggaaatgagggtatttattctagggaggactctctattacaccatagactgaaatttggcacagaccaaaatatggtttattgagatgactggctctctaaytgtcatatgtaaattacacatctgtaatacagatgcctaatgccaacccaggtcatctgcatttttaatttaaagttaagcatcacaaattcatttaaaataatttatattgcccataaaatgcaagtaaggtataaccattactatgcacctgagtttcaaaatgatataattaagactttcctgtaaacacctctgactatctggttaaagtttcatcttaacagggagaaacagtacaactctactaactggttatgattttattactaagaatttttaaaagttagggcactgaat

SEQ ID NO: 24097 - DNA, 601 bp, Human
aacaaattagaataaattcattatcatatatattcacattagatcaatctatacaaagcagcatggtgtgggaggaagaatgccaactctagacacaggcagattcactcccaggttagtggtaggacttgggcaagttccttaggtttatagttaaaagataggaagacttagaaaagagacaatagcacttatggcttttgagaagtacataaaataatgcaaacaaattcttagatgtgactcgcagagattactcaaatggtagctattatccaaggcggtaaagttcattaagcaygaaggcatcacattagaagatgctcacacataaggcagctacgctgtacaaaccccagaaatagccacaatgctataaagcagcacctggctctggtttctcccagaagtcaaggaagtaattatctgtctgtgtgatcgtgggcaagatacttaattctgtgcctcagtttccccattgcaaaatgggagaaagagtatcttatagttgggaagattaaatgaattaataaatgaaagacagtgataatggtgcctgtcacatagaatctgctatcgttattaaaatatcagggaagtc

SEQ ID NO: 24098 - DNA, 601 bp, Human
gctgggtgtagtcgctcacacctgtaatcccggcactttgggaggccgaggcaggtggatcacttgaggtcaggagtttgagaccagcctggccaacacagcaaaaccctgtctctactaaaaatacaaatattagccaggcctgctggcacatgcctgtaattccagctactcaggaggctgaggcaggagaatcgcttgaacccgtgaggcagaggttgcagagagccgagatggcaccactgcactccagcctaggagacagagtgagactccgtctaaaaataaacaaaaaaaaaaatgccaaaaacctcaggatgaggaagccataactctttaatcaatactttggtaagtgttaaaaggctgacctctgcataatgcaaactgctctcactcaaagcagagaggcctgcataaattgttcagcatttctgcaatcacatttgtgacccacgtcttcacccttccaccaacaaccttggcagtgggttttagggccagtgtcttcaggaaacatgtcagccaatgctggaaatatcttcttaaatcttgaataggtccattttgaaagtacagcatgttagacttggaacctgag

SEQ ID NO: 24099 - DNA, 601 bp, Human
ttgttgcaacactgcactccagcctgggtggcagatagagatcctgcctcaaaaaaaaaaaaaaaaaaaagagaaaaaaaaagccagccaaaggaccagcttagttctgcatggttccctggttcttaatctttagtgaagatcagaatcacctggagggttcgttaaacacagattgctccgctctcctcctggagtttctgaattagccagcctgcaaggaggcctgagagtctgccttcctaacaagtttccaggtgatgctgatgttgctggtgggagatcccacttgagaaccacrggcacagtggtctatcaggcaggcccgccaccccgaactcatcagcattaccttgctccacatgctcgatgaccctgagggctttccttgctgcccatcctcccatggagacgtggtcctccgtggctgcgctggtggagagggagtcaacagacgagggatggcacagagccttgttctcagaaactgcaagagaccagtgccagttaagaagtgctcctcataggatgagctgtctaaaggacccgtggcttccacagagtgctccacagcatgggatacactctccagaagatcttg

SEQ ID NO: 24100 - DNA, 601 bp, Human
aaattacccaggtgtggtggtgcttgcctgaggtgtcagttacttaggagactaaggaaggaggatcacttgagcctgggagttcaaggctgcagtgagctattgttgcaacactgcactccagcctgggtggcagatagagatcctgcctcaaaaaaaaaaaaaaaaaaaagagaaaaaaaaagccagccaaaggaccagcttagttctgcatggttccctggttcttaatctttagtgaagatcagaatcacctggagggttcgttaaacacagattgctccgctctcctcctggagtktctgaattagccagcctgcaaggaggcctgagagtctgccttcctaacaagtttccaggtgatgctgatgttgctggtgggagatcccacttgagaaccacaggcacagtggtctatcaggcaggcccgccaccccgaactcatcagcattaccttgctccacatgctcgatgaccctgagggctttccttgctgcccatcctcccatggagacgtggtcctccgtggctgcgctggtggagagggagtcaacagacgagggatggcacagagccttgttctcagaaactgcaagagacc

SEQ ID NO: 24101 - DNA, 601 bp, Human
ccatctttacaaaaaatttaaaaattacccaggtgtggtggtgcttgcctgaggtgtcagttacttaggagactaaggaaggaggatcacttgagcctgggagttcaaggctgcagtgagctattgttgcaacactgcactccagcctgggtggcagatagagatcctgcctcaaaaaaaaaaaaaaaaaaaagagaaaaaaaaagccagccaaaggaccagcttagttctgcatggttccctggttcttaatctttagtgaagatcagaatcacctggagggttcgttaaacacagattrctccgctctcctcctggagtttctgaattagccagcctgcaaggaggcctgagagtctgccttcctaacaagtttccaggtgatgctgatgttgctggtgggagatcccacttgagaaccacaggcacagtggtctatcaggcaggcccgccaccccgaactcatcagcattaccttgctccacatgctcgatgaccctgagggctttccttgctgcccatcctcccatggagacgtggtcctccgtggctgcgctggtggagagggagtcaacagacgagggatggcacagagccttgt

SEQ ID NO: 24102 - DNA, 601 bp, Human
ttgagccccagttctattaaataattgtatgcatttcatcaagatgctttacatctcgtggtttccaattccatatgaattgcggggtggggatactggactagaagatgagaaattgcttccaggtccacagtgaattccacaacttcatcctctcccactgtgacctgtctgcactcactagagttcatagtgtacttcataaattgaatgtgctgttgaatcaaggtggggtgtgagagttcatggtactcttctctccactttgaatatgttttaaaagtctcattaaaaaaaaaaaccactttgggggtgaggtgggaggatcgcttgaggccaagagtttgagaccagccaaggcaacacagcaagaccccatctttacaaaaaatttaaaaattacccaggtgtggtggtgcttgcctgaggtgtcagttacttaggagactaaggaaggaggatcacttgagcctgggagttcaaggctgcagtgagctattgttgcaacactgcactccagcctgggtggcagatagagatcctgcctcaaaaaaaaaaaaaaaaaaaagagaaaaaaaaagccagccaaaggaccagctta

SEQ ID NO: 24103 - DNA, 601 bp, Human
tttacctgaataattaccagacctgcacacctacccaggaagctgcccattcatctgcactagcaaaatctgccatgtcccccattcacatcctctaacaaaggtttgttggccaagtttgggtcatgtgggtagggaaggaagtcagaaagaagagctgatcctcatcttgagccccagttctattaaataattgtatgcatttcatcaagatgctttacatctcgtggtttccaattccatatgaattgcggggtggggatactggactagaagatgagaaattgcttccaggtccacmgtgaattccacaacttcatcctctcccactgtgacctgtctgcactcactagagttcatagtgtacttcataaattgaatgtgctgttgaatcaaggtggggtgtgagagttcatggtactcttctctccactttgaatatgttttaaaagtctcattaaaaaaaaaaaccactttgggggtgaggtgggaggatcgcttgaggccaagagtttgagaccagccaaggcaacacagcaagaccccatctttacaaaaaatttaaaaattacccaggtgtggtggtgcttgcctgaggtgt

SEQ ID NO: 24104 - DNA, 601 bp, Human
tcttaccttacaacagagcgcaccaggtcatagaccttctccagcggagtggttgttttcaggggacgtagaaactctatgccctggcaggctgcaaggagctcgatggccagcactgaaacaagaaattccaagagggtagcttatgaaagtctgacttcatgcttaaggaatgtggatttcccaaagttgacacccatcaccacccaactaacagatggtttgttctctgtctattggtagaatgaagttgctttggtatttagttgccattttaacctgttttctaaccccttgactrtatctttaatgctgagaaggggagaattgagacatttacctgaataattaccagacctgcacacctacccaggaagctgcccattcatctgcactagcaaaatctgccatgtcccccattcacatcctctaacaaaggtttgttggccaagtttgggtcatgtgggtagggaaggaagtcagaaagaagagctgatcctcatcttgagccccagttctattaaataattgtatgcatttcatcaagatgctttacatctcgtggtttccaattccatatgaattgcggggtggggatact

SEQ ID NO: 24105 - DNA, 601 bp, Human
gagtagctgggattacaggtgcatgccaccaggcccagctaatttttgtatttttagcagagatggggtttcaccatgttggccaggctggtctcgaatttctggcctcaagtgatccacccaccacagcttcccaaagtgctgggattacaggcgtgagccaccacacatggcctggacctgtgtgttttctaaagcaagccttaaatggtaaaaggcagtgaattgtatttccctattgccttatttccatgccacaggtgctctgttcctttgaccctgctactcaaagcgtggcctrtgcccctgcagtatcagcatcacctgggacaagtcagaatcttggccttcacccagacctactgaatccacacctgcattttaacaagatgcccagcagattcatagccactttaatgttggagaggcactgcctcagatccttggttagcttttgcctcccacccaccaacctcttttttcttttttttttttttttcttaagcataacatcatctcaaagtaaggccctggacgggcatggtggcatgtgcctgtagtcccagctactcaagaagccaaagtgggaggatcacttgag

SEQ ID NO: 24106 - DNA, 601 bp, Human
aagcaagcaaataacaaaacccagagaattcagtgtggatagagtgaaggatagttgctccagggtcttaacagtacctatgtggttttttcttgtttttttgttttttttctttttttgtgagacagagtctcactctgtcgcccaggctggagtgcagtagcatgatctcagctcactgcaacctccaccttccaggttcaagcaattcttgtgcctcagcctcctgagtagctgggattacaggtgcatgccaccaggcccagctaatttttgtatttttagcagagatggggtttcrccatgttggccaggctggtctcgaatttctggcctcaagtgatccacccaccacagcttcccaaagtgctgggattacaggcgtgagccaccacacatggcctggacctgtgtgttttctaaagcaagccttaaatggtaaaaggcagtgaattgtatttccctattgccttatttccatgccacaggtgctctgttcctttgaccctgctactcaaagcgtggcctgtgcccctgcagtatcagcatcacctgggacaagtcagaatcttggccttcacccagacctactgaatccaca

SEQ ID NO: 24107 - DNA, 601 bp, Human
gctattaaacatcaacttcatccgaagtcaaaacatactctatacatgaccagacacagctgctgtttgcttgcttttattttaagccatttgacacatgacctgtgtcaattagtctttggttgcattaaagactgtaaatatacaaagtccaaaactttctaaagtcatcataaagattttaagctgcatacttttcctaagcaaaacaagcaagcaaataacaaaacccagagaattcagtgtggatagagtgaaggatagttgctccagggtcttaacagtacctatgtggttttttcttgtttttttgttttttttctttttttgtgagacagagtctcactctgtcgcccaggctggagtgcagtagcatgatctcagctcactgcaacctccaccttccaggttcaagcaattcttgtgcctcagcctcctgagtagctgggattacaggtgcatgccaccaggcccagctaatttttgtatttttagcagagatggggtttcaccatgttggccaggctggtctcgaatttctggcctcaagtgatccacccaccacagcttcccaaagtgctgggattacaggcgtgagcca

SEQ ID NO: 24108 - DNA, 601 bp, Human
attgctttgtgctaaactgactgccctctcatctgctacttcatgacaaagcccattaaaggtcctcagactccgggattttggtggatttcttgtgcagaaattgcagtgaaaaggctgttggagaaagaggtcttgattctggaatatgctccattctgtatttttcaatgtatggagcagctacttcccaaacctgaaaagcaaggacaaaacaaagttgaaatattgacgacattgtttccacatgctattaaacatcaacttcatccgaagtcaaaacatactctatacatgaccrgacacagctgctgtttgcttgcttttattttaagccatttgacacatgacctgtgtcaattagtctttggttgcattaaagactgtaaatatacaaagtccaaaactttctaaagtcatcataaagattttaagctgcatacttttcctaagcaaaacaagcaagcaaataacaaaacccagagaattcagtgtggatagagtgaaggatagttgctccagggtcttaacagtacctatgtggttttttcttgtttttttgttttttttctttttttgtgagacagagtctcactctgtc

SEQ ID NO: 24109 - DNA, 601 bp, Human
aaaaaaaaaaaaaaaaaggttaacaaaagtctaatgtttttagaaaaaattgctatcaatctgtttccaaatttgaattcatctaatgctaagagtaaaaaacaggcacatacaattgtggttattcttctcacccttaagagtgagtggcctgttgaaactgttaagaaagaaagaaaagttttataatctgaaaatacctggtgggtcttgaaccacgacaacaggaacacagtgctgaatttagcaactataatactgccatcagcctaaccaacgtaggctttagaagaactgaatkatacaatggattgatctacctaggaaagttctcaggtctctccttcagcctagtattgctttgtgctaaactgactgccctctcatctgctacttcatgacaaagcccattaaaggtcctcagactccgggattttggtggatttcttgtgcagaaattgcagtgaaaaggctgttggagaaagaggtcttgattctggaatatgctccattctgtatttttcaatgtatggagcagctacttcccaaacctgaaaagcaaggacaaaacaaagttgaaatattgacgacattgtttcca

SEQ ID NO: 24110 - DNA, 601 bp, Human
ggggcttgcatctttaacaagcacctcctccaggcaattctgagaaaggtggttcagaaaccacccttgagacacactgttctgtactgtggagatcttcaagtttactttcacaaacttcaagccattgtcaatgcaagagtttaagggtgagaaaaagcatgtgtcagaatcccctgggattccaaatattcccatgcctgggcccacatcagatctggaacatcaaaatctgggataacaaggcaagaacatcttgggtatgcatcctgagatgccccagcctctgcataagctcccmacatggcacctcgcggttcaagcctcacctccccttctttactcctgttccactcacgtcagccaccttgttccccttgaggttcaatcctccgtctttctacatttcagatccacacattttctcttatttgctgctcaaatctcaaacccctgggccactgtgggatcctccctggcctgccctcctaactgcacttcctggtagcccctctgcacccctctctcctcacgtgtcctgttggtcagtgatccccagaagggctgggtgtgtgtggcacaattctgaagcccattgcgc

SEQ ID NO: 24111 - DNA, 601 bp, Human
gcattgatttctcccctactcaagcagaagagaattaacctcagtccctgctttgcccatattccttccccagggccccaggaagaagacatggaaaaacaatatttccaccaaagtttatttctctgaaacaatcaccagttgctgtcctctatggcacactgagagccccaggagggtctttaactcccttcctcagattatattcatcccagaaatatagccttggacaataatttggttacagcatagtcccaggaatgaggtcccccaagttgctaagttttacataggggagackgggaaattcaaagaattggatggagaaaccataggatccaagataatgtcagggggttgaagatgttggagaggcatggtagcatcattgagtttgaatctccttctcacttggagtggaagttgtaggattctgcctctaggaaatgtgccatcctacagaataaataaaagggagataatgaggcttcaacccaacttgcccccatcgtttgtcactgtaaccatcccatgccttaatacagtgatactgaaaactccagggcaccaacaactaatacaaaggaagcaccttcagcct

SEQ ID NO: 24112 - DNA, 601 bp, Human
tggcacaagagtagcggggtcagggcgaagtcccagggcctcaagcgtggctctcagggtctcaggccccacaggcggtgtatgggttggggaggccccgcgttggggattctctcctccttctcctaacctgtgtcgggtccttcttcctggatactcaccgggcggccccagttctcactcccattaggtgacaggtttttagagaagccaatcagcgtcgccgcggtcctggttctaaagtcctcgctcacccacccggactcattctccccagacgccaaggatggtggtcatggcrccccgaaccctcttcctgctgctctcgggggccctgaccctgaccgagacctgggcgggtgagtgcggggtcaggagggaaacggcccctgcgcggaggagggaggggccggcccggcgggggcgcaggactcggcagccgcgccgggaggagggtcgggcgggtctcaacccctcctcgcccccaggctcccactccatgaggtatttcagcgccgccgtgtcccggcccggccgcggggagccccgcttcatcgccatgggctacgtggacgacacgcagttcgtgcggttcgacagc

SEQ ID NO: 24113 - DNA, 601 bp, Human
ggttggggaggccccgcgttggggattctctcctccttctcctaacctgtgtcgggtccttcttcctggatactcaccgggcggccccagttctcactcccattaggtgacaggtttttagagaagccaatcagcgtcgccgcggtcctggttctaaagtcctcgctcacccacccggactcattctccccagacgccaaggatggtggtcatggcgccccgaaccctcttcctgctgctctcgggggccctgaccctgaccgagacctgggcgggtgagtgcggggtcaggagggaaacrgcccctgcgcggaggagggaggggccggcccggcgggggcgcaggactcggcagccgcgccgggaggagggtcgggcgggtctcaacccctcctcgcccccaggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaac

SEQ ID NO: 24114 - DNA, 601 bp, Human
ctctcctccttctcctaacctgtgtcgggtccttcttcctggatactcaccgggcggccccagttctcactcccattaggtgacaggtttttagagaagccaatcagcgtcgccgcggtcctggttctaaagtcctcgctcacccacccggactcattctccccagacgccaaggatggtggtcatggcgccccgaaccctcttcctgctgctctcgggggccctgaccctgaccgagacctgggcgggtgagtgcggggtcaggagggaaacggcccctgcgcggaggagggaggggccsgcccggcgggggcgcaggactcggcagccgcgccgggaggagggtcgggcgggtctcaacccctcctcgcccccaggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacaga

SEQ ID NO: 24115 - DNA, 601 bp, Human
cctccttctcctaacctgtgtcgggtccttcttcctggatactcaccgggcggccccagttctcactcccattaggtgacaggtttttagagaagccaatcagcgtcgccgcggtcctggttctaaagtcctcgctcacccacccggactcattctccccagacgccaaggatggtggtcatggcgccccgaaccctcttcctgctgctctcgggggccctgaccctgaccgagacctgggcgggtgagtgcggggtcaggagggaaacggcccctgcgcggaggagggaggggccggccyggcgggggcgcaggactcggcagccgcgccgggaggagggtcgggcgggtctcaacccctcctcgcccccaggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatga

SEQ ID NO: 24116 - DNA, 601 bp, Human
gttctcactcccattaggtgacaggtttttagagaagccaatcagcgtcgccgcggtcctggttctaaagtcctcgctcacccacccggactcattctccccagacgccaaggatggtggtcatggcgccccgaaccctcttcctgctgctctcgggggccctgaccctgaccgagacctgggcgggtgagtgcggggtcaggagggaaacggcccctgcgcggaggagggaggggccggcccggcgggggcgcaggactcggcagccgcgccgggaggagggtcgggcgggtctcaaccyctcctcgcccccaggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagtgagtaactccggcc

SEQ ID NO: 24117 - DNA, 601 bp, Human
gggtgagtgcggggtcaggagggaaacggcccctgcgcggaggagggaggggccggcccggcgggggcgcaggactcggcagccgcgccgggaggagggtcgggcgggtctcaacccctcctcgcccccaggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccrgagtattgggaagaggagacacggaacaccaaggcccacgcacagactgacagaatgaacctgcagaccctgcgcggctactacaaccagagcgaggccagtgagtaactccggcccagggagcagatcacgacccccacctccatgccccacggacggcccgggtactcccgagtctccgggtctgggatccaccccgaggccgcgggacccgcccagaccctctacctgggagaaccccaaggcgcctttaccaaaatccccgcgggtgggtccgggcgagggcgaggctcggtgggc

SEQ ID NO: 24118 - DNA, 601 bp, Human
tcaacccctcctcgcccccaggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagtgagtaacyccggcccagggagcagatcacgacccccacctccatgccccacggacggcccgggtactcccgagtctccgggtctgggatccaccccgaggccgcgggacccgcccagaccctctacctgggagaaccccaaggcgcctttaccaaaatccccgcgggtgggtccgggcgagggcgaggctcggtgggcggggctgaccgagggggtggggccaggttctcacaccctccagtggatgattggctgcgacctggggtccgacggacgcctcctccgcgggtatgaacagtatgcctacg

SEQ ID NO: 24119 - DNA, 601 bp, Human
cgcccccaggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagtgagtaactccggcccagggmgcagatcacgacccccacctccatgccccacggacggcccgggtactcccgagtctccgggtctgggatccaccccgaggccgcgggacccgcccagaccctctacctgggagaaccccaaggcgcctttaccaaaatccccgcgggtgggtccgggcgagggcgaggctcggtgggcggggctgaccgagggggtggggccaggttctcacaccctccagtggatgattggctgcgacctggggtccgacggacgcctcctccgcgggtatgaacagtatgcctacgatggcaaggatt

SEQ ID NO: 24120 - DNA, 601 bp, Human
tatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcgggtaccaggggcagtggggcgcctccctgatctcctgtagacctcccagcctggcctagcacaaggagaggaggaaaatgggaccaacacyagaatatcgccctccctctggtcctgagggagaggaatcctcctgggtttccagatcctgtaccagagagtgattctgagggcccgtcctgctctctgggacaattaagggatgaagtctctgagggagtggaggggaagacaatccctggaagactgatcaggggttccctttgaccccacagcagccttggcaccaggacttttcccctcaggccttgttctctgcctcacactcaatgtgtgtgggagtctgactccagctcctctgagtcccttggcctccactcaggtcagaacc

SEQ ID NO: 24121 - DNA, 601 bp, Human
tgcgtggagtggctccacagatacctggagaacgggaaggagatgctgcagcgcgcgggtaccaggggcagtggggcgcctccctgatctcctgtagacctcccagcctggcctagcacaaggagaggaggaaaatgggaccaacactagaatatcgccctccctctggtcctgagggagaggaatcctcctgggtttccagatcctgtaccagagagtgattctgagggcccgtcctgctctctgggacaattaagggatgaagtctctgagggagtggaggggaagacaatccctggargactgatcaggggttccctttgaccccacagcagccttggcaccaggacttttcccctcaggccttgttctctgcctcacactcaatgtgtgtgggagtctgactccagctcctctgagtcccttggcctccactcaggtcagaaccggaggtccctgctcccccgctcagagactagaactttccaaggaataggagattatcccaggtgcccgtgtccaggctggtgtctgggttctgtgctcccttccccaccccaggtatctggttcattcttaggatggtcacatccaggtgctg

SEQ ID NO: 24122 - DNA, 601 bp, Human
acctcccagcctggcctagcacaaggagaggaggaaaatgggaccaacactagaatatcgccctccctctggtcctgagggagaggaatcctcctgggtttccagatcctgtaccagagagtgattctgagggcccgtcctgctctctgggacaattaagggatgaagtctctgagggagtggaggggaagacaatccctggaagactgatcaggggttccctttgaccccacagcagccttggcaccaggacttttcccctcaggccttgttctctgcctcacactcaatgtgtgtgggrgtctgactccagctcctctgagtcccttggcctccactcaggtcagaaccggaggtccctgctcccccgctcagagactagaactttccaaggaataggagattatcccaggtgcccgtgtccaggctggtgtctgggttctgtgctcccttccccaccccaggtatctggttcattcttaggatggtcacatccaggtgctgctggagtgtcccatgagagatgcaaagtgcttgagttttctgactcttcctttcagacccccccaagacacacgtgacccaccaccctgtctttgac

SEQ ID NO: 24123 - DNA, 601 bp, Human
agaatatcgccctccctctggtcctgagggagaggaatcctcctgggtttccagatcctgtaccagagagtgattctgagggcccgtcctgctctctgggacaattaagggatgaagtctctgagggagtggaggggaagacaatccctggaagactgatcaggggttccctttgaccccacagcagccttggcaccaggacttttcccctcaggccttgttctctgcctcacactcaatgtgtgtgggagtctgactccagctcctctgagtcccttggcctccactcaggtcagaaccrgaggtccctgctcccccgctcagagactagaactttccaaggaataggagattatcccaggtgcccgtgtccaggctggtgtctgggttctgtgctcccttccccaccccaggtatctggttcattcttaggatggtcacatccaggtgctgctggagtgtcccatgagagatgcaaagtgcttgagttttctgactcttcctttcagacccccccaagacacacgtgacccaccaccctgtctttgactatgaggccaccctgaggtgctgggccctgggcttctaccctgcggagatc

SEQ ID NO: 24124 - DNA, 601 bp, Human
ccttggcaccaggacttttcccctcaggccttgttctctgcctcacactcaatgtgtgtgggagtctgactccagctcctctgagtcccttggcctccactcaggtcagaaccggaggtccctgctcccccgctcagagactagaactttccaaggaataggagattatcccaggtgcccgtgtccaggctggtgtctgggttctgtgctcccttccccaccccaggtatctggttcattcttaggatggtcacatccaggtgctgctggagtgtcccatgagagatgcaaagtgcttgarttttctgactcttcctttcagacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggagta

SEQ ID NO: 24125 - DNA, 601 bp, Human
gtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggagtaaggagggagatggaggcatcatgtctgttagggaaagcaggagcctctctgaagacctttaacagggtcggtggtgaggsctgggggtcagagaccctcaccttcacctcctttcccagagcagtcttccctgcccaccatccccatcatgggtatcgttgctggtctggttgtccttgcagctgtagtcactggagctgcggtcgctgctgtgctgtggaggaagaagagctcaggtaaggaaggggtgacaagtggggtctgagttttcttgtcccactgggggtttcaagccccaggtagaagtgtgccctgcctggttactgggaagcaccatccacactcatgggcctacccagcctgggccctgtgtgccagca

SEQ ID NO: 24126 - DNA, 601 bp, Human
ctttctggcctctcacaggacgttttcttcccacagattgaaaaggagggagctactctcaggctgcaagtaagtatgaaggaggctgatccctgagatccttgggatcttgtgtttgggagcccatgggggagctcacccaccccacaattcctcctctggccacatctcctgtggtctctgaccaggtgctgtttttgttctactctaggcagtgacagtgcccagggctctaatgtgtctctcacggcttgtaaatgtgacaccccggggggcctgatgtgtgtgggttgttgagggraacagtggacatagctgtgctatgaggtttctttgacttgaatgtattgagcatgtgatgggctgtttaaagtgtcacccctcactgtgactgatatgaatttgttcatgaatatttttctgtagtgtgaaacagctgccctgtgtgggactgagtggcaagtccctttgtgacttcaagaaccctgacttctctttctgcagagaccagcccacccctgtgcccaccatgaccctcttcctcatgctgaactgcattccttccccaatcacctttcctgttccagaaaaggggctggga

SEQ ID NO: 24127 - DNA, 601 bp, Human
ggcctctcacaggacgttttcttcccacagattgaaaaggagggagctactctcaggctgcaagtaagtatgaaggaggctgatccctgagatccttgggatcttgtgtttgggagcccatgggggagctcacccaccccacaattcctcctctggccacatctcctgtggtctctgaccaggtgctgtttttgttctactctaggcagtgacagtgcccagggctctaatgtgtctctcacggcttgtaaatgtgacaccccggggggcctgatgtgtgtgggttgttgaggggaacagkggacatagctgtgctatgaggtttctttgacttgaatgtattgagcatgtgatgggctgtttaaagtgtcacccctcactgtgactgatatgaatttgttcatgaatatttttctgtagtgtgaaacagctgccctgtgtgggactgagtggcaagtccctttgtgacttcaagaaccctgacttctctttctgcagagaccagcccacccctgtgcccaccatgaccctcttcctcatgctgaactgcattccttccccaatcacctttcctgttccagaaaaggggctgggatgtctc

SEQ ID NO: 24128 - DNA, 601 bp, Human
aaaaggagggagctactctcaggctgcaagtaagtatgaaggaggctgatccctgagatccttgggatcttgtgtttgggagcccatgggggagctcacccaccccacaattcctcctctggccacatctcctgtggtctctgaccaggtgctgtttttgttctactctaggcagtgacagtgcccagggctctaatgtgtctctcacggcttgtaaatgtgacaccccggggggcctgatgtgtgtgggttgttgaggggaacagtggacatagctgtgctatgaggtttctttgacttsaatgtattgagcatgtgatgggctgtttaaagtgtcacccctcactgtgactgatatgaatttgttcatgaatatttttctgtagtgtgaaacagctgccctgtgtgggactgagtggcaagtccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagcta

SEQ ID NO: 24129 - DNA, 601 bp, Human
tgttctactctaggcagtgacagtgcccagggctctaatgtgtctctcacggcttgtaaatgtgacaccccggggggcctgatgtgtgtgggttgttgaggggaacagtggacatagctgtgctatgaggtttctttgacttgaatgtattgagcatgtgatgggctgtttaaagtgtcacccctcactgtgactgatatgaatttgttcatgaatatttttctgtagtgtgaaacagctgccctgtgtgggactgagtggcaagtccctttgtgacttcaagaaccctgacttctctttstgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttactttttcaaattatttccaagagagattgatgggttaattaaaggagaagattcctgaaatttgagagacaaaataaatggaagacatgagaactttccacagtacacgtgtttc

SEQ ID NO: 24130 - DNA, 601 bp, Human
tctttgacttgaatgtattgagcatgtgatgggctgtttaaagtgtcacccctcactgtgactgatatgaatttgttcatgaatatttttctgtagtgtgaaacagctgccctgtgtgggactgagtggcaagtccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtscactgagctataacttacttctgtattaaaattagaatctgagtataaatttactttttcaaattatttccaagagagattgatgggttaattaaaggagaagattcctgaaatttgagagacaaaataaatggaagacatgagaactttccacagtacacgtgtttcttgtgctgatttgttgcaggagaggagagtagatggggctgcgcccagtgggtgctcaggccaccatgaactttatgtggtcactgctcagctgggtcatctttgctgctccattgtccttggcccttcagt

SEQ ID NO: 24131 - DNA, 601 bp, Human
tcacccctcactgtgactgatatgaatttgttcatgaatatttttctgtagtgtgaaacagctgccctgtgtgggactgagtggcaagtccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtrtaaatttactttttcaaattatttccaagagagattgatgggttaattaaaggagaagattcctgaaatttgagagacaaaataaatggaagacatgagaactttccacagtacacgtgtttcttgtgctgatttgttgcaggagaggagagtagatggggctgcgcccagtgggtgctcaggccaccatgaactttatgtggtcactgctcagctgggtcatctttgctgctccattgtccttggcccttcagtagaaccttgtcccaccaggacctgtgatcacatagacttggatat

SEQ ID NO: 24132 - DNA, 601 bp, Human
tgagctgccttaatgggggaagaggaggtaaggaaggtggggaaagggtctgtcttcttctgctttcaacaaagatgcaagtgtatgtccccagtcagcatgggctgtccagctagctgactgtagccatctcaaaagtatttgataccaagtagtccttctcaggtatccacacctggcagccttgtttcgggccagcaggttgttccaccagccagcatcctggacaactgttctctcttgggtggcaaccagcacagactcttaaccggataatgtcttctttttgattattcttttyaccaatttgggtttgttttggtgtctattatggtccagatggggaggggtggatgaggaacggagcaggagaagagaagagaaaagcaggtaagggatagaaactggttaagatctctagaagattatatggaggagggaacgggtgtggaggtgctcgggtgggggtggggatggaggtgtgggctctgagtttgtgctttccctggtgggccggcagaggccgaggccgaattggaggatcgcatcttggtgttgggcagtttgtggtctttcttccacttcatcctccggttctgaa

SEQ ID NO: 24133 - DNA, 601 bp, Human
ccacataagtctaaatgcactcccctctccccaaagaccgtgccccagaaggggacaacagtatctctgtaacagtgtcttaaataaatgcaagtaagaaaaactaacatgtcacacctaccatcaaggtctacacatcttaagaattaaataatcttgtgaggtccacaatgtctactcatttattcagttaaatacaagcttggatgagctgccttaatgggggaagaggaggtaaggaaggtggggaaagggtctgtcttcttctgctttcaacaaagatgcaagtgtatgtccccastcagcatgggctgtccagctagctgactgtagccatctcaaaagtatttgataccaagtagtccttctcaggtatccacacctggcagccttgtttcgggccagcaggttgttccaccagccagcatcctggacaactgttctctcttgggtggcaaccagcacagactcttaaccggataatgtcttctttttgattattctttttaccaatttgggtttgttttggtgtctattatggtccagatggggaggggtggatgaggaacggagcaggagaagagaagagaaaagcaggtaa

SEQ ID NO: 24134 - DNA, 601 bp, Human
ctcaagttgaacatacatacacacactctcacacacaaattatgtgagccgtcagaatccaagtgaatccagctcaagctatctacaaggtttttacatgcaaggtcaagtatctcaatccagaggacttttgttttcttaatgaaaagcttagaaaacacatgaatcttagatttttaatgttttttaaatggagtttattcttagcacatggctttctatgtagccacatcacaatttgtacagttccacataagtctaaatgcactcccctctccccaaagaccgtgccccagaaggkgacaacagtatctctgtaacagtgtcttaaataaatgcaagtaagaaaaactaacatgtcacacctaccatcaaggtctacacatcttaagaattaaataatcttgtgaggtccacaatgtctactcatttattcagttaaatacaagcttggatgagctgccttaatgggggaagaggaggtaaggaaggtggggaaagggtctgtcttcttctgctttcaacaaagatgcaagtgtatgtccccagtcagcatgggctgtccagctagctgactgtagccatctcaaaagtatttgat

SEQ ID NO: 24135 - DNA, 601 bp, Human
ggtccgggccgtgggggtgttaggttctgaagggcagggtgtttccttgtcctcggagaggagatcagcataggccggtgcaaagcttgcggtctgctcgttcccataagggggatgctgcggaggatatggccccggaccggctccacctgctccgtagccatcggacaagccccctagctgggccccgtagctcgagggatgaaaatagcctccgtctccttctgaatgacccagagggtagtactgagaaggcccgtagctggggctgcaggcggcaggagcataccccgagggcgcrgagctggggaagggcacccccagggtcgaaggcggctgctgggcgggatagccggagttctgctgaaacgcagggctggacagccccccaccgtagcggccctcgcttgcatagctgtcaaccgcctgagccgagcttgggggaaaggaggttggggcgctgtgggcgctgtgggcgctgtaggcgctgggtccccggttacagagtgggtactctaagaaggagttcatcctattatagtccatgcgtcaaggccgcaggagggtcggcccgtttgggggagacaccctcttgccctac

SEQ ID NO: 24136 - DNA, 601 bp, Human
ccggagaaggggtggccacatctgagccctacctgtcttgggtgggtttctcttaaccttcatccagtcgaaggtccgggccgtgggggtgttaggttctgaagggcagggtgtttccttgtcctcggagaggagatcagcataggccggtgcaaagcttgcggtctgctcgttcccataagggggatgctgcggaggatatggccccggaccggctccacctgctccgtagccatcggacaagccccctagctgggccccgtagctcgagggatgaaaatagcctccgtctccttctgawtgacccagagggtagtactgagaaggcccgtagctggggctgcaggcggcaggagcataccccgagggcgcagagctggggaagggcacccccagggtcgaaggcggctgctgggcgggatagccggagttctgctgaaacgcagggctggacagccccccaccgtagcggccctcgcttgcatagctgtcaaccgcctgagccgagcttgggggaaaggaggttggggcgctgtgggcgctgtgggcgctgtaggcgctgggtccccggttacagagtgggtactctaagaaggagttc

SEQ ID NO: 24137 - DNA, 601 bp, Human
ttacatactgggtggggagacctcacctgacctgagacgtaggttgtgctcttacctgtgtctaccagagccgctgaaagagaagaacccagcccagacccaggacatgtcactgcaggggaagcagagatgctttgggccccggagaaggggtggccacatctgagccctacctgtcttgggtgggtttctcttaaccttcatccagtcgaaggtccgggccgtgggggtgttaggttctgaagggcagggtgtttccttgtcctcggagaggagatcagcataggccggtgcaaagctygcggtctgctcgttcccataagggggatgctgcggaggatatggccccggaccggctccacctgctccgtagccatcggacaagccccctagctgggccccgtagctcgagggatgaaaatagcctccgtctccttctgaatgacccagagggtagtactgagaaggcccgtagctggggctgcaggcggcaggagcataccccgagggcgcagagctggggaagggcacccccagggtcgaaggcggctgctgggcgggatagccggagttctgctgaaacgcagggctggacagcccc

SEQ ID NO: 24138 - DNA, 601 bp, Human
aagagtttaggtcccaacacaaacactcgttttggtattataaagacatttatttaatctatgaaaataatgtacaataaatactttccccttttcctattattaaagaattttaataaataatctacagtctaaaacataaaaaagaggaaaataggtccctctagttatttttaagaaagtccccctagagtttaattattcctgagatttcattggaaggagtctaccaaacggaatttttctgtgtgaattttaaaagataaccgagtgcccaatattttagaagaagaagaaaggragtggattaaacgctaattcagtaatacctgaattttagcaaaacacataagtctatgcgactgagggtgggagaggctcgatttttccagtagacggccaaggagcgcgggggtcgaaaggaccgggaggaggaaacaggttagggaaactgcaggtcgatggcacagagcgtactggtgaaaaaatccagctcttcctcggaaaaagggaccgggctgtcgagagaaccctgtaggctaggggagaggcctccggatagctggagacaggagtcggccgcgaagaagttgaggtcggg

SEQ ID NO: 24139 - DNA, 601 bp, Human
tcaaacgaaatatcgtaacacaaggcgaggcaggcttgtgggaaccggtccccagcgggcggcggcagagcggggaggattggaggggccagggctgggggtggcacgggctcttgggccgctgggctcctctgggcgggctcagggctggaaggcgctgccagctgtagccaggctcatacttttcaatttgttgtccttcttccacttcatgcgccggttctggaaccagatcttgatctggcgctcggacaggcagagtgcgtgggcgatctcgatgcgccgtcgccgggtcaggtakcggttgaagtggaactccttttccagctccagggtctggtagcgggtatacgcggtccgggcccttttcccgtccggcccggtcatatctggagcagatagaggaaagccgcaaggcaacattattccggttaagggagggggcactgggtgggagggggcgggggagcaggacccaggcgtcccggcacccagctcaccacagctccaatcctctctactccagatgcccacattcaagctcgatttctgcacccctttctactgcatcccccacttctgcaggcagccagtgcgcccg

SEQ ID NO: 24140 - DNA, 601 bp, Human
aactgctgccccttacagaagtttccagctgaaactcaaaatacagcgatcatctttttataaataagttagaacacagatggggaggggagagttcacattaaacatgcgaatttctttttttttttttcctgggggaaagactgcaaccacagacacaaacattcagaaacactggcggatttgggacaagcagaagggagttgggagcatggaaggaaaataataataattattattattaacaataataacaagataaccagtccaggagagagggagccacaggaagacctaagaycaaacgaaatatcgtaacacaaggcgaggcaggcttgtgggaaccggtccccagcgggcggcggcagagcggggaggattggaggggccagggctgggggtggcacgggctcttgggccgctgggctcctctgggcgggctcagggctggaaggcgctgccagctgtagccaggctcatacttttcaatttgttgtccttcttccacttcatgcgccggttctggaaccagatcttgatctggcgctcggacaggcagagtgcgtgggcgatctcgatgcgccgtcgccgggtcaggtag

SEQ ID NO: 24141 - DNA, 601 bp, Human
gaaagctacaaacaaataccaaaagcgaatcactgagacaggccccgcaaagacagatttcacacgtagcacagcatccactcgctcactacaaatggtcttggaagcaagatgggtaagggagagatgggtctgacccagactatccccatatttacaagctttgggccctctagccagacccatggattcacagagaaatacacaagacattttgcactgaggatcatttttgtttccgtatactcccagaccaggccttgtggggcctacccaggcagcaggaacttaaatctcactrtcttctttctctcttctcaataccatccctttggtcctccctagccccttcccaccctaggaccaagcccctaggagacttgggcctagggagtgaggagggaggaggaggagaatgaaaagggactccatctccgaagccagctcagcttgaccccactgcggcactaccccacctcaactgctgccccttacagaagtttccagctgaaactcaaaatacagcgatcatctttttataaataagttagaacacagatggggaggggagagttcacattaaacatgcgaatttcttttt

SEQ ID NO: 24142 - DNA, 601 bp, Human
ctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggtaccggcgcccgaggccccgggtctcaccgcgggcccaggtcccctcccagctcccagcccccagcccagggcttttttttttttttttttttttaagacaggaatcttgctctagtgactggagtgcagtggcactatctcagctcactgcaacctctgcctcctgggctcaggtgatttttccgcttcagcctcttgagcacctccatgccctgttaatttttttggtatttttgatggtagagagagggttttgccacattatccaggctggtcttgaactcctaggctcaagcgatctgcccgcctcagcctcccagagtgctagaatgacaggtgtgagccaccgtgcctggcctccctgtgttcttta

SEQ ID NO: 24143 - DNA, 601 bp, Human
agagattctcctgtctcagcctcccatgtagctgggattacaggtatgtgccaccgcagccagctaatttttgtatttttagtagagacgaggtttcaccatgttggccaggctagtcttaaactcctcacctcagttgatctgccttcagcctcccaaagtgctaggattacaggcatgggccaccgtgcctggccaagaattgtatgattgctgggctccttggcacttgcaagaggtacctgccaagacctggggaaagccctggatttgagaactcaacagatagcttgtgatgtcyccaggaatgcgcagtcatcaagtaaaactgaagcattaacgatcacgagaatcagctcagcacgggaaagacgtcactttaggaggcatctcttcaccttcatgcctatcaacagctctagcagaaaggccatgtttcagaaggaaaccaagttttgttcacttggccaggtgcctaggtatgcgagagagagtagagagcagagctgcccctccctggcattcccctgagtgcctccctgagcccaggagcatccaattctagaactcatggccaggcctgtaatcccaacactttggg

SEQ ID NO: 24144 - DNA, 601 bp, Human
gcctcccatgtagctgggattacaggtatgtgccaccgcagccagctaatttttgtatttttagtagagacgaggtttcaccatgttggccaggctagtcttaaactcctcacctcagttgatctgccttcagcctcccaaagtgctaggattacaggcatgggccaccgtgcctggccaagaattgtatgattgctgggctccttggcacttgcaagaggtacctgccaagacctggggaaagccctggatttgagaactcaacagatagcttgtgatgtccccaggaatgcgcagtcaycaagtaaaactgaagcattaacgatcacgagaatcagctcagcacgggaaagacgtcactttaggaggcatctcttcaccttcatgcctatcaacagctctagcagaaaggccatgtttcagaaggaaaccaagttttgttcacttggccaggtgcctaggtatgcgagagagagtagagagcagagctgcccctccctggcattcccctgagtgcctccctgagcccaggagcatccaattctagaactcatggccaggcctgtaatcccaacactttgggtggccgaggctggaggat

SEQ ID NO: 24145 - DNA, 601 bp, Human
cgaggtttcaccatgttggccaggctagtcttaaactcctcacctcagttgatctgccttcagcctcccaaagtgctaggattacaggcatgggccaccgtgcctggccaagaattgtatgattgctgggctccttggcacttgcaagaggtacctgccaagacctggggaaagccctggatttgagaactcaacagatagcttgtgatgtccccaggaatgcgcagtcatcaagtaaaactgaagcattaacgatcacgagaatcagctcagcacgggaaagacgtcactttaggaggcrtctcttcaccttcatgcctatcaacagctctagcagaaaggccatgtttcagaaggaaaccaagttttgttcacttggccaggtgcctaggtatgcgagagagagtagagagcagagctgcccctccctggcattcccctgagtgcctccctgagcccaggagcatccaattctagaactcatggccaggcctgtaatcccaacactttgggtggccgaggctggaggatcgcgtgagcccgggagtttgagaccagcctgggcaatatagtgagactccatctctataaaaaattaaaa

SEQ ID NO: 24146 - DNA, 601 bp, Human
caccatgttggccaggctagtcttaaactcctcacctcagttgatctgccttcagcctcccaaagtgctaggattacaggcatgggccaccgtgcctggccaagaattgtatgattgctgggctccttggcacttgcaagaggtacctgccaagacctggggaaagccctggatttgagaactcaacagatagcttgtgatgtccccaggaatgcgcagtcatcaagtaaaactgaagcattaacgatcacgagaatcagctcagcacgggaaagacgtcactttaggaggcatctcttcrccttcatgcctatcaacagctctagcagaaaggccatgtttcagaaggaaaccaagttttgttcacttggccaggtgcctaggtatgcgagagagagtagagagcagagctgcccctccctggcattcccctgagtgcctccctgagcccaggagcatccaattctagaactcatggccaggcctgtaatcccaacactttgggtggccgaggctggaggatcgcgtgagcccgggagtttgagaccagcctgggcaatatagtgagactccatctctataaaaaattaaaagagtagca

SEQ ID NO: 24147 - DNA, 601 bp, Human
catgctggtggccctgaacctggaggggttgagatcaaaggatcccagatgttggggtcctggggtgctggccatgcctctcttgctgccatcctgagagaagaagctgcccagatggccccagtgtccaaggggaactgtcaggatgtacgctgccaccttgtccacctacagcagctctgtggagactcagccccactgcagaagtgcaagtctcacgatggtgggtggcagcagtggtgacagggctgtgcctcgagtgccctcctctgcattggctgtgaggtgagggcggctgtgsggccctcccattctgctcttcttgccggctttgtcaagagcagccacagcaccaggtttgctttgcttttgagcaataaagaaacacgaccttaagaagagaaaatacaggctgggcgcagtggctcacgcctgtaatcccagcactttgggaggccgaggtgggcagatcacgaggtcaggagatcgagaccatcctggctaacacggtgaaaccccgtctctgctaaaaatacaaaaaaattagccaggcgtggtggcgggcgcctgtagtcccagctactcgggaggctgaggcagg

SEQ ID NO: 24148 - DNA, 601 bp, Human
tgccatcctgagagaagaagctgcccagatggccccagtgtccaaggggaactgtcaggatgtacgctgccaccttgtccacctacagcagctctgtggagactcagccccactgcagaagtgcaagtctcacgatggtgggtggcagcagtggtgacagggctgtgcctcgagtgccctcctctgcattggctgtgaggtgagggcggctgtgcggccctcccattctgctcttcttgccggctttgtcaagagcagccacagcaccaggtttgctttgcttttgagcaataaagaaacrcgaccttaagaagagaaaatacaggctgggcgcagtggctcacgcctgtaatcccagcactttgggaggccgaggtgggcagatcacgaggtcaggagatcgagaccatcctggctaacacggtgaaaccccgtctctgctaaaaatacaaaaaaattagccaggcgtggtggcgggcgcctgtagtcccagctactcgggaggctgaggcaggagaatggtgtgaacccgggaggcagagcttgcagtgagccgagatcgcaccactgcactccagcctgggcgatagagtgagactcc

SEQ ID NO: 24149 - DNA, 601 bp, Human
aagaggaaatactccctgggttgtgctggggattaaacgataagctaatgcccaagaagctgctctgcgaagtctggagtgcagccctcgggtgagttaagcatggccccagcgggagacgggatgtgggggagctgtaagcagcaaagagcattccaggcagccaggtcacagtttcaaaacacacacacacagaaaacaaggctgcctggtgcctggcgttgcctttgggctgatgggaaatgtgtgttccaccctccagcctagcagggcacctgctgccgctctcctgaggctgtcygctcctcgtggggatggtgaatccggtcccatggggttgtgaggtttcagcgagatgatgccttaaagcttttagcagggcttgcactccacaaataatggctgttgttcccaacttcacagtgtccctggggaagccacccatggtcactcgctgcccgaatctgcctcctggcttggccctgcccacctcttcagagggcatcttctaggttggttgggaatttggatggcatggtcgttgctaatgtgcctgctgggatggagcacttcctcctgtgagcccaggggacccgcctgt

SEQ ID NO: 24150 - DNA, 601 bp, Human
tggagcacttcctcctgtgagcccaggggacccgcctgtccctggagcttggggcaaggagggaagagtgataccaggaaggtggggctgcagccaggggccagagtcagttcagggagtggtcctcggccctcaaagctcctccggggactgctcaggagtgatggtgccctggagtttgccccaacttccctggccaccctggaaggtgcctggctgctccaggcctctaggctgggctgatgggtttctccaggacacaagtatcattaaagccaccctctcctcagcttgtcaggcygcacatgtgggacaggctgtgctcagcaaccccctcgcctgccctgccctccatcaggaggagccagtggaaccttcggaagctcccagcatctcagcagccctcagagtcgtcctggggcagctctggttctcctgactggaggtccatctgggctggcctgctctctctcggcctgagacaggagggcctggggtcaggaactggaagtggggaggctggggccgtggactctgaggccccacacctagccaaggagatgaccacacagctggctgccctgagtggtcagaggtggag

SEQ ID NO: 24151 - DNA, 601 bp, Human
gatggtgccctggagtttgccccaacttccctggccaccctggaaggtgcctggctgctccaggcctctaggctgggctgatgggtttctccaggacacaagtatcattaaagccaccctctcctcagcttgtcaggccgcacatgtgggacaggctgtgctcagcaaccccctcgcctgccctgccctccatcaggaggagccagtggaaccttcggaagctcccagcatctcagcagccctcagagtcgtcctggggcagctctggttctcctgactggaggtccatctgggctggccygctctctctcggcctgagacaggagggcctggggtcaggaactggaagtggggaggctggggccgtggactctgaggccccacacctagccaaggagatgaccacacagctggctgccctgagtggtcagaggtggagggtggggagccactctctccattggcagaggttcctggggactgtctgctgagggcctggctgtccctccctctccctacccaccccttagcccgggcattgtttgggctctcttggggccagcaggctgcccaggccccagaggcatcaagttcgtgccct

SEQ ID NO: 24152 - DNA, 601 bp, Human
ccctcgcctgccctgccctccatcaggaggagccagtggaaccttcggaagctcccagcatctcagcagccctcagagtcgtcctggggcagctctggttctcctgactggaggtccatctgggctggcctgctctctctcggcctgagacaggagggcctggggtcaggaactggaagtggggaggctggggccgtggactctgaggccccacacctagccaaggagatgaccacacagctggctgccctgagtggtcagaggtggagggtggggagccactctctccattggcagaggktcctggggactgtctgctgagggcctggctgtccctccctctccctacccaccccttagcccgggcattgtttgggctctcttggggccagcaggctgcccaggccccagaggcatcaagttcgtgccctggaagaagccagcctgcccaagcctgggccagagtcccatgaggacaggtgtccctgcctgccagtgggctggaggggctgaattcccagcagggccctactgtgcaggggcatcctccgtcctggtgctggtctgagtcctcaaatgcatcctcccaggtgcctttgag

SEQ ID NO: 24153 - DNA, 601 bp, Human
ggcctggggtcaggaactggaagtggggaggctggggccgtggactctgaggccccacacctagccaaggagatgaccacacagctggctgccctgagtggtcagaggtggagggtggggagccactctctccattggcagaggttcctggggactgtctgctgagggcctggctgtccctccctctccctacccaccccttagcccgggcattgtttgggctctcttggggccagcaggctgcccaggccccagaggcatcaagttcgtgccctggaagaagccagcctgcccaagcctrggccagagtcccatgaggacaggtgtccctgcctgccagtgggctggaggggctgaattcccagcagggccctactgtgcaggggcatcctccgtcctggtgctggtctgagtcctcaaatgcatcctcccaggtgcctttgagatgggtgttcccattatcccaccttcgagacgaagatcctgagacctggaaacgttggtggcttgccatgcgccagagccgagagcccctcctgcatgccttcccctgtgctgggcctggctgcatgcgtctgtgttgcctgcacagacattttgc

SEQ ID NO: 24154 - DNA, 601 bp, Human
ttcaacaaagggagcatacctgacctgagagctgtccccatcctctctggaagcataaagaacagtgagcactggctaatcccattgtctctggtcccctgcaggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctccygggccccgggcctggggcatgcgttgcacctgcccggcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgt

SEQ ID NO: 24155 - DNA, 601 bp, Human
cccatcctctctggaagcataaagaacagtgagcactggctaatcccattgtctctggtcccctgcaggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccrgcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggc

SEQ ID NO: 24156 - DNA, 601 bp, Human
tttaaaatttcataattccttccagaattgcttcccttttaaactactgtattagtggttccaatattcttcccattacttaggcatgacatttttgagtcacccctgacactactcagaagatacacacaaccaattaatcatcaagtcatgtggatcctacctataagcctatttctgttcccccttttcattctcctctaaatccatttctgtttctccttttattctcaggtcttcataatctattaagtcaaatgtaacctgaaagtgggaccgtctcaaacgtttcctcaatttwgttatatcctattaacatagactccacaggtatactcatgcaaatgtacaaaatgtgtatacaatgacattcaccgaataattgtttctccaggcaaataactgaaaacaatctaaatattcatggtgactgaagtaaattacggtacatcaataaaataagtatctcgcagccattgaaggtaataaattaagacatataaaaatacgtattgcctatacataaagtcacagctatatcaatttatactatgtatatcattttaaaaagattttactcatttcaaacactacctcattc

SEQ ID NO: 24157 - DNA, 601 bp, Human
gggtgtacatgacactatccatacttttaaaaaattacagctttattgatgtacaatttacatagtgtaatgtaaaaagtgtacaattcagtggctttttagtatatttacaaggtagtataactagtaatacctaatttcaaaacgttttcaacctcccctccccaccaaaacaccccaaaaccattagcagtcactccccattctttcttctccatagccagtggcaacgatttatcttctttctgtccctgcagatttacctattctggacatttcatataaatgggaaaatttatakgaatcatctatatgtggcctattgcatctggtttcctttctctagcatgttttcaaggctcatccatgatgtaatatgtattcatacttcattacttttgatagctgaatagtattccatttcatgaatatgccacattttgtttatccattcatcatttcttggatacctgtattgtttccactttttggttattacgaataacgctgctatgaacattcacatacaaaattttgtgtggatctatgttttcatttctcttgggtttgtagctagaagtagaatttctgggtcacatga

SEQ ID NO: 24158 - DNA, 601 bp, Human
ggcaaattttactaatgtaattttcaaacctaggccatgaaacaagaattccaaacaagtcaacatcctttaaaaacagagggtcagataaactctcaaaactgaaaacaactcagtatacacacgagaagagatggttcacatttcagaagacttactagtatataatatctgtctagatatggtataacaatacactctgtaaacatcaaacatgtctaaacacctcaatcatagcaacaacaacaactgattctatctcatcagaggaaaaataataccatttggcatctcaaattawtttttttccaaataccgttaacaaataaatgatatcatgaggtcccagataaggcataaaattactcaacccttaagaaacgatgactacaggaagtatgtcaaagctggacttgttaacccaacagagaggcacaaaaatatggtcaaaacaagcaaaacctatcacattaagacacatcataaatccaatgtggaaaaaaaatccctcatcttaacagagccttagtatactaactggcaatatttccagcactcagtaagaagtggtcaaagtggtggatgtcgtgggcaacattcc

SEQ ID NO: 24159 - DNA, 601 bp, Human
tgacatagcgagatcctatctcaaaaacaacaacaacaacaaaaaggtaactgctgatgactttttaaggtgtgacaacgaatgctaacatggcaatgtttaaagaagataaagattatttatgaaagatctatactggattatttcttgatgaaataatatgatatctggaatttgtttcagaattggaaggaaagtgggaaagaatatgtgtatgaatgaggcaagattagccagtcattggtgctgggggccttaatgggcctacagaaattaattataccattctgtttacttttgyatgtccctgaaactgtccacattcaagtgttttaaaaaacaaccaaacaggccgggcgcaatggctcacaactgtaattccaacactttgggaggccaaggtgggtggatcgcaaggtcaggagttcaagaccagcctggccaaaatggtgaaaccctgtctctactaaaaatgcgtggtggtgggcacctgtaaacccagctactccagaggctgaggcaaagaactgcttgaatcgggtaggtggaggttgcagggagccaagatcgcgccactgcactctagcctgggcgacagagc

SEQ ID NO: 24160 - DNA, 601 bp, Human
cgcctgtaaaaatacccgcactttgggaggctgaggcaggtggatcaactgaggtaaggagttcaagaccagcctggccaacatggcgaaaccctgtctctactaaaaatacaaaacttagctgggcatgctggcgggcacccgtaatcccagctactcgggaggctgaggcaggagaattgcttgaacctgggaggagggtgcaatgagccaagatcacaccactgtacttcagcctgggcatcagagtgagactccgtctcaaaaaaataaaaattaaaacaaagtatactctgactcrataattccactacttgttatataaccaactgaaacgtgtacaagacctaaaagacaacagtcaccatgtgtttaagtcttggtagatcctgatttaaaaaaataaataaataaaaataaaatataaccccttgggaaatgattaaaccattagaaatatgaactgatgatgttcaggaattacataatttgagaatattaaaataaaaactattaaaggtggctaggtgcagtggctgacacctgtaatcccagcactttgggaggccaaggcgggtggactgcttgagcccaagagttc

SEQ ID NO: 24161 - DNA, 601 bp, Human
ttttttgagacagagtctaactctgtcacccaggctggagtgcagtagcacactttcggctcactgcaacctcaacttcctgggctcatgtcattctcttacttcagcctgtggagtagttggaactaaaggttcacgccaccacgcccagctaatttttgtaattttagtagagatggggttttgtcatgttgcccaggtcggcctccaaaagtgcgaggatttcaggtgtgagccactgtgcttggtcaagtcaaaaaaattttaaaaacccttggttaacaatcaatatacagaccgygtagaatagaggtcagcaaaccatggcccctgggccaaatctggctcatcacttgtttcatacagtgggtgagttaagaatggtgacaaaattgagaacactttgcctgaaaagcctaaaatatttaatttgcagaggaaagtttcccaacctcagtattagaactaaaaattaagtatactctgtgactcacctgggcgtggtggctcacgcctgtaaaaatacccgcactttgggaggctgaggcaggtggatcaactgaggtaaggagttcaagaccagcctggccaacatggcgaa

SEQ ID NO: 24162 - DNA, 601 bp, Human
actgattttaggaaatatatagtttttagaggaaaagggccataattcctgcaacttactctcaaagggtactgtgccccactcccataaaaagagagaaggataaagcaaatgtggtaaaaggttaacatttagggaatctagttgaaggatataaagaactctccgcttttctgtgagtttgaaactacatcaaaattaatttttttcttttcttttttttttgagatggaatctcactctgtcacccaagctggagtgcagtgacgtgatctcagctcactgcaacccccacctcccrggttcaagcattctcctgcctcggtttcctgaatagctgggactacaggtgtgcaccaccatgcccagctaatttttgtaaaaaattaaaattttttagcacggtggctcatgcctataatcctggcactttgggaggccaaggcaggaggatcgcacaagctctggagtttgagaccagctggggcaatatggtgagatcccatctctacaaagataaaaaaattttctgggcatggtgatgcacatctgtggtctcagctgctcaggagggtgaggctggaggatcacttgaacccag

SEQ ID NO: 24163 - DNA, 601 bp, Human
tttaaatctcggaaaggccctcgttgagactggtaactctctaccaggggacatttgaaaggcaaaaagttctcaagttctggtatcaattgctagtaacgacgtgatgccacatcgctgaatcttagattcttcatctgtcacaggggcatggtgtggaaaaatgtactataaactggaaattataagaaaattttatgttctactttttatatctctgtactattttaattgttttgttagttttcaattagaaatgaaaacaaatgtttaaagttatttttctaattaagtcagattsttttcaaataattctattcttcatgcaaaaagaaaggtaagctttcatattttccaaaatataaaattatcttatccatattaatcataagtaaccagcctcccacttacctttaattttcacatattgcatttctggattaacacacacagcaaggttactaggtagagtccagggagtggttgtccaagcaactaaagatacagtttcatcttcttccaaaggggaaagttacaaatactgaaggatcttgaacatcctgaaataaattgaggtaaagtattgttttagaaatccaca

SEQ ID NO: 24164 - DNA, 601 bp, Human
aatctaggccaatttaaactctcatcataagctatgatattacacatctgagatttactagagcctatgtcatatatttagttcactataagaaaaatgagtatctatgggtcattgtaaaagcctttccaatttattgaaaaactgctatgaataaggctgccactccctagctctgacctcacaggaacttcattgtaagtggggaccacagtttctgataaagctcagatacaaagtctgccaagcacaagagttatacacaggtagatgggtgatgtgttttgagatctcagtcagrtggctgctgagattgtcaagctcaccacagaatggctagtgacccaccagtgacatagggaaattgtgcagatgggactgtccttgctccagagaagcagctgcagacacctgagccaggcctctttgtggccaacagctttccagtaggtcaactcttagtcctatttgctcccaggaaagaacaaataaaaaactccctccgtaccttttttctggcacccaatctttccccattcctttctcaatatttttcccttgccaacacaagctattgttcaatcaagttgactgttttaat

SEQ ID NO: 24165 - DNA, 601 bp, Human
tgcagtggctcacgcctgtaaccccagcactttgggaggccaaggcggtcagatcacctgaggtcagaagtttgagaccagcctggccaacatggtgaaaccctgtctctactaaatttacaaaaaataagccaggcatggtggcaggtgcctataatcccagctacttggcaggctgaggcaggagaatcgcttgaacctgggaggcagaggttgccgtgagccaagattgcaccattgcactacagcctgggcaacagagggagactctgtctcaaacaaaacaaaacaaaaaaaaaamaaaaaaaaaaaatttaccaaatggtgttaaaagctatagtttaaagaatgaatcttctataacattaacatgcacagcattgagaatagatatatgagatataactctagagttaatgacaaacacccacatttaaaaaagaaaacctcaggaggctgaggcaggagaatcgcttgaacccaggagacggagattgcagtgagccgagatcctgccactgcactccagcctgggtgacagagcgagactcccatctcaaaaaaaaaaaaaaaaacccctacactacaattcaaaaccaag

SEQ ID NO: 24166 - DNA, 601 bp, Human
tccgaataatgttaaagtccatacagacccgatagtcctcctgagaaaaggcaaaagagagggaagaataaaacagtctatgtatgggtgtgagcatgaggtaatagattcccaagataattgttctatattgtaacatatacatttcatcaactttgtcctgtaaactgaaggtaactcaagaccattcggagaatcagaccctcacagttggacaggggttaggtcacccagtctagtcttctcaaatattatttcccagacctccatatgtagcagagtatccactaaatgagaagayagatgacatacatcaattttttaagtgaaaggaattaagaaagtaaagcaataaagaatggctactccataagcagagcagccacacaggaatgttttaaaactaaatcaaatttgatttataacagcagcacacacatctgaaaaaccaaaaatttcctattttacagataggaaagtcgaggtaccaagaagtaactcagctatgaagcagcaatgctaggattcaaaaccaaacagcctggctccagagtctatagtcttcatcactgtgttatgatgcctaaatataaaattaaag

SEQ ID NO: 24167 - DNA, 601 bp, Human
aatacaaaacagatttgtacaggtctatttttctctcacagttccttaggaaagcaacatttttagccattcataaaactctcctagaccaggcgctgtggctcatgcctgtaatctcagcactttgggaggacaaggtgggaggattatttgagcccagtagtttgagaccagcctggacaacatggcgaaacctcatttctataagaaatgcaaaaatcagccgggtgtgatggcaccacctacatagttccagctactccagaagctgaggtgggaggattgcttaagccggggaggyggagggtgcagtgagctgtgattgcaccactgcattccagcctgggcgtcagagtgagaccctatctcaaaacaacaacaaaaaaacaaacaaaaaacccaactctcctaaaaatgaagtaagaaggtggcttcccaaaccaactctaaaggatacaagtgagatgaacaccacaaataagatggaatgggcacatatagtaagtgtaagcacagactggaagctctagctacaacacagtctttgtttcttctgacctccagcaaaaagggtagctgtgagtgaaggtggtggcaacca

SEQ ID NO: 24168 - DNA, 601 bp, Human
cacatacctctaaccagtcaccttagctttagccagcctcatcccatacaactctagtcttcacattatcctcaccatagcagtttttctgaactcattaagcaaaggccaacaggccaggggattggtagctgctctagcagccctctctatagtcacctctctggtcatccttggtcttgaatttcaggctctggcaatgaggcaagttccctagaatccttctcacttaactggctttgcccatgcctgccctctgacacgcagcctgcctgccctctgacacgcagcttccctcccytctgcatccatcctcttgcatccctcccactcccagtactctttattccttgaggttcagctttgcagaaatccttttcaagcacaaggctgagtcagggtaggctaccagacctccccttcttctcttgggcactgcagttactgccctgtacttcaaagatcagtttatatgcctgcaccccctcgaggctatcttactaatattctatatctagtatcttacacattaggggaactaattagcttactagctctaaaaatgaaaagctgtcttttgagaaatcaggaccactctgct

SEQ ID NO: 24169 - DNA, 601 bp, Human
gagatctttgctcctgacagttcttcaagttccgccactgacccaatgcataccacctgtcaaaaacaaagttcaatagcaggagctccttagagccaaacagagcatactgagttaatttatatagcatgcatgtttactttgagagactgatgattttctttttcctttttttttgagatagggtctcactaccattgcccaggctggagtgcagtggcacaatcacagctcactgcagcctcagcttcctgggctcaggtgatcctctcacctaagcctcccaagtacctggggctayaggcaggcaccacctcacccagctaattttttgtatttttagtaaagacagggtttcgccatgctgcccaggctggtctcaaactcttggactcgagctatcagccaccctcagcctcccaaagtgctgcgattacaggcgtgagccacccagcctgagactgatgatttaaaggcacattaacacaccaatctgggccgaaggatagtatttgctaatgtggcttctctctcatgaaagacacagcctactcttagtctctgaagaggccagggttgccactgctcctctgtttccacc

SEQ ID NO: 24170 - DNA, 601 bp, Human
aatgcacacagtggggcctggcaaaaaataaggatgcacaaaatgttaggtgacatcctcttcctcctcacacagcatataaagtaggatttctgtgtgggtactcagcacaaattctattttaaaatatttcattttaaaattttcatttatgtttatttttattcttaatgactagaggtaataaagtaaaggaaaaatgagacttccttataatagcaaaatgtgggaaataatgcccattgggaggaagtttcagatgaggggaagaatgggatctggtggcagagtacctcggtcragcccagtgtggctgtcactagctttgatcctgggcacctgtggtctctagaacccacagcttcctcgtgtgttaaaaaaaggacaacaaaatctacatgaaaggactgatgtacagattaaataagatctataagcaaaagtatttcataaagtgctaagtttagtaaatgctattttattactagtaatatcactagtagcattatgttactagcagtagcacaatctgaaagtcctccccttcctcctcctccatcaggcttagctgtcacacactccttcttgagaaacagtggag

SEQ ID NO: 24171 - DNA, 601 bp, Human
ggctgcagtgagccgagatcacgccactacactccagcctgggtgatagagtgagactctgtctcaaaaaaaagaaaaaaaaagccaattcccccaagttagttactgtataattctatttatataacattctggaaacgacaaaattacagagatggagaaaaaaccagtggttgccagggattggggatgacagtgggaaggcaggaggggaaggcaatgcaggaagggagcctttgatgttgaattcattcagtaacctgactgtgctgctggatacaggatcctacacacgatagcygtatacaggtaaatgcgtataagcaaataagtatatgtaaaactagagaaatctgaatacgattagtgggctatatcaatatcctggttgtgatatatactgtagttttgcaaaatgtgaccactgggggaaactgggcaaagaatttaagggatctctattatttttcacaattgcatgcaaatctacaatgatctcaatacaatttccccctttttttttttgagatggagcctcactctattacccaggctggagtgcagtggcatgatcttggctcactccaacctctgcctccca

SEQ ID NO: 24172 - DNA, 601 bp, Human
aactataaaccaaatctaagaatactgattaatagtataggagatgcttacataaaaaaacaatagatacacacaaggcaaagcactggtttgtacctgagggcatcagcaccatacttctggatgatggaaactggatctggataattctttttccgtttgctcattttttggccatcacttgtaaaacaaaagggagatgccaattaagtaagtcaatatcacagatgatcttgttttaaggatacaaatcatttgcaaacaggaatatacaaaatgaaatgggaaggagtaacttagrtagaagttagtgctaataggccgggcgcggtggctcactcctgtaatcccagcactttgggaggctgaggcaggcagatcacctgaggtcaggagttcaagaccagcctggccaaaatggtgaaacctgtttctactaaaaatacaaaaattagctgggcgtgggggcgcacacttgtaatccccactactggggaggctgaggcaggagaattgcctgaacctgagaggcagagattgaagtgagccaagatcgcgccactacactctagcctgggcagcagagcaagactctgtctca

SEQ ID NO: 24173 - DNA, 601 bp, Human
cctgtaatcccagcacttttgggaggccaagaagggcggatcacctgaggtctggagttcaagatcagcctgaccaacatgatgaaaccaagtctccactaaaaatataaaacaattagccaggcatggtggtgggtgcctgtaatcccagctactggggaggctgaggcagtgcctcaacccaggaggcagaggttacagtgagccgagatcgtgctattgcaatccagtctgggtgacaagactgagactccacctcaaaaacaaaaacaacaactggcgactaaacaactatatgacrtaactcttttgcaggctagggcccatggtcttggcatagcccggaccctagataccttccgcacctgcatgtatggcctccccatggctctaagttaccccagcatcaggcagcagagaacagcagccctaaagtctcacacagagctccacctcacagcttggtgaagggagcgctgtggagacacggcaggtacatgtgcagccccctacagcccataccttctggagcctcagaacgttctggattaagaagcgataggcattgtaccatgggagcagtacatccttaaggacgtcc

SEQ ID NO: 24174 - DNA, 601 bp, Human
tgtattcctgagtcccacaccagtggagacctgcagagtgcacctgcccaaggactgtttgccctacttggcagagaaccacatgcaggacaggtggcaggctgcagagaggaggaatgctgggagcctggggaagatgactgcccttctcaattcctggggaaaggctactctgagagcctcaggtgaacatgatgtgtcctcattagcagaacaaccagagcccaaggggagcagaagtaattgacctgcctgctggagtgggataacaagagttcatttttccaaccagctttttcawctgctcaagcaggaataatatctcattttcattcaacagttatttacttacaagcaattttacttgtaaggtgctggagatcagatgtgcagtatcggaactctgaccccaaatcaggtcttgaaagcccatacaggaacatgttcaatgaaggtgatggacgctgacaatggtcagttgtggggcatggaaggtggctctagagcaagggcttctcaggtgagaaagtaactcctgggcgtggaggtaactgccattgaagtacacttccacatacatcacaactattatatgtgaccc

SEQ ID NO: 24175 - DNA, 601 bp, Human
cctcctaggaaggaacaattaatgaaacactggcacacttgggaagaaagttactatgaggaaataaacttcttaaatcacttaaacaaaaacaaaaagaaaaaatcccagaccctactggcaatgtgaatttctgattttcagcaatattttcaagataagcaccaacgtggcacattaagtcctcaattaatttattatgtttttgagtaaactgaagagagtttaggaaaacattacttctctgcaccaaagagtaattatgaattgaaagatattctaaaatcttgtcagaaaagtrtagggtttagttactttaaacctcaggaaggaaggacagtagaactgtctaggattgaatgattgtccacaaactgaaaatgagtactgggaaataatttccatgctaaggctgttcattttacccagaaagttctatcccactctttttgctttgcaaaatcctccttgatcttaagtccttgctctacaaacagaactcatgtcctgctttgtttctctggcagcaccacaaccaggctagcggggcagtgataatgtgactcttcctctgtgtttaaggccctgatcatggagtctg

SEQ ID NO: 24176 - DNA, 601 bp, Human
gtctctacttaagccttacaaacactactgggcattctgcagataaagaaactgaaggtcaagataggctgaataagagtggcatctgatggcacaatggggtgatttcagtcaacaataatttcttgtacatttaaaaacaagaaaaagggtataaccgagatgtttgcaacacaaagatatgataaatgcttgaggtgatggatatcccatttaccctgatatgactattacacactgtatgcctatataaaaatatctcctgtaccccataaatatatacatctactatgtacccataaaaaaaaaaaaggaaattgacggtcagacttcaggcaactctctggattgggaacaagtggtagagttgggctctgaacccatggctatccagctctaaagctcttctgtggagcattgagaccacgaggacaccccctaaagacagaattccccagggctttttttttttttttaagatggagtttcgctcttattgcccaggcagtggtgcaatctcaactcactgcagcctccgcctcccaggttcaagcaattctcctgcctcagtctcctgaatagctgggattacaggcgcccg

SEQ ID NO: 24177 - DNA, 601 bp, Human
taaaattacccaacgaactcactgttgttagttaatagaaataacagcaaaatgtccatttcattattgctcttctgacttttctaatttttctggaaaagaaggggactatttagtaatgaaaatagaactaaaaataagttataaatgcattaataacaagtattatttattgagtacctatcatctgccagctactttatgtaaatcgtctctacttaagccttacaaacactactgggcattctgcagataaagaaactgaaggtcaagataggctgaataagagtggcatctgatggcacaatggggtgatttcagtcaacaataatttcttgtacatttaaaaacaagaaaaagggtataaccgagatgtttgcaacacaaagatatgataaatgcttgaggtgatggatatcccatttaccctgatatgactattacacactgtatgcctatataaaaatatctcctgtaccccataaatatatacatctactatgtacccataaaaaaaaaaaaggaaattgacggtcagacttcaggcaactctctggattgggaacaagtggtagagttgggctctgaacccatggctatc

SEQ ID NO: 24178 - DNA, 601 bp, Human
actttttaccttccaggaagctcaggttttctatgttctggtttcaactctgagggagtaaatgaacccaaatagaactccacatacaatggataaacatacaacacacaggggcagcagcagcagccactacccaggccaccaccaccctgtgaggcaggtcctctcatacccacagtgctcctgagggagtggaggacatgaagctgacaggccggcagaaccgggacttaaacacggcccacaaaacgtggctgccgatctccagtttccaggcagaccaggctccagccagaatgcrcatctccagacccagcttcacaggaggtcatggcagctggtgcccaaatattgaagggggtccgggcaacaatccccacgtttcccacccacttgtatcactcaggagggaaaagcagacacaggtgtgagcatgtctggggagtgtgctgggctcccagtgctgccctcgccagggcagcactcagcctcacactcacttccatcttcatctgtgtctatctgagcaacagctggactgtcgtgatccttctacatgtttaacaaggtggacaaatcctgtagcagtccttctgtgcta

SEQ ID NO: 24179 - DNA, 601 bp, Human
ggcagtcagagtgtttaggggtgcacacaaaaaaatcaccatgtgagccacatgcgaattcccattggtcagtgagaaaagccaaaaactccagtatgtgtggatcaaagtccaagactgcccactacacaactgtaggaagtgccatttacacggagctgtgcaatttgacagcatcaacaatgcccaacttctttccattgtattacactgtacttcaactaaaagacaaaaagcacaattcagatgctaagaggcacagcataggccagtgattctcaaacaaaagcaattttatccyatgggaaacatttgtcaacgtttggagaaacattttgcttgtcacaacttggagggtagcacggtgctactggaatctaatgggtagacccagagatgctgctcagttataaagcacagcacagccccaccacagaggatgacctggcccaaactgcccatagtgctgcagttaagaaactctggcacaggctatgaataaaatagaactggccttctaaacattaaaacagtcgagtaaaaacagcatcagaggtagtgaaggtcttgaggaattaggaggatttgaagagttccctga

SEQ ID NO: 24180 - DNA, 601 bp, Human
tctcattttaagtgaagtagttaatttcaaaatttttcagctgggtgtggtggcgcaaacttgtaatcttagcacttcgggagatcgaggtgggaggatcacttgagctcaggagttagagaccagcccgggcaacatggcgaaaccccatctctacaaaagcctgtactactatgcctaatctccgccacttgggaggctgaggtgggaggattgcccgagcccaggagatggaggctgtagtgagccaagatcacatcactgcactccagcctgggtgacagagcgagaccctgtcacaaaaaaaaaaaaaaaaaaaaaaaaaatttctattttatgcatagccacaggtactaatgtcagaatttaaaatctaacttttggtttctaatatttctctgcaactttcaagcaactgaaaaccaaatatagaaattaacattttctataataatgattttaaatatcacctgtgaaaagaataaacaatgaaattttaaaaaatatttgttttctatcatcacaaagaagatgaggtaaaacatatgcgtttttaaaacatcatggaataaagatgttttaaaatatcatggaataaaaa

SEQ ID NO: 24181 - DNA, 601 bp, Human
tcagttaaacagaacacttcatgcttcagtcatgctactgaggattactgatgcggcagggatggtgatggcacagtagcggatgggaaaatgagaacagcttgaagcaaataatacggaatgtttagttttgccattatatttagctacattaattaatctcattttaagtgaagtagttaatttcaaaatttttcagctgggtgtggtggcgcaaacttgtaatcttagcacttcgggagatcgaggtgggaggatcacttgagctcaggagttagagaccagcccgggcaacatggcraaaccccatctctacaaaagcctgtactactatgcctaatctccgccacttgggaggctgaggtgggaggattgcccgagcccaggagatggaggctgtagtgagccaagatcacatcactgcactccagcctgggtgacagagcgagaccctgtcacaaaaaaaaaaaaaaaaaaaaaaaaaatttctattttatgcatagccacaggtactaatgtcagaatttaaaatctaacttttggtttctaatatttctctgcaactttcaagcaactgaaaaccaaatatagaaattaacat

SEQ ID NO: 24182 - DNA, 601 bp, Human
tctcggctcactgcaagctctgcctcctgggttcacgccattccccggcctcagtctcctgagtagctggaactacaggcgcctgccaccacacctggctaattttgtgtgtgtgtgtgtgtttttagcagagacggggtttcaccgtgttagccaggacagtctcaatctcctgatttcgtgatctgcccgcctcggcctcccaaagtgctgggattacaggcatgagtcaccacccccagccatctcaggaatttttgatgctttggctatctggcgaacaatttagatttgtggcttraaggctcgtaacactttgttattttaatattttgagttgattagtaattagtaataacttgaggtttagctgctgatgtcttatgttttattaattctatctaaatatttggagaatcttagggacagttcccccatctgatttatgaatcctcaaatctctcttctcaagacatctcctagcttatgattttcaacttcagaggaagccgtaacaataaacagcttgtgccccaggatagttacaggatgtcagacagccacactcagaccatgtatgattctaatcatggcagagctg

SEQ ID NO: 24183 - DNA, 601 bp, Human
caggctgcagtgcagtggcaggatctcggctcactgcaagctctgcctcctgggttcacgccattccccggcctcagtctcctgagtagctggaactacaggcgcctgccaccacacctggctaattttgtgtgtgtgtgtgtgtttttagcagagacggggtttcaccgtgttagccaggacagtctcaatctcctgatttcgtgatctgcccgcctcggcctcccaaagtgctgggattacaggcatgagtcaccacccccagccatctcaggaatttttgatgctttggctatctggygaacaatttagatttgtggcttgaaggctcgtaacactttgttattttaatattttgagttgattagtaattagtaataacttgaggtttagctgctgatgtcttatgttttattaattctatctaaatatttggagaatcttagggacagttcccccatctgatttatgaatcctcaaatctctcttctcaagacatctcctagcttatgattttcaacttcagaggaagccgtaacaataaacagcttgtgccccaggatagttacaggatgtcagacagccacactcagaccatgta

SEQ ID NO: 24184 - DNA, 601 bp, Human
acgatacctccgactccttgccactgtcttcccacgtagagttctgtacacatctaacttaagcgcctgggtaaaggactgaggaggtcgaccttcctttcatggaggtgctgctctaccttcccctgcacatggtatgctaagcacagagggacccctgcaatatccccaaacccacatgcgagatcttacaactatgctgactggggatgtctggtcaggactgcaaagagatagtctcttctccaatatggcaaaaaatattgatcctggaatctaaaacagtttgtatattctcttgaaaagagtgttccctgaccacttttcaccctacacctatttttggataggagccctctgtgtacttatttctaccagataacttatcaggtagaatactaagaactggcttaatttcaggtgtccttgactgactcattccttgaagggttcatttttgtgcaaccccacacttgggacaatgactgacatgtagaaatcacaaaatgcttacttatgtattcactaaacaaatgcatatgttaagggcataataatatattagtttaataaagccaatctaaaccaagtaactggttta

SEQ ID NO: 24185 - DNA, 601 bp, Human
tgacttaaactgccatatttttgctaaggttaatgtttctatctcatctattctgaaggttgctgattatgatgtagcaataatgacactatcgcttctgttacacagcatgttgcagagtaaaatatactctacaaaagacttgtacattaggcatcatctcatttacctttgagtaaacagagaagttaagaaatgactcacttcataaaggcatcagaggtagtgaaatgcatgataaactcaaaattccagtcagtgcagggccactacaacatgtaagccatgtcaagaaactcasaagcatcacatgacacttttgtaaggtggacaacttttcaggcccctaacatctgctgtaatgaggaagaactgcccactgtcagtgtttagaaacctcctccctgccttctttcccagctacgatacctccgactccttgccactgtcttcccacgtagagttctgtacacatctaacttaagcgcctgggtaaaggactgaggaggtcgaccttcctttcatggaggtgctgctctaccttcccctgcacatggtatgctaagcacagagggacccctgcaatatccccaaacccaca

SEQ ID NO: 24186 - DNA, 601 bp, Human
tggatcaacggcctcagcgcagtcaactccaagtgactttcctataccatgacccctgtgatcttcaggtttgtcagaacgactcaagacaaattctacaatggaccacaaaactttctgtgacttaaactgccatatttttgctaaggttaatgtttctatctcatctattctgaaggttgctgattatgatgtagcaataatgacactatcgcttctgttacacagcatgttgcagagtaaaatatactctacaaaagacttgtacattaggcatcatctcatttacctttgagtaaayagagaagttaagaaatgactcacttcataaaggcatcagaggtagtgaaatgcatgataaactcaaaattccagtcagtgcagggccactacaacatgtaagccatgtcaagaaactcagaagcatcacatgacacttttgtaaggtggacaacttttcaggcccctaacatctgctgtaatgaggaagaactgcccactgtcagtgtttagaaacctcctccctgccttctttcccagctacgatacctccgactccttgccactgtcttcccacgtagagttctgtacacatctaact

SEQ ID NO: 24187 - DNA, 601 bp, Human
acagggcaagaaattcctgattctctcactagcaggggctttgcagcccctctgcgctccaggatgagctccctgcatattcctcagctctctaataaggaaaaactacccaactctgtccaaatccgggaatctcccctaagctagaagcctgtctatgctgactgcacctctgcccttctgcaaagacactatcagctctgattaccttctgctccagtcacaggggatattctgtagaagcccaacggagctaaaaaaaaggatgggaaaaggcacaggctggctgaaagctacgacytgggagtgaacacgtggggagaggaagaggagtgacttttctgcagaatacattccaaatggactatggattagtgattgttatgcattgatcactatggtttatattacctgcctctcctatcttctccaaacaaccaaaacaaacaaaaagccaaaacagtagcttattcttaactgacaaactaacctttttgcgaagtttctgtatgcgattgatgacttcccgagccattccttcatctaccattgactggtcaggagtgacatctaagaggaccaaagcctgtgggaatgaaca

SEQ ID NO: 24188 - DNA, 601 bp, Human
ctctacagggcaagaaattcctgattctctcactagcaggggctttgcagcccctctgcgctccaggatgagctccctgcatattcctcagctctctaataaggaaaaactacccaactctgtccaaatccgggaatctcccctaagctagaagcctgtctatgctgactgcacctctgcccttctgcaaagacactatcagctctgattaccttctgctccagtcacaggggatattctgtagaagcccaacggagctaaaaaaaaggatgggaaaaggcacaggctggctgaaagctaygacttgggagtgaacacgtggggagaggaagaggagtgacttttctgcagaatacattccaaatggactatggattagtgattgttatgcattgatcactatggtttatattacctgcctctcctatcttctccaaacaaccaaaacaaacaaaaagccaaaacagtagcttattcttaactgacaaactaacctttttgcgaagtttctgtatgcgattgatgacttcccgagccattccttcatctaccattgactggtcaggagtgacatctaagaggaccaaagcctgtgggaatg

SEQ ID NO: 24189 - DNA, 601 bp, Human
ggctgacccccccacctccctcccggacggggcggctggccaggcagagaggctcctcacttcccagtaggggcagccgggcagaggcgcccctcacctcccggacggggcggctggccaggcggaggggctcctcacttctcagacggggcggctgccgggcggaggggctcctcacttctcagacggggcggttgccaggcagagggtctcctcacttctcagacggggcggccgggcagagacgctcctcacatcctggacgaggcagcagggcagaggcgctccccacatctcagaygatgggcggccgggcagagacgctcctcacttcctagatgggatggcggccgggaagaggcgctcctcacttcctagatgggatggcggccgggcagagacgctcctcactttccagactgggcagccaggcagaggggctcctcacatcccagacgattggcagccaggcagagatgctcctcacttcccagacggggtggcggccgggcagaggctgcaatctcggcactttgggaggccaaggcaggcggctgggagatggaggttgtagcgagctgagatcacgccactgcactcc

SEQ ID NO: 24190 - DNA, 601 bp, Human
ttaatagtacctcactgtggtactatcttgcaagttcctgattaccattaagatgcaccagttgttccttagttggccatttgcatttcttcttttaagttatttaaaagtttctgaaaatgagcattcagattcataaaatgagtattagttttctgaggctgccatagtaaagtcccataaactgcagggggctagggaataaaaataaaagaaatgtactgtctcaaagttctggaggtcagaagtccaaaattaaagtgttggcagatgtgctccctctgaaacctgtaggcgaatycttttttgcctcttcctagcttctggaggctcccggcaatcttggttgtttcttggcttgcagctgtgtgtaactccaatctctgcctttgtcaccacatggcattttctccgtgtgtttctatgtcttcacatggccaccttctttttttttttttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagt

SEQ ID NO: 24191 - DNA, 601 bp, Human
ggtttcatcctgtgtcaatgcagctaagctaaaactatttcccaggttctctgtctgacctggttctgggtaatggcttgatcacagacaaatctacacaggatttagaaggtagaagtttagtaacagtcattatgctaaacaggctaacatggggcccgtgcccttggctttctcaggttgctgtgaatctgccaacttgttgggttaagtgggacagtgagcagcccacgctcctgcctctgctcttccaacttccaggccaggaatgtgtgcaactctctggaaaagtgtaccagcrgtttcttctgcaaggcacctgtcagtgtgggatgaggtcagatagatgtgcactctagcctgtttttgctcgtttctacttctcatcctaccgtgactttaggcagagatccagctttccactgacttatccaccaccttggtggaacctggttagagatttttctcagacctctaacttgctaccttcttgtagaattttacttggtttctcccacattgcttttgcttctcctatccaacctttaatggatacaatagcaaacagttttccagtggttccaacaattcataatccagc

SEQ ID NO: 24192 - DNA, 601 bp, Human
acatagcatcgcttgaccagagaactcatttttcagcaaatgaagtgtggcattatgtattaatatatattagccaattcttatttttccactctcttatttccttaccatataacatgaaatattttaacgggttaaccttatacctcagtgaagttaaagaacagcaaaagagggatgtatggctcagctagaagagaaatcaacatcacccaaagaaggataaggtaactttctatctcgttttgggtaatgaagttagcatctttgaagcagtacaagaaagagttaaaagtgtgatttttttttttttttttaatctactagggtctttatttggaagttacatatgatttaaagagccatgtatagatgtcaagatcacaatggggtgaactatggtggtttcatcctgtgtcaatgcagctaagctaaaactatttcccaggttctctgtctgacctggttctgggtaatggcttgatcacagacaaatctacacaggatttagaaggtagaagtttagtaacagtcattatgctaaacaggctaacatggggcccgtgcccttggctttctcaggttgctgtgaatctgccaa

SEQ ID NO: 24193 - DNA, 601 bp, Human
aaaaaataaataataataatcagtggacatgttctattctgccgccagccactcctgcccttgcccaatggattgatgaacaaaggggccacccagactgggaggaagaataaccacgggctccacaacattacttccactccctaaggctgattttgctacagctgctactgcgtatcccacctaccaacagcgggaaccattacttgagctttcgatacagtgttattgccaggaaagacaagccagactcctgatggcagcttggttgtactgcactgtttccattatgggaaaaggyagtgctttggtcttactggaacacacactccttttggacaaggatttgccactgtcacctataatgcttctggcaaacccaccatccatggaggtagagaatgtcttatttaccaacacagcattccacatagcatcgcttgaccagagaactcatttttcagcaaatgaagtgtggcattatgtattaatatatattagccaattcttatttttccactctcttatttccttaccatataacatgaaatattttaacgggttaaccttatacctcagtgaagttaaagaacagcaaaag

SEQ ID NO: 24194 - DNA, 601 bp, Human
ctccgaaggccaaacaccttggctgcttcatacagaagaccttggtgggtgagtccattctgcccaagtgggttttcaagcaggagagtgcccactgtccccattaaacactctgtggaagacagaacaaactggattaaatctcgagagttcaccctctagctccaaaagaggtggccactgcggacagctctaacaggcagtgctgaggccagcagtgcgtccaggagcgtgagtgtgaccgctgaagatgcagtccatgcagaaacagctctcaacatttcatagaggtgaaggggarggggaaaaagaaaaaaaaaaaacttatataaaagcccagcagcttggggagcagatactcagtacacagtgaagtgaggagcccgaagacttcagtacaaatgtgcacaatgaggatcctaaaatatcaggaaaaaaatcactatcaatctagtctgttgattaaggcatggaggtatagaagttttcagaacatttttcctcagaaaagaaagtaaaatttgagattaaaatgttttggcactcaaacaatttagttgtaatttttacctaaccaattttttcatttcctaaccatgcc

SEQ ID NO: 24195 - DNA, 601 bp, Human
aatattccatcaaattatccaggaaaatccaggtggcagaaatatataatatgtccatttcatcaagaggtctcaaataaattttaaaaggccagaaaatgatatatatactatgccatttaaatcacttctatcttctgtacttaagaactcaagtatagaaataaactgtgggctgaagtaacattgtaacctgctcccaacatgactgcataggtgtctaaggttaagtgtgaagattactgtgaggtctcaagttacttgactaatcaatcccatttgaatttcaatccaagcagcrtattttacacacacctgaaggaaatatcttcagtgtgttcatgtgtgtgtctatgtgcatgtatgtgtaggggataggtgtaattagggaagggctgaccgaacaacattgataagtacatgctagaagtctgctgttgttggtaacacagaaacatacacagtcttcatattcaaagtcttcacggggatgtcttctgtaatttctagaatggaaagaaaaagttgaaaaaaaatcagtattttacctattgggggtgaatatttaaaaaaatgttaactgcttgtgtagtaaggaatt

SEQ ID NO: 24196 - DNA, 601 bp, Human
aacacatttatatctgagtttgtttattgttctgatttactgaaacttaaaatattccatcaaattatccaggaaaatccaggtggcagaaatatataatatgtccatttcatcaagaggtctcaaataaattttaaaaggccagaaaatgatatatatactatgccatttaaatcacttctatcttctgtacttaagaactcaagtatagaaataaactgtgggctgaagtaacattgtaacctgctcccaacatgactgcataggtgtctaaggttaagtgtgaagattactgtgaggwctcaagttacttgactaatcaatcccatttgaatttcaatccaagcagcatattttacacacacctgaaggaaatatcttcagtgtgttcatgtgtgtgtctatgtgcatgtatgtgtaggggataggtgtaattagggaagggctgaccgaacaacattgataagtacatgctagaagtctgctgttgttggtaacacagaaacatacacagtcttcatattcaaagtcttcacggggatgtcttctgtaatttctagaatggaaagaaaaagttgaaaaaaaatcagtattttaccta

SEQ ID NO: 24197 - DNA, 601 bp, Human
tgggcaagtcacttgtccctctctggcctcagtttccctaaaccgagtgagtggcaatttttcaaaacgtctgccaactccaggacttgccgtttaaacctccctctccaagagaggagatactcacctggaggtgtcaggacacggccgagtcagtggcaaaagctccttttgtcgttggagatgacaagttccggagcgagctcggctgtctgattagaggaaaagagggaagagttacgcgaggcaatcgggagctccgagggtcccgcagcatccttgcctgggtgttcagccctgycccgacttcgaggcttacctggatgggaaggtgggggccatcagggggtccaggggctggctcggccaggactacctgcaggtcgagaatgtagtcgatgacgcgctgtaggatttccacctggctaagctgagtgcctctcgggactccgggtaccagttcccgcaggcgggagtagcagtggttcatgtcgtccagcaagctcagcggctcctcagctgccgggcccttccctcggccccgggcgatggccagactgcgttccgacaggcagcacaccgcctcgtagcagccgcgcac

SEQ ID NO: 24198 - DNA, 601 bp, Human
gccagaccctcggccactgcgggagggcagggcccaggcgcatttaaggcttaaatgcacatcacatggaaactgactctgccattcatttgatgcaaccatgggcaagtcacttgtccctctctggcctcagtttccctaaaccgagtgagtggcaatttttcaaaacgtctgccaactccaggacttgccgtttaaacctccctctccaagagaggagatactcacctggaggtgtcaggacacggccgagtcagtggcaaaagctccttttgtcgttggagatgacaagttccggagygagctcggctgtctgattagaggaaaagagggaagagttacgcgaggcaatcgggagctccgagggtcccgcagcatccttgcctgggtgttcagccctgccccgacttcgaggcttacctggatgggaaggtgggggccatcagggggtccaggggctggctcggccaggactacctgcaggtcgagaatgtagtcgatgacgcgctgtaggatttccacctggctaagctgagtgcctctcgggactccgggtaccagttcccgcaggcgggagtagcagtggttcatgtcgtccagc

SEQ ID NO: 24199 - DNA, 601 bp, Human
caaggagcagtcagtttccgccgagcgtgccgaggcgggggccgtccgcagactggccggcgccagggaggaaacttggtctgtacctccagctgataactccgcgccccacgctgcccccacccagttggcgccaaagaccacaggcggagcttgcgctacccctcctacttggaattgacactagctgggagggggctgccgaagacagctccctatacaacatggaacagaaagacttgtatttagtcggacccatgtctactttgccagaccctcggccactgcgggagggcagggsccaggcgcatttaaggcttaaatgcacatcacatggaaactgactctgccattcatttgatgcaaccatgggcaagtcacttgtccctctctggcctcagtttccctaaaccgagtgagtggcaatttttcaaaacgtctgccaactccaggacttgccgtttaaacctccctctccaagagaggagatactcacctggaggtgtcaggacacggccgagtcagtggcaaaagctccttttgtcgttggagatgacaagttccggagcgagctcggctgtctgattagaggaaaagaggg

SEQ ID NO: 24200 - DNA, 601 bp, Human
tcctctcagagtgctgagcactttgaagctatttcctaaaaagggagaaggcagtatctaagaggagtgtgctaatgttttcttatgaactttgactctgctgttatatcagtaaaggttagcagtactggcttggtaagctgaaagttggggcatttcattgatctctccatgtacctccactgctaggcatttctggaatattcagtgcttaatgacaaggctgtgttattttcaaagtaaatgttgaaaatagaaaccatatttaggttaaaacacctttctttaaactgtcaaaaakgctccataaatcatttgttgagtttttaaaaagaaaaatcataccacttaaaatatatttctaattaatgcactgtaacattaacttttttgggagtacagctctttgaatattaactcatgtatcgaatcaagtaaccactgtgacaaacaggatacaaaactgttctgtttctccaaacaactctcatgtgcccttcttttgcagtcatactctcccattatccctaaccccttgatctgttctcggtcactccagttctgtctttttgagagtgttatttaaatggaatcatacaat

SEQ ID NO: 24201 - DNA, 601 bp, Human
cagaaaactttggtgactccctatttgctctttaaatcccaagcctttggcctgttatttaaggctttgccatattatgattctaccactgtctgctttccaacaaaatcttctgtagttctttttctaaaaccttgtgcttgagcaaaactcagttctttatatactattttccatttgtgttctatgctttcactacctttgagcattattctccactgaaagtttctttttctcacatgttccttctgtctcaagtctaaatatccataccagttcaaatgtcacctcttgtgtttcrtcttcttttattgtcttggctggagtgacctctttcctttgctaatcttcaataacacttatctgttcctctctatttttatcactttttacttcatattgcagggggttttttttttggtgcacattttaagtttctgttagaccctgcctagtgctagaatttctgtctggtaactctttttatctcttaagtgtctctagatgtgtgttctatacatagttgatgatactaaagtgtcttgctgggggttcatctttactgtggaaaagtgcctttagagaagaccctacattttgc

SEQ ID NO: 24202 - DNA, 601 bp, Human
gatattccattttccatgatgtgcttatttcacattgcttgcctgtatcaaaacatatctcgtccacacacacacacacacacacacacacacacacacacacacatctgctacataaccacacacacacacaaactaaaaaatttggaaaagaaggagaaaatgctcaatacatgttttattgaataaatgaaagactgatggagagaaaaagatttccccaaggtcataatataagagctggaaggaagaggtgctgggaagaaaacatcatttaatttatcagatgaaacaacagctygtgatatgacgagctcacctgtgatttgtgtacaaccaggctaaaaaaggaagcatgaaccagagatttttggagaggtgtggtcaagagaggtgacgggagttggaaacttgcatagtcctttagggtggccacacctcttggattccttgtgtagtttataccttttgttataatttaatgctcttaaaattggcccattttaaatgatgttatatggtcatcttatttatcaaatacctctttgatctgtttaagctgctgcatacctgtggttgtgaaacttgtggcataggctat

SEQ ID NO: 24203 - DNA, 601 bp, Human
gctcaatacatgttttattgaataaatgaaagactgatggagagaaaaagatttccccaaggtcataatataagagctggaaggaagaggtgctgggaagaaaacatcatttaatttatcagatgaaacaacagctcgtgatatgacgagctcacctgtgatttgtgtacaaccaggctaaaaaaggaagcatgaaccagagatttttggagaggtgtggtcaagagaggtgacgggagttggaaacttgcatagtcctttagggtggccacacctcttggattccttgtgtagtttataycttttgttataatttaatgctcttaaaattggcccattttaaatgatgttatatggtcatcttatttatcaaatacctctttgatctgtttaagctgctgcatacctgtggttgtgaaacttgtggcataggctatttgagataataatctttgtagttagcctaatgtggatataaatagcatctttgtcacttactggaaatatgagctggacaagttatcaagacctctgcaagcattcttatatggctgttaccttcgacacagaaagcagagttcttgagcatggaatttctgca

SEQ ID NO: 24204 - DNA, 601 bp, Human
acagctcgtgatatgacgagctcacctgtgatttgtgtacaaccaggctaaaaaaggaagcatgaaccagagatttttggagaggtgtggtcaagagaggtgacgggagttggaaacttgcatagtcctttagggtggccacacctcttggattccttgtgtagtttataccttttgttataatttaatgctcttaaaattggcccattttaaatgatgttatatggtcatcttatttatcaaatacctctttgatctgtttaagctgctgcatacctgtggttgtgaaacttgtggcatrggctatttgagataataatctttgtagttagcctaatgtggatataaatagcatctttgtcacttactggaaatatgagctggacaagttatcaagacctctgcaagcattcttatatggctgttaccttcgacacagaaagcagagttcttgagcatggaatttctgcatcatcttcaggtttcagtatttataacccacagaggttttaccagtggccagatatttcttgggtagtagaaaaagaaatacttcacagagctgtcaaatctccacatcttcagcattaaatatcatgca

SEQ ID NO: 24205 - DNA, 601 bp, Human
acttactggaaatatgagctggacaagttatcaagacctctgcaagcattcttatatggctgttaccttcgacacagaaagcagagttcttgagcatggaatttctgcatcatcttcaggtttcagtatttataacccacagaggttttaccagtggccagatatttcttgggtagtagaaaaagaaatacttcacagagctgtcaaatctccacatcttcagcattaaatatcatgcaaccaaatgtaagggtatggttcacagcagttggctgtttcagctggttattaataggaaggmgaaagatcatagaaagttgactcctccctcatcatttctgtcttccagtgagaagaggagagcacgaacagcaggaattagatttatatattttccttaatataaattcacagtatggtagattgcagacaaagtctgaatccaggatttctagactttctatgtgtctatgtgtcactaaaagggaaaagtacctggattgtaaagtattccaactagaaatagaccaagggaatgcaaagaggggtaagaaggttgaatttatctgccagaaatgtaaatcctggtcaaaaaatccag

SEQ ID NO: 24206 - DNA, 601 bp, Human
atcttcagcattaaatatcatgcaaccaaatgtaagggtatggttcacagcagttggctgtttcagctggttattaataggaaggcgaaagatcatagaaagttgactcctccctcatcatttctgtcttccagtgagaagaggagagcacgaacagcaggaattagatttatatattttccttaatataaattcacagtatggtagattgcagacaaagtctgaatccaggatttctagactttctatgtgtctatgtgtcactaaaagggaaaagtacctggattgtaaagtattccawctagaaatagaccaagggaatgcaaagaggggtaagaaggttgaatttatctgccagaaatgtaaatcctggtcaaaaaatccagatgaatattttttaagtaggcagttatagttcagtgaaaaagagagttgtggagccagaaagctggagtttgatcatagctctaccactctctagccaaaggatcgtggtgatgttattgaaacttgtctctagccaaaggatcttagttatgttatttaaacctgtgtattaaacttctttatctgcatgtaatatgggaattgaaaaacaaac

SEQ ID NO: 24207 - DNA, 601 bp, Human
atgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggtagcctgattcttggcagtggctttctcttttccctttagtttctgggctcttttccggatgatccgygtgctaggaagctggggagaagtcggaagcatttagatagagtttagtgaggtaattgtctgcagcttagctgaaggggtctgaaggaggtatgcagagaaattggttgtggcccttagaatgttctccagaggtagttccttcccagaccctgagacatatcaaagttgtccgaaagtggagccttgttattaatcccctctcaccacaccggttcctgcctgcctttatgccccacctggagacatccatttctccagacattgaacagggcagagaatagagcccatttgtatctgt

SEQ ID NO: 24208 - DNA, 601 bp, Human
agaagagaaactcaggtgcattgtgtgatgcacaatgcctcccaaatatgtgtgatgtgatgcctcccaaatattattttactttttgagtgtggcaactgaaatgtcgaaaattacatatgtggttcgcattatcatttctgtcagacactgcacatctagcccccaaatcagaagacctagaacgaactgggagtcctctctcccatttgtccaaggtttgccttttcagttacaatttcctccttagaattttgtctgtcataatattctcccaaatattattttgggaggcatgacrtatatgtatgacaatgctttttaaacttctaccaactttcccctaagaagcaagagaataccatatctctggcaatctaaggatataatccaaacaatttaccatgactgtaaaatttcttttcaatccacttttttttcccttgaaagttttgtagattttatattttactcttcagtattcctcttttttttttctgcattaatgttgtttttggggaaaaaaacaaaaaaacaaaacaaaacaaaacaaacaacttctaaaaactgaggcctctccacagaatagcccttttcaggg

SEQ ID NO: 24209 - DNA, 601 bp, Human
gcctcccaaatatgtgtgatgtgatgcctcccaaatattattttactttttgagtgtggcaactgaaatgtcgaaaattacatatgtggttcgcattatcatttctgtcagacactgcacatctagcccccaaatcagaagacctagaacgaactgggagtcctctctcccatttgtccaaggtttgccttttcagttacaatttcctccttagaattttgtctgtcataatattctcccaaatattattttgggaggcatgacatatatgtatgacaatgctttttaaacttctaccaamtttcccctaagaagcaagagaataccatatctctggcaatctaaggatataatccaaacaatttaccatgactgtaaaatttcttttcaatccacttttttttcccttgaaagttttgtagattttatattttactcttcagtattcctcttttttttttctgcattaatgttgtttttggggaaaaaaacaaaaaaacaaaacaaaacaaaacaaacaacttctaaaaactgaggcctctccacagaatagcccttttcagggttaattatttggttactttttactcacagtcacttt

SEQ ID NO: 24210 - DNA, 601 bp, Human
aagaccccctttatgacctcatttgagctcagttatgtctttaaatgttctgttttcaaataaagtcacattctaatgtactgtgaattaggaccttagcatataaattggggttgggtgacacaactcagtccataacaataaataatcacaaatgttttttctctcatggagagtaactactccctgatggaaaactatgactatgctttggtaaatgtaagctatgttatgattatgtgaaaaaagatctcttttctatcacagaaaagcctttggatcactgtgttcttgggggttrcaggtaagggggatccctgtagcctctgaaggtccttctgaggctttcattggacacttgaattttaatggagtggactttagactggtatatgggtttctgaggatcctgaaatactcatgttgtcattatttatgttctaatacaacttggtagaagttaaagcagattatagtggaaagagcattaggagaagacagagaaaccaggccatcacttccactctgccactacttagctggtgaccttaggcaagtcctgtccatgtctgagagctgtggtatctacgtccacatagga

SEQ ID NO: 24211 - DNA, 601 bp, Human
actatatttagtctttattcataagtcattttggtaccagataagccaaataggtgttatgtgatgcctcccaaatgttatttagacaaaaatcacagaaatggctacacatagactccttatcccatcactgtaaaaaattagttgtttttattattgtatgttctttttcatgttttcctatatttagacacaagttttacatccattccatttatttaataacaaatatttatttagcagttactgaaagttaagacactgtactagatgcaatttatgtaataaaaaacataaatarcgttgtgggacttatattttacagaggataagcgtacgtatctataacataacaatctaattttgagctataacaaatttaataaaggaaatgtccaaggtgctcaataaatgacagatcaaatttagatatgaggtgggaaaagataacagagaaggcctgcatgtgaaatggagggggtgggggaagtaagccctccaggcagacggaacaacgtgtgtgaacattatagcaccaatgtaattccccagtcatcctaaggaattgttatgtgtttgtttttttccttcatgcctgatt

SEQ ID NO: 24212 - DNA, 601 bp, Human
ttcctttattttatgctttgcttgttttaaatgactgaagtgcagtaattgagtatatcttggactataggccttctctaaaacaactgacaaactatgccaggaagttaggcaagattcagagaagagcagaatttttaataaggctgcctgatttaacatcatctcccttttttatttcctctaacacaggctctccaaaaaatgcagtgccccctgtgatccattcacctaatgatcatgtggtctatgagaaagaaccaggtaattacagctatgtctctgaatttcacttagattmtcttaattacaaggaataaaatgtcatttaagttaatgcaagaaaatagacgactgttgtagagaaacacatgaattgaaactgaaatgtcagaaaccaaagcagctgtggagatcagttacttccctgatcccatgggcaactctagaattttttgcttcactctcggtatctgctcccttctccctctgctagccgtcttcctctgctgatgagtgatttctgtttgatgcaaactttagcttgcacagggctttggtttgccaaggctgcaacatgggcacaagatttagacatcct

SEQ ID NO: 24213 - DNA, 601 bp, Human
agtatatcttggactataggccttctctaaaacaactgacaaactatgccaggaagttaggcaagattcagagaagagcagaatttttaataaggctgcctgatttaacatcatctcccttttttatttcctctaacacaggctctccaaaaaatgcagtgccccctgtgatccattcacctaatgatcatgtggtctatgagaaagaaccaggtaattacagctatgtctctgaatttcacttagattctcttaattacaaggaataaaatgtcatttaagttaatgcaagaaaatagaygactgttgtagagaaacacatgaattgaaactgaaatgtcagaaaccaaagcagctgtggagatcagttacttccctgatcccatgggcaactctagaattttttgcttcactctcggtatctgctcccttctccctctgctagccgtcttcctctgctgatgagtgatttctgtttgatgcaaactttagcttgcacagggctttggtttgccaaggctgcaacatgggcacaagatttagacatccttcaagctcctgctccattatgaaaggtcagtggtggatcttgaaggcaaga

SEQ ID NO: 24214 - DNA, 601 bp, Human
aggaagttaggcaagattcagagaagagcagaatttttaataaggctgcctgatttaacatcatctcccttttttatttcctctaacacaggctctccaaaaaatgcagtgccccctgtgatccattcacctaatgatcatgtggtctatgagaaagaaccaggtaattacagctatgtctctgaatttcacttagattctcttaattacaaggaataaaatgtcatttaagttaatgcaagaaaatagacgactgttgtagagaaacacatgaattgaaactgaaatgtcagaaaccaargcagctgtggagatcagttacttccctgatcccatgggcaactctagaattttttgcttcactctcggtatctgctcccttctccctctgctagccgtcttcctctgctgatgagtgatttctgtttgatgcaaactttagcttgcacagggctttggtttgccaaggctgcaacatgggcacaagatttagacatccttcaagctcctgctccattatgaaaggtcagtggtggatcttgaaggcaagactgtgaatataatagctaacaactgataaaactagtagacattgacgcag

SEQ ID NO: 24215 - DNA, 601 bp, Human
ttaggcaagattcagagaagagcagaatttttaataaggctgcctgatttaacatcatctcccttttttatttcctctaacacaggctctccaaaaaatgcagtgccccctgtgatccattcacctaatgatcatgtggtctatgagaaagaaccaggtaattacagctatgtctctgaatttcacttagattctcttaattacaaggaataaaatgtcatttaagttaatgcaagaaaatagacgactgttgtagagaaacacatgaattgaaactgaaatgtcagaaaccaaagcagctgtggagatcagttacttccctgatcccatgggcaactctagaattttttgcttcactctcggtatctgctcccttctccctctgctagccgtcttcctctgctgatgagtgatttctgtttgatgcaaactttagcttgcacagggctttggtttgccaaggctgcaacatgggcacaagatttagacatccttcaagctcctgctccattatgaaaggtcagtggtggatcttgaaggcaagactgtgaatataatagctaacaactgataaaactagtagacattgacgcagaacact

SEQ ID NO: 24216 - DNA, 601 bp, Human
caaaaaatgcagtgccccctgtgatccattcacctaatgatcatgtggtctatgagaaagaaccaggtaattacagctatgtctctgaatttcacttagattctcttaattacaaggaataaaatgtcatttaagttaatgcaagaaaatagacgactgttgtagagaaacacatgaattgaaactgaaatgtcagaaaccaaagcagctgtggagatcagttacttccctgatcccatgggcaactctagaattttttgcttcactctcggtatctgctcccttctccctctgctagccrtcttcctctgctgatgagtgatttctgtttgatgcaaactttagcttgcacagggctttggtttgccaaggctgcaacatgggcacaagatttagacatccttcaagctcctgctccattatgaaaggtcagtggtggatcttgaaggcaagactgtgaatataatagctaacaactgataaaactagtagacattgacgcagaacactattgaatgcttactgtggctcttcggttcttcttttagtttccataatttttcattatagccaaaaatcattgataactgaccaaatacgg

SEQ ID NO: 24217 - DNA, 601 bp, Human
tatctcatataacctatagttacatttataattagtaatttttaatattaactaaatacgtttgtgtaatttaaattttattttaaaggtagatgggtagtaatataactcacttttaaaataaaataacattttattcctaaataaacctgattttttaaagcgttggcaaagtggaaagtgtgcgtccttgaagacagaaggttccactgcaaatgaagcataccattaccgaacagcagttggctcactgcaccaattaaaaatttgcagctggtcagctatatgacaaagtaatgtrgctggaggctcacagggagaattattgatcttttttaggaatttttaacactttgtagcccatccttataataataatgaataaataacaaggaaagtcatgttgttccaccttgctgctgttgaaacgtactcagtgttcataggatagcagtggcgttaagcttaagcaaaaccaatcagagcccttaaccaaattctcatacctgacagtaagcctagttaaaaagagaacctagatggcagtcagctgtagcagagagatttttctctgcgataagtaaaggagttcaaaggaatt

SEQ ID NO: 24218 - DNA, 601 bp, Human
taaagcgttggcaaagtggaaagtgtgcgtccttgaagacagaaggttccactgcaaatgaagcataccattaccgaacagcagttggctcactgcaccaattaaaaatttgcagctggtcagctatatgacaaagtaatgtagctggaggctcacagggagaattattgatcttttttaggaatttttaacactttgtagcccatccttataataataatgaataaataacaaggaaagtcatgttgttccaccttgctgctgttgaaacgtactcagtgttcataggatagcagtggcrttaagcttaagcaaaaccaatcagagcccttaaccaaattctcatacctgacagtaagcctagttaaaaagagaacctagatggcagtcagctgtagcagagagatttttctctgcgataagtaaaggagttcaaaggaattttaaattctgatcttggacccaaaacacttgatctctgattcactgagagttggatatatttatttttacaaagtttacgtgttcataacagctttctctttttatatgttaggatttaaccatgagatttcagatttctgaccacagtattctagct

SEQ ID NO: 24219 - DNA, 601 bp, Human
aagtggaaagtgtgcgtccttgaagacagaaggttccactgcaaatgaagcataccattaccgaacagcagttggctcactgcaccaattaaaaatttgcagctggtcagctatatgacaaagtaatgtagctggaggctcacagggagaattattgatcttttttaggaatttttaacactttgtagcccatccttataataataatgaataaataacaaggaaagtcatgttgttccaccttgctgctgttgaaacgtactcagtgttcataggatagcagtggcgttaagcttaagcraaaccaatcagagcccttaaccaaattctcatacctgacagtaagcctagttaaaaagagaacctagatggcagtcagctgtagcagagagatttttctctgcgataagtaaaggagttcaaaggaattttaaattctgatcttggacccaaaacacttgatctctgattcactgagagttggatatatttatttttacaaagtttacgtgttcataacagctttctctttttatatgttaggatttaaccatgagatttcagatttctgaccacagtattctagctgtgttcggaatcc

SEQ ID NO: 24220 - DNA, 601 bp, Human
tgtagctggaggctcacagggagaattattgatcttttttaggaatttttaacactttgtagcccatccttataataataatgaataaataacaaggaaagtcatgttgttccaccttgctgctgttgaaacgtactcagtgttcataggatagcagtggcgttaagcttaagcaaaaccaatcagagcccttaaccaaattctcatacctgacagtaagcctagttaaaaagagaacctagatggcagtcagctgtagcagagagatttttctctgcgataagtaaaggagttcaaaggrattttaaattctgatcttggacccaaaacacttgatctctgattcactgagagttggatatatttatttttacaaagtttacgtgttcataacagctttctctttttatatgttaggatttaaccatgagatttcagatttctgaccacagtattctagctgtgttcggaatccatgctttgggaatcactgaaatgcatcagctattcctatgggataacagtaatacctacatgaatatttattaagcattattctaatattcatgccttagcatattcagtcctcagaattcctgaa

SEQ ID NO: 24221 - DNA, 601 bp, Human
ccaccttgctgctgttgaaacgtactcagtgttcataggatagcagtggcgttaagcttaagcaaaaccaatcagagcccttaaccaaattctcatacctgacagtaagcctagttaaaaagagaacctagatggcagtcagctgtagcagagagatttttctctgcgataagtaaaggagttcaaaggaattttaaattctgatcttggacccaaaacacttgatctctgattcactgagagttggatatatttatttttacaaagtttacgtgttcataacagctttctctttttataygttaggatttaaccatgagatttcagatttctgaccacagtattctagctgtgttcggaatccatgctttgggaatcactgaaatgcatcagctattcctatgggataacagtaatacctacatgaatatttattaagcattattctaatattcatgccttagcatattcagtcctcagaattcctgaataaattaatgcatgtaatgcactgtgtgggcattatgacttccctcttttccaaaagaggaacctgagacctggaaagattagttatctcacccaaagtatatagccagga

SEQ ID NO: 24222 - DNA, 601 bp, Human
tctgatcttggacccaaaacacttgatctctgattcactgagagttggatatatttatttttacaaagtttacgtgttcataacagctttctctttttatatgttaggatttaaccatgagatttcagatttctgaccacagtattctagctgtgttcggaatccatgctttgggaatcactgaaatgcatcagctattcctatgggataacagtaatacctacatgaatatttattaagcattattctaatattcatgccttagcatattcagtcctcagaattcctgaataaattaatrcatgtaatgcactgtgtgggcattatgacttccctcttttccaaaagaggaacctgagacctggaaagattagttatctcacccaaagtatatagccaggaattgacaaatcctggataaaaacccaaaaggacctggccccagaagcttctctctaaactgatacagcatcctggctcagaagtttaagcaaaagagacattttgttttgaagagagatctataaaaagaagccagtattgggatttggtctagacaatgggatagtgtgtagcgtagatggtatagtatagtgttaga

SEQ ID NO: 24223 - DNA, 601 bp, Human
cactgagagttggatatatttatttttacaaagtttacgtgttcataacagctttctctttttatatgttaggatttaaccatgagatttcagatttctgaccacagtattctagctgtgttcggaatccatgctttgggaatcactgaaatgcatcagctattcctatgggataacagtaatacctacatgaatatttattaagcattattctaatattcatgccttagcatattcagtcctcagaattcctgaataaattaatgcatgtaatgcactgtgtgggcattatgacttcccycttttccaaaagaggaacctgagacctggaaagattagttatctcacccaaagtatatagccaggaattgacaaatcctggataaaaacccaaaaggacctggccccagaagcttctctctaaactgatacagcatcctggctcagaagtttaagcaaaagagacattttgttttgaagagagatctataaaaagaagccagtattgggatttggtctagacaatgggatagtgtgtagcgtagatggtatagtatagtgttagaatcttaccattaatactttgtaatcactgcattat

SEQ ID NO: 24224 - DNA, 601 bp, Human
gaagagagatctataaaaagaagccagtattgggatttggtctagacaatgggatagtgtgtagcgtagatggtatagtatagtgttagaatcttaccattaatactttgtaatcactgcattataggtggctcagcttatcaaccttcctcgccctcacctgtagtgggggtctgtggttgcttacttgtctgattcctacacagtccatagctcttgagtcactctcaaatgctttgattttcttctctctatttctagtataagtcatagtagaacagaagatgaaacaagaactcatattttgagcatcaagaaagttacctctgaggatctcaagcgcagctatgtctgtcatgctagaagtgccaaaggcgaagttgccaaagcagccaaggtgaagcagaaaggtaatagatgcggtcagtgatgaatctctcagctccaaattaacattgtggtgaataaggacaaaaggagagattgagaacaagagagctccagcacctagcccgacggcatctaacccatagtaatgaatcaaacttaaatgaaaaatatgaaagttttcatctatgtaagatactcaaaatattgtttc

SEQ ID NO: 24225 - DNA, 601 bp, Human
tcatacataggcaggtgcatagctaagctgcttggcttatccagctatttgccgggatggtgggtcactgtggtcaccacacagaaatcaattctgtttctttgttgttcattccagtgccagctccaagatacacagtggaactggcttgtggttttggagccacagtcctgctagtggtgattctcattgttgtttaccatgtttactggctagagatggtcctattttaccgggctcattttggaacagatgaaaccattttaggtaagtaacagaaatttgacataaacctcttctwctgtcatctttagaacatatgttgtaaaaaaaagaaaaaagaaaacatgttgatttgaaaaacctagattaactggaagatttaagcagattaactttaatttcaaccgttgctattagaaatctttccgaagattattattctattttcttggattaattagtgagtcggtctaaattaacaccctccaaatagaaatataatgcgagccacttacctacttaaaatttcccagtgaccacattagtaaaagtaaaaagaaacaagtaaaaataacgaattgactaaatatatttataa

SEQ ID NO: 24226 - DNA, 601 bp, Human
ccagctccaagatacacagtggaactggcttgtggttttggagccacagtcctgctagtggtgattctcattgttgtttaccatgtttactggctagagatggtcctattttaccgggctcattttggaacagatgaaaccattttaggtaagtaacagaaatttgacataaacctcttctactgtcatctttagaacatatgttgtaaaaaaaagaaaaaagaaaacatgttgatttgaaaaacctagattaactggaagatttaagcagattaactttaatttcaaccgttgctattaraaatctttccgaagattattattctattttcttggattaattagtgagtcggtctaaattaacaccctccaaatagaaatataatgcgagccacttacctacttaaaatttcccagtgaccacattagtaaaagtaaaaagaaacaagtaaaaataacgaattgactaaatatatttataatactattttttagcatgcaattaatattaaaaagctaatgagatattttagtgttttctttggtactaaaaatgttcaaaatgtaaaatgtattctactttatccttatagcacatctc

SEQ ID NO: 24227 - DNA, 601 bp, Human
tgactcgtggctgctgtattggacagtgctgatccacactccttgtactcagatagagatctgtgaaccagcagcaacatatcacgtgtagcttattagaagaagaatcttagacctagcccctactgactcagaatctacatttaaaccatattcccaagtgattcatgtgtacgttaacatctgaaaagcacagctctagtgcaaatttgcttagtgaaaagaatagagcatttaaacatacaaattcataggtccaccccataaagattttaattcagtaggcttatggaagaaacasggaatcgatagtttttaatgagatgtgatttttctaattaagcaacttcgtgaaagattggtccattaaatctaattatatttttaattttagttcttttcagatataaataattcaggcagtttcacaaggttttgctcaatttgtaattttaagatattaatgagtgataggcttggacaggaagttgaaattttctctacagtgttaattgccagtacctatgatttaccttctggctttgttaatttacagttgaatgggacaaacctcactctttttccactgtaaagcaacctg

SEQ ID NO: 24228 - DNA, 601 bp, Human
ctacatttaaaccatattcccaagtgattcatgtgtacgttaacatctgaaaagcacagctctagtgcaaatttgcttagtgaaaagaatagagcatttaaacatacaaattcataggtccaccccataaagattttaattcagtaggcttatggaagaaacacggaatcgatagtttttaatgagatgtgatttttctaattaagcaacttcgtgaaagattggtccattaaatctaattatatttttaattttagttcttttcagatataaataattcaggcagtttcacaaggttttrctcaatttgtaattttaagatattaatgagtgataggcttggacaggaagttgaaattttctctacagtgttaattgccagtacctatgatttaccttctggctttgttaatttacagttgaatgggacaaacctcactctttttccactgtaaagcaacctgtaagatgagagttgaggatatatcagataacattcaaaattacatcttcaaatagtcgttttgcgtggagacttgttgcaagtagaaaatcgcactggaatctgtcacataatgaaaatgtctaatatgcagaagtt

SEQ ID NO: 24229 - DNA, 601 bp, Human
agaatcattagttttgcattatgggagagagtcatggcacagcatctttggatatttaatgtccgatgctctttgatgtaacagactcctctagaaataaaactacgttggaaatgtatactattcaactcagtttatggtattaaaatattttcccttgcaatctttcagagatgcatgtcagaaaagcatggaggcacagtggattagagctctgttaaagggccatagctgtaaacatcctgtttattcacatttagatttttcggtttaggctaatctacactggttggtctagaamtgttttacaagactgagaatttttttttaaagcagttttattttggttttagaaagacagaggtttacttggttttactaaaagtgagtggcggaagagtgtgggtagaatttttccttatgtgattcactgataataattacagtattttcctgtggcatttgctcttttttttccccctcacttttcttttcaagcaaaatagtgctactcaaattccccttttccttgggtctatttcttcttcctgtcagcttatacatttgagggttactttaaaattttataatagccagtgta

SEQ ID NO: 24230 - DNA, 601 bp, Human
atgggagagagtcatggcacagcatctttggatatttaatgtccgatgctctttgatgtaacagactcctctagaaataaaactacgttggaaatgtatactattcaactcagtttatggtattaaaatattttcccttgcaatctttcagagatgcatgtcagaaaagcatggaggcacagtggattagagctctgttaaagggccatagctgtaaacatcctgtttattcacatttagatttttcggtttaggctaatctacactggttggtctagaactgttttacaagactgagaatttttttttaaagcagttttattttggttttagaaagacagaggtttacttggttttactaaaagtgagtggcggaagagtgtgggtagaatttttccttatgtgattcactgataataattacagtattttcctgtggcatttgctcttttttttccccctcacttttcttttcaagcaaaatagtgctactcaaattccccttttccttgggtctatttcttcttcctgtcagcttatacatttgagggttactttaaaattttataatagccagtgtaactagaaggtttaaaaagaa

SEQ ID NO: 24231 - DNA, 601 bp, Human
acatcctgtttattcacatttagatttttcggtttaggctaatctacactggttggtctagaactgttttacaagactgagaatttttttttaaagcagttttattttggttttagaaagacagaggtttacttggttttactaaaagtgagtggcggaagagtgtgggtagaatttttccttatgtgattcactgataataattacagtattttcctgtggcatttgctcttttttttccccctcacttttcttttcaagcaaaatagtgctactcaaattccccttttccttgggtctrtttcttcttcctgtcagcttatacatttgagggttactttaaaattttataatagccagtgtaactagaaggtttaaaaagaaaggaaatgcctaaattcttgaatgtgttaaaataaaagtacaactcctttttagatccgcacagtaacacacaaagtaatttttcattggtgtctttttaataaatatataagttacattcccaaacccactgttaaactttatcctgttgaaatgcttgtaatatatctaatcataagcaagacaaaccaattttactcctctaaaatcctgtcta

SEQ ID NO: 24232 - DNA, 601 bp, Human
tcagtatgagaagtcactgtcaatgaaagttgttttgtttgttttcagtaatattttgctgtttttaagacttggaaaactaagtgcagagtttacagagtggtaaatatctatgttacatgtagattatacatatatatacacacgtgtatatgagatatatatcttatatctccacaaacacaaattatatatatacatatccacacacatacattacatatatctgtgtatataaatccacatgcacatgaaatatatatatatatataatttgtgtgtgtgtatgtgtatgtatatractttaaatagctatgggtacaatattaaaaaccactggaactcttgtccagtttttaaattatgtttttactggaatgtttttgtgtcagtgttttctgtacatattatttgttaattcacagctcacagagtgatagttgtcatagttcttgccttccctaagtttatataaataacttaagtattgctacagtttatctaggttgcagtggcatctgctgtgcacagagcttccatggtcactgctaagcagtagccagccatcgggcattaattgatttcctactatattcccagc

SEQ ID NO: 24233 - DNA, 601 bp, Human
cattctcttgccaatgctgcattccttttgcacttttggattccatatttatcccaaatgctgttgggcacccctagaaataccttgatgttttttctatttatatgcctgcctttggtacttaattttacaaatgctgtaatataaagcatatcaagtttatgtgatacgtatcattgcaagagaatttgtttcaagatttttttttaatgttccagaagatggccaatagagaacattcaagggaaatggggaaacataatttagagaacaagaacaaaccatgtctcaaatttttttwaaaaaaattaatggttttaaatatatgctatagggacgttccatgcccaggttaacaaagaactgtgatatatagagtgtctaattacaaaatcatatacgatttatttaattctcttctgtattgtaacttagatgattcccaaggactctaataaaaaatcacttcattgtatttggaaacaaaaacatcattcattaattacttattttctttccataggttttaatattttgagagtgtcttttttatttcattcatgaacttttgtatttttcatttttcatttgatttgtaaat

SEQ ID NO: 24234 - DNA, 601 bp, Human
tccacaggccctctgatcccaccctgggggtggccaggcaacacccttgttgctgtgtccatctttctcctgctgactggcccgacctacctcctgttcaagctgtcgcccaggtaggtggctgatgtgtgcgtgtgtgtacatgtgtgagcgggcaagagtgtgcatgttagtgtatgtgtgcagatgtgtgactgtgtgcatgtgtgagtgtgtggtgggtgggccatcaagggccgcccttgtctggttcctcccctcccctctccactgcctggtcctggacggggtgggcttttcsagtctccaccctggtccagaagagggttctcaagttgccaggggagagcagggaaggggggtctgaggcagaggctgaagataagggcagcttggtcccgaccagacccagagtcaccgagatcaagagccggaggtcctagtctcctgcctctggaggagcttggtttgttcatttgttcacatgttctacgaaaggacagttggggcatctggtgtgctcaggaccctgttctcagaacaagatggacaagggccctccttaaataaaccgtcacgcctcatgcaccacatgtcaggt

SEQ ID NO: 24235 - DNA, 601 bp, Human
gcccttcctgtccacaggccctctgatcccaccctgggggtggccaggcaacacccttgttgctgtgtccatctttctcctgctgactggcccgacctacctcctgttcaagctgtcgcccaggtaggtggctgatgtgtgcgtgtgtgtacatgtgtgagcgggcaagagtgtgcatgttagtgtatgtgtgcagatgtgtgactgtgtgcatgtgtgagtgtgtggtgggtgggccatcaagggccgcccttgtctggttcctcccctcccctctccactgcctggtcctggacggggygggcttttcgagtctccaccctggtccagaagagggttctcaagttgccaggggagagcagggaaggggggtctgaggcagaggctgaagataagggcagcttggtcccgaccagacccagagtcaccgagatcaagagccggaggtcctagtctcctgcctctggaggagcttggtttgttcatttgttcacatgttctacgaaaggacagttggggcatctggtgtgctcaggaccctgttctcagaacaagatggacaagggccctccttaaataaaccgtcacgcctcatgcacca

SEQ ID NO: 24236 - DNA, 601 bp, Human
cctgggcccttcctgtccacaggccctctgatcccaccctgggggtggccaggcaacacccttgttgctgtgtccatctttctcctgctgactggcccgacctacctcctgttcaagctgtcgcccaggtaggtggctgatgtgtgcgtgtgtgtacatgtgtgagcgggcaagagtgtgcatgttagtgtatgtgtgcagatgtgtgactgtgtgcatgtgtgagtgtgtggtgggtgggccatcaagggccgcccttgtctggttcctcccctcccctctccactgcctggtcctggayggggtgggcttttcgagtctccaccctggtccagaagagggttctcaagttgccaggggagagcagggaaggggggtctgaggcagaggctgaagataagggcagcttggtcccgaccagacccagagtcaccgagatcaagagccggaggtcctagtctcctgcctctggaggagcttggtttgttcatttgttcacatgttctacgaaaggacagttggggcatctggtgtgctcaggaccctgttctcagaacaagatggacaagggccctccttaaataaaccgtcacgcctcatg

SEQ ID NO: 24237 - DNA, 601 bp, Human
ctgtgtctctgtgtgtgcacataagtgtggtgagtgtgcatgtatgtgtttatgtgtacacatatgtaactgtgcacactcatgtttgtgtgcccatgtttgtgtgtttatatgtaagtgtacatatgtgtgtgcctgtgccttgcatttgtgtgagtgtgcacatgggcatgcctatgtgtatgagtgtgtatgtgagtgtggtgagttgcttctgtgcacacacttttgtttatgagtgtgcatgcaagtgtgatgagtgtgaaagtgttcctgtagacatgtttgcctgtgtgtgcayatgtgtatttgtgggcaaacgcagctgtgtctgtgagtgtgagtgtgccttctgtgtgtgtgtgtgcacgtgaatgtggtgagtgtgtctgtgtgttaacacaagtgtgttcaagagtgtgttatatgagcatataatgcatgtgtgtattctcgagggctgagggacccagccccaccttcaccacctgctaactgtccccacccccacagcaggcccagcacagggatcacattgtcggggtgacctggcttatacttgaagcctttgagctggaccctggctttatccatgaggcca

SEQ ID NO: 24238 - DNA, 601 bp, Human
tttgcacagggccctcagcccagtcccttgcaggctggaccttggagagtgaggccctgaggcgagacatgggcacctggctcctggcctgcatctgcatctgcacctgtgtctgcttgggagtctctgtcacaggggaaggacaaggtgagggctgggcactaatgtctgtatgaggtgggtggagaactagggcatgtttgggggactgggttgtccgatgtcaagcctctagggaaaggtttggcccaaactgtgctggggcatgtcctctaggggtcagcctggacctcagtctctmgtctccctacttttacctccctaccttcattccctggaccgactgtagtctcccttccttcactctcttgacgcctctccagatctgacttgcccgtgtaccacaggtcagagcccatcacttcccaggcctcccagtgcttccctggacagattctgggatcatttactggtgactgccctgctagggtgtcagctgtcagatcctccccaacccccgagctcagctctggcctgaagtacttaccgtgggctcctgatggtcactgtctccagggccaaggtctagaaccttcacctg

SEQ ID NO: 24239 - DNA, 601 bp, Human
cccttctggtgttgctcttctttgcaggtgccttggaacaggggtgcaacagagttcagaaagtgccatctgttgcatggataccctgctgccaccctcgtccacctttctggggcagaacagttggatgggtctttatttaagaggacaaaagggagagagaatgcatagaggctgggtctggtggctcacgcctgtaatcccaacactttgggaggccaaggcaggtggatcccttgaggtcaggaggtcaagactagcctggccaacatggtgaaaccccgtctctactaaaaatacaaaaaaaaaaaaattagctgggcatggcgggagatgcctgtaatcccagctactcgggaggctgaggcaggataatcacttgaacccaggaggcggaggttgcagtgagccaagatcacaccactgcactctagcctgggtgacagagggagactgtctcaaaaaaaaaaatttgcttagaatttgtctgtgtgaccctgggcaagtcatttcccctccttgggactcagttccttgcctgtgaacggggacagtgcttctcccttacagagctgttgtgagaattaaagtagaaaatgta

SEQ ID NO: 24240 - DNA, 601 bp, Human
gattcccactgtgctgaaggaagtcctcatgtggtccagagagggagctggcccctgctcccatttccagcaccattttctggcacaggctccatgtccccaggctccagctgcttctggggtaccaaggtctgcatttcttcctcttcccccagcagacagaagaccttgctggacaggtgtccacttcaatagtaacttctgaggctgccagcctcctgaatggtccagaagaaccagacccttccccgcccccattaaaaaagacaaaatatggccaggcatgttggctcatgcctgrcatcccagcactttgggaggccaaagcaggtgaatcacttgaggccaggagtacgagaccagcctgacaaacatggtgaaaccctgtgtctactaaaaatacaaaaattagccaggcgtggtgactcatgcttgtaaatgcttgtaatcccagctacttgggaggctgaagcaggaggatcacttgaactcgggaggcagaggttgcagtgagccgagatcacgccactgtgttccagcctgagcgacagagcgagactccgtctaaaaaaaaaaaatatatatatatatacacacatat

SEQ ID NO: 24241 - DNA, 601 bp, Human
gctgtgcagaaggagagttgcctgtgctcaggctcaggggttccgtccagctaaggaggcctactaggggactggggaaaggcctcatgaaggaccaggcctgtgatggggagggaagatggcagaggggacagtgggaagcagagcagcaggggtctcctccacgcctctctgtacttctcccacccacccttgcctgctcccctctgccctgggtatgtgcccttgtccacccaacacctctgcagtgccaagtccagccctgacttcttcctgagctgtggcccagcgttcccacagrcatttacctcacggatgcagcactgcccctcatcctcttctctgaaagtgtgtgggaaatgcttcttggtgccatctctctcccaccctgccttccctgcaccttctctatgaggtgtctgttgtctctgtacttgcctccagctggcctttcagaccccatccctcctgcctcctgcccatccctacccctgtcagcaccttacatactctgtgcccaacagcattggggattcccactgtgctgaaggaagtcctcatgtggtccagagagggagctggcccctgctcccatttccag

SEQ ID NO: 24242 - DNA, 601 bp, Human
gggtacccacaacatgaacaccgtccagaagcaagggcagcctctgcaggtggggcgggggttggaaaacatttatcaaacggttgagttgggtgcaggggatgcaacatgatcaaacagggtcttgcctccaggagcctcatgtagggacaacgcacagtgatgaccttcaactgcagtggggcagcaaggctgtgggaggggtgttttgggcagagcaggcgacgtgggtacctcttcaccaagacagcaggaagagcacggacatcattttcccgtctcacctccagactcccagggractgtgccaatatcctcactccagccctggcccatggccactgctcaacccttgggccctgtcagttcagggctgtgcagaaggagagttgcctgtgctcaggctcaggggttccgtccagctaaggaggcctactaggggactggggaaaggcctcatgaaggaccaggcctgtgatggggagggaagatggcagaggggacagtgggaagcagagcagcaggggtctcctccacgcctctctgtacttctcccacccacccttgcctgctcccctctgccctgggtatgtgcccttgt

SEQ ID NO: 24243 - DNA, 601 bp, Human
gagctctgtgtgtttcctgggagggctgagaggtgccatcccccatagcagcccaaggcacagtagttgttgttgttgctgctgctgctgctgctgctgctgctcctgctgccctctgagtctgggggagccggcctagtcagggacgtgggggcccagtcctcctgtggcagataggcaagcgtctgtaccctccactccgtacaccctgctggcagcacatcctctgagctcaggttccccgggagcctggtcccagggccctcctgttcctcctccagggccacagatttccaaggaygcgctgggccacaagtgagcagtgcagtggcctcctggacgcagggctccaaggctccctgtggggtgccagcacagtcctggctcaacagcacaccggccccgtgggcccccatccaagtctggaacagagcacgggaggagggaaaggctcaggcagcatgtttagaactcatcctgggagcagctgcctcctttctggcaagcccagcatccctcctcctccaggaagccctcctgaggtccacacccagaggccaagcagcgcctgtgtcttggacattctgtctttcctccatgt

SEQ ID NO: 24244 - DNA, 601 bp, Human
caagttacttaatctctctggcctcagtttccaacatctgtaaaatgggatacagacagtctctacttcatatggctcttgtgagaattaagtgagacagtgcactcaataaacattaactattattattatacaattaaagatagtaatcgccaacattatgatgttggcttcagtgataaaaatctgagggtctttcaggtacagccaacggtcagaatgcacatttactgagtgtgagatactagaaggatgggcagaactccttattttaccattaactattctattagtctactawtaatttttactgatcattgggataataaaaagtatctcttgaatcatgaaagatattttaaacaaccaaaatagtaatactagctgacatttactttcactttactatctgtcgagttgtattctgcattcattaacccactaaataacccacgtggtaggcatccactttgtaacatccagtttacagttgaggaaattcaggattagaggtgacccagcttaaagtcacataaccagtcattgacagacctaggacttgaacccaagtcaatgtgagtctgaatcctatgcttcctcc

SEQ ID NO: 24245 - DNA, 601 bp, Human
agaatataaagttttcactttacatcaattggattataaggactgaatggataacaaaaataagaggtcaaaagcatttggggtccaactctggggaaatgattagctgtgctgatgtaaaaccatgtggcacttttggctttttcttggttttttttttgtccccctgacacctgaagagcatggttactttcctgtcccaactgaggctcggaagccctagaagatgtttgctcaacagcagggaaaacagctgcaggaggaaagctgaagaggagcatcaagaacctggcacttagcytcactgcatcgtctgccctcctaagtcacacctcggagagtttctcacactgattttctggaatttctgtggtttaccaaatcagaagtcactaaggggtcaaatatgccaggaccaaggttcctgagctcgctaacaatcccagggttggaagggatctgccatatacccctggctcaggcctttgcctttacttaagagagtgtctaaatctctcaaattctcatggagaaggggtggctggattctgtcttcctaaaattcttgagaagagaggagtggtcccagatttctttcagg

SEQ ID NO: 24246 - DNA, 601 bp, Human
atttcattatcatgagcctcagtttcctcatctgtaaaatgataataataacagtatctgccttacatttgactgaggattaaatgaaaaaaaaaaaaagcacgtaaagtacttagcacagtgtctgccacacagtaaattcggtgttagttatcgttacttatagactgaggagtcagccaactgtacagagaaactctcttaacaattttccatggatatttaaggatttcgttccctctgttttaaatcaccagtggagattttcattctctctgcattattattattattattattatttttagctatcttacactcttatgaagcagtccagtagagcttagtcttcccatttaatgaagaagcgtactgaggccaacgatctaagcatggtcacagcaagtcagaagtacaagggctacagctcagaccttttgtctcttgggctttgcaagggatgcctaatgctagtgtctaaactggcctttgaggaatggcttagtatagtatttcagagtgtgtcatagcaaagcttcattcatttttttaatccatgcataaattattaattgaatagaattgtttaatgtagtagttc

SEQ ID NO: 24247 - DNA, 601 bp, Human
cagcacaatttcagtttcatagagaatacggcagggcacaatattcagcagagtaacatagtggttaaaagctcagggtgtcgagaacaacgaaccaagactgtcatcctgtctccactaaccagctgggggatttggaacaaggtatttcattatcatgagcctcagtttcctcatctgtaaaatgataataataacagtatctgccttacatttgactgaggattaaatgaaaaaaaaaaaaagcacgtaaagtacttagcacagtgtctgccacacagtaaattcggtgttagttatygttacttatagactgaggagtcagccaactgtacagagaaactctcttaacaattttccatggatatttaaggatttcgttccctctgttttaaatcaccagtggagattttcattctctctgcattattattattattattattatttttagctatcttacactcttatgaagcagtccagtagagcttagtcttcccatttaatgaagaagcgtactgaggccaacgatctaagcatggtcacagcaagtcagaagtacaagggctacagctcagaccttttgtctcttgggctttgc

SEQ ID NO: 24248 - DNA, 601 bp, Human
caaaaactgcaaacagcacaagactctttgccaaaggtctgggggagagaaacttccagcacaatttcagtttcatagagaatacggcagggcacaatattcagcagagtaacatagtggttaaaagctcagggtgtcgagaacaacgaaccaagactgtcatcctgtctccactaaccagctgggggatttggaacaaggtatttcattatcatgagcctcagtttcctcatctgtaaaatgataataataacagtatctgccttacatttgactgaggattaaatgaaaaaaaaaaaaagcacgtaaagtacttagcacagtgtctgccacacagtaaattcggtgttagttatcgttacttatagactgaggagtcagccaactgtacagagaaactctcttaacaattttccatggatatttaaggatttcgttccctctgttttaaatcaccagtggagattttcattctctctgcattattattattattattattatttttagctatcttacactcttatgaagcagtccagtagagcttagtcttcccatttaatgaagaagcgtactgaggccaacgatctaagcatggtca

SEQ ID NO: 24249 - DNA, 601 bp, Human
ggaatgcacataaagtggagaaccaggctgtaagctccaggaactctgggactgtgttttattaacccttcgggcatccccattgcctaaacacaaccttgtttacaacaagtatttggcaaatgcttgctgagatgatctcaaggcatgagaccctgcttgggctcaaggtcatggaaaagagaaacaaagagttttatagctgccatcgactcattgactggaaggctgcctttaatagtaacctttgattatttagcagattggaaacaccttaatataccaaaaactgcaaacagcmcaagactctttgccaaaggtctgggggagagaaacttccagcacaatttcagtttcatagagaatacggcagggcacaatattcagcagagtaacatagtggttaaaagctcagggtgtcgagaacaacgaaccaagactgtcatcctgtctccactaaccagctgggggatttggaacaaggtatttcattatcatgagcctcagtttcctcatctgtaaaatgataataataacagtatctgccttacatttgactgaggattaaatgaaaaaaaaaaaaagcacgtaaagtacttag

SEQ ID NO: 24250 - DNA, 601 bp, Human
gctctggtccaaggtccaggtgataccatcttcttcaggggtgtcacaggtgaggaccaccatttctccaggggcatccggataccaatccaattctacgacataaactggaatgcacataaagtggagaaccaggctgtaagctccaggaactctgggactgtgttttattaacccttcgggcatccccattgcctaaacacaaccttgtttacaacaagtatttggcaaatgcttgctgagatgatctcaaggcatgagaccctgcttgggctcaaggtcatggaaaagagaaacaaacagttttatagctgccatcgactcattgactggaaggctgcctttaatagtaacctttgattatttagcagattggaaacaccttaatataccaaaaactgcaaacagcacaagactctttgccaaaggtctgggggagagaaacttccagcacaatttcagtttcatagagaatacggcagggcacaatattcagcagagtaacatagtggttaaaagctcagggtgtcgagaacaacgaaccaagactgtcatcctgtctccactaaccagctgggggatttggaacaaggtatttcat

SEQ ID NO: 24251 - DNA, 601 bp, Human
cagagcctaagacctcactgctctggtccaaggtccaggtgataccatcttcttcaggggtgtcacaggtgaggaccaccatttctccaggggcatccggataccaatccaattctacgacataaactggaatgcacataaagtggagaaccaggctgtaagctccaggaactctgggactgtgttttattaacccttcgggcatccccattgcctaaacacaaccttgtttacaacaagtatttggcaaatgcttgctgagatgatctcaaggcatgagaccctgcttgggctcaaggtcatggaaaagagaaacaaagagttttatagctgccatcgactcattgactggaaggctgcctttaatagtaacctttgattatttagcagattggaaacaccttaatataccaaaaactgcaaacagcacaagactctttgccaaaggtctgggggagagaaacttccagcacaatttcagtttcatagagaatacggcagggcacaatattcagcagagtaacatagtggttaaaagctcagggtgtcgagaacaacgaaccaagactgtcatcctgtctccactaaccagctgggggat

SEQ ID NO: 24252 - DNA, 601 bp, Human
acctggggtttgcttcggtgatgattaaagtaagccacatgggggttaacacataggtcttgtatttatggaagttgctttcttacggaaagtccaggtgcattggaccaacagcgaacttcagattagtggtgtcagcagaagtaaaaggagttgaggtggccctgggaaaatttcgggaggcctcatcgagttttggagtctgcttcagggcccctaagatctacgccctggagctcttgtttttatttttgactcaaggtgcaatttcagcaagtcatttgtagctttgaattctccktttatccctttctttggtgctatgaggcttcaggaagcatggccaggcaatttggatgagtgggttcaaacacagcagagactattctcagttcccaataatatcctgccccaacacatacatttattcaagcaatcggctaaaatctccatgttctttcttcaatgtagacaaggaagggcggttgaaaaaacacgggtttgactttgcttttcccattatcattaactgataggtcactgagaggttgcccttaatttcttaatgaaatagttctagaaaaatgctgagaaaccagag

SEQ ID NO: 24253 - DNA, 601 bp, Human
gacaaatagtatctttccttatggagcacatataatcatccaaaactcactgatgtccctgatgaagaagctgctggtgtagttttcatacttgagcttgtgaacggcatccaccatgacctcaatgggcagactctcctcagcagctgggcaggcactgtcctcctggcactccactgagtactcatactccttgttgtcccctctgactctctctgcagagagtgtagcagctccgcacgtcaccccttgggggtcagaagagctgaagtcaaagacagaaattagcctgtgttacacmttggggagagagttcctagtgattgtagccagtaaggcaggtaaggcctcaactgttgtctgaggacacagtttctccaactgggctgatttctacccagagggtaagaaactgccctccccaggagaaaaagcttaaattcaagagcacttacatgtctctggactaaatgaatatggaagtttttgtttgttttagatctagaatctctgattattaaacccccttgttaaaaacttaaattcattttttcccattttaattataaaatcaatacacaaatcagtacacactaattat

SEQ ID NO: 24254 - DNA, 601 bp, Human
tagcaagtctttagcacataggaagcactcaatatcacctattagtcatacagatcttaaatagggaaagtacttgccaagatgtaaaataatatttaggtaaatatctattccaggatagcctccctacctaattattttcccagagagtaactagctcactgaatttctaccacatgctaaatgctatgctgaattagggctttgtccagtgattttaaaagtggggtgaaaggagtctggggcggtacaaaagggcctctggaaccttgcaacaggcaaaggaattctgctgtaaggygaggaagctgggaagccaatatcttagcctctataagtgtagacattctgtttagtaaaataattttataatatctggaacagccaggagctatccattttgggggcgatatctcttgcctgttctatcattcattacatgcactcagttgaaacaacaattttaggcttctggagcccaggtctcctctatcaggactaattctgagtgccaagatcaatgaccaacatcagaggtagtggagtggttaggtgcatggcctttctgtctggcagattgagtttatgtcttggttatgtc

SEQ ID NO: 24255 - DNA, 601 bp, Human
ggcccagctttcatctttctagcacaattgccttgcctcaagaccccatggccactcacccagtcctgagctgatggtgagagagagacagatttgctctagccatccctgagatattgagaaataccatatcctgatcatttcatcagaaaacttgccttcaaattctggcactgctacttaatagctgtgtaacttcaggaaaatgtcttaggttctctgtgtctgtttcctcacttataaatagggataacaataatgcctacttcatagaattatagttcaaggtaaaaatcacgtyaaactcttagcaagtctttagcacataggaagcactcaatatcacctattagtcatacagatcttaaatagggaaagtacttgccaagatgtaaaataatatttaggtaaatatctattccaggatagcctccctacctaattattttcccagagagtaactagctcactgaatttctaccacatgctaaatgctatgctgaattagggctttgtccagtgattttaaaagtggggtgaaaggagtctggggcggtacaaaagggcctctggaaccttgcaacaggcaaaggaattctgc

SEQ ID NO: 24256 - DNA, 601 bp, Human
cagacaaacgttaaataacagtaatatactaataaatacataaattacttaaatatttaaatagcatgaaggcccatggcaacttgagagctggaaaatctatacataaattagctgattgtttcaatgagcatttagcatctaactatacaaatacagcaaagatatcattgtgatcctaaaaaaacgttttaaagcaaatcagatagaaattatctttttgggtctattccgttgtgtctttaaacattttgcttaatatcttccacttttcctccaaattttcatcctggatcagaayctggaagagaatgccaaaagttgatgtggggtgacattgtaacagcaatgtctcttcttatttctcacaacatatgatcctgggcaactgggtttcagggatttcatgccagaaggcccaggccttccttatgtggcctggaatttggctggcaccatgcttgccagaggctttcttgagggttttcttaaaataatatctgattgtgttacttccttgctgaaaacccttcagtgggtttcagggcccggggcccccagaacaagattctgagtcctgcaagcttgcaagtcctccatg

SEQ ID NO: 24257 - DNA, 601 bp, Human
agaacactgcattcttcctgattgtcataaaactgatgtacttgcagccttgcttgaaaagttgtcagtacaaataaaattaaattcacattttgcataatagggactgatcctgatggatcaggtcataagagtatgaaacattccatacatcctggcagacaaacgttaaataacagtaatatactaataaatacataaattacttaaatatttaaatagcatgaaggcccatggcaacttgagagctggaaaatctatacataaattagctgattgtttcaatgagcatttagcatckaactatacaaatacagcaaagatatcattgtgatcctaaaaaaacgttttaaagcaaatcagatagaaattatctttttgggtctattccgttgtgtctttaaacattttgcttaatatcttccacttttcctccaaattttcatcctggatcagaacctggaagagaatgccaaaagttgatgtggggtgacattgtaacagcaatgtctcttcttatttctcacaacatatgatcctgggcaactgggtttcagggatttcatgccagaaggcccaggccttccttatgtggcctgga

SEQ ID NO: 24258 - DNA, 601 bp, Human
gtcaggtttccatgtaagtatctcttgcgttcccatccatcacaagtgtatgatggcactggtatcagaacactgcattcttcctgattgtcataaaactgatgtacttgcagccttgcttgaaaagttgtcagtacaaataaaattaaattcacattttgcataatagggactgatcctgatggatcaggtcataagagtatgaaacattccatacatcctggcagacaaacgttaaataacagtaatatactaataaatacataaattacttaaatatttaaatagcatgaaggcccakggcaacttgagagctggaaaatctatacataaattagctgattgtttcaatgagcatttagcatctaactatacaaatacagcaaagatatcattgtgatcctaaaaaaacgttttaaagcaaatcagatagaaattatctttttgggtctattccgttgtgtctttaaacattttgcttaatatcttccacttttcctccaaattttcatcctggatcagaacctggaagagaatgccaaaagttgatgtggggtgacattgtaacagcaatgtctcttcttatttctcacaacatatg

SEQ ID NO: 24259 - DNA, 601 bp, Human
acctcagccttccccttgcccagggctcagcctggtgggcctcctctgtccagggccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctrgcacttggagccaagggttcagagactcagggccccagcactaaagcagtggaccccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttcctcgtatttaaatattaaatatgttagcaaagagttaatatatagaagggtaccttgaacactgggggaggggacattg

SEQ ID NO: 24260 - DNA, 601 bp, Human
ccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctggcacttggagccaagggttcagagactcagggccccagcactaaagcagtggacmccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttcctcgtatttaaatattaaatatgttagcaaagagttaatatatagaagggtaccttgaacactgggggaggggacattgaacaagttgtttcattgactatcaaactgaagccagaaataaagttggtgacaga

SEQ ID NO: 24261 - DNA, 601 bp, Human
ggtcttatttattattgtgtgttatttaaatgagtgtgtttgtcaccgttggggattggggaagactgtggctgctggcacttggagccaagggttcagagactcagggccccagcactaaagcagtggaccccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttcctygtatttaaatattaaatatgttagcaaagagttaatatatagaagggtaccttgaacactgggggaggggacattgaacaagttgtttcattgactatcaaactgaagccagaaataaagttggtgacagataggcctgattgtatttgtctttcattttggcctttggggacactggtctgtggtctgaagactctgaggagctcttcgggaggctggtgggttggaggaggggactgggatggattacagcgagggtagggtgcagtgacctgggctgaatgcaagctagctcccgag

SEQ ID NO: 24262 - DNA, 601 bp, Human
agtctaaggtcttactgttattatatcacttatggttaacagtaaagatttctgagtcagaccgttcaagttcaaatcttggcttcatcactttttgtgtgatcttatgatctacctctcagtgcctctgtttacttatctgaaaatgatgacattagtaagatctaacccacaggactactgcgaggattaaatgacacaatgtaaataacatacttagcaggtgccaggcacacagggagtgttcagtaagcattagctattattatgaatactatcattgctactaagtctataggggctatgttgccccaagtgcaccagctataggcttcttgggccagagtgactggtgcaagattaactcgtttgtcctctgctaagccaggcacgtttctgcccagcagcatccacttctcagtcttctatttgttcgattggagccctgcagagtgctgtgtatgtttgtaagggtctcgcttagaggagagcagaactccagctctgcagatgctggaaagtcttgctgctggaaactggaagtgccttcaggtgggtgccctacctcaagaagggaagaaggcaggagtcatgcaagtga

SEQ ID NO: 24263 - DNA, 601 bp, Human
ctgtgtaaccctggcattgtcactgtatctctttgcccctcagttttctcttctcggaaatgagaaaacatatccaacaaaattttgaggattaaaaaccagaggatgtgtagggacacagtgacaaatatgaagtctaaggtcttactgttattatatcacttatggttaacagtaaagatttctgagtcagaccgttcaagttcaaatcttggcttcatcactttttgtgtgatcttatgatctacctctcagtgcctctgtttacttatctgaaaatgatgacattagtaagatctamcccacaggactactgcgaggattaaatgacacaatgtaaataacatacttagcaggtgccaggcacacagggagtgttcagtaagcattagctattattatgaatactatcattgctactaagtctatagggtctatgttgccccaagtgcaccagctataggcttcttgggccagagtgactggtgcaagattaactcgtttgtcctctgctaagccaggcacgtttctgcccagcagcatccacttctcagtcttctatttgttcgattggagccctgcagagtgctgtgtatgtttg

SEQ ID NO: 24264 - DNA, 601 bp, Human
acagactttggggctgagtctgagacccaggcctgcccagccagacaggtctgagaaaaggctgacttccccttttttcccctgacatctggcttggacacccatcttgaggctggcttaaacagaccactctggatctctcaggagggacacctagtttggatgagctgcagcattattagctcacaaagacctccctctgcctgttacacatgtgctaggacccacacagggcaccctcccccaaagccctggttttgaagctctgggatgtttctctctggcttgtaagcacccacawggaagtaagaacttcttccattagaaaggactcctcaggacacctgggagcatgggctcttacacagggggtcctggtcataccactgagggagctctgggctagacttggatggtgaacactgtgtaaccctggcattgtcactgtatctctttgcccctcagttttctcttctcggaaatgagaaaacatatccaacaaaattttgaggattaaaaaccagaggatgtgtagggacacagtgacaaatatgaagtctaaggtcttactgttattatatcacttatggttaacagtaaa

SEQ ID NO: 24265 - DNA, 601 bp, Human
ccagctccggaacaaacaggcatccttgttgatgtcccagccatgcttggcagcatgcttccatgggatctggaagatcatctcctcctgaacaatacacacatacacataaggctgtgtcaggtcagagaccacagactttggggctgagtctgagacccaggcctgcccagccagacaggtctgagaaaaggctgacttccccttttttcccctgacatctggcttggacacccatcttgaggctggcttaaacagaccactctggatctctcaggagggacacctagtttggatgagytgcagcattattagctcacaaagacctccctctgcctgttacacatgtgctaggacccacacagggcaccctcccccaaagccctggttttgaagctctgggatgtttctctctggcttgtaagcacccacatggaagtaagaacttcttccattagaaaggactcctcaggacacctgggagcatgggctcttacacagggggtcctggtcataccactgagggagctctgggctagacttggatggtgaacactgtgtaaccctggcattgtcactgtatctctttgcccctcagttt

SEQ ID NO: 24266 - DNA, 601 bp, Human
tggcccagctccggaacaaacaggcatccttgttgatgtcccagccatgcttggcagcatgcttccatgggatctggaagatcatctcctcctgaacaatacacacatacacataaggctgtgtcaggtcagagaccacagactttggggctgagtctgagacccaggcctgcccagccagacaggtctgagaaaaggctgacttccccttttttcccctgacatctggcttggacacccatcttgaggctggcttaaacagaccactctggatctctcaggagggacacctagtttggaygagctgcagcattattagctcacaaagacctccctctgcctgttacacatgtgctaggacccacacagggcaccctcccccaaagccctggttttgaagctctgggatgtttctctctggcttgtaagcacccacatggaagtaagaacttcttccattagaaaggactcctcaggacacctgggagcatgggctcttacacagggggtcctggtcataccactgagggagctctgggctagacttggatggtgaacactgtgtaaccctggcattgtcactgtatctctttgcccctca

SEQ ID NO: 24267 - DNA, 601 bp, Human
agtgcctcctcttgtctctaccctgggcttcctaggcctgagtcccaggcacacacctgtgtgaatggcccagctccggaacaaacaggcatccttgttgatgtcccagccatgcttggcagcatgcttccatgggatctggaagatcatctcctcctgaacaatacacacatacacataaggctgtgtcaggtcagagaccacagactttggggctgagtctgagacccaggcctgcccagccagacaggtctgagaaaaggctgacttccccttttttcccctgacatctggcttggatacccatcttgaggctggcttaaacagaccactctggatctctcaggagggacacctagtttggatgagctgcagcattattagctcacaaagacctccctctgcctgttacacatgtgctaggacccacacagggcaccctcccccaaagccctggttttgaagctctgggatgtttctctctggcttgtaagcacccacatggaagtaagaacttcttccattagaaaggactcctcaggacacctgggagcatgggctcttacacagggggtcctggtcataccactgagggagctct

SEQ ID NO: 24268 - DNA, 601 bp, Human
cctgaaggaggaaggcaaggtacccctgacctcttatgctaccagagagccacagtggtcaaaccagcaggtactcccggtgacactctgcaggtcctaggccctgggccttctcaaatgcccaggcttggcttaaacacatctagcgggcctcagtgaagggcccagccagaagcactagagtccccatatccccaaagtgtactatctgtgtctcagactatgcccagtcttcctccttgggctatcagcagccagagggtagagtgggcacagactgggcagcagagaacagttactraatgggtgggctgactgttctgagatgggcctagagctccatctctcaaggataaaggaggccaccaaccacatgaggcttggaccaagggccttggtcaacacgaagaaaaaggcagacctgggtctctttcagtgccctggcttacagctgcttttcacagatgcttttgccagggagaactttcatctagccacaaaccccctgaagccacacactttctaagatcttggcttttccctttgagaatttgctgagatgatcgactctcttctccagaaacacaagtctgccaccagc

SEQ ID NO: 24269 - DNA, 601 bp, Human
aggccccaggagcaccaaccttcagaggtggagggcatgggtgacacctggaagttgtacagatcactggtgctgtccggcacaacttccactgggatgtgccagtcggggagagtgctgctgacagcacatggcgacagtgctggggaacagcagaagccacaggtcaaggttgtgtgctttcttagtttgcaagacatcgagcgccctccgaccaaccctgcagcctgcactaatgggccaccatgtgccagcaccatgcctccaagagaaagagtcatcccactgacctgtggggtcycctgccagacctggaccagctcacctggagtcagggcctgctccacctccaagtcctgcatgtagcctggaactgtgtagctgctgtggtcatcaggcagagtggagctgctgagtccatcagagaaggtatcagggctggaatccccacatgactgtcgagggagaaagcagcttaggcccaggcccaccttagcatttcttccactgctcaccctggcccacaggtgaccaaaggcctggctgcttaggaccacactcaccttcctcttggccttgctcttagcatctcggctggact

SEQ ID NO: 24270 - DNA, 601 bp, Human
actcaatcaattcagtgccaggtggagttctgatcatcttttctctctcaggaagcccttcacaggacccagacagtcaagcaggcaggccaggccccaggagcaccaaccttcagaggtggagggcatgggtgacacctggaagttgtacagatcactggtgctgtccggcacaacttccactgggatgtgccagtcggggagagtgctgctgacagcacatggcgacagtgctggggaacagcagaagccacaggtcaaggttgtgtgctttcttagtttgcaagacatcgagcgcccyccgaccaaccctgcagcctgcactaatgggccaccatgtgccagcaccatgcctccaagagaaagagtcatcccactgacctgtggggtctcctgccagacctggaccagctcacctggagtcagggcctgctccacctccaagtcctgcatgtagcctggaactgtgtagctgctgtggtcatcaggcagagtggagctgctgagtccatcagagaaggtatcagggctggaatccccacatgactgtcgagggagaaagcagcttaggcccaggcccaccttagcatttcttccactg

SEQ ID NO: 24271 - DNA, 601 bp, Human
gcagcccactctgaactgccttcctagtgtccccgtcgcttgcctccccctatggtggctaagactgggcaatgcccaactcaatcaattcagtgccaggtggagttctgatcatcttttctctctcaggaagcccttcacaggacccagacagtcaagcaggcaggccaggccccaggagcaccaaccttcagaggtggagggcatgggtgacacctggaagttgtacagatcactggtgctgtccggcacaacttccactgggatgtgccagtcggggagagtgctgctgacagcacayggcgacagtgctggggaacagcagaagccacaggtcaaggttgtgtgctttcttagtttgcaagacatcgagcgccctccgaccaaccctgcagcctgcactaatgggccaccatgtgccagcaccatgcctccaagagaaagagtcatcccactgacctgtggggtctcctgccagacctggaccagctcacctggagtcagggcctgctccacctccaagtcctgcatgtagcctggaactgtgtagctgctgtggtcatcaggcagagtggagctgctgagtccatcagagaaggta

SEQ ID NO: 24272 - DNA, 601 bp, Human
tagagattccagaacaggaccctggcctggtgactcagcctctcaaaccctgaagccacgccgcttcccacccctaccctacttccttcctcaccctcagatgctgggctacagaggaggaaggagaaccagcaccccaaaatgcagcccctggcccccttccctcctctcaccagcccccactgtactgcagcccactctgaactgccttcctagtgtccccgtcgcttgcctccccctatggtggctaagactgggcaatgcccaactcaatcaattcagtgccaggtggagttctgakcatcttttctctctcaggaagcccttcacaggacccagacagtcaagcaggcaggccaggccccaggagcaccaaccttcagaggtggagggcatgggtgacacctggaagttgtacagatcactggtgctgtccggcacaacttccactgggatgtgccagtcggggagagtgctgctgacagcacatggcgacagtgctggggaacagcagaagccacaggtcaaggttgtgtgctttcttagtttgcaagacatcgagcgccctccgaccaaccctgcagcctgcactaatgggcca

SEQ ID NO: 24273 - DNA, 601 bp, Human
cccctgccctttctctgtctctctgtctctctgacacacacacacacacacacaccctcccggtggacctatctgccatagagattccagaacaggaccctggcctggtgactcagcctctcaaaccctgaagccacgccgcttcccacccctaccctacttccttcctcaccctcagatgctgggctacagaggaggaaggagaaccagcaccccaaaatgcagcccctggcccccttccctcctctcaccagcccccactgtactgcagcccactctgaactgccttcctagtgtcccygtcgcttgcctccccctatggtggctaagactgggcaatgcccaactcaatcaattcagtgccaggtggagttctgatcatcttttctctctcaggaagcccttcacaggacccagacagtcaagcaggcaggccaggccccaggagcaccaaccttcagaggtggagggcatgggtgacacctggaagttgtacagatcactggtgctgtccggcacaacttccactgggatgtgccagtcggggagagtgctgctgacagcacatggcgacagtgctggggaacagcagaagccacag

SEQ ID NO: 24274 - DNA, 601 bp, Human
tggcagtcagccacactcaccctgcagttccagttccagcccaccagatccccctgccctttctctgtctctctgtctctctgacacacacacacacacacacaccctcccggtggacctatctgccatagagattccagaacaggaccctggcctggtgactcagcctctcaaaccctgaagccacgccgcttcccacccctaccctacttccttcctcaccctcagatgctgggctacagaggaggaaggagaaccagcaccccaaaatgcagcccctggcccccttccctcctctcamcagcccccactgtactgcagcccactctgaactgccttcctagtgtccccgtcgcttgcctccccctatggtggctaagactgggcaatgcccaactcaatcaattcagtgccaggtggagttctgatcatcttttctctctcaggaagcccttcacaggacccagacagtcaagcaggcaggccaggccccaggagcaccaaccttcagaggtggagggcatgggtgacacctggaagttgtacagatcactggtgctgtccggcacaacttccactgggatgtgccagtcggggagag

SEQ ID NO: 24275 - DNA, 601 bp, Human
aagcagccaggtgacaacagcagctacccatcctctgatttggaagcttcactggttctctctcctcactgagaaacggtcacttcaagagtgcccaggtaggaaggggctttaccttcatgatgtcctcaggtaatttcccttcctcatcctcatctgttgtagctgtggatggggaaagcagagaggttggctggcagtcagccacactcaccctgcagttccagttccagcccaccagatccccctgccctttctctgtctctctgtctctctgacacacacacacacacacacaccctcccggtggacctatctgccatagagattccagaacaggaccctggcctggtgactcagcctctcaaaccctgaagccacgccgcttcccacccctaccctacttccttcctcaccctcagatgctgggctacagaggaggaaggagaaccagcaccccaaaatgcagcccctggcccccttccctcctctcaccagcccccactgtactgcagcccactctgaactgccttcctagtgtccccgtcgcttgcctccccctatggtggctaagactgggcaatgcccaactcaatcaatt

SEQ ID NO: 24276 - DNA, 601 bp, Human
gcaagcagccaggtgacaacagcagctacccatcctctgatttggaagcttcactggttctctctcctcactgagaaacggtcacttcaagagtgcccaggtaggaaggggctttaccttcatgatgtcctcaggtaatttcccttcctcatcctcatctgttgtagctgtggatggggaaagcagagaggttggctggcagtcagccacactcaccctgcagttccagttccagcccaccagatccccctgccctttctctgtctctctgtctctctgacacacacacacacacacacaacctcccggtggacctatctgccatagagattccagaacaggaccctggcctggtgactcagcctctcaaaccctgaagccacgccgcttcccacccctaccctacttccttcctcaccctcagatgctgggctacagaggaggaaggagaaccagcaccccaaaatgcagcccctggcccccttccctcctctcaccagcccccactgtactgcagcccactctgaactgccttcctagtgtccccgtcgcttgcctccccctatggtggctaagactgggcaatgcccaactcaatcaa

SEQ ID NO: 24277 - DNA, 601 bp, Human
acctggaggataatttgctaactttttctataaagccatcatcatattaacggatcctaaaggctgattattgaagcctgatgtgcatttcccgaactagcagggctggggcatgttggggcagaggatgcaggccagggacccatcgctgatagtgcctgactcacagagctgtctgatgccccaaggcttgcttcaggacggcctgtcagaggccaggcctcccacctgccttcccttcccatggtggctttcccaccagtcaagccacgtgaatgtggcacttgtgggacaatgcaarcagccaggtgacaacagcagctacccatcctctgatttggaagcttcactggttctctctcctcactgagaaacggtcacttcaagagtgcccaggtaggaaggggctttaccttcatgatgtcctcaggtaatttcccttcctcatcctcatctgttgtagctgtggatggggaaagcagagaggttggctggcagtcagccacactcaccctgcagttccagttccagcccaccagatccccctgccctttctctgtctctctgtctctctgacacacacacacacacacacaccctc

SEQ ID NO: 24278 - DNA, 601 bp, Human
gccactgcccccggctgcaaaaactatattcactttcaaaactgaagcagaaaaaaaaacctggaggataatttgctaactttttctataaagccatcatcatattaacggatcctaaaggctgattattgaagcctgatgtgcatttcccgaactagcagggctggggcatgttggggcagaggatgcaggccagggacccatcgctgatagtgcctgactcacagagctgtctgatgccccaaggcttgcttcaggacggcctgtcagaggccaggcctcccacctgccttcccttccyatggtggctttcccaccagtcaagccacgtgaatgtggcacttgtgggacaatgcaagcagccaggtgacaacagcagctacccatcctctgatttggaagcttcactggttctctctcctcactgagaaacggtcacttcaagagtgcccaggtaggaaggggctttaccttcatgatgtcctcaggtaatttcccttcctcatcctcatctgttgtagctgtggatggggaaagcagagaggttggctggcagtcagccacactcaccctgcagttccagttccagcccaccagatcc

SEQ ID NO: 24279 - DNA, 601 bp, Human
gatgactagaaaagctagagataaggaacgacatccatgtctcaattttttgggctaatggaacagctggcgtacaactactgcaaaaacttttttttgaaatggagttttgctcttgttgcccaggctggagtgcaatgacacaatctcagctcactgcaacctccgcctctcaggttcaagcgattctcctgcctcagccttcagagtagctgggattacaggcatgcgccaccaggcccagctaatttttatatttttggtagagatgggtttcaccatgttagtcaggctggtctcraactcctgacctcaggtgatccacccaccttcgccttccaaagtgctgggattacaggcatgagccactgcccccggctgcaaaaactatattcactttcaaaactgaagcagaaaaaaaaacctggaggataatttgctaactttttctataaagccatcatcatattaacggatcctaaaggctgattattgaagcctgatgtgcatttcccgaactagcagggctggggcatgttggggcagaggatgcaggccagggacccatcgctgatagtgcctgactcacagagctgtctga

SEQ ID NO: 24280 - DNA, 601 bp, Human
ggccctgcccccaagctttctccatccctacgtggttctccctcatctaagaagccataaggatccagggccttcttaccccctgggctgtcaatttctggctcctccttacagctaaagtctccatagacagaggtgggctggactccaggttcattgagtaggtaccccttcccatccacgtttgttggctgccactccgactgctccaagagctggggacagaagagcaagaggctatcaactcccttccagtgcagactcaccctgtggccctgccctcaatgagccagctcctctmagccagtatcacacccttggccattttcacaatctcagataggatgcagaagtgcactgcagtcaggacaagggcccgggagggaggaggcagaaatgcatgttggcactggtcctcaattcattttcccacccctctcacacccactctctggtatagcatctccacgacttccctctcaactgtgtaaggacatagtaagagggaatgtggcttaaaacaaaggttagcataataaatcaagaaaagatgactagaaaagctagagataaggaacgacatccatgtctcaattttttg

SEQ ID NO: 24281 - DNA, 601 bp, Human
aaccggactggggtcagcaggctgtccagccaggtggcatccatgttcttcagatctgtgaagacacgctgtagactcagcccaatatcccctagaagatgtgaagaaggttgtatgagggtaggggacggtggcatcaggtgtgcttccccctacccctgaaggccatagacatggcctctgctcttcccagcacagcagtaaacatccactcagcttcaggcaaaccttaaggcatggcagccgtagctaattcacaatgtgtcagtaccccagatgctttaccgccctgctccctggycctgcccccaagctttctccatccctacgtggttctccctcatctaagaagccataaggatccagggccttcttaccccctgggctgtcaatttctggctcctccttacagctaaagtctccatagacagaggtgggctggactccaggttcattgagtaggtaccccttcccatccacgtttgttggctgccactccgactgctccaagagctggggacagaagagcaagaggctatcaactcccttccagtgcagactcaccctgtggccctgccctcaatgagccagctcctctcag

SEQ ID NO: 24282 - DNA, 601 bp, Human
ggagggcaaccggactggggtcagcaggctgtccagccaggtggcatccatgttcttcagatctgtgaagacacgctgtagactcagcccaatatcccctagaagatgtgaagaaggttgtatgagggtaggggacggtggcatcaggtgtgcttccccctacccctgaaggccatagacatggcctctgctcttcccagcacagcagtaaacatccactcagcttcaggcaaaccttaaggcatggcagccgtagctaattcacaatgtgtcagtaccccagatgctttaccgccctgcyccctggccctgcccccaagctttctccatccctacgtggttctccctcatctaagaagccataaggatccagggccttcttaccccctgggctgtcaatttctggctcctccttacagctaaagtctccatagacagaggtgggctggactccaggttcattgagtaggtaccccttcccatccacgtttgttggctgccactccgactgctccaagagctggggacagaagagcaagaggctatcaactcccttccagtgcagactcaccctgtggccctgccctcaatgagccagctc

SEQ ID NO: 24283 - DNA, 601 bp, Human
taagaggggcccaggggccctgctacggtgcacagggaatggcctggatggagggcaaccggactggggtcagcaggctgtccagccaggtggcatccatgttcttcagatctgtgaagacacgctgtagactcagcccaatatcccctagaagatgtgaagaaggttgtatgagggtaggggacggtggcatcaggtgtgcttccccctacccctgaaggccatagacatggcctctgctcttcccagcacagcagtaaacatccactcagcttcaggcaaaccttaaggcatggcagcmgtagctaattcacaatgtgtcagtaccccagatgctttaccgccctgctccctggccctgcccccaagctttctccatccctacgtggttctccctcatctaagaagccataaggatccagggccttcttaccccctgggctgtcaatttctggctcctccttacagctaaagtctccatagacagaggtgggctggactccaggttcattgagtaggtaccccttcccatccacgtttgttggctgccactccgactgctccaagagctggggacagaagagcaagaggctatcaactc

SEQ ID NO: 24284 - DNA, 601 bp, Human
gtcctatgtgttcacacatgacttaatggttagatgacatttccaattttaagtcataccaaggcgctcacacttccctccctgggcctgttgagggctgctggggcttgagggggtggtgggcgccgagcaaggcactgtataaataaatgcaaaggccaagagctcgggggaaatgttagtgtacacctctgatcagaaatgtggcaagatccacacgaaaaagtgccaagtttttttcccaagcccctcagccaaagcagggagcagggtagagctcctctgaggctgagggagcatygccccgaaggaccccactttccttcacatttcactggctttggaacagtccccagggctcagctgaaaagggggtagttctttgggaacgagattcatttagtgcaattttctcttagtgcagagccagccctgggattggtgttatgcttttctggggtcactggtctgttcccctaggagccagccagtgacagcgagaccctctccaggcagctgggctcagaggaaaaagccagacactgactcctgtccaagtccctgacctgatacactggtctcagaacctcatcttcccagg

SEQ ID NO: 24285 - DNA, 601 bp, Human
aatggagtttcaccaggctggtctcgaactcctgacctcaggtgatccacccatctcggcctcccaaagtgctgggattacaggtgtgagccaccgcgcctggccgaaaggattttataatagatgcatgtccctgttcaccccaaagtcaagttcaggcgggatgccaataataagtccatcagtgtttccataaaaagtaaaatcatctacaagttaaatttctctctaaaaaggccacaccccttataaacaatttactttttataaaaagacaaatgtacatatttacacacgtcctatgtgttcacacatgacttaatggttagatgacatttccaattttaagtcataccaaggcgctcacacttccctccctgggcctgttgagggctgctggggcttgagggggtggtgggcgccgagcaaggcactgtataaataaatgcaaaggccaagagctcgggggaaatgttagtgtacacctctgatcagaaatgtggcaagatccacacgaaaaagtgccaagtttttttcccaagcccctcagccaaagcagggagcagggtagagctcctctgaggctgagggagcatcgccc

SEQ ID NO: 24286 - DNA, 601 bp, Human
ggttactggttggttcaccctggagtggctttcctgagaaccgaatgggagatgtgtataaatgtcctgttgacctatccactgccacatgtgaaaaactaaatttgcaaagtaagtttaaatttacttgcaaggcatgtgatttgtcttagactcaactgaaaaataacatcagaacaatcattgttctgtcttaaagaaatacagacagcttttttttgcccttatgtctttagtaatatggggcacaatcatatccaaatttccaaaacagtttggagacttgacttaacaagatgcrtggaaaatgtgctatctcctggaccatttacctatagaccatggactggtttccatcaacatttagaataattttgatgattacttgcagaatcaaggctatccttgaatccgaggctatccatatttctttctctcctctttgcaaaataaaccattaagtttggaaacatcagtacaagggctgagtttggaggcaccaaaaacactctgtgtttcttgttatgtctaaatgatggcattctaataaaacaaatccacaatttggaattatttgctgttttaattatccccatctcag

SEQ ID NO: 24287 - DNA, 601 bp, Human
tggaattatttgctgttttaattatccccatctcagatgcctcctattaatgccaaaaatttactaaaggttcaagggtagacagctaaatgagtgacatttccatgtaatatgctgatacaagtaaaaagtcactcaatttgatcatcattacatcatcagcagcagcagcctaaaaaaacagccctgaggaatcacggagttcctctgaagaattgaggcatgaattagaaaagagtgttgtgaaaatcaagggaaagaagagtttcaaaaatagtgattaagacttggaaacaagggmagtggtgtttcttgcatatctctgtagacctaatatctagaataatttatggcacataatagggctcaataaacatattttcagtgaagtagaaggaatatcagtagtgtcaaatgctacagaagttgaaggggatgaggactgagtaaatgtcttcagcttatttaagcaggttgtgggtgatctagatcagtgatctccaaattttttgaacactcagtatatatatatatatatttctaataacacaaatatatacatttggagtgagtgttcaaagctttattatatagtccaaaa

SEQ ID NO: 24288 - DNA, 601 bp, Human
aggcagaggttgcagtgagccaagatcgctccactgcactccagcctggatgacagagtgagactctgtctcaaaaaaaaaaaaaaaaaaaaaaaaaaaaaaaaagaaaggtgaacttttacaacagtcaccctgggaaataagggaaggaatccaattaagaataagtgacagaggcaatgatagcttggcagagatgagaaacatgactgaatgatggtattactaaagagaattgcaatgttcgataactcaagaatggatacagtggttgatgccctaggtcagtggaagacaggargtggagagatttatttagtatattatatgactcgtctaatttccttttaacattcacccactattgctttgagccagattctatcatagggcattctttgataacacttcaaggatatttttactgacccagaaaaaaaaaaaggcattagatagagctactgtgactttcaaaagagaggcaaaaatgatgtcctcaaatgtgttttgttttgctagaatattgtaaaaaaaatcataattaaacatctataagtcataccctctccagagcccactccttactgtcttatgctctgca

SEQ ID NO: 24289 - DNA, 601 bp, Human
agaatcccaaatctcatttctacttcctgtaggatcattcaagatagtttcaaagctaaaaagtatttttggtttttaatcatttcctgtaattgttgagtaatctggtgttatctgaggcatggagcagtctctcatgtcagtgctcactttcatttagttacaaaaagagtaaaaagacatcactaatcagtgaaatagaatgccttatttaacaagtgcttttggaacaattaattgattaatatttacatatccaaatacactgtcaagtgaattgaaagttaatataaaaaaactrgaaaaaaatggaaattttctgaaggatggaaaaatttctgagtttagagctaatagaaaaaataatataggaaattgttgaaaggatttgactatataaaaaaagggaaaaacatcacacaccaaaaaaaaagtttgaagacaaaaacacaatcttatttgaaatttccattgactcatataggtatgtgtatgtatgtataaccctgttaaaattgtcttagagaggttgggcgcggtggctcatggctgtaatcccagcactgtgggaggctgaggcaggtggatcacatgtggtcag

SEQ ID NO: 24290 - DNA, 601 bp, Human
cttatttgaaatttccattgactcatataggtatgtgtatgtatgtataaccctgttaaaattgtcttagagaggttgggcgcggtggctcatggctgtaatcccagcactgtgggaggctgaggcaggtggatcacatgtggtcaggatttcgagaccagcctggccaacatggtgaaaccccatctctcctaaaaatgcaaaaatcagccaggagtggtggcacacacctgtaatcccagctactcgggaggctgaggcaggagaatcactgggacccaggaggcaaaagttgcatgcrctgagccgagatcgtgccactgcactccagcctaagcgacagagtgagactctgtctcaaaaaaaaaaaaaaaaaaaaagaaaaaaaagtcttagacagcataattcaactttacactagttttatctgaaccattggcacgctttcttaaaaatcctatgttttataactgtattattctaaaaatgtaatcaattttcaacgtcattctatttttactaatggatattattattctgatgactgtgctgccagtaagtgaattagatattgcttgtgatatgtgttaacatcagtgca

SEQ ID NO: 24291 - DNA, 601 bp, Human
ggttgggcgcggtggctcatggctgtaatcccagcactgtgggaggctgaggcaggtggatcacatgtggtcaggatttcgagaccagcctggccaacatggtgaaaccccatctctcctaaaaatgcaaaaatcagccaggagtggtggcacacacctgtaatcccagctactcgggaggctgaggcaggagaatcactgggacccaggaggcaaaagttgcatgcactgagccgagatcgtgccactgcactccagcctaagcgacagagtgagactctgtctcaaaaaaaaaaaaaaraaaaaagaaaaaaaagtcttagacagcataattcaactttacactagttttatctgaaccattggcacgctttcttaaaaatcctatgttttataactgtattattctaaaaatgtaatcaattttcaacgtcattctatttttactaatggatattattattctgatgactgtgctgccagtaagtgaattagatattgcttgtgatatgtgttaacatcagtgcataaatgaatattgcaatggatctttatggtttatgatattccaaggtctttacaataaggttgctttaatctt

SEQ ID NO: 24292 - DNA, 601 bp, Human
ggctgaggcaggtggatcacatgtggtcaggatttcgagaccagcctggccaacatggtgaaaccccatctctcctaaaaatgcaaaaatcagccaggagtggtggcacacacctgtaatcccagctactcgggaggctgaggcaggagaatcactgggacccaggaggcaaaagttgcatgcactgagccgagatcgtgccactgcactccagcctaagcgacagagtgagactctgtctcaaaaaaaaaaaaaaaaaaaaagaaaaaaaagtcttagacagcataattcaactttacaytagttttatctgaaccattggcacgctttcttaaaaatcctatgttttataactgtattattctaaaaatgtaatcaattttcaacgtcattctatttttactaatggatattattattctgatgactgtgctgccagtaagtgaattagatattgcttgtgatatgtgttaacatcagtgcataaatgaatattgcaatggatctttatggtttatgatattccaaggtctttacaataaggttgctttaatctttttgttttttgattttaaagttgcaaaaatttaaaaaaagaaca

SEQ ID NO: 24293 - DNA, 601 bp, Human
ggatttcgagaccagcctggccaacatggtgaaaccccatctctcctaaaaatgcaaaaatcagccaggagtggtggcacacacctgtaatcccagctactcgggaggctgaggcaggagaatcactgggacccaggaggcaaaagttgcatgcactgagccgagatcgtgccactgcactccagcctaagcgacagagtgagactctgtctcaaaaaaaaaaaaaaaaaaaaagaaaaaaaagtcttagacagcataattcaactttacactagttttatctgaaccattggcacgcttycttaaaaatcctatgttttataactgtattattctaaaaatgtaatcaattttcaacgtcattctatttttactaatggatattattattctgatgactgtgctgccagtaagtgaattagatattgcttgtgatatgtgttaacatcagtgcataaatgaatattgcaatggatctttatggtttatgatattccaaggtctttacaataaggttgctttaatctttttgttttttgattttaaagttgcaaaaatttaaaaaaagaacatactgatatttagagattacagaatgtgc

SEQ ID NO: 24294 - DNA, 601 bp, Human
ctttcttaaaaatcctatgttttataactgtattattctaaaaatgtaatcaattttcaacgtcattctatttttactaatggatattattattctgatgactgtgctgccagtaagtgaattagatattgcttgtgatatgtgttaacatcagtgcataaatgaatattgcaatggatctttatggtttatgatattccaaggtctttacaataaggttgctttaatctttttgttttttgattttaaagttgcaaaaatttaaaaaaagaacatactgatatttagagattacagaatktgcctcaaaatttttaatctataactccagataaagtaaaaaatgaaaggtaaaaagcaagagaatttgagagattaattagcagtccaggtagcaagcagagaggcagaaagagagagaggaggagaaagaaaaaaagaaaaaacccaaagtttcctttacatacttagaaggtcaaaatcataagatactcttaagaattatgtggaaaagactgacaatcatcacatttttttgaaacttcttaagttctgggcttaaagtaggaatgtagttctggcacttacaattggcatattt

SEQ ID NO: 24295 - DNA, 601 bp, Human
tttataactgattcacaactttacataacgttaaattctgtaggcattttttaggatcttaattagatttctcttttgcacttgtctcctttttcatgtatcaattttaaagttatttaatctaatgtttcttgtgtcatttaatcatgatttaatcaggagtttttggcattcaaggactcctgaaaaggagagaattgggattgcattaatggagatattaaggattggagcaggtataatgtgagcaagaagacaagtgccattcagcgttagtgactgcagttaattgggaagtggscaaagttaaaaactggtagtcagtgaacctcatttgtgtttgcttagcatatggagtaattttgaactgaattttcacacaacatttgccctctcgactctcttttacaaattagggaatctggcaacacaacctatttcatacccgtgggcaggcagaaaacatagtggtctgtacataggcatgggttcttcattcaccatgatgtctatacctgaccccaagccctcttcaagcgttactgccattaggtttatggtttctgctgagcagtatgaatggaaggaactgcagaaaact

SEQ ID NO: 24296 - DNA, 601 bp, Human
tttcatacccgtgggcaggcagaaaacatagtggtctgtacataggcatgggttcttcattcaccatgatgtctatacctgaccccaagccctcttcaagcgttactgccattaggtttatggtttctgctgagcagtatgaatggaaggaactgcagaaaactaatgttcagcaagaacaatgataatgatgctagctaacaatattatatggcatttgctatttacctggcattgttcttagtgttttgtatctatagacccatttaatctttacaacaatcttaaaagatagaatgtrtggttatcctcattttacagatgaatcacctgaggcccaggtaaatgagagacaaaaagtgaacctgcatgcattctcctccttggtgttctctggaaggaaagcacctgttttatctagcttgttgggagacctcataggctcctcccttcactgacacctgctcccaacagtctcagcactcctcctcccgcaaggcttgccactgggcacagagcacctgccaccttctccatcacttctgctttccccgaaggcattactgactcattggttttgagttgacaattattagtatct

SEQ ID NO: 24297 - DNA, 601 bp, Human
tctatagacccatttaatctttacaacaatcttaaaagatagaatgtgtggttatcctcattttacagatgaatcacctgaggcccaggtaaatgagagacaaaaagtgaacctgcatgcattctcctccttggtgttctctggaaggaaagcacctgttttatctagcttgttgggagacctcataggctcctcccttcactgacacctgctcccaacagtctcagcactcctcctcccgcaaggcttgccactgggcacagagcacctgccaccttctccatcacttctgctttccccraaggcattactgactcattggttttgagttgacaattattagtatcttagaaaagagtagagatgatttctgagctccataatggagaggtagaaggtttgcatttttcatgtgtttccattgattgttttctcatttctttgaagacatgtggtcctctgtgggcacagcaatgtgggaatcagtattacacaacgggtgtgtgttctgacatcagtcctgattttcagctctcagccagcttctcacctgcaactcagcgtaagttattaatgtgcagatggtctgagcaatgcctta

SEQ ID NO: 24298 - DNA, 601 bp, Human
agaagaaatcattccattgaaagaaaagtaactatcaagaacaaagttggaagtgatgccttaaagctaccggcccatgtctaaatgtacttttgatttttattttattggttaagtagaaattatttttaatgtaatgacagcccattaataaatgtctcctctgttgaaggtggggttaattcagtatgccaataatccaagagttgtgtttaacttgaacacatataaaaccaaagaagaaatgattgtagcaacatcccagacatcccaatatggtggggacctcacaaacacattyggagcaattcaatatgcaaggtaagttttggtgctaataggccaatgttttcataatgtaaaacattatatttatgtaataaatatgaaaaagtaaggaaaagacaaagaaaaataatatacctggtacctaatttaaatcagaactaataaagaaaaaaacatcagagcattctatgtcttgaatactttgagaaggcagctgggaaagttaaatctttgattttaggatatttataagatatcacatgatatttaaatgaatttatgtgaagtaaatgaaatgagaagaccttagatt

SEQ ID NO: 24299 - DNA, 601 bp, Human
caataatccaagagttgtgtttaacttgaacacatataaaaccaaagaagaaatgattgtagcaacatcccagacatcccaatatggtggggacctcacaaacacattcggagcaattcaatatgcaaggtaagttttggtgctaataggccaatgttttcataatgtaaaacattatatttatgtaataaatatgaaaaagtaaggaaaagacaaagaaaaataatatacctggtacctaatttaaatcagaactaataaagaaaaaaacatcagagcattctatgtcttgaatactttragaaggcagctgggaaagttaaatctttgattttaggatatttataagatatcacatgatatttaaatgaatttatgtgaagtaaatgaaatgagaagaccttagattaaaacagtaggaaatggggcaatctgtcataatttgttaatattcatcagagattcagacaaattgagctcatggatcacttggtgcaaattaacaaagaccacagaatcttaaacatacgagtttaagtttattatgcttattacaatcagtgggaaatgtgaaattataactatacaggactctcttgat

SEQ ID NO: 24300 - DNA, 601 bp, Human
ataatgatgaacatacgctgctattcctaaccaagttgccatgacaccacaaacttctcgaactcctgccaaattcttttgcctcttcactagctccttttcctattttttcttcactaaacagagccctctcttctttactgctcttctcctgtagggattctatccactgtcatggcatcagcagcagcactgttgggttatctcattgctatgttgtcagccctacactctctcccaaaactcacactggcatctagctgatgatgaatatttttatttggagtgttggctcacttaycaaattcaatctgtcccacactggccttattcttttccctaccactcctcatgaacttgccattttgattcatgccactgtctcttgcctagtcagtcgaactaaaaatttggtttcctttattctttccactcttccttatgtcacacatctggtcagtggccacatcctgtcatttctatttctgcatttcccattttatctgtcttctttttctgtgtgtgtatttcagttgctacttccgtcaactggtgacaatcccaaatgtctcaaaagcagattccccacaagagaagatat

SEQ ID NO: 24301 - DNA, 601 bp, Human
tggaaggagcctggggccctggcgagctttgttctccaggacaatggccactgtccattgaggaaggacttgcctggctttcatcatgtttcaaaactttggttttctcccttgggccattgtctatctccctcttcccactatttcccaagctaacaggttttagtctgcccagtgctaggagaatcacccaacattttactcatccctcctagaatgtaattgcctgtctctctctctctgtctgtctctcatctctttctttaaaacattgaagataatctgaaattatttcagtaawtgttgccatgttttcattcacctcatttcattcaatgcctacagttgcagtttattgttttaagcactgcgggtaattaaaactaaatgagacacagtttctgtcctcaaaaaccttagaatcatacatgaaatttacagtgtatcataaagagaatgtgacactcagaaaggatctgatgtggatagtgtaattcaaatttggccgaaaaatgcagaatattttctatgtttctatagtctacattatagaatacaaaaaagattttaggaaataaaatgatatgctcagttttataat

SEQ ID NO: 24302 - DNA, 601 bp, Human
cctcctagaatgtaattgcctgtctctctctctctgtctgtctctcatctctttctttaaaacattgaagataatctgaaattatttcagtaattgttgccatgttttcattcacctcatttcattcaatgcctacagttgcagtttattgttttaagcactgcgggtaattaaaactaaatgagacacagtttctgtcctcaaaaaccttagaatcatacatgaaatttacagtgtatcataaagagaatgtgacactcagaaaggatctgatgtggatagtgtaattcaaatttggccraaaaatgcagaatattttctatgtttctatagtctacattatagaatacaaaaaagattttaggaaataaaatgatatgctcagttttataataaactgaaactcatatgtttaagattctgtggcctttgttaatttgcaccaagttatccatgagctcaatttgtctgaatctctgatgaatattaacaaattatgacagattgccccatttcctactgttttaatctaaggtcttctcatttcatttacttcatataaattcatttaaacatcatgtaatatcttataaacatccta

SEQ ID NO: 24303 - DNA, 601 bp, Human
atgtataaaaagagctactacaatcagtaagagaaatggatgaaaaacatgaataaatagtttataaatgataaaatacaaatgactgataaacataagaaaatattcccaatttacaaagtatatttctaaatactttcagtaagtatttaaaaacataaattaaaccgacaatatgttttgcctaaaagatgacacagaataataatgtttaatcctggagagattatcaggaagcaaagaagctcatacactgttgataggatgataaattgttatgacttttgggggacaatgtatkaatatctatctattagaatcataaatagttttacctttttacactgtgttatgtaagttctaaaattcttgaatttgtttacagtaagcatatatatttttaaaattagaaaaatacagcaaagatttttaatagttcagtttttgaggaagcattttatttataggacctaaaataatttacttaggtggccttggaaaatctagttagtgcagaaagatcacgtgttcaggagctcactgtgtgggggactagcacacacttcacagttggttaaaagaaaaaaaaaacacacatcac

SEQ ID NO: 24304 - DNA, 601 bp, Human
gtataaaaagagctactacaatcagtaagagaaatggatgaaaaacatgaataaatagtttataaatgataaaatacaaatgactgataaacataagaaaatattcccaatttacaaagtatatttctaaatactttcagtaagtatttaaaaacataaattaaaccgacaatatgttttgcctaaaagatgacacagaataataatgtttaatcctggagagattatcaggaagcaaagaagctcatacactgttgataggatgataaattgttatgacttttgggggacaatgtatgawtatctatctattagaatcataaatagttttacctttttacactgtgttatgtaagttctaaaattcttgaatttgtttacagtaagcatatatatttttaaaattagaaaaatacagcaaagatttttaatagttcagtttttgaggaagcattttatttataggacctaaaataatttacttaggtggccttggaaaatctagttagtgcagaaagatcacgtgttcaggagctcactgtgtgggggactagcacacacttcacagttggttaaaagaaaaaaaaaacacacatcaccc

SEQ ID NO: 24305 - DNA, 601 bp, Human
cttgatttaaaattactgacagtaatacaatttttaaaattgaatgttccaggtactgttcaaggaggagacaactttcagatggaaatgtcacaagtgggattcagtgcagattactcttctcaaaatgtgcgtatatcagatagcttcaagccatgttgtcatttggcataacacttccagacacagtagccttatacataaaatgggaagacagccatctagggatcagcccttctgattcctagtcacggtcatttagtttctttgtgctgctgatttacctctaaaatttgaaggwtaataatgtcttcccttccctgtttcacagggatcttatatgggggaaaactgatagtataccagaaagtctttgagtaccccagggcacagactgtatattaacttaaggtattattcctgcaggaattttctttgaatcaattaactactggaaatgtttgttaaaaacacgtactcttgtcatcaccgtcatggtcgaattctgaatggtcatagtatctttttctaagagcagacagaaaagagttgaaaaaataaggaggtaggaaaaacgtgaggtggaattggaatacaacac

SEQ ID NO: 24306 - DNA, 601 bp, Human
agacagccatctagggatcagcccttctgattcctagtcacggtcatttagtttctttgtgctgctgatttacctctaaaatttgaaggataataatgtcttcccttccctgtttcacagggatcttatatgggggaaaactgatagtataccagaaagtctttgagtaccccagggcacagactgtatattaacttaaggtattattcctgcaggaattttctttgaatcaattaactactggaaatgtttgttaaaaacacgtactcttgtcatcaccgtcatggtcgaattctgaatkgtcatagtatctttttctaagagcagacagaaaagagttgaaaaaataaggaggtaggaaaaacgtgaggtggaattggaatacaacactgtcttttcagctcggggaagtctatttctatctctcagaaacatccacctcctgggcccctgattctaatttgagtcaggaggtgagagagatagtgaaaggaggcgaaaaaaaaaagaaagagatcctgggaattatttaaggaacagtaggaaatcccaggatttgatcggcaggtcagaggaccaagaacagcttgttttctatcta

SEQ ID NO: 24307 - DNA, 601 bp, Human
tgtttcacagggatcttatatgggggaaaactgatagtataccagaaagtctttgagtaccccagggcacagactgtatattaacttaaggtattattcctgcaggaattttctttgaatcaattaactactggaaatgtttgttaaaaacacgtactcttgtcatcaccgtcatggtcgaattctgaatggtcatagtatctttttctaagagcagacagaaaagagttgaaaaaataaggaggtaggaaaaacgtgaggtggaattggaatacaacactgtcttttcagctcggggaastctatttctatctctcagaaacatccacctcctgggcccctgattctaatttgagtcaggaggtgagagagatagtgaaaggaggcgaaaaaaaaaagaaagagatcctgggaattatttaaggaacagtaggaaatcccaggatttgatcggcaggtcagaggaccaagaacagcttgttttctatctagaatcaaaggaactgactttttctggatcatcaatccttagagatgctcatagaagttatggatctttccctcagaaaaaatgtaaatgaatctatgcacggagaatttt

SEQ ID NO: 24308 - DNA, 601 bp, Human
gaatggtcatagtatctttttctaagagcagacagaaaagagttgaaaaaataaggaggtaggaaaaacgtgaggtggaattggaatacaacactgtcttttcagctcggggaagtctatttctatctctcagaaacatccacctcctgggcccctgattctaatttgagtcaggaggtgagagagatagtgaaaggaggcgaaaaaaaaaagaaagagatcctgggaattatttaaggaacagtaggaaatcccaggatttgatcggcaggtcagaggaccaagaacagcttgttttctrtctagaatcaaaggaactgactttttctggatcatcaatccttagagatgctcatagaagttatggatctttccctcagaaaaaatgtaaatgaatctatgcacggagaattttgcacacaatcccatgaggtttttgtacatacgctgaagtcctttcatgcaccccaaatccagagtccctcaatttactacagtcattcacataacttcatggtctcttatcctcaaagtagaacacatcttttccttacttgctatttttcatggcttgtattttttagtccaacatcttatcttt

SEQ ID NO: 24309 - DNA, 601 bp, Human
agacaattctacaatatgtcaatatatgttcatatatatttcatcatttttaataaatctaaacaacttatttcaatgttttgcctaccctgcattcttatgttttaaaggtgatttgtttcaatgatcttcatttttcaattattttaggatattctgatgctgggtgcagtgggagcttttggctggagtgggaccattgtccagaagacatctcatggccatttgatctttcctaaacaagcctttgaccaaattctgcaggacagaaatcacagttcatatttaggtaaggcatggyaataattggctcagcaaacttaagttcccttgctttaaaccagctctttgttgaatctcagggtgagttcagcaaaatccttgaactgtcatctaattatcatatttattacacatacatatgttgtctctttgccaatcgggccttaaggcataactacttattggaatactatattatactcactagtttcttctggctggtcaagtggttgtaattcctggaacatgattgtgttcctccaaaatggaaatagttcccaaaagtcaatacagtaagtgatagtcttatagtatttta

SEQ ID NO: 24310 - DNA, 601 bp, Human
tggacctagttacttgttgaaaaactgacaaatccccccttctttaaatatttcttacttgtgagatatactgaattatcattaattgttgaaaatgaacagatcttttaataccgtgtcaaacgcagtaaaaatttgtataagattatattagaggagaaagaacactgacccagtttcatggttgagaaacattgctttcttgtgaagtcatgaaatatttccatacttgatcataaaattgaagaaaaaaactgtgttttacaaggaaacgtcttttcctttgcacagaattatttartgtttttaataatggagatattaacaatctcattttctacttcctgtaccactataattatgtcactatttggtaatttttacagaaagcctaaattaagatattgtgttttattttgttctgtgtctgctttaatttcattcaagatattagtaattttcaccagaaaaattttaaatcaaaaggttggaaatagatgaagatcgtattattgagaggaaaatgagaccaagaaatggatgctgttcagctacagtaaagagaattatctcctttgaccttggtttatgagcagatatt

SEQ ID NO: 24311 - DNA, 601 bp, Human
ggcactatccgcacaaagtattcccaggtaatccatgagctgttatggtgatgtatgtatttgtgggtcttatcatattagacatagaaagcgtcatgtaaaccatgcaatccgtccgccttattttgtaacttcattctttcactcagcaaatataaagtgagcctctactgtgtgcccaagcactgttctagagtctggggatgctataagaacaggacagacacaattctgatctttgtgtgccttatattatattggaggagacaaataaaaagaaagaagtagataagataaagtrttccagatagtaataaaggaatttttaaaaaagcaaatgaaactaaaataggaaataaaatttcagcaataggagtatcaggtggttgaaggggtgactaatgaggcctcactgagcagccaattttggagtaagactggaaggaaaagaactaggaaattaaccctgtacctgaacttgcatcaatttgctccaagtccactgatcttttcactggtttatgattttttattaaagatttatgctgtcccttcgatgaaaatgtggctgtaagagtgatgcagagatcagataataaga

SEQ ID NO: 24312 - DNA, 601 bp, Human
ctatcatttattgcatcaggtgcacacttcactttaagattaataacatagcccatgaagcgatgtatcatttttataaagctgcttgaaaaaaaaaggaaaagcattataatgtggactaactttgtcctaactgcactcacctccttgccattgtttttcctttacatcatcttcacaacttatttttagtttatttaattctttaatattttatctatctttgttggcattgttaagtcactggagcaagaaaaattgtacaacatatatgatagatttttttcaaggtaacatgtakaattcatgttttgggaagtatatacaacctttaaaatattgaaaataataaagtaagatagaataaccccaaataaggcaataaggcagctgatgctgtgaatggcaccaggtgttctctctcaattttggacacacggccagtggactttagttgaaggtaataattctgatagtttagacatcggctactgacatcagttattatcacataattttttttcatgagttggtattaggaaacagaggttcaaagagggtaagtaaattgccccaagtcacagagctcataaacagcaga

SEQ ID NO: 24313 - DNA, 601 bp, Human
attttgaaaatttcccaagtgagaaaaatgcttttcaggagaaaacttccagccggaaatttattttataaatgatgtgaatatttccaccttggaaaccacataatggcatttgaaaggataatttactcaggaaatcacttttttaaaaggatatttaagtactttcttagaatacagttctcagaatttaaggtgcgaaagaactgccagggaaacttttgggaaatgtatattctgggttcttaccatcagaaatctaggtttgaaggcccaaggaatatgcagatctaaggagcamcccaaatatttctgatgtaaatggatggtacagagagatcttacttcaagaaatgctaagtgtaaacactagaaaaacataaagttgacggttagatgaattaaaatcagttgagttgtttagttcatttttcaatttgaaggtttcttgtttgtgaagacgtagacttcttttttgttaaagtgacaattttatagattccttaaaggaaaaaatcttatttcccttctctcccatcctgtgctgactggtggatcagattatacatgcaatccctagtgaggaaatggagacagccaa

SEQ ID NO: 24314 - DNA, 601 bp, Human
aaatgcttttcaggagaaaacttccagccggaaatttattttataaatgatgtgaatatttccaccttggaaaccacataatggcatttgaaaggataatttactcaggaaatcacttttttaaaaggatatttaagtactttcttagaatacagttctcagaatttaaggtgcgaaagaactgccagggaaacttttgggaaatgtatattctgggttcttaccatcagaaatctaggtttgaaggcccaaggaatatgcagatctaaggagcaacccaaatatttctgatgtaaatggrtggtacagagagatcttacttcaagaaatgctaagtgtaaacactagaaaaacataaagttgacggttagatgaattaaaatcagttgagttgtttagttcatttttcaatttgaaggtttcttgtttgtgaagacgtagacttcttttttgttaaagtgacaattttatagattccttaaaggaaaaaatcttatttcccttctctcccatcctgtgctgactggtggatcagattatacatgcaatccctagtgaggaaatggagacagccaagctgtttttctttaaagtttaaaaa

SEQ ID NO: 24315 - DNA, 601 bp, Human
cccccaagagttaagagtaagtcctgcctgtgaatggactaaagaataccaagataccgcttctgaggaaaaggcaaattcaaatgttagggtttcatttgtatagacatagtgcttttttgacaagaactgatgagcttaactaagaatccctgcttcaaattcttactagacccaagtctcttttggtttcttagtagaagagaggctaaaagcagaattaggatggaagaaaagaagcgagagtcttgattattcacaacaaagatattctacataattgagagctgactgtgctctwaattgtaaacacatttggaatcattttcttgttttaatgttgctatgctctaataaactgactctgtctccccctgtatgtttgtgtgtgtgtatgtttaggagccctctgatgttgtcaactctttggatttgcgtgtggacatcagtctggaaaaccctggcactagccctgcccttgaagcctattctgagactgccaaggtcttcagtgtaagtgcagcttacacttcctggatttagactggcaaataaagttccacagtcactgcaatagtgtctgaaggatggttaggatgca

SEQ ID NO: 24316 - DNA, 601 bp, Human
aaagaataccaagataccgcttctgaggaaaaggcaaattcaaatgttagggtttcatttgtatagacatagtgcttttttgacaagaactgatgagcttaactaagaatccctgcttcaaattcttactagacccaagtctcttttggtttcttagtagaagagaggctaaaagcagaattaggatggaagaaaagaagcgagagtcttgattattcacaacaaagatattctacataattgagagctgactgtgctctaaattgtaaacacatttggaatcattttcttgttttaatgytgctatgctctaataaactgactctgtctccccctgtatgtttgtgtgtgtgtatgtttaggagccctctgatgttgtcaactctttggatttgcgtgtggacatcagtctggaaaaccctggcactagccctgcccttgaagcctattctgagactgccaaggtcttcagtgtaagtgcagcttacacttcctggatttagactggcaaataaagttccacagtcactgcaatagtgtctgaaggatggttaggatgcagcctgaaaattcttaattttctaaatgaactacaattaca

SEQ ID NO: 24317 - DNA, 601 bp, Human
gaaacattcataactcataaatacctttaaaaactaaatttcaatgtctaccatccacataggagtaaaacaataagaaatataaaattatctgtatttaaatggttccattccctctaatacaatagcaacaaagaacaatccaattgcatttacttatttgttgtcagtatcattttgatgcaaagatagtttattacacagcaattttctcagtattctaagtaagtctaaagagtttagttttttaatgagtgaaattttaaaatactggcctttttatttaacagtaatggctttwcccccctcctttttacttttaacagagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggtatgtgatgagaccctgtacttacttccaccatgcttcctacttatagatcactgtcttctctatgtcctctgagttgtttaaagaagcaccttaaccctcaacatgatcaatctgaactttgtggcttccg

SEQ ID NO: 24318 - DNA, 601 bp, Human
aaggctgataatttggtcaacctcaaaattcctctcctgtatgatgctgaaattcacttaacaaggtaggtgaagcagtgggtaacctgctatcactgacaccaactctagatcagaagatttttggctcatggctaaagaagtcctctgtatgctcattcttaactgaagaatttgaattaaaattcttgtcaactaaaacaggagtccacagacatattggtccctaggaaaaccttgagtgactcgttaggcttattaaaccaatgagagtagcccagaaaggcagagaaagatcccygtagccacacatcacaggcacactccacattgcaggccctctgagtagctgcaaacattctcaaaatgttgaaacagaactctcaaaggtcctgagagttgtcttcactttcttctcactgcctacttcccattgtatgtgagatctcaagcagtatccccattcctggacattgaagccccaagcacaatgttttgcacagagtaggtccacaataaatattgaatctagtcactgtttgaatattcaaatattggaactagatcaagtctagtttctgagggaaaaattcctcacata

SEQ ID NO: 24319 - DNA, 601 bp, Human
ttgcattttacataatcttagaaaagttttcatatgaggacatacagatctaacttattccagtcctggctggatcataatttatgtaaccaattcaatattaacaagacatttggttgttttgcatttttattttgttttgtttaaccatcataagcaatgctgcaaaaaaaataacaaacatctttgcaaacttttggaaaaaatcctacacaataacttagtgtatttcttagcaacaactttgatactgtataactgtacagttatattgtaaaaaaaatgatgggtagaaatagcrataatagtattatttctgaagcaggatccccctgagtatagatatttactattataaatatattgatcaacacttaagtaacaaatggaaaagtgtcagatctctttaaaatgcaaatgcagaccatattaatttagaaattggccccatttaggatctcacacaaagatcttctggaaggcataggaaataattcatgcacacacatccaagctttctgtttcaaatcctagtcagttttcccattttccatgtcaggctgacaaatcattgtttcctctcatatataaccttgacaaa

SEQ ID NO: 24320 - DNA, 601 bp, Human
gacatacagatctaacttattccagtcctggctggatcataatttatgtaaccaattcaatattaacaagacatttggttgttttgcatttttattttgttttgtttaaccatcataagcaatgctgcaaaaaaaataacaaacatctttgcaaacttttggaaaaaatcctacacaataacttagtgtatttcttagcaacaactttgatactgtataactgtacagttatattgtaaaaaaaatgatgggtagaaatagcgataatagtattatttctgaagcaggatccccctgagtrtagatatttactattataaatatattgatcaacacttaagtaacaaatggaaaagtgtcagatctctttaaaatgcaaatgcagaccatattaatttagaaattggccccatttaggatctcacacaaagatcttctggaaggcataggaaataattcatgcacacacatccaagctttctgtttcaaatcctagtcagttttcccattttccatgtcaggctgacaaatcattgtttcctctcatatataaccttgacaaatacatccactcaagtctccctgtgacatattttccttt

SEQ ID NO: 24321 - DNA, 601 bp, Human
tgtttcctctcatatataaccttgacaaatacatccactcaagtctccctgtgacatattttccttttaaggatatggaaaaaatcattaaggcataaaagagggaaagacaaggttttagtaaagaaacccaaaaaattctacttcagaaaatatccaccccaagtttttaagaaatagaatcaacattctataattaacgtaaattgtccagtgggaataaatggaaaggatatgcacagtgttctcagacccctaccctcactgctcatcccctaatcccccacgcaaagaagctacyctggttggaatcccacctcagagccccagaaatgagtgaggagaggggaggtccccagtttcattctagtctgagtggtcctatgagggtttctctgatctcatcatcactttgcttgcagaacttagttggcaatcttaagcaaagaagttaagatcaatccagtggctttaggtccagaatactaaaacctctggatcatccatcttaaaggtggtctctacactaatggtggaaacagatttgaccaacctcattcagacccaaaccattcaaattggtttgcaactaaagaaggat

SEQ ID NO: 24322 - DNA, 601 bp, Human
atcccccacgcaaagaagctaccctggttggaatcccacctcagagccccagaaatgagtgaggagaggggaggtccccagtttcattctagtctgagtggtcctatgagggtttctctgatctcatcatcactttgcttgcagaacttagttggcaatcttaagcaaagaagttaagatcaatccagtggctttaggtccagaatactaaaacctctggatcatccatcttaaaggtggtctctacactaatggtggaaacagatttgaccaacctcattcagacccaaaccattcaaaytggtttgcaactaaagaaggataggaagaacgaataatacaggcatccaataatgaacactgaaggagctcaataccctattattatattttagccacaccaaagtgaaaacccctggcttataaatccattcattcaactaacaagtactgattgtctactatgttaacatactagtcaatataacagtaatcttgggaagacttctactatcaattctaaagtaatacttttgtacttatttagaaacttgagaattggtagacatgtaatgcacaaactcttagcagaaaatccaca

SEQ ID NO: 24323 - DNA, 601 bp, Human
tgcagaacttagttggcaatcttaagcaaagaagttaagatcaatccagtggctttaggtccagaatactaaaacctctggatcatccatcttaaaggtggtctctacactaatggtggaaacagatttgaccaacctcattcagacccaaaccattcaaattggtttgcaactaaagaaggataggaagaacgaataatacaggcatccaataatgaacactgaaggagctcaataccctattattatattttagccacaccaaagtgaaaacccctggcttataaatccattcattcamctaacaagtactgattgtctactatgttaacatactagtcaatataacagtaatcttgggaagacttctactatcaattctaaagtaatacttttgtacttatttagaaacttgagaattggtagacatgtaatgcacaaactcttagcagaaaatccacaaagaaatatgttttcaaaggaatttatgttagtcttagaaacatacattggacgataagcccataggcaagcatttctttttatttggtgcttttgtaactaaaagtaaaatttactttaacctaagctataagatact

SEQ ID NO: 24324 - DNA, 601 bp, Human
gacacaacactccggcagcccagctccacagatggcatttttaaccatttataccacatgtctcacaaagtcacaaattacttacccattaacattgtagatgttgagtttttttccattgagccatttatgcccagtgttccattattggcgcactaagcatgtgggagttacttatatcctactgctcaaggtcattgccaaggtatgatcgaaatttcaaaaaaattgcaacctcaggcataaatgcgttttaagaggtgagacacagagacctgaagtgtgactataaagtaatggstgactttcatttggactcagtcttaccacctcgtagttgcccttcatcaacacggggttactggtgaatttccttgcatcatgtacatcctgttgcagtactggcacattttattctctacataggtaacaacaggaagtgttccagtaagcatggcaactgtaatcatccacatccctcagtataccaaagaaaagaacccactgatgtacctaactggggtgcaaacagacaaggtaaagattaaaaaattgcctaaaaatgtgtactttcaagatgtaaataacccatgagattagg

SEQ ID NO: 24325 - DNA, 601 bp, Human
gtgttccattattggcgcactaagcatgtgggagttacttatatcctactgctcaaggtcattgccaaggtatgatcgaaatttcaaaaaaattgcaacctcaggcataaatgcgttttaagaggtgagacacagagacctgaagtgtgactataaagtaatggctgactttcatttggactcagtcttaccacctcgtagttgcccttcatcaacacggggttactggtgaatttccttgcatcatgtacatcctgttgcagtactggcacattttattctctacataggtaacaacagtaagtgttccagtaagcatggcaactgtaatcatccacatccctcagtataccaaagaaaagaacccactgatgtacctaactggggtgcaaacagacaaggtaaagattaaaaaattgcctaaaaatgtgtactttcaagatgtaaataacccatgagattagggtgatcatgtctgacattttacagatgggaaacagatggtaactcctatgcagcctgggtgccaactgactagcagttaatttcatattagaaaaaatattgttacaagaaaacaaatggctgagtctagggaatt

SEQ ID NO: 24326 - DNA, 601 bp, Human
tcttacattcgggaggactataaatggtccccttgataaaaaaaaaaaaaaaagcttttacagagaaatgtactttcacagaaaacaaaggctctctgttctaagagctggcatgagataattttcctctgcactgactctggttagaatatgccatgtttagatacagtgggatttccatgcccagctaatctgctggcagagccctgagcattttcctcccagtgcttgtgttaggagttgaaagccagtttaagagtctgcccccaaggccagcttggcagttggcctcagtccactsctctggcttggtcaaaaagttatggccccatgaactatgggcctcctcactccatgcctgagagtgaagctcacagcactggagccccactcttgtccaagggaaaatgattctacgcaacagagcacacttctctgcctctggtttaggagcctcagtgaaagcctacaccctctcttcagacactggggcctggaaaatcagaaatagagccaaaggaaatgcagacttcaaattcaaaatgctatgaacttagcataggggagaagtattatagattttttttaaaagctcatttta

SEQ ID NO: 24327 - DNA, 601 bp, Human
gagataattttcctctgcactgactctggttagaatatgccatgtttagatacagtgggatttccatgcccagctaatctgctggcagagccctgagcattttcctcccagtgcttgtgttaggagttgaaagccagtttaagagtctgcccccaaggccagcttggcagttggcctcagtccactcctctggcttggtcaaaaagttatggccccatgaactatgggcctcctcactccatgcctgagagtgaagctcacagcactggagccccactcttgtccaagggaaaatgattcyacgcaacagagcacacttctctgcctctggtttaggagcctcagtgaaagcctacaccctctcttcagacactggggcctggaaaatcagaaatagagccaaaggaaatgcagacttcaaattcaaaatgctatgaacttagcataggggagaagtattatagattttttttaaaagctcattttagaaaaacatagtgttcagacaatatgtgaaactctactgaagactgtttttagaaagcagtattaaatatatcaattggaaattcaaatgaacaattttaataaatccattaga

SEQ ID NO: 24328 - DNA, 601 bp, Human
gcagctgagctctctggatataaatttccttctagcaggtggtagatatcaggtcatcagtctgcacacctcccttcagagcctcagggattcccagaggtgcatcagaggacgtgggcagccaagggggtcagaggcaccttacaaaataagccacgggtggtaacattcttatatcatcacctttacagctcggcttcttcaaaagaaaatatgaaaagatgaccaaaaatccagatgagattgatgagaccacagagctcagtagctgaaccagcagacctacctgcagtgggaaccrgcagcatcccagccagggtttgctgtttgcgtgaatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttt

SEQ ID NO: 24329 - DNA, 601 bp, Human
gcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagamtaaggcacaaaattttgtttaaaactcagaatataacatgtaaaatcccatctgctagaagcccatcctgtgccagaggaaggaaaaggaggaaatttcctttctcttttaggaggcacaacagttctcttctaggatttgtttggctgactggcagtaacctagtgaatttctgaaagatgagtaatttctttggcaaccttcctcctcccttactgaaccactctcccacctcctggtggtaccattattatagaagccctctacagcctgactttctctccagcggtccaaagttat

SEQ ID NO: 24330 - DNA, 601 bp, Human
cttttagaccacggctgccccttccacaccccatcttgctctaatgatcaaaacatgcttgaataactgagcttagagtatacctcctatatgtccatttaagttaggagagggggcgatatagagaataaggcacaaaattttgtttaaaactcagaatataacatgtaaaatcccatctgctagaagcccatcctgtgccagaggaaggaaaaggaggaaatttcctttctcttttaggaggcacaacagttctcttctaggatttgtttggctgactggcagtaacctagtgaatttytgaaagatgagtaatttctttggcaaccttcctcctcccttactgaaccactctcccacctcctggtggtaccattattatagaagccctctacagcctgactttctctccagcggtccaaagttatcccctcctttacccctcatccaaagttcccactccttcaggacagctgctgtgcattagatattaggggggaaagtcatctgtttaatttacacacttgcatgaattactgtatataaactccttaacttcagggagctattttcatttagtgctaaacaagtaagaaaaata

SEQ ID NO: 24331 - DNA, 601 bp, Human
accagacgccctcatgcccaggagcatgtccaggcttcagaggtctctctgccgtggcctcagagcgcgcggaggttggcggttgggggaggtgaagctgtccaaagagggacggtgtttaggacaggttaagcaggtaccatccaccactttgggctgggcgatctgccaggcatctgcccccacctagcctctgcccccacctggcctctgaccccactgaacaagaagacgtggtcacatccagggtacactggaaaatctccctgctctggctggggcctgcagagcttgaggaagyttagaatgtccaaagtccaaactctgcccccgccttggttctgccctcctgacccagcctacctacctggacttaacctcaactccatcttgctcttgcagaggctagggctaccacacccttcccagcctggccccagcagctgccacctggccttagccaaccctctatcttttggagatcctgagccaccatgagcacaagtttctacatcagctctttctgccctaactgagaaaaagattttcagactttcaatgccaaatctgcatgatataagataacataggtaaagagatc

SEQ ID NO: 24332 - DNA, 601 bp, Human
gcagaggctagggctaccacacccttcccagcctggccccagcagctgccacctggccttagccaaccctctatcttttggagatcctgagccaccatgagcacaagtttctacatcagctctttctgccctaactgagaaaaagattttcagactttcaatgccaaatctgcatgatataagataacataggtaaagagatcagactggaaagaaagagtcaataatgattccgcaacccttttgcctggtgaccttgagcaagatatttcccctccctgggccaggtttcccccaaaasgggttggacctggatctagtgctctttcccactgctgctggcctgtgagaagcaacttgatatggtagagggagaagaggcttggaggtcccatggccagtgtcctgtctcagatctgttaccaatacctgaacctgaatttccgcacatgttggagggaggggaacagcatgccttctgctgggatgttagtggggctgtaacgagataaagtgcgtaaaatcctctgcacatgtgcctttctccaaggagcacctgaaggctcttgcgctgaggccagaacctggatgcatcctcatt

SEQ ID NO: 24333 - DNA, 601 bp, Human
tccctgggcaaagcaggtgcctggcagccttcaaggttcgtgccagcagaaatgggcacagcagctgtggctggaggcagaaggcctgctcgtgtagtatctttttcctctggctctacccagtgaccagtctaggccaagaggctttcaactgggcaggagtaggggaagcctgatcttgtagaaaaagcagcagcgaagggggcttggtcagaagtaaacaaagaaggaagaagatcccctttgcagtaagaggaattgaggttagatgacacttagaatgccctcgggggtcaaatayaggaaaaatactgaagagccaaggaaagggagcagaactgagaaaaatggccttgttctttttttatctgaggcttagccagggctctttttcctgtcctttctcattctctctctccctccagcttgttgctctggttctagggctgagtcaccagtggggagagggggctgggtgggcagcaagggaagggtcaggaaggatggggagggctgcagtttcagctgccacagggccggcctctggggagatggctaattcgggcagcaaggctggcatagagctgggatccaggcatcc

SEQ ID NO: 24334 - DNA, 601 bp, Human
ccagccaggcacggtggctcacgcttgtaatcccagtaacttgggaggccgaggcgggtggatcacctgaggtcaggagttcgacatcagcctggccaatatggcgaaaccccatctctagtacaaatacaaaaattagctgggcgtggtggtgcatgcctgtaatcccagctacttgggaggctgagtcaggagaatcacttgcacccgggaggcggaggtggcagtgagccgaggttgtgccactgcactccagcctgggtgacagagcaagaccctgtctcaaaaaaaaaaaaaaaaagaaagaaaaaaagaaattcctgggtccctggagggagggctggaggcatgctagaccagtcctgatgccacaacaaatcggaacaacaatgctcacattagctatggcttcatatcagaacacctttttgtagaatagacctatttgttcctctagcaaccctggaggtcagcaggagaggggctgcccccattttacagatggggcactcagggctcagagaaggaaaggaaattgccccttcaggcagaacaaaccctagacccaggtccgtgggttctcaggctgagatgctccttt

SEQ ID NO: 24335 - DNA, 601 bp, Human
gggtggatcacctgaggtcaggagttcgacatcagcctggccaatatggcgaaaccccatctctagtacaaatacaaaaattagctgggcgtggtggtgcatgcctgtaatcccagctacttgggaggctgagtcaggagaatcacttgcacccgggaggcggaggtggcagtgagccgaggttgtgccactgcactccagcctgggtgacagagcaagaccctgtctcaaaaaaaaaaaaaaaaagaaagaaaaaaagaaattcctgggtccctggagggagggctggaggcatgctagrccagtcctgatgccacaacaaatcggaacaacaatgctcacattagctatggcttcatatcagaacacctttttgtagaatagacctatttgttcctctagcaaccctggaggtcagcaggagaggggctgcccccattttacagatggggcactcagggctcagagaaggaaaggaaattgccccttcaggcagaacaaaccctagacccaggtccgtgggttctcaggctgagatgctcctttcccgcaggctgtgggtcccttctctcatctgtcaggcacgccagagagcggatgt

SEQ ID NO: 24336 - DNA, 601 bp, Human
tcgacatcagcctggccaatatggcgaaaccccatctctagtacaaatacaaaaattagctgggcgtggtggtgcatgcctgtaatcccagctacttgggaggctgagtcaggagaatcacttgcacccgggaggcggaggtggcagtgagccgaggttgtgccactgcactccagcctgggtgacagagcaagaccctgtctcaaaaaaaaaaaaaaaaagaaagaaaaaaagaaattcctgggtccctggagggagggctggaggcatgctagaccagtcctgatgccacaacaaatcrgaacaacaatgctcacattagctatggcttcatatcagaacacctttttgtagaatagacctatttgttcctctagcaaccctggaggtcagcaggagaggggctgcccccattttacagatggggcactcagggctcagagaaggaaaggaaattgccccttcaggcagaacaaaccctagacccaggtccgtgggttctcaggctgagatgctcctttcccgcaggctgtgggtcccttctctcatctgtcaggcacgccagagagcggatgtccatgggtggtcaggcagtggactc

SEQ ID NO: 24337 - DNA, 601 bp, Human
ttcctccgcatgcctacactgggtgctcagccttcgtgggaacaagccgagggagccgagggaactgcaaggaggagaaagggcagagagggccccaggcagctcagcgctggctggcgctccttcctgggaggctgactgccggaagaggcccagccctgctgaccccggctcacccagctctggtctgggggctaatcaaatgtgtcacctcctgcccacattctatagtggcagcccctgagttctccatttctgggtcccagatagacatttccccccgcatttttttctctctctstctcttgttgttgttgttatattccaaaaaggattttgattttattgcttcacacacagaagagttctggttaaggcttgccttgctcctggtgctcatatgatgccaccaggatgtgatttatctcaagcacttaactctgtgttcttcgtgttgcctccattctttgataggcattcttttcgtagtgccaagatgaatgcaacagcttcagctttatcttctttgaccttcaagttctatagtcccagtagatatctgactacaactcattagctctgactatttcaggtactcctc

SEQ ID NO: 24338 - DNA, 601 bp, Human
gcagtggcacattcatggctcactgcagcctcgacctccccaggctcaggtgatcctccaacctcagcttcttgagtagctatgaccgcaggcatgtgccactacacctggctaatttctgtattttttgtagagatggagtttcaccatgttgctcaggctagtcttgaactcctgggcttaagcaatccaccctcctcggcctcccaaagtgctgggattatgggcatgagccaccatgcccagcctcaatcagtcttttttatttatttatttatttatttatttatttatttatttrtttatttttttgagacagagtctcactctgtcacccaggctggagtgcagtggtgcaatctcggctcactgcaagctccacctccagggttcacgccattctcctgcctcagcctcttgagtagctgggactacaggtgcccgccaccatgcccggctaatttttttgtatttttagtagagacgggctttcaccgtgttagccaggatggtctcaatctcctgacctcgtgatccgctcacctcggtctcccaaagtactgggattacaggcgtgagccaccgcgcccagcctaatcat

SEQ ID NO: 24339 - DNA, 601 bp, Human
tggcacattcatggctcactgcagcctcgacctccccaggctcaggtgatcctccaacctcagcttcttgagtagctatgaccgcaggcatgtgccactacacctggctaatttctgtattttttgtagagatggagtttcaccatgttgctcaggctagtcttgaactcctgggcttaagcaatccaccctcctcggcctcccaaagtgctgggattatgggcatgagccaccatgcccagcctcaatcagtcttttttatttatttatttatttatttatttatttatttatttatttatttttttgagacagagtctcactctgtcacccaggctggagtgcagtggtgcaatctcggctcactgcaagctccacctccagggttcacgccattctcctgcctcagcctcttgagtagctgggactacaggtgcccgccaccatgcccggctaatttttttgtatttttagtagagacgggctttcaccgtgttagccaggatggtctcaatctcctgacctcgtgatccgctcacctcggtctcccaaagtactgggattacaggcgtgagccaccgcgcccagcctaatcattctt

SEQ ID NO: 24340 - DNA, 601 bp, Human
gttgctcaggctagtcttgaactcctgggcttaagcaatccaccctcctcggcctcccaaagtgctgggattatgggcatgagccaccatgcccagcctcaatcagtcttttttatttatttatttatttatttatttatttatttatttatttatttttttgagacagagtctcactctgtcacccaggctggagtgcagtggtgcaatctcggctcactgcaagctccacctccagggttcacgccattctcctgcctcagcctcttgagtagctgggactacaggtgcccgccaccaygcccggctaatttttttgtatttttagtagagacgggctttcaccgtgttagccaggatggtctcaatctcctgacctcgtgatccgctcacctcggtctcccaaagtactgggattacaggcgtgagccaccgcgcccagcctaatcattcttaaaatactcttatgaggcaagtattattatatccattttacaaaaacaaaaactaagacttagagaagtaaattgcccaaggccaacaaagttatgaaacctggattggaatacaggtccatctgacttcagtttaaccatttaca

SEQ ID NO: 24341 - DNA, 601 bp, Human
gccaggcacagtggctgacacctgtaatcccagcactttgggaggccaaggcagatggatcacttgaggccaggagtttgagaccagcctggccaacatggtgaaaccttgtctctactgaaaatacaaaaattagccgggcatggtggcgcatgcctgtaatcccagctactcgggaggctgaggcaggagaatcgcttgaacccaggaagcggaggttgcagtgaggcaagatcacaccattgcactccagcctgggcaacaagagcaagactgtctcaaaaaaaaaaaaaaaaaaaaaaaaggaaaaaagaattgttaaagaggatgtgttttataaatggcaaaatgctcaccaataaaaggggttattactatccttgttgggtgggggtgggggtgggctggacatggtagaggaaaccagaaaccggtggtgacttatactccctactctccctccctcaatccctgtgaaggaaacagctacatgattcagcgcaaggagtgggacttatctgagtatagttacaaggacccagaggaccaaggaaacctctatattggtgagtacagtagtggtagcccatcaagtggtaga

SEQ ID NO: 24342 - DNA, 601 bp, Human
tgggtgggggtgggggtgggctggacatggtagaggaaaccagaaaccggtggtgacttatactccctactctccctccctcaatccctgtgaaggaaacagctacatgattcagcgcaaggagtgggacttatctgagtatagttacaaggacccagaggaccaaggaaacctctatattggtgagtacagtagtggtagcccatcaagtggtagaggggaagggggcttagtccctggtggaaaggtgaggccagagtgcagttgtgactaatggcatttagttaaactagcacacacrgattggccggcacctgtatgccaggccctgttccaagctcccaagatgcaaagttcttgacttcaggatgctcacagtccagtgtccaggcagaactgggccatggctgctggccatctggagtctactttcttgccctacttggaatagtgggatagaacatcatggtggggggcaagagagggaatagggagatgggtccagagtagaaagagacgaagttgactgggaccttggttgaacatcttccctctatcccagggtacacgatgcaggtaggcagcttcatcctgcacccca

SEQ ID NO: 24343 - DNA, 601 bp, Human
tagtgggaagcctgtcagaccacattgtgctgctgcggtgagccaggaggccagtgaataagggtctttctcttcttcatctttgtctgcacagattcccatctgtgtccatgtttgcgctagctccttggaagcctgggccccaactctggcctggggcaggcaggaggcactgatatctgtctggctctgttgtctctgcagggcccggcccgtcatcaacatcgtccacaagaccttggtgcccaggccagctgtgctggaccctgcactttgcacggccacctcttggtgagattgytctgcccacctactcctcatttatttatagggaggctaggaggggctgcagctcccaaacccctcccctggcctcctgacatcccacctttagaaatttgattcttggggccagcatttgccctctctacccaacctcattaaaaagcaaaattccttgtaagaggtaatggatgaagtcgggggcagtagagtatagtggttcaaggtgggagctctggacggcctggttcaaatcccagctatgccagtgcaggggtggggatgggctctggaaagggggacgcatttaagtggatgg

SEQ ID NO: 24344 - DNA, 601 bp, Human
gtgtccatgtttgcgctagctccttggaagcctgggccccaactctggcctggggcaggcaggaggcactgatatctgtctggctctgttgtctctgcagggcccggcccgtcatcaacatcgtccacaagaccttggtgcccaggccagctgtgctggaccctgcactttgcacggccacctcttggtgagattgttctgcccacctactcctcatttatttatagggaggctaggaggggctgcagctcccaaacccctcccctggcctcctgacatcccacctttagaaatttgattmttggggccagcatttgccctctctacccaacctcattaaaaagcaaaattccttgtaagaggtaatggatgaagtcgggggcagtagagtatagtggttcaaggtgggagctctggacggcctggttcaaatcccagctatgccagtgcaggggtggggatgggctctggaaagggggacgcatttaagtggatggatatggaggagagtctcctcaggtgaattattaatccctcttaggctcagatttcttgcttgtagaacagaattgataataactgattcacagggttgttgtga

SEQ ID NO: 24345 - DNA, 601 bp, Human
tgggtctgaaggtctctcctaccatccaccctgagggggagaacaacagggagagggcgagtccagggtcatagcatgggtgtgtgtgtgtgtgtgtgtgtgtgtgtgtgtgtgtgtgtgtgatttgcgtgtctttgcatggatgtgtatgtgtttgtccccagccaaaatgacctttctcgtgtccattattctgttatgtgtccattactgtcccacctccatgcctttccccagggtgttccttaaccctggaatgctcatttcccctcttttatctctgcgtgtaaacccctatttygttttcaaggtccctgtcagatgcttcaccatcagtgagctcttttctggcttttccagctgaaaatgacctctcttccaatggccacccacctaactttctcagaagccacacatgccatttatcacgctcgactctgggttgcaatgcctcacgtgcccactttctcatgccatctagaccaaactttttctgtacatgactagattagaaatcttttcaacttggcgggccatagagtttctgttgcaactactcagtactgccattgcaccacacaaacagccatagacaaatgaa

SEQ ID NO: 24346 - DNA, 601 bp, Human
gtttctgttgcaactactcagtactgccattgcaccacacaaacagccatagacaaatgaatgggtgtggccgtgcgccaaaaatacttcatttacaacagcaggtgccagtccagatttagcccacaggcctgacctagactgtgaccttcattgtttcggttgtccccagcatccagcacaggacctgacgcagaaatgaatgaacaaataaatgaatgatgcgcatttgtgtgtggaggggaggcctggctgacagatcctttggggtgctgtttaaggatgctacttggtgggagggtgatggggtgggaaagcttagggtcggaggtaggctcagagaagtgtcaagtgttccccttgacccaccccactcccaatccaggattacagagactttgaccgagtccgggtaaatggctgggctaccctattcctccgaaccagcatccccaccatcaacatggagaacaagaccacgtgggtgagtgcgcatgttcactaggacagcagtctccagccagagcttgagagtacagggcatcttttaagaggacactgacgcacttcagccatatggttctcaatcttggccacacgg

SEQ ID NO: 24347 - DNA, 601 bp, Human
ggctgacacagggctgagtcctcctctccccgctccagttctctgtggacattgactcggagctggtggaggagctgccggccgaaatcgagctgtggctggtgctggtggccgtgggtgcagggctgctgctgctggggctgatcatcctcctgctgtggaaggttagtagcccagcccactcctgctccgggacctccaccagcacactcaccagcccttcctccaacccacgtctccccatcctggtcctcccttccatctcacccccacccttcctccctgtcctctccaccttctmccaccagcttacagtctcacccctggcctgggttagtggggggagctgcaagctggaaagggggacccaggagctctggcttctgaccacaccaccaagctgggactgagccccagcccccaggctccccagccctaaagccctggtccacgagtgctgctggtgaggatagcccagcgcccccctgatggcccgtccccacctcctcccctccgcagtgcggcttcttcaagcgagcccgcactcgcgccctgtatgaagctaagaggcagaaggcggagatgaagagccagccgtcag

SEQ ID NO: 24348 - DNA, 601 bp, Human
ccaccaccaccccaaagatcaggtcactctgactgtccctccagccccctgggtgtctggctttcatcagcctccccctaagccccttggtgacttgggaccccatgagggaggcataaatcctctctgtgatgaccttgctttctggggattggaacaaggtcaagggcaaggccaggccccatctctgtaaaccacagccatgtccagaataattctacactcccatttccacccctagggaaggaggggagcagtagagaccctcctcctgggaactagcctgtttcctcctgagcamcccttccaggataacaaatggacccattcccaacattgtggtcagggtagactgcccagtcttcctggccattccatccactgtctctgcagctgccctcggtctccatctgcctcttcctctgctctctgccttcctcaactccttcttcctctggggcctggggtggagaaactcatcctccgtatctcagtgcagagagatgggatgcgtttcggtcaagagttctggctttgaggagttctgggtgggagagggagaggcctggcactccttcctggtggctcaaactctggatgc

SEQ ID NO: 24349 - DNA, 601 bp, Human
gcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggartgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagtt

SEQ ID NO: 24350 - DNA, 601 bp, Human
gccacagactgaactcgcagggaatgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgygtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgtatgcagctgcatctgcttccacccactcccc

SEQ ID NO: 24351 - DNA, 601 bp, Human
cctctcccccaagcccacacagaaaagtataataatatgattttcaaagtgagcactcagagagcccacccgtggttgggtgaatacttagccatctgcctcctattttcttatcgtaggttgtgacagaatgcctttttctcttgctgcagggtccttgtgggcgcaccaaaggcagattccaaatacagcccttcagtgaagtctcctggggctgtgtttaagtgccgtgttcacaccaaccctgaccggagatgcaccgaactggacatggctcgaggtgggtgaccattactgctgyggtggaaatgggttctgtacccttataccttgctcttcttcttcccaggatggcctgatcattcactcacccatccatccttccctccttccctccctccttctctccaacaagcatgtattgagtacgtaatagttattaagcactgggatacaccagtgaacaaaaaaaacaaggatgctgccatccctagtcccataaattagtgggcaaaagagatattaagacaagtaattgagagagaaaagaccagagggaaggtgagtatttgatttaatctagataggagggtcaagaaag

SEQ ID NO: 24352 - DNA, 601 bp, Human
ctctcccccaagcccacacagaaaagtataataatatgattttcaaagtgagcactcagagagcccacccgtggttgggtgaatacttagccatctgcctcctattttcttatcgtaggttgtgacagaatgcctttttctcttgctgcagggtccttgtgggcgcaccaaaggcagattccaaatacagcccttcagtgaagtctcctggggctgtgtttaagtgccgtgttcacaccaaccctgaccggagatgcaccgaactggacatggctcgaggtgggtgaccattactgctgtsgtggaaatgggttctgtacccttataccttgctcttcttcttcccaggatggcctgatcattcactcacccatccatccttccctccttccctccctccttctctccaacaagcatgtattgagtacgtaatagttattaagcactgggatacaccagtgaacaaaaaaaacaaggatgctgccatccctagtcccataaattagtgggcaaaagagatattaagacaagtaattgagagagaaaagaccagagggaaggtgagtatttgatttaatctagataggagggtcaagaaagg

SEQ ID NO: 24353 - DNA, 601 bp, Human
gcatggctttgaggttgcttattctggactactgcttagacaaatgacttatcttcttattttctttatctgtcaaatgtgaataatgtctgtcccaaggtgctgagatgtgactattgaaaaataaaacatatgtgaaaagtgctttgtacatctcattcattacataggtatttgtgtgtgtgtgtcttaaattgaggtataatttacagtacacaaatcttaagattacagtcttgattttcacaattgtacacacctgtgtaaccatatgcccactgagatatagaatatttccatygtcccaaaagtctccgatgtccctttccagccaactcctctcacctgagacaaaccacagctgtgatttgtataatacattacttttgctttttctagaatttcatataaatggaatcctacagtatgtgctcttttatataagacttctttcactcaaaataatattttctgaaattaatccccattgtatgtatcagtagttcattcctgtttatctctacataatattacattttatgaaataaatgttatttttaactagttatttatcggacctccaaagcacctatgctgtatt

SEQ ID NO: 24354 - DNA, 601 bp, Human
attgtatgtatcagtagttcattcctgtttatctctacataatattacattttatgaaataaatgttatttttaactagttatttatcggacctccaaagcacctatgctgtattttgatccgtaggtgctttgagggagatagaaagaaaagtctttgcatttgagactcctgagatcctggagttgtgctgtgcagtaaggtggccaccagccctgtgtccttatttaaacttaaatttatccaaattaaactagaaattcaggtttttagtcatattagccacatttaagtggctcartaatcacaaatggttactggctactctattggaaagcagagagagagaatattttcatcatcacagaaagttttattagactcaacacgaaaggaatttctaacactgcagaggttttgtttttgtcaatttttcctttaagcttttctatgaggtataatactaaagcacttaacacacccagctgtgagtgcacagcccgatgggttttcacgcatgtacacttatgcatccccattgccagtactccggaaggacccctgcaccctttcccagtcagttcctctgcccttggtgagt

SEQ ID NO: 24355 - DNA, 601 bp, Human
gacctccaaagcacctatgctgtattttgatccgtaggtgctttgagggagatagaaagaaaagtctttgcatttgagactcctgagatcctggagttgtgctgtgcagtaaggtggccaccagccctgtgtccttatttaaacttaaatttatccaaattaaactagaaattcaggtttttagtcatattagccacatttaagtggctcaataatcacaaatggttactggctactctattggaaagcagagagagagaatattttcatcatcacagaaagttttattagactcaacacraaaggaatttctaacactgcagaggttttgtttttgtcaatttttcctttaagcttttctatgaggtataatactaaagcacttaacacacccagctgtgagtgcacagcccgatgggttttcacgcatgtacacttatgcatccccattgccagtactccggaaggacccctgcaccctttcccagtcagttcctctgcccttggtgagtgaacaactgttctgacataggctttctcttgcccttgacttttatcagaagctgtacgaagatttttgttataaaagcgtaagctcaag

SEQ ID NO: 24356 - DNA, 601 bp, Human
caccagccctgtgtccttatttaaacttaaatttatccaaattaaactagaaattcaggtttttagtcatattagccacatttaagtggctcaataatcacaaatggttactggctactctattggaaagcagagagagagaatattttcatcatcacagaaagttttattagactcaacacgaaaggaatttctaacactgcagaggttttgtttttgtcaatttttcctttaagcttttctatgaggtataatactaaagcacttaacacacccagctgtgagtgcacagcccgatggkttttcacgcatgtacacttatgcatccccattgccagtactccggaaggacccctgcaccctttcccagtcagttcctctgcccttggtgagtgaacaactgttctgacataggctttctcttgcccttgacttttatcagaagctgtacgaagatttttgttataaaagcgtaagctcaagaggggaaagtaatactagctgccgcttatggagggcttcatttgggtcacatgctgcaaagctgagggtttcgtgtgtattttatcccagggaaacaggttttccttaaggcactagg

SEQ ID NO: 24357 - DNA, 601 bp, Human
aatggttactggctactctattggaaagcagagagagagaatattttcatcatcacagaaagttttattagactcaacacgaaaggaatttctaacactgcagaggttttgtttttgtcaatttttcctttaagcttttctatgaggtataatactaaagcacttaacacacccagctgtgagtgcacagcccgatgggttttcacgcatgtacacttatgcatccccattgccagtactccggaaggacccctgcaccctttcccagtcagttcctctgcccttggtgagtgaacaactrttctgacataggctttctcttgcccttgacttttatcagaagctgtacgaagatttttgttataaaagcgtaagctcaagaggggaaagtaatactagctgccgcttatggagggcttcatttgggtcacatgctgcaaagctgagggtttcgtgtgtattttatcccagggaaacaggttttccttaaggcactaggcaaagtgtttttgtcccctctctaaggagcccacttttgtgttaaacttcttcatggcataagctgttaatctgaattccgtcctcagcacaattaagcatc

SEQ ID NO: 24358 - DNA, 601 bp, Human
gactcaacacgaaaggaatttctaacactgcagaggttttgtttttgtcaatttttcctttaagcttttctatgaggtataatactaaagcacttaacacacccagctgtgagtgcacagcccgatgggttttcacgcatgtacacttatgcatccccattgccagtactccggaaggacccctgcaccctttcccagtcagttcctctgcccttggtgagtgaacaactgttctgacataggctttctcttgcccttgacttttatcagaagctgtacgaagatttttgttataaaagcrtaagctcaagaggggaaagtaatactagctgccgcttatggagggcttcatttgggtcacatgctgcaaagctgagggtttcgtgtgtattttatcccagggaaacaggttttccttaaggcactaggcaaagtgtttttgtcccctctctaaggagcccacttttgtgttaaacttcttcatggcataagctgttaatctgaattccgtcctcagcacaattaagcatctcccccttgtcgggccccttgggagaggaggaagcagctggatgctgtcgccagcatggtgggggcctcc

SEQ ID NO: 24359 - DNA, 601 bp, Human
atcttattacttatattgtgtgtataatttattttgtggccatatgtccccttttatggaagccacttggggatagagaccaaatctacccactttcattctcagcatctggaggacatctctctaaggaatggcatctgaaagtgtgtttgaataatacagggactgagggtcaatgttaaaacaattagaaaccaaattagttgccatcttttcttggtggctgattctaagtggctgaaggaaacaccaggaaacattctgtaaaatgttccttggaaatggcaggcaaaaacaagawacagtgagtgtccctatttacatttggaggtctcatagccatttgcttttttctttaatgtttcaaccctacctgtcagagctttctgggaggcaagtatttacttttaaattaaaaatgggaaggatatgtgttgttcaggtgcattttgagaacttgagaagtgcctgggggtgtaggcaagagaccagtatccccaaggagcacaatattggattccaaggttgggtttgaagagggagaggtgggctagctcttttgaaagtggtgtctggtgctgatagaaaacctaagaacaaa

SEQ ID NO: 24360 - DNA, 601 bp, Human
tgtgtgcctctgagtaagcagctcggctcttcatcagcacagcagtgacatctggatgtgcagagacatgcacgggaactggggccactgtcatgtccaagcagaaggcaggggcatgtttagtgtggcagaaggacgatccaggcctgcatcctggctgctggcactgctccagtgtctgttagcagagctgccctgcctcatggtgtcttgcgtggcttcgaccctagtgctgagaggctcctctggagagctggccaatgcatctgtccatcttcttcgccagtatgcggagctctcrtgcaccccaagacccttggccatgaaccttccttcagctttctcctcagagaggccttccttgacctgcctggcaaaaccagccactccctggcatgagggaactttctggtgagatggagatgttctgtgtcttgctagggccttggtgacatgagtgtgtacatttgtcaaagctcatttgtgcattttgctgtatgtaagtttccataaaaaaacaactctccacacacatttacttctagttaatgagatgcatgctgaagtgtttctgtgggtagaaacatggttgaatatcagc

SEQ ID NO: 24361 - DNA, 601 bp, Human
gctccacgcacagctggcatacactgacatggctgtggtttgcttctctctccttccttgcccctagagtataagaagaagtacggagaggaacacggctcctgccaggctgggatagcgggcttcttcaccgaggtgggtgtctgctgtctgggcatttctgttctcttgtgggtgttcatttccttgcttatatgattttggcaacccttagaggtgggacttctggagtcccagatacttgagcctcgagggagcagattctggtcctcacaccagaggaggctatttctacctgccmggagggcaccagctggccagagaccactgggcagaggaggtggggtggctcatctcgaggctacccctatttgatgatttttgtaggagtctgcttgactctgagacctggggaaggagtcgatttggggatgtgtgagtgagatgacattcagtcaggttgtgccccatcattggcgactgtgcagatacatgaagcgtgtgagcatcccctcctagcagccttctctccttagtggagagacttgtttgtttttcgagacagagtcttgctatgtcactcaagctggagtgcagtggc

SEQ ID NO: 24362 - DNA, 601 bp, Human
tacggagaggaacacggctcctgccaggctgggatagcgggcttcttcaccgaggtgggtgtctgctgtctgggcatttctgttctcttgtgggtgttcatttccttgcttatatgattttggcaacccttagaggtgggacttctggagtcccagatacttgagcctcgagggagcagattctggtcctcacaccagaggaggctatttctacctgccaggagggcaccagctggccagagaccactgggcagaggaggtggggtggctcatctcgaggctacccctatttgatgatttytgtaggagtctgcttgactctgagacctggggaaggagtcgatttggggatgtgtgagtgagatgacattcagtcaggttgtgccccatcattggcgactgtgcagatacatgaagcgtgtgagcatcccctcctagcagccttctctccttagtggagagacttgtttgtttttcgagacagagtcttgctatgtcactcaagctggagtgcagtggcgtgatctcggctcactgcaatctccgcctcctgggttcaagcaattctcttgccttagcctcccggttataggcgcccacc

SEQ ID NO: 24363 - DNA, 601 bp, Human
catttccttgcttatatgattttggcaacccttagaggtgggacttctggagtcccagatacttgagcctcgagggagcagattctggtcctcacaccagaggaggctatttctacctgccaggagggcaccagctggccagagaccactgggcagaggaggtggggtggctcatctcgaggctacccctatttgatgatttttgtaggagtctgcttgactctgagacctggggaaggagtcgatttggggatgtgtgagtgagatgacattcagtcaggttgtgccccatcattggcgrctgtgcagatacatgaagcgtgtgagcatcccctcctagcagccttctctccttagtggagagacttgtttgtttttcgagacagagtcttgctatgtcactcaagctggagtgcagtggcgtgatctcggctcactgcaatctccgcctcctgggttcaagcaattctcttgccttagcctcccggttataggcgcccaccgccacacctgtatttttagtagagacggggtttcgccatgttggccaggctggtcttgaacacctgacctcaggtgatctgccagtctcggcttccca

SEQ ID NO: 24364 - DNA, 601 bp, Human
agattcagaaggacaggacacctgcatgcttatgtgcccgtgtggtagtagcatgacttttggctggtagtacatttttagggactgttttcttgtgtcattcttacttactgtaagtttgcccttcgtatcagttcctcctctctcaaacactttcatgactgcctgctggcactgtctatccatgtggttgctcaggccaaaaaaagagtactttttacttctaattcatctgcagtcctgttgttttagcctccaaaacacatcccaaatatgacagcttttattactattacaatcrcctccattatcaccatcatgcttctagaaaggccaccaccatcacctggaggtacactggccctgattggtcttcttatgtctattatgcttttttaaaaattgtggtaaaagatgcataatataaaagtcaccactttaaagtgtgattcagtggcattagtgcattcacagtgttgtgcacccatcaccatgggctaggttagaacactttatcacccagcctgcatccattctgacctgtgaagtgtgctttctgcatactagccccagggtccttcaaatgaaacccatccttctg

SEQ ID NO: 24365 - DNA, 601 bp, Human
gttgtttttaaaaaagatttcgatctttaatctttctggaatttgtgttgtatacattgtgtgatagaaactaactacattatttttctaaatatatagttggttgttctgatactggtttgttaaacaacttttcctctccccattgaaatgccatcctgccgtgtggcgacttcactctcttcttccatctcagcaaacatttagattgtgtgacaactatggctgttgttcctccaacaggcctgtctagtattgtatgacttgagtcaataggcagtgggaaccactgtaagttcayaagcaggtgacacactggcagatggcagtgttgaaagaaaggctatttgagctgggtttgcccagaactttgggagtggaagggcctgaagggaggcctggtaggaggccgtgatgtggtaggaggccgtgaagcaacaggacagtgtagagggaggcttaaggaataaaaatgattgggggaggcagagaatatgaaggaaatgtcaaggggctgggtggccagggagctgtggggtagaggaaggagggtttgagccaggcttctggagaatggtggtgcctctggtgaaaaggggtt

SEQ ID NO: 24366 - DNA, 601 bp, Human
ccaggagggaagtgtcattatgtttgccgcagcagctggcaagtcaggcattgggctgagtggaggcagggagtggtaggaggaaccggcggggcaggagtgtggaggggaagtccaggtagctgtgcaagctcagggtgaccagaagaacagaagacctgctgaaatccaggctttgggatttagaacctgagggaaacatggggtgtcagcatgtgctggctgtgctcatggtacagcaaagtggggacatggtgggtgtacagagtgtccggggagggtgggcagtggtgagtgggawggcagcccctctgggcgccactctgtcctctgaccccggcctgctgtctcctggctactttggactttggcctccgcttcagttcccaggcttttggcctccttaaacaggaggtctttgaactcactgcctgccttgtttctggaagttcagctgtttgtggctgagcaggaaatgtggttgaagggtccaggccagcgcgactcccctcctctgccctcttgctgacctcgccacttgggcttgccttttctgtgagctgttgtcccctcccaagctggacatggatctgtggccttc

SEQ ID NO: 24367 - DNA, 601 bp, Human
cctgaattttagcctgacattgaggattagagagaatttcctgggaggtttatttatttttgtagatgaggctaacagaggtagtagatactgcttagcagcaagagaggatttggaccagctgggctggcgttcacgcctgctgtagaagcctagaggcacttgggtgggagtttgttcagcacggacttctgttgtagatcccgggcactcctgcccagctgctcatgccaacttgcagtacacagaggaaatatatggcttctcccaggcccacctacataccccggttcctctaggkgttctgctaataaatgcatcttgggaaaaagctgcattgcttattgatgggattccacaaatgtgatttaggtagtggtggcctttgcttagagaagctttcatttgtgtgtgtgacattgacactggctgttcctgcatggtggggagctaagtattagtcactttttcctagcacttgtgaacagcaccagaaaggtcacaagcatcatccatagggaacagaaaaaacaactatgagggatttccaggaaggcactgtccctcccttcagcctcagccctgagggtcgcaggcttgg

SEQ ID NO: 24368 - DNA, 601 bp, Human
aatggtgagcctggagtccaggcagggtgcggtattgcttactgcttttcatgagtggtgttccccagaatctgtggttgaggtcaatgtcagctgtttgtcatttccttgttagagcctgatgtaaagttgaggaaacgtgtgtggtctcatcgtggatagaataggggcctggcctgtcgtgaattctgtcaccttgctcagtctcttcacatctttagtcctgataatcccgtctgtataatagattccataatgctgatgaatctggtgaaatctgtttttgttgcttagctggggmaaaaaaagttcttggtgtgaggaatttctcctttgttgtgactgtggttctcattgcattcccctcctcccctcctcacttccttctctgcttaccgttggatttctttttggtaggagctggtggtgatgggtgctccagggtcattttattgggctggaaccatcaaagtgctgaaccttacggacaacacctatttaaaactgaacgacgaagtgatcatgaacaggcggtacacctacctgggtgagtactcagggagagaacaggtaagaaaggggaaatgggagtgattcccac

SEQ ID NO: 24369 - DNA, 601 bp, Human
ggttcttcaaaactgaaaccagataaaccagggccctgagctggcagggaggagggatcaagcaggtgaccttcgatcacctcaagaaagaggtggttctttctgagttgcatgaatttatctaagtagagaaagaagcactgagagctgttcacattgatgttgtcttcttggggaggggctgcgggctaccgggcatctctgtagaaatggtaaaaatgcctacgtctagttcacagtgatgcgggtgcctctatgctaatgatagcagctttcttttctccctaattgcagaaaacaygacccagttttatagtttttccttcagatgattgtgatgaacttcatagtccctgtcaagtcttaagatgacccctccgcaaacccctctcactggctatctggggggtgcaaggtataaagttaaaaagttgagaatggtacttataattgatagagccagacagcgggactcctggacccagtttataaagtacataaaaatgcttctttcaattagaccacctgagaggcatggggaaactggtcatagtgacaaagttgctgacaattccacattcccagggattggggctagtac

SEQ ID NO: 24370 - DNA, 601 bp, Human
tcttcaaaactgaaaccagataaaccagggccctgagctggcagggaggagggatcaagcaggtgaccttcgatcacctcaagaaagaggtggttctttctgagttgcatgaatttatctaagtagagaaagaagcactgagagctgttcacattgatgttgtcttcttggggaggggctgcgggctaccgggcatctctgtagaaatggtaaaaatgcctacgtctagttcacagtgatgcgggtgcctctatgctaatgatagcagctttcttttctccctaattgcagaaaacacgayccagttttatagtttttccttcagatgattgtgatgaacttcatagtccctgtcaagtcttaagatgacccctccgcaaacccctctcactggctatctggggggtgcaaggtataaagttaaaaagttgagaatggtacttataattgatagagccagacagcgggactcctggacccagtttataaagtacataaaaatgcttctttcaattagaccacctgagaggcatggggaaactggtcatagtgacaaagttgctgacaattccacattcccagggattggggctagtacaga

SEQ ID NO: 24371 - DNA, 601 bp, Human
gcaacagttttcatgagcttatcagtcatgcacttcttgtgtggcttagatcagcaggactgtttggctgagcttggctactctaagggacacaagtttaggctgggagctgtgggggtaatttggaggtcttggtggaggccttagtgggatctgggaagaagcataggatgtctgggacatgggaggaggccatgtgcctcctcaattctgttcctgccgagttagaactgctgtacgccagcctaggatccttccatgttgttctcccattcaagtagacctttttgcaattttaacwatccgaataggtacacttagtgtataattgtcattatcttttgaataaaaaatgcatcaccaaacttggttttgcatttttcctcagaatggctctgccttcccgagaactctgctggcttgtgttattttaacatttccaaaaccccaaagcaacagcactggaaaatgactgtgagccattctgcaaaagggttttccaagcacccttaaagttagaaaagaaataactctgtgctacttgtgatttacaaaagagagtttcaaagagcaagtagggtatgagtggaattaaggctaa

SEQ ID NO: 24372 - DNA, 601 bp, Human
taacatttccaaaaccccaaagcaacagcactggaaaatgactgtgagccattctgcaaaagggttttccaagcacccttaaagttagaaaagaaataactctgtgctacttgtgatttacaaaagagagtttcaaagagcaagtagggtatgagtggaattaaggctaacattttagatcttctgcagaagataacaaatgggtgaatgtatctagcatggaaacaatctccctcttcccttcaaatgtacctgggtttgaaagcctaaaggtaaaggattcctttttttttttttttttgagacagagtctcactatggcatgatcttggttcactgtaacatctgcctcctggactcaagccatcctcctacctcagcctcccaggtagctcggaccacagacatgtgccaccatgcccagcaaatttttgtatttttttttgtagagatgggtttcaccatgttgcccaggctggtctcagactcctgggctcaagggatccacccaccttggcctcccagagtgcgggatgataggcatgagccaccgcacctggccaaggattatttaaaatgaattgtggagtttctgagtatc

SEQ ID NO: 24373 - DNA, 601 bp, Human
gaaaagaaataactctgtgctacttgtgatttacaaaagagagtttcaaagagcaagtagggtatgagtggaattaaggctaacattttagatcttctgcagaagataacaaatgggtgaatgtatctagcatggaaacaatctccctcttcccttcaaatgtacctgggtttgaaagcctaaaggtaaaggattcctttttttttttttttttgagacagagtctcactatggcatgatcttggttcactgtaacatctgcctcctggactcaagccatcctcctacctcagcctcccargtagctcggaccacagacatgtgccaccatgcccagcaaatttttgtatttttttttgtagagatgggtttcaccatgttgcccaggctggtctcagactcctgggctcaagggatccacccaccttggcctcccagagtgcgggatgataggcatgagccaccgcacctggccaaggattatttaaaatgaattgtggagtttctgagtatctttatgttcagttgtagctgtgcccccccaaactgcttttccttccctgccctactccttactgtctgtgccctggggaggtccggt

SEQ ID NO: 24374 - DNA, 601 bp, Human
gccatattgaagttttattgaattaacggagtatgtgaagcatttgtatttcaaaactgagataggaaacttcacatatagagatttctaatttaacattgatgaagatgccaagttaaatagtcctttggaatgaaacaaatagttcccctggggctcagccagtgagcgcagccagcagcttggctctttgggtctttgcctgtgtcttactgatttcttttaccaaagctcagatggggagattggcaaggccactgaaatagtgactggcaactcggtttctttcctcctcaccctytgtgatttcaaccctttcctgctccgttctcctttgagaatgggtaatcagaggggaggaagatggccttggcatatcactggggaaggatttctgagcggccactacaaagccctcctgtgaccctgttagctgcaggaaatagattggagtgtcctctacctctctccctcaaactccctgggtcagctgccaacaaactccaacagtaaaagaaaaggcttgttcatgtccatcaacccaggggccttttattagaaaacatttattttaaaagaataatgctttttctccttttct

SEQ ID NO: 24375 - DNA, 601 bp, Human
tggaaaaaattctgactttggagcaaggtggacctgagtttgaatcttggttttgccatgtcctagcctgtgtgatgtggacaaatggcttgaaattggtggcccaatttcctcatctgtaaagtgagaggcatcataagatcttccttatggagtcattgtgtgatttgaatgaggagctggctgtacagtacctggtacataggagcaatcagttgctggtgttcctctcctcttccccactacactgaaagaaagaaattaatgcatatttgtgttttggggtggaggtttcattcayccaagaaatcatctcaccttgactgttttcaaggtgtaaattgtgtttatagtgaaaaagaagacttggtcatgataaaagccagacactcgtgggatggcctgtaggatatagtgggcccagactgcctctgcactggggaatgcatacatcttctcatgtctcaggacatcagattgcattgtatcactctggtcttcatgtgtcagtgatttggggtgagagtaggtatgactttttcccccaagttagatgacttttcctgcctttgtacaccattaaccccctccctctgttggt

SEQ ID NO: 24376 - DNA, 601 bp, Human
ccctctatcaagataactcatatatgcactttgcaaaacagttttataaacttgtaccaaaaggcacaggaaagaaaaaatagaaaaatgtatacccttttaaaacaacattggggaaaaagtgctatgccttaaggacgtggagagcacatgggggaaaggtgggtagggaggtttgcttgtgtgtagtgtattaggacaaggcagagagtgtagtcattggctaccatgacattctccttccctcaaaaatgcatctcaggctatgggagaccatcctgctaagcaggtaaaagggackcattttgccagcaggagagagaagtttgggttcctgtaattctgcccaggtgtttcctgtcaatgagtgtgctctagcagggcagcattcaaactctggttttttattgatttttattgtttgttctgtttgtttttgttttgttttccattttctcctccatcctgtttcccagggagccctcgaggagcagctggctctgactggggatggtgcctacaatgcgcactttggagagagcattgccagcctggacgatctggacaatgatgggttcccaggtgagtgagtgctcctggt

SEQ ID NO: 24377 - DNA, 601 bp, Human
atccccttcgaaggcccatcaatgtgctgtggggagataggacacgtttagaggtgctctccctgtagacacgcagggctgagcttccagcccactggagttttgcctctgcataatcccttctcaccagctcagtgttctttgttgtttgcagtggaagcaaaccttggggctggtccatttgggacttcttatggcaagaagtttgaatagcttcatcctgccatcaactctccttgtttctgagcctttgatgctccatcatgctctaccatgttgatggggaaatgagtgaggagaraattagaaacccagacatcttctgcctgattatagcagcagctagattgacttttgagagtgtacgcgtgtgtgtgtgtgtgtgtgtgtgtgtgtgtgtgtgtgtgtgtgtcttgggaggcatggaggcatatgtacctaatgtctaggtctgtttggacagcagtgttcctcacagcctcttggcctctctctctggcttgtttgagcctcttcacctcgctgcatacacagcatacagacgtcgggaggcagagcaaccatgtcaccagggcatgtggtggtggaggtggggcaaccc

SEQ ID NO: 24378 - DNA, 601 bp, Human
cagtttgtgagagtaatgttatttcttgtgtgtgaagtgaatgcccttctgtatatttcctttatccaggaatggatttattatcaaataataataaggaatggtcctttatccaggacctcagactttctcagttacacaatagccattgtctatggaattctccctgatggaaattatggcacgtagtttatatttgcatttcttttattggatgggtcagtggtttttcttacgagcataaggtagaaacttttttggaactaaattcttctcagtcagcttctatagttttcactgkactttttttttttttttttttttttttgagatggagtctcactctgtttcccaggctggagtccagtggcacaatctcagctcactgcaacctccgcttcccgggttcaagtgattctcttgcctcagcctccagagtagctgggacaacaggtgcgtgccaccacacccagctaatttttgtatttttagtagagctggggtttcactatgttggccaggctggtcttaaactcttgacctcaggcgacctgcccgccttggcctgccaaagtgctgggattacaggcgtgagccacca

SEQ ID NO: 24379 - DNA, 601 bp, Human
agatggagtctcactctgtttcccaggctggagtccagtggcacaatctcagctcactgcaacctccgcttcccgggttcaagtgattctcttgcctcagcctccagagtagctgggacaacaggtgcgtgccaccacacccagctaatttttgtatttttagtagagctggggtttcactatgttggccaggctggtcttaaactcttgacctcaggcgacctgcccgccttggcctgccaaagtgctgggattacaggcgtgagccaccacactggcctacttttttttttttttttttcctgctgagggatcttgtccccaaattaatgcttgaacaatcaacaaccaataatttctggtatccagggactcagacatgacaaccagaattagggaagctgcacttgtattattaatgtggctttttaacccatagctgtttttttaccctcagatgtggccattggtgcacccaaggaggatgacttcgcaggggcggtctatatctatcatggtgatgccggtgggatagtccctcagtactcaatggtaattagtgtgagagtgatatggcaactgttcatacattcattcagca

SEQ ID NO: 24380 - DNA, 601 bp, Human
tggagtctcactctgtttcccaggctggagtccagtggcacaatctcagctcactgcaacctccgcttcccgggttcaagtgattctcttgcctcagcctccagagtagctgggacaacaggtgcgtgccaccacacccagctaatttttgtatttttagtagagctggggtttcactatgttggccaggctggtcttaaactcttgacctcaggcgacctgcccgccttggcctgccaaagtgctgggattacaggcgtgagccaccacactggcctacttttttttttttttttttccygctgagggatcttgtccccaaattaatgcttgaacaatcaacaaccaataatttctggtatccagggactcagacatgacaaccagaattagggaagctgcacttgtattattaatgtggctttttaacccatagctgtttttttaccctcagatgtggccattggtgcacccaaggaggatgacttcgcaggggcggtctatatctatcatggtgatgccggtgggatagtccctcagtactcaatggtaattagtgtgagagtgatatggcaactgttcatacattcattcagcaaac

SEQ ID NO: 24381 - DNA, 601 bp, Human
gtgattctcttgcctcagcctccagagtagctgggacaacaggtgcgtgccaccacacccagctaatttttgtatttttagtagagctggggtttcactatgttggccaggctggtcttaaactcttgacctcaggcgacctgcccgccttggcctgccaaagtgctgggattacaggcgtgagccaccacactggcctacttttttttttttttttttcctgctgagggatcttgtccccaaattaatgcttgaacaatcaacaaccaataatttctggtatccagggactcagacatgrcaaccagaattagggaagctgcacttgtattattaatgtggctttttaacccatagctgtttttttaccctcagatgtggccattggtgcacccaaggaggatgacttcgcaggggcggtctatatctatcatggtgatgccggtgggatagtccctcagtactcaatggtaattagtgtgagagtgatatggcaactgttcatacattcattcagcaaacatgtatggaaccttcattatgcaccatgccctggaggtacaaagaaaaacatttttcttgccttggccttcctaccctt

SEQ ID NO: 24382 - DNA, 601 bp, Human
tttaatcctcgcagcagccatgtaagatgggtctgtttattatccaccatttatttatccacgaggcccaaggaggttatttaacttgcccaaggtcataagtggcagtatggccacagaatctttgccagtctgctgcctgaaacttgttatcgtaaccaccatcctcaactccacattgcaaaaaggaacgctcggaaactcagtaggaaaacttacgaatatggaaactattttgccatgaggcatacatagtctgaggggcatttatctatccagaccatcctcttttcattagaartacataacaggagattaataaacttcggtgattcagcccacaaggcaggaggaagagagctttgggcacagtttgggggccacatctgagtcacaagagctgccctaggctgcggcagggatgctcttcccagggtgacaagctaaaagtcacccaaggagccccgtgctcgggcagcggtcagggtcattctccacgcatcctccgggaagcttgttttcctggacctcggaagctaatcacacagtgaggcaacctgtgagagaccccagcttcccctcctccggggccctcccagtg

SEQ ID NO: 24383 - DNA, 601 bp, Human
taagaagtgagcacagccaggagtggtggctgtaatcccagttccttgggaggctgaggcaggaacatcgtttgaggcttggagtttgaaaccaccttgggcaacatggcgagaccccgtctgacaaaaaaagtaaaacagctgggtatattggagcatgcctatagtcccagctacttgggaggctaaggcgggaggatcacttaagcccaggagtttgaggctgcagtgtgctatgattgtgccattgcattctagcctgggcaacagagcaagactctatctcttaaaaaaaaaaaaagagaaagttttttgtttttaaaaaacatataaagtaagcatagatgctagtgtgtcccatggtgaagttgtgaactctggttggttgagggggctgttttctagaggggagggcagggcatcttcttcagctgagtgcttttgatttcctacagtttaagaagtgttcaggaccatggagttctagatttactgggtaaaactgttcactcctgtctgtgaagctccagaatctatagatcatctggttggctggatggagaggtagtttccacatggccatcttttccagctggacatg

SEQ ID NO: 24384 - DNA, 601 bp, Human
ggagaaaggcatagaaccactggaagagtaagtacttcctaaattaaagttatttaggaataaacattaccagttaaaccagggtcttggtttatagcttaccaagtatttccatgaatttactgacttaaatatctgatttcatatatttaataaatatttactataaatctagtgggtacttaatgaatattatataatgactaataaatattttctgatttaaatgtaatgaaatattatcagcttttgaagaaggccctggggataattatcttcattttacagacagggataccaygagatactcaggtcacatagagtgaggggtggagggtgacaattccatgttcttcagaacctagagcattttccaagagtcactgaattctaggtatgtctttctctaattcactgatgtgaaaagaagtataagccatatgtgtaatctaaaatattcctgtaattacataaaatgataaaaaaggtgaagttaattttattaatttttttagcccaatatagccaacatattatcatttcaacatataatcaatatgaaagttattagtgaggtagttaatggttttctgtactaggt

SEQ ID NO: 24385 - DNA, 601 bp, Human
gggttatttccagataaatccattctaagtcaaaacatggtagtttcaacttaggatgggtttatccagatgtagcctcatggtaagtcaaggagtgtgctgcattcctatggcttttgcaccgttgtgaagttgaaaaatcataagttaaaccattataagtcggggactatctgcagtacatgtaaaatgttcagaacagtgcctggtttaactgcttaataaatcttagcaagtttgatgtaaattgggttaaatttgcctccctaaaattctgcttctcagtcttgtgtcttttatrtagcaaccctttagtatctgaagggggcaattgtgtcccccaagtggtgacttcactaagataaggcctccctggttcctgtaattatttcccatgtgactggattttcactttctttatcagcgcttcctctggataaaacagcttttgtggctccaaatgattgaggttagatttgtgaatctggttgctctagttggtgctttcatgatgtcatctttgctctcttcattatcctgagcatcttactttggtttgtcaggattcttctcaaataaaacacactcctcaacttttaca

SEQ ID NO: 24386 - DNA, 601 bp, Human
ttatttcccatgtgactggattttcactttctttatcagcgcttcctctggataaaacagcttttgtggctccaaatgattgaggttagatttgtgaatctggttgctctagttggtgctttcatgatgtcatctttgctctcttcattatcctgagcatcttactttggtttgtcaggattcttctcaaataaaacacactcctcaacttttacagttgaaaacaggcttttttttttcttcttttctttttttgagatggagtcttgctctgtcacccgggctggagtgcaatggtgtratctcagctcaccacaacctccgcctcctgggttcaagtgattctcctgcctcagcctcctgagcagctgggatcacaggtgcacaccaccacacctggctaattttttaatatttttagtagagacaggtttcaccatgttgatcaggctggtctcgaactcctgacctcgtgatccgcccacctcagcctcccaaagtgctgggattacaggcgtgagccattgcgcctgacccaacaggccctcttaaaaccggggccatctggctgaaggtccatcatatagactctgctttctca

SEQ ID NO: 24387 - DNA, 601 bp, Human
accacaacctccgcctcctgggttcaagtgattctcctgcctcagcctcctgagcagctgggatcacaggtgcacaccaccacacctggctaattttttaatatttttagtagagacaggtttcaccatgttgatcaggctggtctcgaactcctgacctcgtgatccgcccacctcagcctcccaaagtgctgggattacaggcgtgagccattgcgcctgacccaacaggccctcttaaaaccggggccatctggctgaaggtccatcatatagactctgctttctcatcattcttgtrttttttaatcttcctgctgtgagcttaatccaaagggtattttctttttctcttcttcatggtgagggacagccttctccaggagtttgctcacatatggatgtaaagtaaagcgaggcagttacacaatgggtgggagaccccagactccagcctaggatggagggttgaatctggtgagttggagctcaacagggacaaatgtaaagttcttcaagaagaactccagggagagcacatatcaagagaagagacctaggagaggagcctggggagccctgccctgaataagagcatgga

SEQ ID NO: 24388 - DNA, 601 bp, Human
ggaaacctgacctagcctgtgaccttagattatagccagagagccatatgcaagtgaataataatgcaaccaatgtttggtaagctcctaccgcatgcctggcacagtgtgagcacttcatttgtgttcattctttgttattgttttctttctgtattaaggtagaatttgcatgcaataaaatgcaccaatttgagagtatgactccatgagttttgaccactgcatacgctgtgtgactaccaccccaccacaataaagaatacttctgtcaccccagatagtttccttgtgcctctgkctggtcatacccctctcctgatagacaaccactgttctgacttctatcaccatagatccatcttgcccattctagaatttcacattggtgggaatatacagtatggactcttttgtttctggcctcttttaatcagtgtgatgcatttgagattcgttcatgttggtgtgttgcttgtttttccccttactgagtagcactccattgactgaatatccttgagtttgttcatccatcctcttgttgacagaacacatgacaactcttagtcttcttaacaatccatgacataagtggggc

SEQ ID NO: 24389 - DNA, 601 bp, Human
aatgtttggtaagctcctaccgcatgcctggcacagtgtgagcacttcatttgtgttcattctttgttattgttttctttctgtattaaggtagaatttgcatgcaataaaatgcaccaatttgagagtatgactccatgagttttgaccactgcatacgctgtgtgactaccaccccaccacaataaagaatacttctgtcaccccagatagtttccttgtgcctctgtctggtcatacccctctcctgatagacaaccactgttctgacttctatcaccatagatccatcttgcccatkctagaatttcacattggtgggaatatacagtatggactcttttgtttctggcctcttttaatcagtgtgatgcatttgagattcgttcatgttggtgtgttgcttgtttttccccttactgagtagcactccattgactgaatatccttgagtttgttcatccatcctcttgttgacagaacacatgacaactcttagtcttcttaacaatccatgacataagtggggctgttatccccattttatgggtgaggagaccaaggacatgcagatcttattaatataaaagggaaggtgatt

SEQ ID NO: 24390 - DNA, 601 bp, Human
cttttaatcagtgtgatgcatttgagattcgttcatgttggtgtgttgcttgtttttccccttactgagtagcactccattgactgaatatccttgagtttgttcatccatcctcttgttgacagaacacatgacaactcttagtcttcttaacaatccatgacataagtggggctgttatccccattttatgggtgaggagaccaaggacatgcagatcttattaatataaaagggaaggtgattccagatggtggtaggtgctgtgaggattctaaggcagggttacttggtcaggcartggtgtcaaagtcagcaggaagggccaagcagagtgaggcctgagacttgttggaggtggcagggggaggtcaggggtgcccttggctgtggtggctctagagaagtgatggggcaaaagccagatggcagtgggtgggtgagagaagaaacaagaaggacagtgactcttgactgcttctccagaagcttggctgcaaaggagcaaatgggaccagcaggtagttcagggaggtgttttaaggacgggaagctctagatcagtgattaggccaagaacgtctttgagccattttctggt

SEQ ID NO: 24391 - DNA, 601 bp, Human
tttcaaaggatactgtttttccaacttccactgaggtcactgtgtctgggctgcccacgtctgtttcctgcctgccgcactgtcttctgcagagctcttttgtgagaggaggattcggcctcctccctgacgaggtggcccctggggatgatggggcgggctaggcttttcttctgtaccatgaccaggcgcgtcagggaccaggcaaggtggagaccagctcttcatggtacttctgtccatctgtgaggctttggacactcgtggttttcagtctcctaggctggagtaaaatttgtayttatttaacaagggtgtttgcacatttattatgggaacgagaggatgaattcaccggatcccagcccttgcagggtgctgcaggatggtggggcaggtttggaaatagacaatgactgttcaccttagtaagtgggggccagaggtgtgtgtacagagctggaagcacagagagggaggatgcctgtcaggggtactagagaaggcttcctcagggtgggaacatttgagctggctgttgaaaggtcgacggggttttatagggtgtccattggcatctgcacaatcacactggccaggg

SEQ ID NO: 24392 - DNA, 601 bp, Human
agggatcattgtacacaggggcatcattgttctcaagctactaatgccccttaatcttgttatgtcaccccagtggtgtgaaggccagggctccttagaggtaaaagggtctctttgtgaggcctggaggggagaaggttgagcagtagcttaggtgaatgctgcctgagcagatgtctgcagtgggagcagaatggtgtgatttactctttgtttttgtgggatgtccttggggagcccaaggactgtccattcatcaagcactgggagatggtccatggcagggaggagagtatggctwtttattgagtttcatttggtcataagactgggcaggttgatttcttctgccctgaagcactttgctattaccagctgggactccacttatcaagttcttttaggaaattacccaatgaattggtggaggtaaatgatgcaggaggtttgaccaactggatggggctacaacattgcagttcatgctcataatggcagcaaatgcttgagggaatccctgagtatgcatctatttcttgaatcatggcatctgctataggaaatcctcttaaatgtattcttatctccctaataaaatgga

SEQ ID NO: 24393 - DNA, 601 bp, Human
atgctgcctgagcagatgtctgcagtgggagcagaatggtgtgatttactctttgtttttgtgggatgtccttggggagcccaaggactgtccattcatcaagcactgggagatggtccatggcagggaggagagtatggctttttattgagtttcatttggtcataagactgggcaggttgatttcttctgccctgaagcactttgctattaccagctgggactccacttatcaagttcttttaggaaattacccaatgaattggtggaggtaaatgatgcaggaggtttgaccaactgsatggggctacaacattgcagttcatgctcataatggcagcaaatgcttgagggaatccctgagtatgcatctatttcttgaatcatggcatctgctataggaaatcctcttaaatgtattcttatctccctaataaaatggaaattggtacttaattggtaaaattttaaataattacccagcatctggtggttcatttatggcttcaaccagatgcgttttattaacaacaaacttgcttttattattgggacgctaactattaatttactaggcaatatgccccttctaaaaccagaa

SEQ ID NO: 24394 - DNA, 601 bp, Human
atcaagcactgggagatggtccatggcagggaggagagtatggctttttattgagtttcatttggtcataagactgggcaggttgatttcttctgccctgaagcactttgctattaccagctgggactccacttatcaagttcttttaggaaattacccaatgaattggtggaggtaaatgatgcaggaggtttgaccaactggatggggctacaacattgcagttcatgctcataatggcagcaaatgcttgagggaatccctgagtatgcatctatttcttgaatcatggcatctgctmtaggaaatcctcttaaatgtattcttatctccctaataaaatggaaattggtacttaattggtaaaattttaaataattacccagcatctggtggttcatttatggcttcaaccagatgcgttttattaacaacaaacttgcttttattattgggacgctaactattaatttactaggcaatatgccccttctaaaaccagaaaaaaatgctcacagaacatactagcccttctctcttgggatatttcatgctttaattaaatgctgggttgaaggcctaggatttatcctgttggtct

SEQ ID NO: 24395 - DNA, 601 bp, Human
tggctttttattgagtttcatttggtcataagactgggcaggttgatttcttctgccctgaagcactttgctattaccagctgggactccacttatcaagttcttttaggaaattacccaatgaattggtggaggtaaatgatgcaggaggtttgaccaactggatggggctacaacattgcagttcatgctcataatggcagcaaatgcttgagggaatccctgagtatgcatctatttcttgaatcatggcatctgctataggaaatcctcttaaatgtattcttatctccctaataawatggaaattggtacttaattggtaaaattttaaataattacccagcatctggtggttcatttatggcttcaaccagatgcgttttattaacaacaaacttgcttttattattgggacgctaactattaatttactaggcaatatgccccttctaaaaccagaaaaaaatgctcacagaacatactagcccttctctcttgggatatttcatgctttaattaaatgctgggttgaaggcctaggatttatcctgttggtctagttcttgtttggttctgagagctgctccttaccacgact

SEQ ID NO: 24396 - DNA, 601 bp, Human
tgagtttcatttggtcataagactgggcaggttgatttcttctgccctgaagcactttgctattaccagctgggactccacttatcaagttcttttaggaaattacccaatgaattggtggaggtaaatgatgcaggaggtttgaccaactggatggggctacaacattgcagttcatgctcataatggcagcaaatgcttgagggaatccctgagtatgcatctatttcttgaatcatggcatctgctataggaaatcctcttaaatgtattcttatctccctaataaaatggaaattgrtacttaattggtaaaattttaaataattacccagcatctggtggttcatttatggcttcaaccagatgcgttttattaacaacaaacttgcttttattattgggacgctaactattaatttactaggcaatatgccccttctaaaaccagaaaaaaatgctcacagaacatactagcccttctctcttgggatatttcatgctttaattaaatgctgggttgaaggcctaggatttatcctgttggtctagttcttgtttggttctgagagctgctccttaccacgactaagtcaccttc

SEQ ID NO: 24397 - DNA, 601 bp, Human
acagaacatactagcccttctctcttgggatatttcatgctttaattaaatgctgggttgaaggcctaggatttatcctgttggtctagttcttgtttggttctgagagctgctccttaccacgactaagtcaccttcctctcttgccctgcagagcaaggcctgtcattacggtggatgtctccatcttcctcccgggctccatcaacatcacagcgcctcagtgtcacgacggacagcagcctgtgaactgcctgaacgtcaccacctgcttcagcttccatggcaaacacgttccagragagattggtaatgagccaccaagtcagggctcaggatacccgtttagctggagtgggctagtgggatatttccgatgttccctgtcgctgttcctcccagctggttttgcaggcagcaggcacacaggctggacatcctttccctctgaggttcctccccttctatttcctgcttatcaacatgtttctaatgtcacacaacctccagctctaggacaaataatgttggaccccaagcattctttttgcaaatatgagggctagactgaagcctcattggaccacaggtcctatgggac

SEQ ID NO: 24398 - DNA, 601 bp, Human
gttcttgtttggttctgagagctgctccttaccacgactaagtcaccttcctctcttgccctgcagagcaaggcctgtcattacggtggatgtctccatcttcctcccgggctccatcaacatcacagcgcctcagtgtcacgacggacagcagcctgtgaactgcctgaacgtcaccacctgcttcagcttccatggcaaacacgttccaggagagattggtaatgagccaccaagtcagggctcaggatacccgtttagctggagtgggctagtgggatatttccgatgttccctgtcrctgttcctcccagctggttttgcaggcagcaggcacacaggctggacatcctttccctctgaggttcctccccttctatttcctgcttatcaacatgtttctaatgtcacacaacctccagctctaggacaaataatgttggaccccaagcattctttttgcaaatatgagggctagactgaagcctcattggaccacaggtcctatgggactggtggagatatagtgcctggagcctggcccttagggaacattcgagcagttagaaagcagaagtgacaggactttggaggctcctta

SEQ ID NO: 24399 - DNA, 601 bp, Human
acaggtcctatgggactggtggagatatagtgcctggagcctggcccttagggaacattcgagcagttagaaagcagaagtgacaggactttggaggctccttattgagcttgtagcatcagccagatgtcaggggacttataccatttactatggaattggagaccaaagatggatggtgggattcggatgctggtgttacagaggcttaggtttctaaaagaggggtgctgctttggcagctcagaattgaaaagaggcaggcattgtcctgacagctggtaactgtccctgccatttktctggctggggaaaatcaacttgctagcccagctctagagactggattaaaccccagaacaagatagaaccagtgttgattggaattcagagcacgtgatcacctgaaggaaatgaatctggagctttatgcatattactaggtgcttcatttttatttaaaaggctgatttaataatagaaagaaaaactccaggcaaacaaaaacactaacggacctgaacctactgacgttcttagatatttttaatgtcatgagtgactccttttgctactcacagtgtagcccctggcctagcat

SEQ ID NO: 24400 - DNA, 601 bp, Human
tttctaaaagaggggtgctgctttggcagctcagaattgaaaagaggcaggcattgtcctgacagctggtaactgtccctgccatttgtctggctggggaaaatcaacttgctagcccagctctagagactggattaaaccccagaacaagatagaaccagtgttgattggaattcagagcacgtgatcacctgaaggaaatgaatctggagctttatgcatattactaggtgcttcatttttatttaaaaggctgatttaataatagaaagaaaaactccaggcaaacaaaaacactaaaggacctgaacctactgacgttcttagatatttttaatgtcatgagtgactccttttgctactcacagtgtagcccctggcctagcattgtcagcatcactgggaacttgttagaaatgcaggactttgggctccgctttggacttctgaatcagaatctgcattttcacaagagccccacaagattcctgtgcacatttaagtttgagaagcactgctctggagcacacatgtgtgcacacacgcccactcatgcagaaatatttacgtgagctagttcattcctcagccacacctcaaa

SEQ ID NO: 24401 - DNA, 601 bp, Human
gtgttgattggaattcagagcacgtgatcacctgaaggaaatgaatctggagctttatgcatattactaggtgcttcatttttatttaaaaggctgatttaataatagaaagaaaaactccaggcaaacaaaaacactaacggacctgaacctactgacgttcttagatatttttaatgtcatgagtgactccttttgctactcacagtgtagcccctggcctagcattgtcagcatcactgggaacttgttagaaatgcaggactttgggctccgctttggacttctgaatcagaatctkcattttcacaagagccccacaagattcctgtgcacatttaagtttgagaagcactgctctggagcacacatgtgtgcacacacgcccactcatgcagaaatatttacgtgagctagttcattcctcagccacacctcaaatgttctaccttatttaatatgttcatccttcttggctgtctcattggcaatttctcttgatcttcaggtatattgaataagctcaacgattaaacatatttattttatcattttttaaaaagagcttagaaatttcaacattgaatgaaaccataccata

SEQ ID NO: 24402 - DNA, 601 bp, Human
catattactaggtgcttcatttttatttaaaaggctgatttaataatagaaagaaaaactccaggcaaacaaaaacactaacggacctgaacctactgacgttcttagatatttttaatgtcatgagtgactccttttgctactcacagtgtagcccctggcctagcattgtcagcatcactgggaacttgttagaaatgcaggactttgggctccgctttggacttctgaatcagaatctgcattttcacaagagccccacaagattcctgtgcacatttaagtttgagaagcactgctstggagcacacatgtgtgcacacacgcccactcatgcagaaatatttacgtgagctagttcattcctcagccacacctcaaatgttctaccttatttaatatgttcatccttcttggctgtctcattggcaatttctcttgatcttcaggtatattgaataagctcaacgattaaacatatttattttatcattttttaaaaagagcttagaaatttcaacattgaatgaaaccataccataaaacttgggaactggttagtgagggaggattaacaacattttcttgtgcagctcaatga

SEQ ID NO: 24403 - DNA, 601 bp, Human
tgtcagcatcactgggaacttgttagaaatgcaggactttgggctccgctttggacttctgaatcagaatctgcattttcacaagagccccacaagattcctgtgcacatttaagtttgagaagcactgctctggagcacacatgtgtgcacacacgcccactcatgcagaaatatttacgtgagctagttcattcctcagccacacctcaaatgttctaccttatttaatatgttcatccttcttggctgtctcattggcaatttctcttgatcttcaggtatattgaataagctcaackattaaacatatttattttatcattttttaaaaagagcttagaaatttcaacattgaatgaaaccataccataaaacttgggaactggttagtgagggaggattaacaacattttcttgtgcagctcaatgagaaagagcagctcactcaagatcacacagatattgttgaagccaggagttgaatttggatcttatgatacttagttttgctttctaacaactatttctcaccacctccataattgtttaagatactacagtcttaaggaaaaaagctttctgatagttctgggactcgt

SEQ ID NO: 24404 - DNA, 601 bp, Human
tattgttgaagccaggagttgaatttggatcttatgatacttagttttgctttctaacaactatttctcaccacctccataattgtttaagatactacagtcttaaggaaaaaagctttctgatagttctgggactcgtgtgtcctccacataattaagcagtctgtcttctgtccagtgccagctcatcacgtagttggactctgttaaaaaacatttttaaagaatgaagattaattttgatacacataagaatgagaactattctagaactctcaaaaagggcaaacgagtaatagtktctgtgtatgttcatttgacacatgcttattatgtatccacatgtgccaggcactggagatatagtcctgccctcatggagcttctaaagggagttacaaagagtttctactattttggccttgaagcagtgttagacaacgttcacttatcgctgttgtgaaagtgaaggtaaattggcatagctgaagcagagaagaagaaaccaagatgcaagttagagcaagagtgattcagagcatgagacaagtggtagagcaaactctgatttgaaggttcatgagctgagcgcagaggagat

SEQ ID NO: 24405 - DNA, 601 bp, Human
tctaaagggagttacaaagagtttctactattttggccttgaagcagtgttagacaacgttcacttatcgctgttgtgaaagtgaaggtaaattggcatagctgaagcagagaagaagaaaccaagatgcaagttagagcaagagtgattcagagcatgagacaagtggtagagcaaactctgatttgaaggttcatgagctgagcgcagaggagatgtgggtgcctcctcatgctgttcccgaccagtggctctttctggggccccatctagcatgagcctttcacagactgctaagcayaattagaatgaaggtctaggcttagccatagccccagaagtgttggggtaaagtggaagaggccggcagttggatggcatcttgtactgtaccttgtgggcaatgcgaagcaacctggcttatatctgacattaggtggggcccattcagcaccagtgtaccctcccattaatttctcttccctatcctccatctgccacatgggttcatagataaagtcaaacatccctttatactctaagggtgtgtttccccgataatcaggcttaaaggggatggtaactggagaattttgatatc

SEQ ID NO: 24406 - DNA, 601 bp, Human
ttatcgctgttgtgaaagtgaaggtaaattggcatagctgaagcagagaagaagaaaccaagatgcaagttagagcaagagtgattcagagcatgagacaagtggtagagcaaactctgatttgaaggttcatgagctgagcgcagaggagatgtgggtgcctcctcatgctgttcccgaccagtggctctttctggggccccatctagcatgagcctttcacagactgctaagcacaattagaatgaaggtctaggcttagccatagccccagaagtgttggggtaaagtggaagaggcyggcagttggatggcatcttgtactgtaccttgtgggcaatgcgaagcaacctggcttatatctgacattaggtggggcccattcagcaccagtgtaccctcccattaatttctcttccctatcctccatctgccacatgggttcatagataaagtcaaacatccctttatactctaagggtgtgtttccccgataatcaggcttaaaggggatggtaactggagaattttgatatctcagtataataaggcaatgcagaaaattattcatccccagcatgtttctgtcactttctctggc

SEQ ID NO: 24407 - DNA, 601 bp, Human
ctgttcccgaccagtggctctttctggggccccatctagcatgagcctttcacagactgctaagcacaattagaatgaaggtctaggcttagccatagccccagaagtgttggggtaaagtggaagaggccggcagttggatggcatcttgtactgtaccttgtgggcaatgcgaagcaacctggcttatatctgacattaggtggggcccattcagcaccagtgtaccctcccattaatttctcttccctatcctccatctgccacatgggttcatagataaagtcaaacatccctttayactctaagggtgtgtttccccgataatcaggcttaaaggggatggtaactggagaattttgatatctcagtataataaggcaatgcagaaaattattcatccccagcatgtttctgtcactttctctggcattcatatctcaatctttgcagtagaaagagaaatgtagaaatctgccagaaaatgtgctggcagtgaaatggagagtttggggagggaaaaatgggcaggccttatggaaatgtgataggaaatgaggtggaggtgaaaggtcaggtaactgtgggggcccagctctgg

SEQ ID NO: 24408 - DNA, 601 bp, Human
tagaatgaaggtctaggcttagccatagccccagaagtgttggggtaaagtggaagaggccggcagttggatggcatcttgtactgtaccttgtgggcaatgcgaagcaacctggcttatatctgacattaggtggggcccattcagcaccagtgtaccctcccattaatttctcttccctatcctccatctgccacatgggttcatagataaagtcaaacatccctttatactctaagggtgtgtttccccgataatcaggcttaaaggggatggtaactggagaattttgatatctcartataataaggcaatgcagaaaattattcatccccagcatgtttctgtcactttctctggcattcatatctcaatctttgcagtagaaagagaaatgtagaaatctgccagaaaatgtgctggcagtgaaatggagagtttggggagggaaaaatgggcaggccttatggaaatgtgataggaaatgaggtggaggtgaaaggtcaggtaactgtgggggcccagctctgggtgaggtgtcctagaattcagcaaggaaggcagcctcttggctctgcacagttgggaaggtcagtcttca

SEQ ID NO: 24409 - DNA, 601 bp, Human
gaattttgatatctcagtataataaggcaatgcagaaaattattcatccccagcatgtttctgtcactttctctggcattcatatctcaatctttgcagtagaaagagaaatgtagaaatctgccagaaaatgtgctggcagtgaaatggagagtttggggagggaaaaatgggcaggccttatggaaatgtgataggaaatgaggtggaggtgaaaggtcaggtaactgtgggggcccagctctgggtgaggtgtcctagaattcagcaaggaaggcagcctcttggctctgcacagttkggaaggtcagtcttcagatggaggaaagatgggcacttccaggacacagataccctccactcccatccaagctcagcagagggtgctggccaactctgtcatttccaggcctccgcctcaggaacccacagctgagacactgggttaccagccttcctactctttgtgctggcagctgcagaggaaccatgtggatgatgactttgtccatggaatgcctggtgaatgagtgccagccctgggcaggccttccaggcacctctcaatgtctgcatatcttgggctgagtttgttattaag

SEQ ID NO: 24410 - DNA, 601 bp, Human
gtcactttctctggcattcatatctcaatctttgcagtagaaagagaaatgtagaaatctgccagaaaatgtgctggcagtgaaatggagagtttggggagggaaaaatgggcaggccttatggaaatgtgataggaaatgaggtggaggtgaaaggtcaggtaactgtgggggcccagctctgggtgaggtgtcctagaattcagcaaggaaggcagcctcttggctctgcacagttgggaaggtcagtcttcagatggaggaaagatgggcacttccaggacacagataccctccactyccatccaagctcagcagagggtgctggccaactctgtcatttccaggcctccgcctcaggaacccacagctgagacactgggttaccagccttcctactctttgtgctggcagctgcagaggaaccatgtggatgatgactttgtccatggaatgcctggtgaatgagtgccagccctgggcaggccttccaggcacctctcaatgtctgcatatcttgggctgagtttgttattaagacggctgcatttgggcagagcaatacacagatacctgtggtgggctaggtactgctgtcaga

SEQ ID NO: 24411 - DNA, 601 bp, Human
aagagaaatgtagaaatctgccagaaaatgtgctggcagtgaaatggagagtttggggagggaaaaatgggcaggccttatggaaatgtgataggaaatgaggtggaggtgaaaggtcaggtaactgtgggggcccagctctgggtgaggtgtcctagaattcagcaaggaaggcagcctcttggctctgcacagttgggaaggtcagtcttcagatggaggaaagatgggcacttccaggacacagataccctccactcccatccaagctcagcagagggtgctggccaactctgtcatytccaggcctccgcctcaggaacccacagctgagacactgggttaccagccttcctactctttgtgctggcagctgcagaggaaccatgtggatgatgactttgtccatggaatgcctggtgaatgagtgccagccctgggcaggccttccaggcacctctcaatgtctgcatatcttgggctgagtttgttattaagacggctgcatttgggcagagcaatacacagatacctgtggtgggctaggtactgctgtcagaagtggtatcttctgtggtatttatctgctgctgtcttcagc

SEQ ID NO: 24412 - DNA, 601 bp, Human
agaaatctgccagaaaatgtgctggcagtgaaatggagagtttggggagggaaaaatgggcaggccttatggaaatgtgataggaaatgaggtggaggtgaaaggtcaggtaactgtgggggcccagctctgggtgaggtgtcctagaattcagcaaggaaggcagcctcttggctctgcacagttgggaaggtcagtcttcagatggaggaaagatgggcacttccaggacacagataccctccactcccatccaagctcagcagagggtgctggccaactctgtcatttccaggcctcygcctcaggaacccacagctgagacactgggttaccagccttcctactctttgtgctggcagctgcagaggaaccatgtggatgatgactttgtccatggaatgcctggtgaatgagtgccagccctgggcaggccttccaggcacctctcaatgtctgcatatcttgggctgagtttgttattaagacggctgcatttgggcagagcaatacacagatacctgtggtgggctaggtactgctgtcagaagtggtatcttctgtggtatttatctgctgctgtcttcagctacatgacctg

SEQ ID NO: 24413 - DNA, 601 bp, Human
agttgggaaggtcagtcttcagatggaggaaagatgggcacttccaggacacagataccctccactcccatccaagctcagcagagggtgctggccaactctgtcatttccaggcctccgcctcaggaacccacagctgagacactgggttaccagccttcctactctttgtgctggcagctgcagaggaaccatgtggatgatgactttgtccatggaatgcctggtgaatgagtgccagccctgggcaggccttccaggcacctctcaatgtctgcatatcttgggctgagtttgttaktaagacggctgcatttgggcagagcaatacacagatacctgtggtgggctaggtactgctgtcagaagtggtatcttctgtggtatttatctgctgctgtcttcagctacatgacctgctctctgaggatggttttgagagccataagcagctgatgttagtcttgtgcctttggtttcttcttctctacctggcagggttcaagcctatgtacagagaagggacaccaactgcctctttatttcctgctttagaaatgggagaccacagtgcctacttggtcatgggagtgttcaggac

SEQ ID NO: 24414 - DNA, 601 bp, Human
gttgggaaggtcagtcttcagatggaggaaagatgggcacttccaggacacagataccctccactcccatccaagctcagcagagggtgctggccaactctgtcatttccaggcctccgcctcaggaacccacagctgagacactgggttaccagccttcctactctttgtgctggcagctgcagaggaaccatgtggatgatgactttgtccatggaatgcctggtgaatgagtgccagccctgggcaggccttccaggcacctctcaatgtctgcatatcttgggctgagtttgttatyaagacggctgcatttgggcagagcaatacacagatacctgtggtgggctaggtactgctgtcagaagtggtatcttctgtggtatttatctgctgctgtcttcagctacatgacctgctctctgaggatggttttgagagccataagcagctgatgttagtcttgtgcctttggtttcttcttctctacctggcagggttcaagcctatgtacagagaagggacaccaactgcctctttatttcctgctttagaaatgggagaccacagtgcctacttggtcatgggagtgttcaggacc

SEQ ID NO: 24415 - DNA, 601 bp, Human
tgggaaggtcagtcttcagatggaggaaagatgggcacttccaggacacagataccctccactcccatccaagctcagcagagggtgctggccaactctgtcatttccaggcctccgcctcaggaacccacagctgagacactgggttaccagccttcctactctttgtgctggcagctgcagaggaaccatgtggatgatgactttgtccatggaatgcctggtgaatgagtgccagccctgggcaggccttccaggcacctctcaatgtctgcatatcttgggctgagtttgttattargacggctgcatttgggcagagcaatacacagatacctgtggtgggctaggtactgctgtcagaagtggtatcttctgtggtatttatctgctgctgtcttcagctacatgacctgctctctgaggatggttttgagagccataagcagctgatgttagtcttgtgcctttggtttcttcttctctacctggcagggttcaagcctatgtacagagaagggacaccaactgcctctttatttcctgctttagaaatgggagaccacagtgcctacttggtcatgggagtgttcaggaccag

SEQ ID NO: 24416 - DNA, 601 bp, Human
tgttcaaggttatacttcgggttaaccacttccttggggttatcagaacctatgagcttggagaaggggccctgcggagctaggacctgaacctctgaggaggaggctggtgctgctgatctctctgagggagtgcaatgaggctggctctgggagaatggggggaaaattgaaaactacaattaactgctgttggggccagctgccgtgagaaactgttgctgggataagctgctaggaataggaagcagggaggaaggagcgagttcctttgccctctccagccttgcaggctccctcygatgctccatattagcagagccgcacagcgagcctctggcaaaacaagtgaggtttgcagggtcccagctccagtgtcacagtgcagggtagagaagggtgggttggagctgaggacaacagcttcataaaccagcacagcaagcatccagttacattgagttgctgaatccctgttgggtcattcaatcaaacaataataattaaggtcctacagagtgccagacaccctgcttatcctggggcacggagcagtgagcaggacaggcaaagtccttgccctcatggagctggcattcta

SEQ ID NO: 24417 - DNA, 601 bp, Human
aaccacttccttggggttatcagaacctatgagcttggagaaggggccctgcggagctaggacctgaacctctgaggaggaggctggtgctgctgatctctctgagggagtgcaatgaggctggctctgggagaatggggggaaaattgaaaactacaattaactgctgttggggccagctgccgtgagaaactgttgctgggataagctgctaggaataggaagcagggaggaaggagcgagttcctttgccctctccagccttgcaggctccctctgatgctccatattagcagagcckcacagcgagcctctggcaaaacaagtgaggtttgcagggtcccagctccagtgtcacagtgcagggtagagaagggtgggttggagctgaggacaacagcttcataaaccagcacagcaagcatccagttacattgagttgctgaatccctgttgggtcattcaatcaaacaataataattaaggtcctacagagtgccagacaccctgcttatcctggggcacggagcagtgagcaggacaggcaaagtccttgccctcatggagctggcattctagtgggaggggggcaggcagacgg

SEQ ID NO: 24418 - DNA, 601 bp, Human
tccttggggttatcagaacctatgagcttggagaaggggccctgcggagctaggacctgaacctctgaggaggaggctggtgctgctgatctctctgagggagtgcaatgaggctggctctgggagaatggggggaaaattgaaaactacaattaactgctgttggggccagctgccgtgagaaactgttgctgggataagctgctaggaataggaagcagggaggaaggagcgagttcctttgccctctccagccttgcaggctccctctgatgctccatattagcagagccgcacagcragcctctggcaaaacaagtgaggtttgcagggtcccagctccagtgtcacagtgcagggtagagaagggtgggttggagctgaggacaacagcttcataaaccagcacagcaagcatccagttacattgagttgctgaatccctgttgggtcattcaatcaaacaataataattaaggtcctacagagtgccagacaccctgcttatcctggggcacggagcagtgagcaggacaggcaaagtccttgccctcatggagctggcattctagtgggaggggggcaggcagacgggacaaaa

SEQ ID NO: 24419 - DNA, 601 bp, Human
accagctgctctcttgctggcttttctagatgagctccgggccccttgtgtggcatgcactgtgcttagcactgggacacagacagacacagacttctcactccgactgtgggctcctccaggagcaggtttacaacgtatttcataaagcactttaaaataggagttcttcctgtccctaatagtattattcatcacttcattcttggcctgggaacagcctgtggccccttggagcctcctggctagcataggtgaaggtggtgaatgctttgcccaaggggaccctgcccctcacccrtggacggtgcttgtacctactcactggccaggctgaagcctaaacttgcttgtcaatctctggaggctgggaatcaagctggcagttctgggctttcaccagagtgtgaaacgaaaaccaggaaggggcgctctctgagtgattgcattttgcactcagacccagtgctcctgtgtttccatggttagcctgaaactcgggaaggagaatttgttagaatttcacagctgaaatcttgttctgacagagagcaggaattaatcaaaacttgctgggagagaccagagctagagttgatga

SEQ ID NO: 24420 - DNA, 601 bp, Human
aataggagttcttcctgtccctaatagtattattcatcacttcattcttggcctgggaacagcctgtggccccttggagcctcctggctagcataggtgaaggtggtgaatgctttgcccaaggggaccctgcccctcacccatggacggtgcttgtacctactcactggccaggctgaagcctaaacttgcttgtcaatctctggaggctgggaatcaagctggcagttctgggctttcaccagagtgtgaaacgaaaaccaggaaggggcgctctctgagtgattgcattttgcactcwgacccagtgctcctgtgtttccatggttagcctgaaactcgggaaggagaatttgttagaatttcacagctgaaatcttgttctgacagagagcaggaattaatcaaaacttgctgggagagaccagagctagagttgatgagagacagctggctccctcctggcccaggcccgtgcaggggggctcctcgggaagcagccgggggcagggcagggaggtggctgaaagtattactcggggctgatcagcttttccatcaccatgacatcattcgacatggcagggacacaagctgccag

SEQ ID NO: 24421 - DNA, 601 bp, Human
ggcttgcccacattttggagggtaatctgctttattcaaagtctactgatttaaatgttaatctaatataaaaaaataccttctcagtgacatctagattggtgcttgaccagattctgggtactgtggcccagccaagttgacacataaaattagccatcagagcagccaaatagagggtgtcttattgagcaggttaccactgtgggcagctggagctcagtcctgctggggaaccctggcagtcagtgtagaccgtgccccagaattaccccacatcaaggggcaagggagctggggmcctgcattatggagggctgctctggggacttgagttccctggcactcctggcttgccaggcacatggacagagccactagagaaagccctcaggagaagagatgcaggtactggcagttgcaatttgggccggacagcagagaaatggtaaaagccaagaggatatgggtgggggagcaataccatcagttccatcttcctgtgttcctttccacccaggttttctctgagctcagctagttcatctctggtaagatagtccagtctcgctgttctctccattgtctcccttcctgaggg

SEQ ID NO: 24422 - DNA, 601 bp, Human
tgagcaggttaccactgtgggcagctggagctcagtcctgctggggaaccctggcagtcagtgtagaccgtgccccagaattaccccacatcaaggggcaagggagctggggccctgcattatggagggctgctctggggacttgagttccctggcactcctggcttgccaggcacatggacagagccactagagaaagccctcaggagaagagatgcaggtactggcagttgcaatttgggccggacagcagagaaatggtaaaagccaagaggatatgggtgggggagcaataccatcmgttccatcttcctgtgttcctttccacccaggttttctctgagctcagctagttcatctctggtaagatagtccagtctcgctgttctctccattgtctcccttcctgagggaaggcagccattcacctgggaaggaggctggtcaggggaccccgaggagagtctgctcagcagctgcctccaccacattggttcacccaactgtggcctctggcttgtcttccagcaatgtgtatctgtagccatgactttgcttaagcgaacttggaaattcacttcatttaaatgtaatctttctt

SEQ ID NO: 24423 - DNA, 601 bp, Human
aaaagccaagaggatatgggtgggggagcaataccatcagttccatcttcctgtgttcctttccacccaggttttctctgagctcagctagttcatctctggtaagatagtccagtctcgctgttctctccattgtctcccttcctgagggaaggcagccattcacctgggaaggaggctggtcaggggaccccgaggagagtctgctcagcagctgcctccaccacattggttcacccaactgtggcctctggcttgtcttccagcaatgtgtatctgtagccatgactttgcttaagcraacttggaaattcacttcatttaaatgtaatctttcttacttcagggcagttgttcagggaagttgtgatcagtagaaagtaaattggctagagttcagttgtagatctctgcacttgtttggacctgctatccatgcattcaaaaaaatgggaggttttggtcaagtaatgtacaacatgcagcaagaacaagtgtggtgggaatagcctggcaccagagattaagggagtcctagattcagctgtttgatgggtggccctctggcctggagcaagtcttgttcccttttggggcctca

SEQ ID NO: 24424 - DNA, 601 bp, Human
aggtttgtcatgatgttttgcttgtcaggacactaacctgtgttgggtacaccttgttaatgggcatattgctggctcagttgatacctcatgatggcatgaggtttaaatcagggagagccgtgaagtatgacacaaggagagtcattagaaaggcagaggacatcatgcttctctctcgattctttgagcaccctggctgtgtgctgctttctgagcaagtctctgcttggggctgcagtctcctgccatggaagggtaggtatcatatgagatgtgcatgtgatcctgtgacaaggamaagaggtggcctcatcacagtgtgtcggtcctttctgacattttgacctctcatttattggcaggcctgaattatgttctgatggctgacgtggccaaaaaggagaagggccagatgcccagggtctactttgtgctgctgggagagaccatgggtcaggtcacagagaagctgcagctgacttacatggaggagacgtgtcgtcactatgtggcccatgtgaaggtcagtcctctcctcctttttatcctcaaactttgatctctgcagatgttcacttggagctggtggaaactattt

SEQ ID NO: 24425 - DNA, 601 bp, Human
gcctaccgtctgagcactgctctgaaggactcgattgccccgtggagcctgctcccacacacctgccttttgtgcagccggcccatctgttggtgctttttctttcaggaggagatgggcatctcctgtgagctgctggaatcggacttcctcaaatgcagcgtgggatttcctttcatgaggtcaaagtcaaaggtaagggacacagacgggacccttcctcagcagcaggcccccagcccttccaccagccactgattccgccgcctccctgaggtgaggagtcctcccaccccctgcytcccatagcagctggggcggccactgaagccctgacatgctcctgtccctggctgtgtacaccggggtatactccggaggggctgcatcatatggtctttctcttcgattcacatgatgtaccccaaatgtgaaagtgaaggacacaccacagcctctgcactttagcacgtgccatttagttgaccttcctaaaataattttttttctgagacattctgtgcctctttgagtcccctagacaacacagaagaagatgtggtctgtcacctatagtcctgtcattcccttgggtgctcac

SEQ ID NO: 24426 - DNA, 601 bp, Human
tgagaatattctggtgagggagaagacttggtcatttcttagcaaatcacttgaacccataagccccattgaatgcacctcgatcttggactttccagccttcagaactgtgagaaataaatgtttaaaccacccaagctagggtaatttgtgatagaatcccaaactgactagggcaaaaaggtaataactttctcactgttagggtcaatgttgttcagtgctgtgttcacatatcacccaagataatctcatgaaccacctaaaataatcttagtgtaccactcccagtgtgaacatmctgtgatttgggtaacactgccccaaacaaatggtgttcaccatatacatatcaggcacgtgtgggaatgtgggaggaacccctgggtaggggttataggaccaggctctaccacaaactgtgtgatcttggcgaaaccacagtggccaagtggccaagtggcccatgactcctcggatttttttctgcctctcttcctcattctgtccacattcaccccaggaggagggaaacctcaataagtgtctgcccttggaaaatggattacatgtggatggcagagtacaggccaagtcccat

SEQ ID NO: 24427 - DNA, 601 bp, Human
cctcaataagtgtctgcccttggaaaatggattacatgtggatggcagagtacaggccaagtcccattagactccaggtagggtgagggtggagataaaggaggacgaccacaatccatggacactattgcctatagtaatgtatgtggcacatctgcacacaaatttaattaaaatcttttgagtaacagataataggcttaactggaaaacttgcaacagtttccatttcattttaaactccagcctatatcacatatcagacctaagatgtgtctttctctctctagtggagtgttamattttgtcaaatttttgtttgtttgagagggagtctctctctgtcgcccaggctggagtgcagtggcgcaatcttggctcactgcaacctccgcctcccaggttcaagggattctcctgcctcagcctccctggtagctgggattacaggtgcccaccaccatgcccagctaattttttgtgtgtttttagtagagacaggtttcactgtgttggccaggctggtcttgaactcctgacctcaagtgatctgcccacctaggtctcccaaagtgctgggattacaggcgtgagccaccgt

SEQ ID NO: 24428 - DNA, 601 bp, Human
ggtcctcaggctccaggccacatgctaagcctcatggctatactttggcttaccttggatggccatgtatttctctctctcacagcctgcccagtttctgacattctgttcttccaggcctccatccctgattttggcttctcacccaattcttttgcctgtcatctcactgtgctctttaatgtttttaatttaattcagatctcctcccagtgctgactctacaccagtcaagaccctgcctctctcttccttcttgtcctcttcccgccctgtctccatgcctgccccccaccccacwgtaagctgaccagtcccacagcaacagaaatttctgtctagaaagagatgtccatgttcactgtagatgatggtccattgtaatggaccaatgtccgttgctttcaggaaacattcagtagaattcagtgttgcaaatattagaccattgcctagaattcaccataatggaacccaaaggtttagacattgtataagttataggctctcaaaatttgatgaaatttaagaaccgttttgtccaacctcctttttttattgaaatgcaaagacagtatcttagccaagatcacagtcagtt

SEQ ID NO: 24429 - DNA, 601 bp, Human
ttttgtccaacctcctttttttattgaaatgcaaagacagtatcttagccaagatcacagtcagtttgtggtggaacctggtcctgtgacccctacccaagggttcctcccacattctcacacatgcctgacatgtatatggtgaacaccatttacttagggcagtgccccctactcacaggatgttcaccactaagtggtacactagataattttagatggttcatgaaattatcgtgggtgatacgtggacgcagcactgaacaacattgaccctaacagtgacccttttcaccttagycagttcagtcatctataacaaattaccctgggctgggtggtttaaacaacagacatgtatttctcacagttcttaaggctgagaagttcaaggtcatggtcccggcagattcagttcctggcgagagttctcttcctggttcataaacagaaccttctctatgtgtgcccatctggctttcccttggtgtgtgtgcatggagagagagagatctctttgtcttctcttcttctgagtgcactaattccatcatgaaggcctcaccctcatctaaacctaagtaccttccaaagaccccat

SEQ ID NO: 24430 - DNA, 601 bp, Human
caagggttcctcccacattctcacacatgcctgacatgtatatggtgaacaccatttacttagggcagtgccccctactcacaggatgttcaccactaagtggtacactagataattttagatggttcatgaaattatcgtgggtgatacgtggacgcagcactgaacaacattgaccctaacagtgacccttttcaccttagtcagttcagtcatctataacaaattaccctgggctgggtggtttaaacaacagacatgtatttctcacagttcttaaggctgagaagttcaaggtcawggtcccggcagattcagttcctggcgagagttctcttcctggttcataaacagaaccttctctatgtgtgcccatctggctttcccttggtgtgtgtgcatggagagagagagatctctttgtcttctcttcttctgagtgcactaattccatcatgaaggcctcaccctcatctaaacctaagtaccttccaaagaccccatctccacataccatcacataggggggttaggccttccacatattaatttgaggagtggcggggggacacaaacattcagcgcataagacttttcaata

SEQ ID NO: 24431 - DNA, 601 bp, Human
aaggcctcaccctcatctaaacctaagtaccttccaaagaccccatctccacataccatcacataggggggttaggccttccacatattaatttgaggagtggcggggggacacaaacattcagcgcataagacttttcaatagtcttccaatcctagccacactcaggagaacgtctccaatcctgctagcacatctttaacacttctctatcaccagcaaatctcccttttcaacaaagatggagtagaccttaggctcagaggcttccaaaggcaacagagttcagcattgctctgtkttcattgtgttcatttttacaactaccttctctttttggcaagtgatcctggattcccatctatgacagtgatataaattgttcttttaaaacaatctttaaactaaaagagtaaggcaacaaaaatatgaacaaatatcccaggtgatgtaatttgcagatgtggcagaaattgaaaagatggtatgtgagtgaaacttagaaagtcccggttaaagagtgtaaacgcatcacttcctaaggagagcctcggtggcggaacaggagcagcaggtctctggccagagtatgtgtcaggct

SEQ ID NO: 24432 - DNA, 601 bp, Human
ggaacaggagcagcaggtctctggccagagtatgtgtcaggcttggttttactgttaaagctgtgactttggcctgacagtcagaaagctatacataaaactaaagcttatcatgcaaatgagcttccagaggtcataaactgcagaagatggaagagaacagtttaagtttggaatgcctgctgatgccaaataccacttcctttttcactagtatgaattcagcgtgatctttgatacaagccacctgtctggggaagaggaagttctcagcttcattgttactgctcagaggtaaggsgggggtttaaacacttttttcaaagatgagagatttatgggaccaggaaaggatgtgtcctggttaagctttgatgaatcccaggatgctgaggaggaagaaatggttactcagtgataaagccttgagccgcaaagtggaattggatttcttggggatggtggttgcctagtgctgcttgcatagccgccactgcagattgaactgagaggaactgggcatcagccactcagaggtgatgattctacagctgaggagagacaggcccaggggggtgaggctctagtccaaggtcagttc

SEQ ID NO: 24433 - DNA, 601 bp, Human
cataaactgcagaagatggaagagaacagtttaagtttggaatgcctgctgatgccaaataccacttcctttttcactagtatgaattcagcgtgatctttgatacaagccacctgtctggggaagaggaagttctcagcttcattgttactgctcagaggtaaggggggggtttaaacacttttttcaaagatgagagatttatgggaccaggaaaggatgtgtcctggttaagctttgatgaatcccaggatgctgaggaggaagaaatggttactcagtgataaagccttgagccgcwaagtggaattggatttcttggggatggtggttgcctagtgctgcttgcatagccgccactgcagattgaactgagaggaactgggcatcagccactcagaggtgatgattctacagctgaggagagacaggcccaggggggtgaggctctagtccaaggtcagttcccacttggctgtgtatttcccagatcagacagatgtcctctgcaaattgtctggctgggcccactgctgcttttggacatggtgctgtatcccttgatggagtgggcaggtcacctgcagcctgagggcctggc

SEQ ID NO: 24434 - DNA, 601 bp, Human
ttttgcctcatctattttatcatcctctttctatataattttttttgttaaccatgtgaaagttgcagaaatcatgcctcttgattcataaatacttcagtgtgcattcccaagaatgaggctgttctcttaataaactgtagtatagttatcacattcaggaaattgaacattgacactatgctattagctaatccgcagtttatgttctgattatgccagttatcccaataatgtctttttagccgcttctttttactggtccacaagacttggttattttctattgacactattttcragatcacataatttacatcacataaaacatgactgtgatctaatagaagcctatgcaaagcatagatagggtagacttcattcccattgcacaaaatccagaagggcttcagtggggaggtagcatttaaacagaggagtctgttttcaggctgaagcaacatgggcacggcagtgaggctgtccatggggcaagaagccctgttacacctgtgtaggtggtgggcacgagagtgtactggggattcgtgcaccttctcagaagaaggatggggagcacacaagcacagtgggaatgggg

SEQ ID NO: 24435 - DNA, 601 bp, Human
actacagttaaaatctcaattgttcctttcttccatcaccaccctttgaaggtctctttgcctacttgtagatttagggggacataacattgagactgagcagtttcttgaacctctcctctcagcagccaccagcctggcttttgcagaccactggaaagtatcccagctcattagcttttggaatgacgggaagccttttgatgtttgacgtctttatctcaactcttcaacttagctcattctggagcagtcacacgatgacagatgagacggttgggcctaagccggccaaacaaayggcagggcaagacctggcaggatgctggggtgggggcgggagtgggccaggatggtgttaacccatccacaggggagtcgcctttggcctgcccacagcagtgatcccaaggcttttgtcaccccttgggaaaggaaggacaaggaagtcaggctgtgtgggcacctgatcctgctgcttttgcaaactgtggatgcccctgagggactgatgtcaccccatgtaggaagacagatgaggagccagggcagagactgtggccctatggggtcagcgtcacacagcaccattgtttcagaa

SEQ ID NO: 24436 - DNA, 601 bp, Human
tgcaggggggccttgggcagttacctgatttatctgacttgctccttacctgtcaaaggtgggtgctccatctccctctggggttgctctgaggtctcagtgaggccatgctgagaaatgcccggcatagtgcctggcacatagtagccacttaacagcatcaattccctcatgttcacctttccagaatgatctcacaagaatccccgttctgtgctttctcacccggaggccttatgtggatgtattttagaatcacctggggagctttcaaaaatatcgatgcctgatctacccccakagacttgctatagccagggtctatagcgagagcttccatgatgtttatagtggtaggtttggtcagggcctctttcctgggcttggctgtccatggatgatgggtggtcctttcaggtgagacatagctgctgaagtctagcaactccttcctggctgcaataccctaacttcattggtccattgttcgtggaacaggcacttacacaagtagcacacacagtaggtgccctgcccataacccctcagccctcacccttcccaatctatccgcaaactgggcagattccggctcccagca

SEQ ID NO: 24437 - DNA, 601 bp, Human
atctgagaagtttgatgacaagtttaagccccataatttctttgaacattccatatacctttatgtgcatatattctcatccgcccctagtccctccagaatgctgtatggtaacaagcagcatggctcctgggattaaaatctcagctggaagttgctgggccagagattatcaccagatgtgtctccagtcctggctcacaggaggaccactttctgattagctccacaggcagtgctggctttgcttgtttctgttaactccctctgcagagccagaggtggcttttcctgatgtctrtaatggtctggaatgggcagggaaccatcccatcggccacactgtctgtctgggtcaagtccacggtcattcagtgccgctggcattgttggaaagcaggaccctgggctgcagtctgtggagacctgaaacaacctgtgtcagttttcaaccaaagccccagcttggaaaaatgagaactccatttctttccagcttcagaaaacagagtgcatacctctttgatagtggaaaaaagatttacacaattagtttagatcaggtgaggacccactgaacccttgacccaaatgcaagctg

SEQ ID NO: 24438 - DNA, 601 bp, Human
agggagagccatccctgcactagcccgcactgctgggagccagtggaatgagtctccaagcattcctgctcctgagcttttggcatttttggtcatgttttttaaacatgaggtactgatggaatatatttgcaaattagcatatttttgcctctgttcacagctctatttttaactgtatcatttatttacttgtctcatcaaaggcacagcaagaatatacccagaaccaagccctatccttggggacaaagagaaaacattctccccaccacccccagacacttgatcatgtaatcaktccttagaggaccttgttgggaggtgttaacagcccctgatgaagccatcagttaaacaaatgagtcaacctctgatctctccaggaacctaaaacagctcttgccatttggtaatgctgggaactcactaccttactaaaataatgcactaaacattgaaaatggatgagttgttgtctattcggacttagtctcaaaaatcttccattgttgtgtttaggtgagtgagtggcctccagcatctagaagtcgatatttgtctgggagtgtcagtcagagctttgtttcttctcaggaat

SEQ ID NO: 24439 - DNA, 601 bp, Human
ggcacagcaagaatatacccagaaccaagccctatccttggggacaaagagaaaacattctccccaccacccccagacacttgatcatgtaatcagtccttagaggaccttgttgggaggtgttaacagcccctgatgaagccatcagttaaacaaatgagtcaacctctgatctctccaggaacctaaaacagctcttgccatttggtaatgctgggaactcactaccttactaaaataatgcactaaacattgaaaatggatgagttgttgtctattcggacttagtctcaaaaatctkccattgttgtgtttaggtgagtgagtggcctccagcatctagaagtcgatatttgtctgggagtgtcagtcagagctttgtttcttctcaggaatgtgttcatataagcaacattgaaagcattgctgcaaactgagcttgaattcttctcacctcttatgtagcctccgaaatccaagggaaaatgctatcaatgaacggattcagctttcaaatgcctaacttctagtcatcttggcagtctgataaatttaagttttttaagtgaatttgtcatagagtggggtttaggatgccaaa

SEQ ID NO: 24440 - DNA, 601 bp, Human
aaacattgaaaatggatgagttgttgtctattcggacttagtctcaaaaatcttccattgttgtgtttaggtgagtgagtggcctccagcatctagaagtcgatatttgtctgggagtgtcagtcagagctttgtttcttctcaggaatgtgttcatataagcaacattgaaagcattgctgcaaactgagcttgaattcttctcacctcttatgtagcctccgaaatccaagggaaaatgctatcaatgaacggattcagctttcaaatgcctaacttctagtcatcttggcagtctgayaaatttaagttttttaagtgaatttgtcatagagtggggtttaggatgccaaatacataactcatttatatttattttttaaaagcttatgatcatcttcttcaacccataaaacatttttcgaatgacaaaacagaaaatgtatacttttataatccagtttttaaaaagtcaaagctatgataatcttgtcatttcagaaaggtaatcccagtgcatatttctccatgcagcttattgacgtaacctaagatgagaagacactactattcatgcctggtcagaaagcacagactggct

SEQ ID NO: 24441 - DNA, 601 bp, Human
tggagtgtcactttcagcccatcaatatcacccttcaggtacccactcctggagacctcctctgtccgtgggggctaacggaagggcacatgggatgtctctcctacagagggctaagctcttgtcaggagaaacccttctgtggttggctggtgtggtgtgtgtgtgagatctgtaaccacacacagaatgaatccttttcgatgcctggtactctgctgtgcaggcccctctgctttttcaggatttggaaggacaggtccacgtcatgaatgccagttttccccaagaagccctctgygtggtggaggcctcagccaatgtcccagcccagatgaccccatgaggacccctttctgttctccatcattccccaccttctgggcagggctgcctcagaggatttgctgtgtcccttcctcctgagattttcttgccagctcatccaggagcccactcctcctgcaggggaacagcctttcggaagggcagttttataagaacagaggagtgtgagcccctgtgagcccccacgggaggcacgctgctccctcactgagccatggctggcttgcccaggcacacaggcatcatttccagc

SEQ ID NO: 24442 - DNA, 601 bp, Human
gctgtgcaggcccctctgctttttcaggatttggaaggacaggtccacgtcatgaatgccagttttccccaagaagccctctgtgtggtggaggcctcagccaatgtcccagcccagatgaccccatgaggacccctttctgttctccatcattccccaccttctgggcagggctgcctcagaggatttgctgtgtcccttcctcctgagattttcttgccagctcatccaggagcccactcctcctgcaggggaacagcctttcggaagggcagttttataagaacagaggagtgtgagyccctgtgagcccccacgggaggcacgctgctccctcactgagccatggctggcttgcccaggcacacaggcatcatttccagcaagtccacttggtgtagactgtggacctcatgaaggacactgtttcttctcttagttgggggtcagcaaactttttctgaaaagagccatggggtaatttaggctttgtgggccatttggcctctgcagcatctattcaaccatacttctgtagttcaaaggcagccatagataacacagaaacaaaattttagttccttatagacaatgaaatttg

SEQ ID NO: 24443 - DNA, 601 bp, Human
gctgttggcattgttataaacacacaagttaagggcaagattcttgccaagaaaattaatgtacgtattgagcacattaagcactctaagagccaagatagcttcctgaaacacgtgaaggaaaatgatcagaaaaagaaggaagctggcggcacagtagctcacgcctgtaatcctaacactttgggaggccgaggcaggcggatcacctgaggtcaggagtttgagaccaacctggccaacatggtgaaatcccgtctctactaaaatacaaaaattagccggggatggtggcagccayctgtaatcccagctactcaggaggctgaggcagggagaattgttcgaatccaggaggtggaagttgcagtgagccgaggttggcccactgcactccagcctgggcgacagagcaagactctgtcttaaaaaaaaaaaaaaaaaaaagaaggaagccaaacagaaagatacctgggtccaactgaagcaccagcctgcaccacccagagaagcacactttgtgagaaccaatgggaaggagcctgagctgctggaacctgttccctatgaattcatggcataataggtgtctaaaaaatga

SEQ ID NO: 24444 - DNA, 601 bp, Human
ccaactgaagcaccagcctgcaccacccagagaagcacactttgtgagaaccaatgggaaggagcctgagctgctggaacctgttccctatgaattcatggcataataggtgtctaaaaaatgaaagacctctggactgtttaaaaaaaaaaagaaaaaagaaaaatccttaacccattgacatagcttcttgtattaatttcttattgctgctgtaacaaattactacaacatttgtggcttaaaacaacacaaatttgttatcttacagttctgaagaacagaagtccaaaatgggccycgctgggctaaaaccaaagtatcagggcctgtgttcttgccagaggcaccaggggaaaatccacttcttgcctttgccagcctctaagggctgcctgcattctttggctcatggcccccttccatcttcaaagccagcaatggctggtcaagtcttaggatgttctctttctgatctgacttctgcctcttccctatataaggactcttgtgagtacaatgtgctcacctggataattcaagataccctctttattttgaggtcgcttgattagcaaccttaattccccctggccacata

SEQ ID NO: 24445 - DNA, 601 bp, Human
gccaacatggtgaaaccctgtatctactaaaaatacaaaaattagctggatgtggtagtgggcgcctgtaatcccagctactagggaggctgaggcaggagaatcggttgaatcagggaggcagaggttgcagtgagccaagatcgtgccactgtactccagcctgggcaacagagcaagactctgtctcaaaaaaaaaaaaaaattataaagacacacacttcagatttgttctatttactatatttgttacacctccatttttaaaaagtgcaggtattgaagatggaatgacaatgcttttccaaagcctccttttttttatctttggttacatttctctaagctccttatttcagccctggcacatctcacctttatcatttcctttctcattcttttctcctgttggagaagggtgactgtttgccacttgaaaggttgggtttttttttttttttttttttttacttacatagtgagggtgatattgttgaaagcccttagacttgttagatgtagtgatacctagtgattttatagttacgactctgtctggctgaaaattttgccgtatagatgaaacatcatcaaggtatgt

SEQ ID NO: 24446 - DNA, 601 bp, Human
ttcatggagcccactactctgtaaattgttgtggatttgtctttgttcttaattccattggaaatttttctgacttttcttctcaggactgtgaaaaaccaggaatttcttgcctaacagcacactgtaactttagtgctcttgctaaagaagaaagtcgtactatagacatttacatgctgctgaacacagaaatactgaaaaaggtaagccctaatgaaccgcacttgtggatgcatttagaagcatttgaattgttgacatctgattttgggtaaaaaaaaggaaaaaggaaagcatytgaattggtgtcctcatgacaatctggctgcccccccttttggctgtctacaagagactgtttttatttttatgtatttagggggtacaagtgcagacttcttatatgaatatattgtatcgtgatgaaatctgggcttttagtgtacccaatagtgaacatggtacccaataggtaacttttcaaccctcacccccctcccacattttggagtctccaatgtctgttaattccactctttatgcctatgggtacccattacttagctcccacttataagtgagaacatgcagtagttga

SEQ ID NO: 24447 - DNA, 601 bp, Human
ttacatgctgctgaacacagaaatactgaaaaaggtaagccctaatgaaccgcacttgtggatgcatttagaagcatttgaattgttgacatctgattttgggtaaaaaaaaggaaaaaggaaagcatttgaattggtgtcctcatgacaatctggctgcccccccttttggctgtctacaagagactgtttttatttttatgtatttagggggtacaagtgcagacttcttatatgaatatattgtatcgtgatgaaatctgggcttttagtgtacccaatagtgaacatggtacccaayaggtaacttttcaaccctcacccccctcccacattttggagtctccaatgtctgttaattccactctttatgcctatgggtacccattacttagctcccacttataagtgagaacatgcagtagttgactacttatgagttatttcacttagggaaatggacttcatttccatccatgttgctgcaaaagacataatttaattcttttttatggctgagtaatattccatggtgtgtgtgtgtgtgtatatatatatataccacattttctataaccagtcatccattcatggacactta

SEQ ID NO: 24448 - DNA, 601 bp, Human
atttttatttattttaatgtttttatttaaaaaaatatttttagagacaggatcttgctctgtcacccagatgggagtacagtggctcaatcatagctcactgcagcctcaaactcctgggctcaagtgatcttcctgcctcagctagtcctcagctaggactgcaggcacatgctaccatgacaggtgaatttttttttaatcttttgtagagataggatgtttccccaggctggacttgacctcctagcctcaagtgatcctcccacttcagtctctcaaagtgctgggattacaggcyttaaccatcgtgcctggcccaagattattgttattattcaagattgaaaatacagcatatcctgatacataaaaccccaactttataaaactgttaaattggtaaaagattatttgttgcttaaaattatttcttgcttaaagtgagttaactggagtaactcttttgaatgacaagcttcccaaaagcatttaaaatgtgtcttatggttgttttaagaaaagaatgataattggtgcataactcccaagtcacatatacagaccagggtccctgtgtgccccaggaaggtctttgtgg

SEQ ID NO: 24449 - DNA, 601 bp, Human
aaaaatatttttagagacaggatcttgctctgtcacccagatgggagtacagtggctcaatcatagctcactgcagcctcaaactcctgggctcaagtgatcttcctgcctcagctagtcctcagctaggactgcaggcacatgctaccatgacaggtgaatttttttttaatcttttgtagagataggatgtttccccaggctggacttgacctcctagcctcaagtgatcctcccacttcagtctctcaaagtgctgggattacaggccttaaccatcgtgcctggcccaagattattrttattattcaagattgaaaatacagcatatcctgatacataaaaccccaactttataaaactgttaaattggtaaaagattatttgttgcttaaaattatttcttgcttaaagtgagttaactggagtaactcttttgaatgacaagcttcccaaaagcatttaaaatgtgtcttatggttgttttaagaaaagaatgataattggtgcataactcccaagtcacatatacagaccagggtccctgtgtgccccaggaaggtctttgtggtttctttggcagagatgagcaaagggtacc

SEQ ID NO: 24450 - DNA, 601 bp, Human
gtaactcttttgaatgacaagcttcccaaaagcatttaaaatgtgtcttatggttgttttaagaaaagaatgataattggtgcataactcccaagtcacatatacagaccagggtccctgtgtgccccaggaaggtctttgtggtttctttggcagagatgagcaaagggtacccttggaactgttttctgtggagtcctctaccttcctgtttctttgagggtttaaccaaaggtggcatttaagtgtaagctccttgcatgacaggcaagctgggtagatgtaggtggggacaccacargacaccttgcctgtggagcccctcctgccccacaggtagaatgttgaatgcactagttctctgctatctgtttccacgacagaagccaggctgcccttctgctccacaatcaacctgtaccactggcttgaggttctggcttctccccagaccacagtttttccagtccctgtcttcttccaaattctttctccatccctgttttggcgccattttctggttatctggatcagtgtctttgaatctgagcccacaggaagacctctgcctgcctctggctggggggtgattccagagtct

SEQ ID NO: 24451 - DNA, 601 bp, Human
ctcccttatacccctgcccctttctccttaattcataagccagatatttaccccttccccatctctccatcaggcatcctctttcaatgtttaatggttttgattccaaaatgacttcatttaagagcaaagaaagagttaaaagcaactcatatgaagggtttgagggttgtggtcaaggcaggaagatgcctataaaatgtagatcagatgccttctgtggaatgccaggcctagatttgctctacacaattaaacagctttatttatcctcaactctttgtgaacatgtcaatatcartatccaaatatctggctctaactgcttggaaaccacagcacacatcttgcgtgtgttgattactggcaaactccatcatttcccaccatccaccatgatctgcaaagaatccttaagagagaccctagtctgtgtttatgtgggtgcctgggatggagaggtatctagttcaatgataaaatttttgtctgggctacatggaatcatggaatttcagttctgcccagtccctctcaaggcccagccattatcatagaaaaatcttcaagtaagttgtgttgtttcttccacaggacagtt

SEQ ID NO: 24452 - DNA, 601 bp, Human
ttctttcgccgaaggtacaaagaaattatcgaagctgagaagaaccggaaagagaatgaagacagttgggactgggtccagaaaaaccagtgagctgccacaccagtcacatgacctgatcactagcctgtcatccttggtctttgtatcttccatatttggaagaaaaaaatcttctccagatttttcggaggccccactgatgctgttctcttcttcattctatcaagcccaggtgccagcctgaggcagccacttcggccaggtcacacgaccggggccagcaccacttcctttaaaratgaactctgaactttggagagtgagctacagagccgagcaatatttatggatgcaacacgcatggtcaaccctcaggggaaaactgttacctaaagtatttttataaatataagccttttatactgattatgtcttttatatttgtatcgatgttttattatttctattaaatagttatataattcactcaagcactgatatctggcctaaaatcttggaagtacatgtccatgaatacaaattttaaaggatgaaaatcttaccgtactttggaacttgctgtttaaaaagacagatg

SEQ ID NO: 24453 - DNA, 601 bp, Human
gagacacttctgggtcatcatgtatcctatgtttctgattacttgaaagtctctaatgtatataaactgtatatgagaaaaataaccagtggaatatttgattaatcaaaggtgtactatttctcaacctagctggggataaaaataaactgttatattaagaatagtatattttgtgtcttaccactcacaatattcttttttaggcaatagagattatgccaaggatgatccattggaatttaagtcccatcagtggtttggagcatctgtgaggtcgaaacaggataaaattttggtragtcttctggatatttacttacaggtgattttagtcagtttatgtggagacacagaaggttttatattttcaggctgatagtaaaattcagtatgctcaagggcacagggtataacaacataagatagctctgatcaaaggccactctgtccaaggaggccatctctcttgcccttcttgaacaggctttcacattttttcacccttattcctactttgttttacctgccccacttgacagttcctatcagtttatttccacctagccaagtataggaatagtgtggctttggctaacaa

SEQ ID NO: 24454 - DNA, 601 bp, Human
aggtgtactatttctcaacctagctggggataaaaataaactgttatattaagaatagtatattttgtgtcttaccactcacaatattcttttttaggcaatagagattatgccaaggatgatccattggaatttaagtcccatcagtggtttggagcatctgtgaggtcgaaacaggataaaattttggtgagtcttctggatatttacttacaggtgattttagtcagtttatgtggagacacagaaggttttatattttcaggctgatagtaaaattcagtatgctcaagggcacagkgtataacaacataagatagctctgatcaaaggccactctgtccaaggaggccatctctcttgcccttcttgaacaggctttcacattttttcacccttattcctactttgttttacctgccccacttgacagttcctatcagtttatttccacctagccaagtataggaatagtgtggctttggctaacaagtgctttaatacttcctctctctctctctctttttttttctttccctgagacggagtcttgctctgtcacccaggctggagtgcagtggtgcgatctcggctgactgca

SEQ ID NO: 24455 - DNA, 601 bp, Human
tagaaaatcaattaaacctttttcactaaatgaattgttacacatttggtagattactatgttgttaaagcattcattactctactgctctatgtggtattacagtctagaatgctgaaaacaaaaaggtcatggtttatttggaaagtaaataaaataagtactgcgcattattttactctcttaataaactatttgctgtataatttagggggtatattccatatgcatgagtgttacttagttcaaaagctagtttggtctctacctttagcatagcatattacatcaagaaatatamtacctgaaataacaattttgctaactattttgaaaaaaaaaaattggactacaaatatggccttcagaataatgtgagaaaaagacttcacttaatatctttatttaccactatgataagaaatttaaggtataggataggtttgattaatttctatgaatgctttgaaagttggccaggtgtggtaggtatggtggctcacaattagcgctttgggaggctgaggcaggaggattgcttgagttcagttagagaccagcctgggaaacatagtgagaccccgtttctataaaaaaattt

SEQ ID NO: 24456 - DNA, 601 bp, Human
accccatctcaaaaaagagaaagtggtattatattctgaagtagtatagagcatctgaaacactaaatttttagaaaatcttcgtgtcgtggactaaacctttgattttaggcctgtgccccattgtaccattggagaactgagatgaaacaggagcgagagcctgttggaacatgctttcttcaagatggaacaaagactgttgagtatgctccatgtagatcacgtatgtataggatattgtaccagcttttaagaagaggggtgggaagcctagtttgtgaaaaatatgtgtgtgtgkgtgtgtgtgtgtgtgtggagagagagagatattaaaagatatagacatattatgatgataacaaaatgaaaacaatcctactaatgtaaagatattacaaatgtgaagtaaacaggtttactttttctaagaactcattttcatcttccttcgttagtataataatagttactacctgattttaagaatctgtatttttgatgactaacagtcaaaagatgcttagttgaacttctcttaacagagaagatgtagaccccacaactaaagattctgattcagtaggtctaggtcaggcct

SEQ ID NO: 24457 - DNA, 601 bp, Human
aggagtcttgactctgaattttcctgctcttaatcagaatttctttgttaacctgctaccaagcccacccctttttggtgatccagaggattttatgctctttgctaatattacttgaaatttcaaaaggaattaatatcatggctaaagatgacttcaagcaattataattttgattatgcttttccaaaatctctacatcctcttctctttggagattccagtccttttgtgccccgctaccctttgttgaattggctactgctttagatcttccttgtaccagaagcataaaaatagrttactgaaatgcagtatagtgtttatgcctagagcccttaggccattattttttgtgttccactggtcaccacatagtttattagagaaaattagtaacaaaagcacaacatgtaagactcttactcctacatttgttttgtccatgttaggtgacctgtgacaccaggtcaaaggaactattctgtcctccagattctaagtagttgaacctacaggaaactgcagattatttcaataaacacttattttcttagcccaacactttgatcctacctgttataagtgggaagtgaacatt

SEQ ID NO: 24458 - DNA, 601 bp, Human
aacctttgaaatgttaagccacctataataggcctaaattgtgaggggcatcttgttcagagaagaagactcaggagcagaagtctgagaacctgggttatattctgactttgtgctgacaatccacctatagctatgggtaattcacctaaccactctgggcctttgtttcatcattggtaaaacaccaattcacacaaaaaacttctgaggtataaattcagtgttttttatctgtttcatacttcaataaattatgcaaacgaataattggttttatgagatgatgtctgttttgtargactacactgctaactttttaataactttgcttgtcttgtgggttattttatttatttgtttgcttttgagtttttgttgttgttgttgttggttagttagtttggttaattggtttgttctgtttttaacctgacttatatggacaccgtggacaaggaacttcactgtctgtcactaacttaccttattactgattacatttgctttcagcttttcataactgcatgataaaacctcagaccttaggagaagagcataaaaaacaacctcaaacaacaaaaaagcaaaattacttggg

SEQ ID NO: 24459 - DNA, 601 bp, Human
aattaggtattcactttcttaaacacatttctgagaaaagggtgtctttttagggcagatgacttagaagttcttttacgtagccaaggcaaaagattgtctattgaaagcttggaagggctatatgtacatttggaggggaaaaaaaatttatcttacctccagcaagaagagatttctaaaatattgtgctgaaacacaatatacctaggattagacacttttagatagttaaatataagaaatgctaggcaagcataatttgtatatgtataatacaccctgaaaattttattctcarcttcacttctgtttagatctgagacactaaaaatatttcctttagcagaaaattcttcaatgattatagaaagaaaatttgctgtatagtcacaaatttaatatacaaaattaagaagtgccttaaaaaaattgtaacctgataatacttcgcattagtcctcatttcaaatatgtgaagcagccaagatccacaaaagtgtgtattttcatgtattgaatgaatatattaaaatgtttcttttaaattttattttagaaaagatacagtgaaaaccactgaaactgagttagatgaatt

SEQ ID NO: 24460 - DNA, 601 bp, Human
tagcttaaagccaggagtttgaccagcttaccagcctggataagggaagactttgtctctacaaaaaaaaaaaaaagtcttattaaattttaaaaaatataattaacctggtaatgatataaagatacaatactgtattgttcagtcatgtatacatatacatatatatcttatgtttttcattgatttctattttgagagatatttgttctttaaatatatatctttttgttgtgtgatttcatctaggctgacagagtacttcttggtggtcctggtagcttttattggcaaggtaggytaatattttttaaattacaattggtgactatgtgtcgctgattcacctggctaattgtatgcctatgacattttacaaattattttaaagaaagaaatggaaatacaattaaagtatataaacactccattttacacagtgttttttaaaagaatatatataatatatattaaatatgtgtatattcctagaagaaaataaactgaatatttaaaaagtaaatacatacttttatgttaaatatattttaaaagtaattatataaagtaatttatttttattgtgtgtgatatatacttc

SEQ ID NO: 24461 - DNA, 601 bp, Human
atgtatacatatacatatatatcttatgtttttcattgatttctattttgagagatatttgttctttaaatatatatctttttgttgtgtgatttcatctaggctgacagagtacttcttggtggtcctggtagcttttattggcaaggtaggttaatattttttaaattacaattggtgactatgtgtcgctgattcacctggctaattgtatgcctatgacattttacaaattattttaaagaaagaaatggaaatacaattaaagtatataaacactccattttacacagtgtttttyaaaagaatatatataatatatattaaatatgtgtatattcctagaagaaaataaactgaatatttaaaaagtaaatacatacttttatgttaaatatattttaaaagtaattatataaagtaatttatttttattgtgtgtgatatatacttctccatgtctgtactctaggggccatgacatagtcattaggcagtgtgcgaaaccaatctgtataggccaactgtggcattctaaaagttgaaggttttgaaagtattttgaagttgctcattaggatatttaagtcattattttatt

SEQ ID NO: 24462 - DNA, 601 bp, Human
tatatataatatatattaaatatgtgtatattcctagaagaaaataaactgaatatttaaaaagtaaatacatacttttatgttaaatatattttaaaagtaattatataaagtaatttatttttattgtgtgtgatatatacttctccatgtctgtactctaggggccatgacatagtcattaggcagtgtgcgaaaccaatctgtataggccaactgtggcattctaaaagttgaaggttttgaaagtattttgaagttgctcattaggatatttaagtcattattttattattactgrtattgagaatgatctctaagtgtttggggacttcttaaaaattgaagctgggcatggtggcgtgggcctgtaatcccagctactcgggaggttgaggcaggagaatcacttgaacccaggaggaggaagttgtagtgagccaagatcatacgactgtactccagtctgggtagcagagtgacactctctctcaaaaaatatatataaaataaaataaaattggaggatcttaataggtttttaaaaaatattaaactggcattgatataaagatgcattattatattattcagtcattct

SEQ ID NO: 24463 - DNA, 601 bp, Human
attgaatttcatatgttcttggtaccgctgaagcccagatgataaagtagtgacctggacagagaaagtgcttctgtgctgtagatccagtctctgtgactgaacagatgggaacaggactgaaaatgttagctgttacacatttctttctaaaacagcagaaatgataagagattactgtgtccatattgtggagacaacacttgataaaccagctatcctttcttggcatggagggcaggctgatttttgtgtagtcatctagatttcttgtctgcttaataacaaggttgtgaacaaaggtgaactcatccattcaggttgtttcctaaagatgtttaaattactagttaaaaaatatcaattgaaccaattattctgattataaaagtaacagtattgtttcagtaaatttttcatgttttaatggattagttgggtgatagcctttgattttattattccgtgtatttaacattgctttctagtgatttaagacaagtcctgttttcttaaatttttattagcagagactacttttaagtactggcttaaacagaaataattttaagttaagaatatccattttcaaattgagtat

SEQ ID NO: 24464 - DNA, 601 bp, Human
gattatttgtgcagtgataataataatagctagcctttaagatatgcttactgtgttctgggcattgttcaaggtgacttggtttgtattcactcatttaatcctcacaagtcaagcatactgtattattctcattttgtaggtgaaaacactgaggcactgagacgcaaaataacttgcccaaagtcactcgcttgtaacttgctgttcagagattcaaatggagacagtctaactcctgaagttttcttcatgatgttaaataaaagttttggtctttaggacttattaacatgtgttmtctctttcaatttctttatgatatattaaaacaagtcatatatgacagaaatagtacttgctgattgagagaatttatttgttctttatgatgagttgtaaatttggtgtttttaacagactcctttgtaaagttaataagacaattgtagttttgtaataaaaatagactatttgagtatttaactcagtttcatttaaaattcatatgtcatatatatatgaatctgttatgactaggggacaaaatattgcataagtaaaggagtttcttgaaaatattttcaaggaatgcttactc

SEQ ID NO: 24465 - DNA, 601 bp, Human
aataataatagctagcctttaagatatgcttactgtgttctgggcattgttcaaggtgacttggtttgtattcactcatttaatcctcacaagtcaagcatactgtattattctcattttgtaggtgaaaacactgaggcactgagacgcaaaataacttgcccaaagtcactcgcttgtaacttgctgttcagagattcaaatggagacagtctaactcctgaagttttcttcatgatgttaaataaaagttttggtctttaggacttattaacatgtgttctctctttcaatttctttmtgatatattaaaacaagtcatatatgacagaaatagtacttgctgattgagagaatttatttgttctttatgatgagttgtaaatttggtgtttttaacagactcctttgtaaagttaataagacaattgtagttttgtaataaaaatagactatttgagtatttaactcagtttcatttaaaattcatatgtcatatatatatgaatctgttatgactaggggacaaaatattgcataagtaaaggagtttcttgaaaatattttcaaggaatgcttactcagcaagcctgctgaagat

SEQ ID NO: 24466 - DNA, 601 bp, Human
tggctgggtgctgtggctgcagcctgtaatctcagcactttgggaggctgaggcgggtggatcccttgagccctggagttcaagaacagtctggacaacatggcaaaaccctgcctctagaaaaaacacaaaaattagccgggcgcggtgatgcacaccagtgtctagcttctcaggaggctgaggtgggaggatctccagagcccagggaggttgaggctgctgtgagttgtgattgcgccactgcactcccgcccgggcgacagagccgagaccctgtctcaaaaaaaaaaaaaaaaaaggaaaagaaaataaaattttaagcaattttaaaccattgttatggaatataacagaagaaatgaggaagatgttagcacactggtgagagtccaggctaggtctgtgctgaacttcctctagtggctgctgaaattgagacagctacacttggcttcagtgcctttcctttctgcttctttttagcccccaacactgttagtgatttccttagcattttcctccttgtcttcagcaaattcattcctctgggaggaagaattagtgtcttctttctttaggcatcctttgttaccttctg

SEQ ID NO: 24467 - DNA, 601 bp, Human
atctcttttagttttgttttgcactttcagctctctttagagctttcctttttcacatttatttacagctaagctgctcatcctatgcaagcctgtggtctcctgtggtagggaagaggacatttctgctccctgtgcattataagctcataataaacccaaacacatttgtactgtgtgtgattcaaaagcaaaatcatgtggcaagtaatctatagagatatgacacaaaaatgagctcctttccatatctttccaaacagtaatttttaaacagtagtagtagttacacataggggarccaattattatctgttattaataattattatctattatcctcatgacataggcatccatataaaacttgttgggttcaatcacaacatttgtctgtgactatatatctttgttagtgtgcttgtgtctggtatgttttgggaagtggagagaaagggagatagtagggtaggcctgagaaggagaattgatagtccttagacttaaatgtcatatatcaacaacactggaaggatatacatgtaatatattgtgtatatacatgtaatatattgtgtccatgatctaggaaaacaacaag

SEQ ID NO: 24468 - DNA, 601 bp, Human
taataattattatctattatcctcatgacataggcatccatataaaacttgttgggttcaatcacaacatttgtctgtgactatatatctttgttagtgtgcttgtgtctggtatgttttgggaagtggagagaaagggagatagtagggtaggcctgagaaggagaattgatagtccttagacttaaatgtcatatatcaacaacactggaaggatatacatgtaatatattgtgtatatacatgtaatatattgtgtccatgatctaggaaaacaacaagcctcattacctgattgtcrttgtgttggtagaataaacaaaagacaagacatttagattgaagcactatatgcagagaaaaaaaataaccctatttggtacatatattacaaatgttaattgtctaaactaattggatgaaatataaacatttcattttcatctttttatccagatggctgcatatttcggattttctgtagctgccactgacattaatggagatgagtaagtttaaaaaaaaatgtttccagaaagttatcttctcatgtttacgaatactttactcaaactaaacatttttttcttctgtttttgta

SEQ ID NO: 24469 - DNA, 601 bp, Human
aacctttctagagatcacagaatggatagttgaactagtttgtgtaatcaacagtatagtaagcctatgcccccttaaaacctaaaggaaaggtatacattaagaagaaaactttaaaaatacagatgacttgttgtatgtctcaaacagtagtggaaaggtaaatgttgtttgccctcaagatttcacacctgtcttgtgggtaggtgctgtcatttactagatgtgtcatctggaagattaaccgtagtcatttctttttctttgtttctttcttttttttctttttttttttttttttgaggcagggtctcactctgtcacccaggctagaatgcagtggtgcaatcatggctcactgcagcctcaacctcccagggtcaagagatcctcccacttcagcctcctgagtagctgggactacaggctcccaccacctagcccagcttattttttttagtagagctgaggtcttcccatgttacccaggctggtctctaactcctgagctcaagtgatcctcctgccttggctgtgcgaagtgctggaattacagatgtgagccactgtgcctggccaacaggagaagtttcagtggtag

SEQ ID NO: 24470 - DNA, 601 bp, Human
tggtatgaagttcataataaaatgtgaaaagaacactatataacagaccaaatcattacttaatcataacaaaagctacataggaaatacagggctaagtttgaggttccatcatgaataaagttaatgaattctttgctatgtagctgggcctctgtctcccaggttttctgggaagcctggtcatgtgtgatcttcaccttgtcttgatgttattccagttactttaaagaaagttttctcattactgtgatctagccaacatctcttccagctttctaagtttttgttataatgtgtygtctgtcagtagaacaaatatagacaacagctttaaaaaatgtgaagttttacaatgattttacaaagggctaaaatatagataaaatcatccatagaggatgattatggtctcccaaggtttctccttgggtcttactgtagcaaatagtagattgtgaatgataatgtctttagtgaaaaattatctgagctgtatttatgtatagtatttagtacatatgtgcaaatatagttacattatacatgtatatgttctattagttatgttagatcttttgttgttgttcatacatgaaga

SEQ ID NO: 24471 - DNA, 601 bp, Human
ttaaagaaagttttctcattactgtgatctagccaacatctcttccagctttctaagtttttgttataatgtgtcgtctgtcagtagaacaaatatagacaacagctttaaaaaatgtgaagttttacaatgattttacaaagggctaaaatatagataaaatcatccatagaggatgattatggtctcccaaggtttctccttgggtcttactgtagcaaatagtagattgtgaatgataatgtctttagtgaaaaattatctgagctgtatttatgtatagtatttagtacatatgtgyaaatatagttacattatacatgtatatgttctattagttatgttagatcttttgttgttgttcatacatgaagacattaagtgtcattgttcctgtattcctatattcctctctttccacctacccccaccctaggcatcatcaagagggatattgaaaacaaaacaataaagttatgttccaaaattttatatagccccaaggtaattatgtgcagttttttatcagtacttttccagaaaaagcagaggaaaaaaaagaaaagcaggaaagagcatctaaaatgatcaaaggaagaaa

SEQ ID NO: 24472 - DNA, 601 bp, Human
ggcttaaaaaaggataaaaagaatacttttacataagttaggtactcatttttaaggataacaaattcttagttggtgtttactgcaggccaggcactcttctaggtggtgaaaatgagcataaatcagagtctactcatgtctttaagaaactcagcatccaatgggggcagcatatatgtttaaaaaaaaaaaagtacctcaatgtgatcatcacagtgtttgagatcccaggcttaatggtctcatataaaggatgagtgatcaaggcatcgttgatgtttcaggggagccaggagaygatgaggcatggcttattaaggagctatgagacagctcgtgtacattaaggaaattgaggcaatttgttatgactggtacgtagggtctgtgataggcaagatacgacatgtccttggtctcatgaagcttatgttctatagcttacttactttgtgtagtcatagaataagtaaacaatggggaaatccagatagtgataaagatgatggattttttagaaggcaaggtaatataatagagtttcgggatagagagggtgatagagaaagtagggggtcgagaggggtggtgcactgct

SEQ ID NO: 24473 - DNA, 601 bp, Human
acttctttttttaaggttattaatacacatggtcaagttaccatcccactccctccacaggaaggtttttgtcaactttttaaagcactcaccagcagtaaatgagtcattgttttcccatacttgtgcttcttttaaaataatttttaactgtataacaggtggacagtgtattttaactaacagtttgtgattctagaaataaggcatgagtttgattcttttttttgagatgaagtctcgctctgttacccaggctggagtgcagtggcgtgatctcagctcactgcaaacttcaccrcccgggttcaagagagtctcctgcctcagcctcctgagtagctgggattacaggcaggcgccaccacgcacagctaatttttgtatttttagtagagatggggtttcaccatgttgatcaggctggtcttggtcaggctggtctcagtcaggctggtctcgaactcctgacttcgtgatctgcctgcctcaacctcccaaagtgctgggattacaggcatgagccaccacacccggccatcaggttgattcttaactatacataaataaaaatgattatttttactaataatctaatgta

SEQ ID NO: 24474 - DNA, 601 bp, Human
gaaggtttttgtcaactttttaaagcactcaccagcagtaaatgagtcattgttttcccatacttgtgcttcttttaaaataatttttaactgtataacaggtggacagtgtattttaactaacagtttgtgattctagaaataaggcatgagtttgattcttttttttgagatgaagtctcgctctgttacccaggctggagtgcagtggcgtgatctcagctcactgcaaacttcaccgcccgggttcaagagagtctcctgcctcagcctcctgagtagctgggattacaggcaggcrccaccacgcacagctaatttttgtatttttagtagagatggggtttcaccatgttgatcaggctggtcttggtcaggctggtctcagtcaggctggtctcgaactcctgacttcgtgatctgcctgcctcaacctcccaaagtgctgggattacaggcatgagccaccacacccggccatcaggttgattcttaactatacataaataaaaatgattatttttactaataatctaatgtatagttatgaggttgattcttaactatagattattagtaaaaataatcattttcatttgtg

SEQ ID NO: 24475 - DNA, 601 bp, Human
ctgggattacaggcatgagccaccacacccggccatcaggttgattcttaactatacataaataaaaatgattatttttactaataatctaatgtatagttatgaggttgattcttaactatagattattagtaaaaataatcattttcatttgtgtgtatatatatatacatttgtatatatatacatttgtgtgtatatatatatacatttgtatatatatacatttgtgtgtatatatatacacatttgtgtgtatatatatacacatttacttctgtgaatttcctttttgtgtctyttttttcttctttgctactgggattgtattttgcttttctttcattcattcattttttttaaactttcacagtgccttaaatgttgcaaatattaacttcttaactcttttatgtattttctagtttgtcagatttgcattttgagcataaagttttaaacttttatgttatttaatctgtttttattttttttttcatgtgattttctgtttagaaaagacttcctcaaatttagcttgggtatactgtgagatagagctctcatttgactttttctgaatcgtgaaccagttgaacct

SEQ ID NO: 24476 - DNA, 601 bp, Human
tcaaaaagaaagaaaagctaataagatctcagttcatttatatgtaattccaaacaggcccatgaacacttacatttttaaaagatatcttgtttttctgatttaatatctatgaacagttgtatgaaaaaaattattttgctctaatatattaattttctgcttattcctttactagtttccaaagaaaaatataataatttttcataagttaaatgtctgaattcttctctactccattctttctctcatctttgtcatttgtatgctacttcagtaatttttgctctattttcattayagatttttttttttttttttttttttttgagacggagtctcgctctgtcgcccaggccggactgcagactgcagtggcgcaatctcggctcactgcaagctccgcttcccgggttcacgccattctcctgcctcagcctcccgagtagctgggactacaggcgcccaccaacacgcccggctaattttttgtatttttagtagagacggggtttcaccttgttagccaggatggtctcgatctcctgacctcatgatccacccgcctcggcctcccaaagtgctcattatagatattttt

SEQ ID NO: 24477 - DNA, 601 bp, Human
tttggtttacatagatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggtaagagctaacttttctgctaccttgttgttcctttttagtcattagttttttatctaaatgattttcactttctgtaaattagtgttagatcaaaaggaaaaacagaaaaatacacaaaggaaatttagmtttgtaaagtgtcatacctgaatgatggacttctacttctggcagattggatattccaaatggcctttccacaacaatactactgaacaaattatgataaacatatttcttaaatgcaactgaactttcaagacagtaaaagaaatcaccagagtccaaaaaaaaaatgagcaatcaactaaaaaactccagtggcaaaaatctgaattgtgagttataagcaaatatatgagcgagagttgctggcaaaggatgaagcctaaggagagggcaggtggtaattgcagacaccagcacagg

SEQ ID NO: 24478 - DNA, 601 bp, Human
ctccagtggcaaaaatctgaattgtgagttataagcaaatatatgagcgagagttgctggcaaaggatgaagcctaaggagagggcaggtggtaattgcagacaccagcacaggaattccgacagttgtataaggctaagtgttcttacgacagaggtgcattctgattccagcaagagccaaatgtaaaaccttgctgaaggggagcaatccagtatgggccccaggatttccataggttaagtttgatcaaatatgaattcattaaacacacacacacacacacacacacacacacaccgaagccactagaagaagcatcagattttagacccacaaagaccagctacagagcacaaatttgtataaaatgtttaaagaaataaagggcctgggcacagtggctcaagcttataatcttggcactttgggaggccaaagcaggaggatcacttgaggccaagagtttgagaccagcctgggtgagactctattttatttaaaggaaaaaacaaaacaagacaaaaacatcagtaaatatttagacaacaacataattaatgaacttgatttaacagacttatatagaacctacacctaa

SEQ ID NO: 24479 - DNA, 601 bp, Human
aatttcaaaaagtaattttatagaatacatactatcacagtgcagttgttagaaatccataacaaaaagatcaactgggaattgggaagtgtgatttttaaataacttatgggtcaaaaacaagatcataatggaaatttacttgcaaccgtattacaatgaaaatgtgacatcaaaatgtataggctatcacaacagtagaatgtaaagataaatgtatagccttaaatgctatttaatttaaatgaaagttaagaaaaaatgaaggtaagaaagaaacaccacaaaattaagaattgaratgggacattacagataagggaggaattaacagaatattttgaataaccttgggccagtacataggaaaacttttagacaaatcatggaaattcttagaaaaacaatacaactgtcaaaagaagaaacagaaaacctgaataatcctctaaacacttaacaaatagaattggccattaatctttacaaaacgacaaagcccagatggttttataggcaatatctatcaaacattcaagaacaagacttctcaattttaaatagctctttgaaagaaaaaaaaaaccaaaatatttcaaag

SEQ ID NO: 24480 - DNA, 601 bp, Human
ataaccttgggccagtacataggaaaacttttagacaaatcatggaaattcttagaaaaacaatacaactgtcaaaagaagaaacagaaaacctgaataatcctctaaacacttaacaaatagaattggccattaatctttacaaaacgacaaagcccagatggttttataggcaatatctatcaaacattcaagaacaagacttctcaattttaaatagctctttgaaagaaaaaaaaaaccaaaatatttcaaagtcaatctgtgaaactagtgtaattggttcctggagtggtcaagkatagtaccagaagggagaatttcattctagtcttacaatagatgtaaaatgactaagccattataagcaaataagtcttagcagtttgtaaaaaaagatacataaaccaagttggatttatcctagagtgggttaatattaagtctaaaaatgtaatttaccacatgaatagattaaagaagaaatatgtgactgtcttttttaagtgcaaaaaaggttttagagtaaattttaaaaacttcaagatttaagaagcaagacaaataccccaagttatgactatgaagaaatagaatctta

SEQ ID NO: 24481 - DNA, 601 bp, Human
atcatggaaattcttagaaaaacaatacaactgtcaaaagaagaaacagaaaacctgaataatcctctaaacacttaacaaatagaattggccattaatctttacaaaacgacaaagcccagatggttttataggcaatatctatcaaacattcaagaacaagacttctcaattttaaatagctctttgaaagaaaaaaaaaaccaaaatatttcaaagtcaatctgtgaaactagtgtaattggttcctggagtggtcaaggatagtaccagaagggagaatttcattctagtcttacartagatgtaaaatgactaagccattataagcaaataagtcttagcagtttgtaaaaaaagatacataaaccaagttggatttatcctagagtgggttaatattaagtctaaaaatgtaatttaccacatgaatagattaaagaagaaatatgtgactgtcttttttaagtgcaaaaaaggttttagagtaaattttaaaaacttcaagatttaagaagcaagacaaataccccaagttatgactatgaagaaatagaatcttacatttaaacaaagtccaccaatacctattaattggtca

SEQ ID NO: 24482 - DNA, 601 bp, Human
aatctgaattttcaagtcagagatatttaaagccactcaacatggagatatacagagaaagacatttcatatacatgaaataggaaaataattcaagaacagcaaagtgccagtttgtttacatagtattttagtattttgctaaatatatttgatatctgttatttttgatattttaattttaaaaagtgcatatatagtaaataaataattcttttcagaaaaccaaagaaagcaacaaaatttgataggtggtattctagttttagaaaatcttatgtgtaatgtatttaaatattgktaattctagttactatttctcctttttaaattacatgttcatgtttttacattaatatttcttccttcataactctttgccctaaatttagtttatcattttttttttgtctttctgagatcccataagctcttttttttttggtttgttttctgtatatgtgacagtagcaaaaggcaaattaaaatatttttaaaagtcttttctaatttttatattttaacaatttcatatttcatcctgtacattaataatcatagtatatgtgccattttctagtattcattaacatagaactta

SEQ ID NO: 24483 - DNA, 601 bp, Human
aaacatactaaaagttttgtagtaagagaattaagcatcagcttttaacattaaactaatttaaattaaataaaatttaaaaatcagttcctcagtgacactaagcccatttcaagtgctcagaagccacatgaggcttgcgagcggttactatattggacaatgcagttctagtgtttccctttctgctccctaatcctttggtgttagagatttagtgctttctgcagaaagagttgggtttttttctctcatttttttcattcaaatacacattaagttttttttgtttttgtttttkttttttttttgagacggaatcttgctctgttgccaggctgaagtgcagtggcgcaatcttggctcactgcaacctccgcctcctgtgttcaagcgattaccctgcctcagcctcctgagtagctgggactacaggaacccaccaccacgcccggctaattttttgtatttcaggagagatgagatttcaccatgttgtccaggacagtcttgatctcctgacctcgtgatccacccaccttggcctcccaaagtgctgagattacaggcatgagccaccgtacccagcctcaaatacata

SEQ ID NO: 24484 - DNA, 601 bp, Human
ttttttgtttttgttttttttttttttttgagacggaatcttgctctgttgccaggctgaagtgcagtggcgcaatcttggctcactgcaacctccgcctcctgtgttcaagcgattaccctgcctcagcctcctgagtagctgggactacaggaacccaccaccacgcccggctaattttttgtatttcaggagagatgagatttcaccatgttgtccaggacagtcttgatctcctgacctcgtgatccacccaccttggcctcccaaagtgctgagattacaggcatgagccaccgtrcccagcctcaaatacatactaatttcttactttgtgcaagatgtaatatatataactgtagagacttggttttctgagcatggaagacattgcttttccatttctgaaactatctttcctgacagcatattttaatactatggctgcttcaatgccagctaagtcctttttttcccctatagagtgatatcagccaaatatctctatattacagttttattaatattttatacatatgtctcattgcaaacttaagatactcatctaacattctaactgggaatgttatacataccttat

SEQ ID NO: 24485 - DNA, 601 bp, Human
gaagtgcagtggcgcaatcttggctcactgcaacctccgcctcctgtgttcaagcgattaccctgcctcagcctcctgagtagctgggactacaggaacccaccaccacgcccggctaattttttgtatttcaggagagatgagatttcaccatgttgtccaggacagtcttgatctcctgacctcgtgatccacccaccttggcctcccaaagtgctgagattacaggcatgagccaccgtacccagcctcaaatacatactaatttcttactttgtgcaagatgtaatatatataactrtagagacttggttttctgagcatggaagacattgcttttccatttctgaaactatctttcctgacagcatattttaatactatggctgcttcaatgccagctaagtcctttttttcccctatagagtgatatcagccaaatatctctatattacagttttattaatattttatacatatgtctcattgcaaacttaagatactcatctaacattctaactgggaatgttatacataccttatcactagttaatttgttatctgtaaagtccacactttgatctaatcaagcgttgattta

SEQ ID NO: 24486 - DNA, 601 bp, Human
aacagatttttgcccaaggtgtagatacattttcttttttctccttagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaaggtaatatgcttaatagcagctcttcattacaatgatatttcattgccttctttctaaacctgtaaaagaaattcataaaataaaacaactattytaatataaaacccactctgcaaaaaatggtttagttcataagcagtacacttaggataagttcatttgtataatgggtaagaattgattctgtgatgtctagtgaaccacatcttcatagagtgcttactgagcctcatgagatgtgtccttcagtgactcagtttgaccttggctccatcacgttgttgtttcttcagggcataatatcacatcaagggtgttttgttgttaaaatttctacctttgggataagctataccattttactcatgattatcttgacttttggatatagtca

SEQ ID NO: 24487 - DNA, 601 bp, Human
cccctggttggcctctgtatttctgcctttctccccactatactttgtatgctatagaagccccagtgatccttttaaatataggtcaggttgtgtcactccagtgccttcccatctaactcaatgagaaagcaagaggctacaatgacctttaagcccaacatcaacaggcccttcctgcctctctgcttgcatctcctctccttactattctctttctcaaattttccaccttgctttcattgaacagatagccccaagcatgtttattcctccatgctttgaaaattgctcttccatytgcctggaattctttgtccagatatccttgtggcttattttcccatatccttctcatgtccttaaaagtaaaattatgtcagagatcttccctgaccaacccatgtgaaatagaaactgccttctacctcccaaccccacttttgatcttgcactttctgtcctccttcagaatctgttttctttaattgagacaaaacttacacaaaattaaccattttaatgattttaaagtgcataatttagtgttttttagtataattacaacattgaaccaccattaccactataattgtaaaca

SEQ ID NO: 24488 - DNA, 601 bp, Human
tttaggcaaatagaataaatttactcaattcaaatgctgtacatgtttttattttgttttttaaagaacgacagcttaacttttttgataatttaaactaatgaagttatatgatagcattataacctagtttaatattatcattttactccttaccccgaagtgattaaagctagaccttttagtttagcatcttgtccagtgtaagagatttcttagtatatactaaattatattggagaaattttaggaattttcgtttacaaagttagaaagttggaaattaactgcaacaagtgakgcattttgaagatatttaaggagtaaaaatgggatcagcacatagtaaactggattggattatttaaaaatcatttcaagctgggtgtggttgcctcacacctgtaatcccagcattttgggaggctgagacaggtggatcatttgaggccaggatttcaagaccagcctggccaacatggtgaaaccccttctctacgaaaaatacagaaaaattagctgggtatagtggcgcaggcctgtaattccaactactggggaggctgaagcatggaggttgcagtgagccgagttcatgccc

SEQ ID NO: 24489 - DNA, 601 bp, Human
tggattggattatttaaaaatcatttcaagctgggtgtggttgcctcacacctgtaatcccagcattttgggaggctgagacaggtggatcatttgaggccaggatttcaagaccagcctggccaacatggtgaaaccccttctctacgaaaaatacagaaaaattagctgggtatagtggcgcaggcctgtaattccaactactggggaggctgaagcatggaggttgcagtgagccgagttcatgcccctgcattccagcttggcctacatactgggcgagactctgtcaaaaaaaagraaaacaaatcatgtcagatgcaatcagaagtcagcctatcattgggagtttcatgtgtgtatgtgcatgctcttgatatcaaatgtgaaaccactaaattatcatatgcaggaaaagaatatactgtgaattccattaaaataaaatataatatttactcagatatttgttgattaagtcaatggactgtttttaaaactaaaagcttttttcctcgataggttaccactaatgtcacctggggcattcagccagcgcccatgcctgtgcctgtgtgggtgatcattttagcagttctag

SEQ ID NO: 24490 - DNA, 601 bp, Human
ccagcattttgggaggctgagacaggtggatcatttgaggccaggatttcaagaccagcctggccaacatggtgaaaccccttctctacgaaaaatacagaaaaattagctgggtatagtggcgcaggcctgtaattccaactactggggaggctgaagcatggaggttgcagtgagccgagttcatgcccctgcattccagcttggcctacatactgggcgagactctgtcaaaaaaaaggaaaacaaatcatgtcagatgcaatcagaagtcagcctatcattgggagtttcatgtgtrtatgtgcatgctcttgatatcaaatgtgaaaccactaaattatcatatgcaggaaaagaatatactgtgaattccattaaaataaaatataatatttactcagatatttgttgattaagtcaatggactgtttttaaaactaaaagcttttttcctcgataggttaccactaatgtcacctggggcattcagccagcgcccatgcctgtgcctgtgtgggtgatcattttagcagttctagcaggattgttgctactggctgttttggtatttgtaatgtacagggtaagtaacggactt

SEQ ID NO: 24491 - DNA, 601 bp, Human
aaattatttccaaagcatatttattccattgttttagtctggctatttacagtataaaaaaagcatttttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaatwaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcc

SEQ ID NO: 24492 - DNA, 601 bp, Human
ttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaataaaaactcttaaggcaactcactgatttacttctagcaatagcatgatgttacaggaatattacctctgtttaagcaaggtaatgtgtaaaatcagtctcggctstcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcat

SEQ ID NO: 24493 - DNA, 601 bp, Human
gacaggaacctggaccccttaccccaactttatgagtaatgcttggaataaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctytgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatt

SEQ ID NO: 24494 - DNA, 601 bp, Human
gtaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagtaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatc

SEQ ID NO: 24495 - DNA, 601 bp, Human
ttttttttatttttttttttttaagtattttaggcatatttaataaataacttcagtaaatagcactgtaaaaagtgaactgttaaaactaaaggcacttaaaacaagaatgtgactagtgtgaaacaagatgggcaactcaaatggtgagaagtaaacatacagtggtctgttatggcactaactcaaagtaagactcgcgtaggtgagagctgttgcatagccacagtataacttcacatgttcattaaaaaggcaaattgaccgctaaaacttcaaagaaaaagtactcataaaaaaagtcttaccccaaaattgcaaacaaatacattaaaagattagaagaggtgacagaaagcaccagacattaaacaaaataaaaataataaaataaattcaactcaaaaggtccccattcagcaaatactttgtaaagtatggcctgtatgtaaatagtgctaaatcaaggactttttagcagaaaattgctcggttcttttatctaaggcttgaatttgtaaagtgaaggcataaaagttaccaaacattaagtaactcttaaaatggcacacaggttttaaagctattggtttttccttcc

SEQ ID NO: 24496 - DNA, 601 bp, Human
tccattattatctgcaaagactttctagaagacattctcactctttgataaaaaagtctcacaaaatgttggcatcatctaggaaagcagtgaaaataaagctgaaaatgtatttaacccttctataaagatgtggctccacatctggaataatggatacgcagttctgtcctctgaatcttgaaaaactacactgcatagagcagttcgatatcaggattggaaggacttactacaagtagtaaaaatgaagcaggagaccgtaaaagaaagtattgataagttagttacataaaatcartaataacaaaaacattctgtgtcagaacaccgtaaacaagatgagaaactaaacaaaggttccacttcattaatgtgtatagaaatccaataaaaactgaggaacataacaaaaaaatttgcaaaagacataacaaaattataaaagaaatggttagtaaaaatatgaaacaatgtaaaacctgaaattgataggcttcaccaatgaattgatattctaatttacacttatgaaatgagcaacagttttttaacattaaagcacttcggttggaaatgtggtaaaatggtatttgtacac

SEQ ID NO: 24497 - DNA, 601 bp, Human
caagaaataatactttgcccagttttaagagaactcatgacatttatgacagtcaagaatgataaattctgaattatgtcttgtctttgatacagaagacaaggaagataacttatgtctctctgtggctttcagtgtcaaggtgatccaaaatcacaggtcccaaattttgcattgttctcaccggtttgtgggagctaaaaattaaaacaattgaactcatgaagatagtagaaggatggttaccagaggctgggaagggtagtgagaaggtggggaggaagtcgggagtgttaatggrtacaaaaaaatagaaagaataagtatgacctagtatttggtagcacaacagggtgactgtagtcaataataatatagttgcatattttaaaataactaaaagagtataattggattctttgtaacacaaaggataaaggcctgaggggatgaataccccatttaccattatatgactgttatgcattgtatgcctgtatcaaaatatctcatgtaccccatacatgtatacacctatttacccacaaaaattaaaaattaaattaaaaaatcctgctctctttggggaaggtctagttta

SEQ ID NO: 24498 - DNA, 601 bp, Human
tcaagaatgataaattctgaattatgtcttgtctttgatacagaagacaaggaagataacttatgtctctctgtggctttcagtgtcaaggtgatccaaaatcacaggtcccaaattttgcattgttctcaccggtttgtgggagctaaaaattaaaacaattgaactcatgaagatagtagaaggatggttaccagaggctgggaagggtagtgagaaggtggggaggaagtcgggagtgttaatgggtacaaaaaaatagaaagaataagtatgacctagtatttggtagcacaacagsgtgactgtagtcaataataatatagttgcatattttaaaataactaaaagagtataattggattctttgtaacacaaaggataaaggcctgaggggatgaataccccatttaccattatatgactgttatgcattgtatgcctgtatcaaaatatctcatgtaccccatacatgtatacacctatttacccacaaaaattaaaaattaaattaaaaaatcctgctctctttggggaaggtctagtttagatggtaactaggtcatagtattaatatttaacatatgtattgcattgtcat

SEQ ID NO: 24499 - DNA, 601 bp, Human
gaaggatggttaccagaggctgggaagggtagtgagaaggtggggaggaagtcgggagtgttaatgggtacaaaaaaatagaaagaataagtatgacctagtatttggtagcacaacagggtgactgtagtcaataataatatagttgcatattttaaaataactaaaagagtataattggattctttgtaacacaaaggataaaggcctgaggggatgaataccccatttaccattatatgactgttatgcattgtatgcctgtatcaaaatatctcatgtaccccatacatgtatacayctatttacccacaaaaattaaaaattaaattaaaaaatcctgctctctttggggaaggtctagtttagatggtaactaggtcatagtattaatatttaacatatgtattgcattgtcattgtgattctgatttttcattattttctctctgacacttcacataaaatgttctgttctttcttctttctgacagatgaaaatagatgtttaaaagcaaatgccaaatcatgtggagaatgtatacaagcagggccaaattgtgggtggtgcacaaattcagtaagtaaggttgctcaagtc

SEQ ID NO: 24500 - DNA, 601 bp, Human
gggaagggtagtgagaaggtggggaggaagtcgggagtgttaatgggtacaaaaaaatagaaagaataagtatgacctagtatttggtagcacaacagggtgactgtagtcaataataatatagttgcatattttaaaataactaaaagagtataattggattctttgtaacacaaaggataaaggcctgaggggatgaataccccatttaccattatatgactgttatgcattgtatgcctgtatcaaaatatctcatgtaccccatacatgtatacacctatttacccacaaaaattaraaattaaattaaaaaatcctgctctctttggggaaggtctagtttagatggtaactaggtcatagtattaatatttaacatatgtattgcattgtcattgtgattctgatttttcattattttctctctgacacttcacataaaatgttctgttctttcttctttctgacagatgaaaatagatgtttaaaagcaaatgccaaatcatgtggagaatgtatacaagcagggccaaattgtgggtggtgcacaaattcagtaagtaaggttgctcaagtcctttccatttgttctctggtc

SEQ ID NO: 24501 - DNA, 601 bp, Human
caagtcctttccatttgttctctggtcatttagtgtggctcagtgctgtatccttcagaagcacatattaatttttatgtaaatcataaaatgaataacctaatggtttggagctatgtggttcaacacagtagccactaggcagatgtggctattgagcacttttgtacaaattagaattgctctaagtttcaaagatatacaagatttcaaagacttagtattaaataaataataatggtgaaatgataatttttgtatatttaaaaataatgttataacagtgttaaaattttctctktttctttttttagtgtggctactaaacaattttaaaatacatatatttgtagctcatctttgtggcacatattagatttttatgggagaaccttcaaaaaaatcctagtcatttagtttgactgtttcagatttccccttttttgatggggaggtataaattaaccttcttaattatatttgagttaaactactggaattgatttgcatcccaatataagcttattgaggttaattagggtttggattttattcacttttgtcatctctatacttttgctaatatggtaccttccacaaa

SEQ ID NO: 24502 - DNA, 601 bp, Human
tgtatccttcagaagcacatattaatttttatgtaaatcataaaatgaataacctaatggtttggagctatgtggttcaacacagtagccactaggcagatgtggctattgagcacttttgtacaaattagaattgctctaagtttcaaagatatacaagatttcaaagacttagtattaaataaataataatggtgaaatgataatttttgtatatttaaaaataatgttataacagtgttaaaattttctctttttctttttttagtgtggctactaaacaattttaaaatacatatayttgtagctcatctttgtggcacatattagatttttatgggagaaccttcaaaaaaatcctagtcatttagtttgactgtttcagatttccccttttttgatggggaggtataaattaaccttcttaattatatttgagttaaactactggaattgatttgcatcccaatataagcttattgaggttaattagggtttggattttattcacttttgtcatctctatacttttgctaatatggtaccttccacaaagcctactaaatgttcagtgagtcaatgaatgaatgaatgaatatat

SEQ ID NO: 24503 - DNA, 601 bp, Human
taaatttcgtggattgattagtatttagaaatgtgtaattcactaggatcttgtgctttggtaggtagtagtttaggtttaataaatagtgcagctttgaattatctgattcttggtattcccttccagttgttgattacataaatactctcattagtatgatgtttctcttaaaaaatcttatgtaaaaactattgtgtattctttaaatttaaatatcttcacttactgttactttatacagcaccgttaaattgatatttgataaataaataccatatataatgtcactgtttcccccacattttcacatttcttgaaacacctttattcacagtctttatatagatctttaacagcagtgtttttgaattcactaaggcacttttcagttatatgattaaatttttatttctaagttgtttgatgtataccacatttaaaatctctgtcattactagaaattttactactgcaaatatccattcacctgccattaggaactttttttccttttttgaaatttacctgccattaggaccttttacccttgtcatatacttactccttttacccttgtcatatacttactattttgctt

SEQ ID NO: 24504 - DNA, 601 bp, Human
aaaagttttttaaaaacttatttacaataatagctaatacttaaagttttttcaaacctgtgggaatacttatttaatcggtgctaaatttcgtgttgtccttttaaaaaatgcaataattaattgagatgtttttaagctcgtctgttttccctaaacatcgggttgttcagcatattgcgatggggagagtgccacataatatgagacgctttgtaaggacttttcaaagggaaattttggagaaatgatctgatatttgggtgtatgtatacattattagtagccattaaccatgctsaattagtgatttcactaaagaaattgcttttgattagatactctgaattacaagatagagcatttactgtgtacacttgggtcagttctgggaaaggtattactttcttggaaatgattgttttttaacaagaacacttaccacagtttggatgaagggagcatattgtttaaaagccagaattggggtacattagatgtgatttgatgttttgcaatttaattgcttatttgcaattattatgtaaaaaggtttgaccattacaattttcatttatacctatattttatatgtcattta

SEQ ID NO: 24505 - DNA, 601 bp, Human
ttgttcagcatattgcgatggggagagtgccacataatatgagacgctttgtaaggacttttcaaagggaaattttggagaaatgatctgatatttgggtgtatgtatacattattagtagccattaaccatgctcaattagtgatttcactaaagaaattgcttttgattagatactctgaattacaagatagagcatttactgtgtacacttgggtcagttctgggaaaggtattactttcttggaaatgattgttttttaacaagaacacttaccacagtttggatgaagggagcatwttgtttaaaagccagaattggggtacattagatgtgatttgatgttttgcaatttaattgcttatttgcaattattatgtaaaaaggtttgaccattacaattttcatttatacctatattttatatgtcatttagacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagct

SEQ ID NO: 24506 - DNA, 601 bp, Human
tatgtatacattattagtagccattaaccatgctcaattagtgatttcactaaagaaattgcttttgattagatactctgaattacaagatagagcatttactgtgtacacttgggtcagttctgggaaaggtattactttcttggaaatgattgttttttaacaagaacacttaccacagtttggatgaagggagcatattgtttaaaagccagaattggggtacattagatgtgatttgatgttttgcaatttaattgcttatttgcaattattatgtaaaaaggtttgaccattacamttttcatttatacctatattttatatgtcatttagacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggtatggaagcccaactctgtgaatacctgcgtgtttacttga

SEQ ID NO: 24507 - DNA, 601 bp, Human
ttgcctcataatgataataaaaataaaataataaataataaataataataaataaataattatttttaaagctgtctgccaggctttctaaagtaaagatcggatcatgttattcacttgcagggagtggcatcccactacacacagaacagagttcacaacttcagtgtctaaaaagtcagttgtaccctatcacgtgttctgccttgccctctccagactaatttatggtgttctatttgttttcttctcttataaactgactttttgtctgttttgtccactgtggattgggaatatsttttttatctttgcatcctgaaggcctggtgttttaagtatttgttgaatgaaactgaatacatacccattgagttacttatggaattcccaggtttttgtaaaaattatgacaacatgttttattttattgtgtttaccgtgtaaaccacatttatttggtttttctcgtttgcgtttgattgccaacaggcaagtttcattttctaatctcttgtctaattaggggagccacagacatttacattaaaattcaagagagctgaagactatcccattgacctctactaccttatggacc

SEQ ID NO: 24508 - DNA, 601 bp, Human
agaatatttgtttattcatttgttcagcatgtcattattgagagctggtgtgccaagaaaatgaatgtgagttatttttaaagtagggaggcaaaataaaaagattgtcttaggtcttagtccatttgtgctgctttaagaaaatactataaactgggtggcttatgaacaacagaaatttatttctcacagctctggaggtgagaagtccaagatccaggcagattgagcatctggtgaggtccctcttctgggttcatagatgataccttcttgcgatgtactcacatagcagcagggrgacagcagctctctggggcttctttgatgaggtcactgtaggagtctattcttacgttgctataaagacatatctgacactgggtaatttatgaagaaaagaggtttaattggtttacggtcctgcaagctctacaggaagcatggcgctagcatcagcaaggcctctggggaggcctcaggaagcttccaatcgtggcagaaggcaaagtggggagcaggcttctcacatggtgggagcaggagcaagagttggggagagatgccacacaattttaaataacagatctcatgagaactc

SEQ ID NO: 24509 - DNA, 601 bp, Human
caagaaaatgaatgtgagttatttttaaagtagggaggcaaaataaaaagattgtcttaggtcttagtccatttgtgctgctttaagaaaatactataaactgggtggcttatgaacaacagaaatttatttctcacagctctggaggtgagaagtccaagatccaggcagattgagcatctggtgaggtccctcttctgggttcatagatgataccttcttgcgatgtactcacatagcagcagggagacagcagctctctggggcttctttgatgaggtcactgtaggagtctattctyacgttgctataaagacatatctgacactgggtaatttatgaagaaaagaggtttaattggtttacggtcctgcaagctctacaggaagcatggcgctagcatcagcaaggcctctggggaggcctcaggaagcttccaatcgtggcagaaggcaaagtggggagcaggcttctcacatggtgggagcaggagcaagagttggggagagatgccacacaattttaaataacagatctcatgagaactcactcactgtggtcagaatagcaccaagccatgagggattgatctgcccccatg

SEQ ID NO: 24510 - DNA, 601 bp, Human
gcaaatctctgtctttccatctatccatccattcattcatttatgtaccatttttttcttggcaggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgyggagtaagcgcattcatttcctatcaggggatattgtttctattatgtgtgtgaattttaagtgtgattttactatgataatagaaaaattgaccttaattttcatagatttgattatcttagagaagtaattttaagtaaacccttaaattgcctgtatacataaagtgcctttataaaagcatatttaatctttatgcaaaccacacagttagtttattcatgcgggcttttaaaagacagaatgctaaccatttgaaacagcggggcaacctctctgtactgtagctggtggtctgg

SEQ ID NO: 24511 - DNA, 601 bp, Human
ctttaatgatgtggctgaggctgaaactagaagacattgtcatgtcaagtttgtcctgcgtacctactcttgtctcatttttgttccctccagtgcccccattctctagatgaccttctttgattttagaggcctcttagtggttatttttcagtcaatttttgctaaggtgctaattgatgcccaaaataataagtgaaggaatatggatagtaattaagaatttttctatcaccactgatgctgggcaatttactcagcctctccagggctgttttcttctctttaagaagggatcatratagtatctacctcatagggctcttgtgaagttaaaatgcatcaatctctataaagtaccaatgagcattcagcaaatactaattcctatattgttattactttcgacttttcactagagtgtttgcaatttaaggttagtccctgctgttatagccgaagcaagtagcattccaggtagtacctagccttacacctcttttcttactagccattgatgtgtgagcctgttagcagctcgttgtggggagggcattctctgggctgcctctaactaggccttaacctgtggtattaaaca

SEQ ID NO: 24512 - DNA, 601 bp, Human
gcattcagcaaatactaattcctatattgttattactttcgacttttcactagagtgtttgcaatttaaggttagtccctgctgttatagccgaagcaagtagcattccaggtagtacctagccttacacctcttttcttactagccattgatgtgtgagcctgttagcagctcgttgtggggagggcattctctgggctgcctctaactaggccttaacctgtggtattaaacaagccataacacccttgattgtggctgtttttctgtgttggtcatgctgatccactcctctagatgsaaaagaatcagacattccacttttgaaagattgccagtattaataaatgtgattcccaccttaaagtattttactgtcttatgaagatctaaacagacgtattaaataaattaacgaaagcaggtaaattcctatagtcctatgattttataattataaattaccatagtgacaagaagattttacagttactttagattctttattggaaagggcaagaataaagtaaatgagtgcataaacagtactgattgaggagttagaatgggtgaaattatccttaaacaagatacttatttc

SEQ ID NO: 24513 - DNA, 601 bp, Human
tgtataactagattgaaaaattagaagagattataagggtgtatttaaatactaaattatattacttgatttcttaggattatccttctattgctcaccttgtccagaaactgagtgaaaataatattcagacaatttttgcagttactgaagaatttcagcctgtttacaaggtaaatgtgtgagataaaaagaacaagattctaaacatttttgattgttagaggcaaatcatgtctgaattgaaatgtgggaaaatgccaccagataggcaaaccgaattttacaaaagtggtttatrttaatttttaatcacatattataaaactggtttctaggtttgactcctaaagttagttaggaggaaacatgggaactggcatttaaagataaaagttgctcagtggatcctaattggttgaatgaatagcagttgtattttacgtgttttatcttttaattgcaggagctgaaaaacttgatccctaagtcagcagtaggaacattatctgcaaattctagcaatgtaattcagttgatcattgatgcatacaatgtgagtacatcttaaataagatcagttttggacaataccctgttg

SEQ ID NO: 24514 - DNA, 601 bp, Human
tcaaaaagatttatagtgttgttttcccctcacagatgggaggaagttgaattgaaattaaagaggaattggcttatcctttttgagcataattcagtgtactttaatcacaccgagttagccttcattaataatcatttaaataatctgaaggcggttgtaatttggtaggtaacccttgtgtgtctcgtgcaccactttcagcccccatccccctaaccctttggcagcttgaattttagacatttttacttcatgtcatgggggtaccataacgctttggaaaggccagcctaccatrtgaggcttcccttttttatggggtaccataatggtttggaaaggcctgacttggaggggtttttataaaggtttttaatattttacttgttccacagcttttcccattctcccctgtcttagataattttcctaactcttgttctttcaggggtgtgaacaagagatagcttgccattgtacccttctccatttgtcctgaatagtctcatatgttaaacaagccctggcttgaatccttccttcttgggggattttgtttttttttttttttggctgggctacaatggttccttaagca

SEQ ID NO: 24515 - DNA, 601 bp, Human
ccagcctaccatatgaggcttcccttttttatggggtaccataatggtttggaaaggcctgacttggaggggtttttataaaggtttttaatattttacttgttccacagcttttcccattctcccctgtcttagataattttcctaactcttgttctttcaggggtgtgaacaagagatagcttgccattgtacccttctccatttgtcctgaatagtctcatatgttaaacaagccctggcttgaatccttccttcttgggggattttgtttttttttttttttggctgggctacaatrgttccttaagcaaatttgttcctagactgcatagttgattgtttaccctagtccatagttagctggagaggtaggactacagaaatgccattttgccgatggggaagacagcatttatttcgtttttttttggggggtttttgtttttgtttttgtttttgttttttagatggagtcgcactctgttgctcaggctggagtgcagtggtgtgatcttggctcactgcaacccctgcctcccgggttcaggcgattcttctgtctcagcctcccgagtagctgggattacaggtgcacact

SEQ ID NO: 24516 - DNA, 601 bp, Human
ccttcaaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtaagctgggtgttgtcagacagtgacagagctacattggtttagagagtataggcaggtcatattttgggacatccagagaatatctctctrtttggagcaaattattttttccaaccacggttgctcaccacaagatcagtttgatgatcttgtgtgtgatatttatagaaagttccttcctgcctttttttcttaaagtgattactctttaaaataaaagattttatagccatgaaagaagtatattcaacaaattgttaaggtagcgtttctctcatgtgagagcaatcaattttctagaacaaaataagcttgtgtaaaataacgtttataggaaaatgttttggaaaaacatcaaaccgatgatggcgatttcgtctgggaaatgga

SEQ ID NO: 24517 - DNA, 601 bp, Human
gaaagttccttcctgcctttttttcttaaagtgattactctttaaaataaaagattttatagccatgaaagaagtatattcaacaaattgttaaggtagcgtttctctcatgtgagagcaatcaattttctagaacaaaataagcttgtgtaaaataacgtttataggaaaatgttttggaaaaacatcaaaccgatgatggcgatttcgtctgggaaatggaattatgaagcagtagaagatgtttgtcttgtactacatgtacttctgcattgttggaataatttttaaaaaataaatrtgtgttgtaaaatacaaaagagaaaatggtattttcagtatgtagaatctagtactaagaaaactaacaaaattacttcagattttattttcacactgtggttactttttgtaattgaaaatgaaaaactgagtatacattgaataccgctttctctgtaaaagaataggaagagggaagagtgtttaatccagtgtcagccccaaaagactaggcttagaaggctattgactatgaaagaaatatatggctttagctcactatcaatttttaattgtctgtgctaagtaacaatttaaa

SEQ ID NO: 24518 - DNA, 601 bp, Human
cttctaacagtcaggaccctcagctgcaggtctgttgggagtttgctggaggtccactccagaccctgtttgcctgagtatcaccagcggaggctgcagaacagcaaatattgcagaatggcaaatgttgctgcctgatccttcctctggaagcttcgtctcagaggggcaccgggctgtatgaggtgtcagtcagcccctactaggaggtgtctcccagttaggctactcgggctcagggacccacttgaggaggcagtctgtccattctcagatgtcaaactccgtgctgggagaaccmctactctcttcaaagctgtcagacacggatgtttaagtctgcagaagtttctgctggattttgttcagctatgccctgcccccagaggtgttgtctacagaggcaggcaggcctccttgagctgcgatgggcttcacccagttttagcttttttttgctttgtttacctactcaagcctcagcaatgggggatgcccctccctcggcctccctgctgccttgcagttcaatctcagactgctgtgctagcagtgagcgaggctccatgggtgtgggaccctctgagctgggcatgggacc

SEQ ID NO: 24519 - DNA, 601 bp, Human
tactaggaggtgtctcccagttaggctactcgggctcagggacccacttgaggaggcagtctgtccattctcagatgtcaaactccgtgctgggagaaccactactctcttcaaagctgtcagacacggatgtttaagtctgcagaagtttctgctggattttgttcagctatgccctgcccccagaggtgttgtctacagaggcaggcaggcctccttgagctgcgatgggcttcacccagttttagcttttttttgctttgtttacctactcaagcctcagcaatgggggatgcccctycctcggcctccctgctgccttgcagttcaatctcagactgctgtgctagcagtgagcgaggctccatgggtgtgggaccctctgagctgggcatgggaccctctgagccaggcgcgggatataatcttctggtgttccgttttctaagagcattggaaaagcgcagtattagtgtgggagtgtcctgattttccaggtaccgtctgtcacagcttcccttggctaggaaagggaattccttgaccccttgtgcttcccgggtgaggcgatgccccgccctgcttcggctcacactccatg

SEQ ID NO: 24520 - DNA, 601 bp, Human
atgggggatgcccctccctcggcctccctgctgccttgcagttcaatctcagactgctgtgctagcagtgagcgaggctccatgggtgtgggaccctctgagctgggcatgggaccctctgagccaggcgcgggatataatcttctggtgttccgttttctaagagcattggaaaagcgcagtattagtgtgggagtgtcctgattttccaggtaccgtctgtcacagcttcccttggctaggaaagggaattccttgaccccttgtgcttcccgggtgaggcgatgccccgccctgcttyggctcacactccatgggctgcacctactgtccagcaagccccagtgagatgaacccagtacctcagttggaaatgcagaaaccacctgtcttctgtgtcgctcacgctgggagctgtagactagagctgttcctgtttggccatcttggaacctcttaaattatttttgttttgtgtgattgcaattttggcatgtttcttcaggtgcaatgaagggcgtgttggtagacattgtgaatgcagcacagatgaagttaacagtgaagacatggatgcttactgcaggaaagaaaacagttc

SEQ ID NO: 24521 - DNA, 601 bp, Human
gcgggatataatcttctggtgttccgttttctaagagcattggaaaagcgcagtattagtgtgggagtgtcctgattttccaggtaccgtctgtcacagcttcccttggctaggaaagggaattccttgaccccttgtgcttcccgggtgaggcgatgccccgccctgcttcggctcacactccatgggctgcacctactgtccagcaagccccagtgagatgaacccagtacctcagttggaaatgcagaaaccacctgtcttctgtgtcgctcacgctgggagctgtagactagagctsttcctgtttggccatcttggaacctcttaaattatttttgttttgtgtgattgcaattttggcatgtttcttcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatgg

SEQ ID NO: 24522 - DNA, 601 bp, Human
tgtgattgcaattttggcatgtttcttcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggtaagtaaagggcctgaagtggttgtaagatrtgatcccatctaatgccacgaaaaatcttgagtttagttggtgcataagtagaaaaggggtagcttgagggtcagtctcgcccctaggtatactttctcacatgttgttgcttattttacttttcagtcaatactgtgattgtatatttttaccattttgagaaatgatatgcttaattgcaggaaatggtgtttgcaagtgtcgtgtgtgtgagtgcaaccccaactacactggcagtgcatgtgactgttctttggatactagtacttgtgaagccagcaacggacagatctgcaatg

SEQ ID NO: 24523 - DNA, 601 bp, Human
tgtttgtaggaagagggataatacaaatgaaatttattctggcaaattctgcgagtgtgataatttcaactgtgatagatccaatggcttaatttgtggaggtaagtaaagggcctgaagtggttgtaagatgtgatcccatctaatgccacgaaaaatcttgagtttagttggtgcataagtagaaaaggggtagcttgagggtcagtctcgcccctaggtatactttctcacatgttgttgcttattttacttttcagtcaatactgtgattgtatatttttaccattttgagaaatgrtatgcttaattgcaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataagtaagtatttcctaattgcttgaaatagttgatacttcctcttggctctcctaagcctgtat

SEQ ID NO: 24524 - DNA, 601 bp, Human
ttaaatacagtgatttatataagacgcttagtgatttatataagacacttagaacgatgcctgacaccaagtgcatattaagagttttttgatgattgatgattttaaaattagagcttgatttaagcttgaatactgggaaagataatttgttaaaggatattaatataaagtgttgaatttgttcaacttctccggaggtgaaactttttttttttaatcttagttttcctagtagcctttttgtagattctttggaattttctaccatagtgtacatgtttttgtgtgaacataagcyttcatttctcttgggtaaatactaaaaatggcattttggagcatatggtaagcatatgtttaactttgttaagaagctgccagactcttagactcccatactgttttgaattatcagctaggtgttttgcaaatattgtctcccagcctgtgtctccttatcatttcatttttttaagtgtcttctgaacaccacaggttttaattttgattaagtacagtttaccaagtttttcttctgtggctcttgcttttacattgtctttaagaactctgcctaacccaagattataaggatttt

SEQ ID NO: 24525 - DNA, 601 bp, Human
agaatcctaaataatgttatctgtgtagcaagctattcaatggaaagctgcttctttctttaaaacaaacaaacaaaaaaaaccttcagtgaaagccagattcaaaaggttatataccaagcttgtccaactcgcagctcgtcggccaggacatgcagcccagaatagctttgaatgtggccccaacacaaatttgtaaactttcttagaaattgtaattattattattatttttttttggtaacttttttttaaagctcatcagctatcgttagtgtattttatgtgtggcccaagacarttcttcttcttccagtgtggcccagggaagccaaaagattggacacccctgctatatactatatgattccatttagaggacattctggaaaagcaaaactgtaggggcaaaaatcagtggttgctaggggctggaatgggggaaagtgttgaccacagaggggcgtaagggatcttccttgggatgatcttgattgtgggtggatttatgtatttgaaaactcacagaactatgtactttaaaaagatgtatgttcctctatgaaaattatatctcagtaaactttggcttataaaaatc

SEQ ID NO: 24526 - DNA, 601 bp, Human
tgagacagtctctctctgtcgcccagcctggagtgcagtggtgtgatatcagctcactgcaacctctgacttccagattccagcaattctcctgcctcagcctcccgagtacctgggattacaggtgcctgccaccatgctaggctaatttttttgtttttagtagagatggggtttcaccacattggctgggctggccttgaactcctgacctccagtgctctgcccacctcggtctcccaaagtgctgggattacaggcgtgagccactgtgccccaccagtattatccttaaataacraatttgttatgagtaaattttagggttggatagtgaaaattgatcatgaaatccaaattgcaaaatagaaaaatataacctactatgatatttgtatggtatgcaactacaatatcattattggttctcaaaagatttgagatcagtttcttgaatataacttgaaatttcattaaaagccagaagaccatatatatgtatgtatattatatatatatgtgtgtgtgtctgtgtgtgtatgtgagaatgattctaattttcaaatgtaagtttgtaactgttcatatctgaattttcatg

SEQ ID NO: 24527 - DNA, 601 bp, Human
atcagctcactgcaacctctgacttccagattccagcaattctcctgcctcagcctcccgagtacctgggattacaggtgcctgccaccatgctaggctaatttttttgtttttagtagagatggggtttcaccacattggctgggctggccttgaactcctgacctccagtgctctgcccacctcggtctcccaaagtgctgggattacaggcgtgagccactgtgccccaccagtattatccttaaataacgaatttgttatgagtaaattttagggttggatagtgaaaattgatcaygaaatccaaattgcaaaatagaaaaatataacctactatgatatttgtatggtatgcaactacaatatcattattggttctcaaaagatttgagatcagtttcttgaatataacttgaaatttcattaaaagccagaagaccatatatatgtatgtatattatatatatatgtgtgtgtgtctgtgtgtgtatgtgagaatgattctaattttcaaatgtaagtttgtaactgttcatatctgaattttcatgaaatgcttccagcatattctaataaaatcatgcaagcccctaaaact

SEQ ID NO: 24528 - DNA, 601 bp, Human
aatttttttgtttttagtagagatggggtttcaccacattggctgggctggccttgaactcctgacctccagtgctctgcccacctcggtctcccaaagtgctgggattacaggcgtgagccactgtgccccaccagtattatccttaaataacgaatttgttatgagtaaattttagggttggatagtgaaaattgatcatgaaatccaaattgcaaaatagaaaaatataacctactatgatatttgtatggtatgcaactacaatatcattattggttctcaaaagatttgagatcartttcttgaatataacttgaaatttcattaaaagccagaagaccatatatatgtatgtatattatatatatatgtgtgtgtgtctgtgtgtgtatgtgagaatgattctaattttcaaatgtaagtttgtaactgttcatatctgaattttcatgaaatgcttccagcatattctaataaaatcatgcaagcccctaaaactctgataacaaaggttaattgtgattagaactaaattctcctgactggtggttgagaactcttcttctctttcccaactgactgactgtaatagggcctg

SEQ ID NO: 24529 - DNA, 601 bp, Human
ccaaagtgctgggattacaggcgtgagccactgtgccccaccagtattatccttaaataacgaatttgttatgagtaaattttagggttggatagtgaaaattgatcatgaaatccaaattgcaaaatagaaaaatataacctactatgatatttgtatggtatgcaactacaatatcattattggttctcaaaagatttgagatcagtttcttgaatataacttgaaatttcattaaaagccagaagaccatatatatgtatgtatattatatatatatgtgtgtgtgtctgtgtgtgtrtgtgagaatgattctaattttcaaatgtaagtttgtaactgttcatatctgaattttcatgaaatgcttccagcatattctaataaaatcatgcaagcccctaaaactctgataacaaaggttaattgtgattagaactaaattctcctgactggtggttgagaactcttcttctctttcccaactgactgactgtaatagggcctggaagatttctgcttttctcactgcctaccttattgtgcagataaagatggtattgggaacacttacataaaaatcactgtgtctcaggcatga

SEQ ID NO: 24530 - DNA, 601 bp, Human
tcttgctgcgggtttttttggggtggggtggtgttgcactctgaatgatggaaactaatttgaattattttagtttaccttcatttaaaatgatgcctaatacagatagtgagcttaattttacctctaaccttgcatgttaaacttttgtttgagtggactttgaaataataaatacaaatgtttgtgtatacgacaagacagatttttctccaaaggtaagttcttccatataaattacactttggactcatctatatagggctttttttctttattttttgttttcttttttttttttgtccttcccttataattcttgagtattaaatactagatttagcaaatatattgtattaaagaaatttaattagatgctaatttattttcccaacatatttgaaggaatgtgtagcacttagcctcaaatcagataggatataaatgtggagtgtaatttatttgcactctggctttttaagatagtagttgccaaaatccagtttcctgacccccattttgaaatgtctgctctcacagctgtataatgtattagcttcagttgggactagagctgagagtttgatgtacacagttttgt

SEQ ID NO: 24531 - DNA, 601 bp, Human
agggctgaggtatgttgtctggttctgattggtatcacatgagctgctgagctgaaatcacagtggtttatttggtgtcttgcaggacccagcctttatatgttaatgtttttccctcattggtatgggatacctacaggatgaagttcagacttcatagcaaggcctctaggactgttcttcctttgtctcctcacctccaatcatatgcccccttaattcttttttttcctcttttttttttttttttttttttgagatggagtcttgctctttcgcccagtctggagtgcagtggtgygatctcagctcactacaatctccgcttcccgggttcaagtgattcccctatcccagcttcatgagtagctgggattacaggcacccgccaccacacccagctaatttttgtatttttagtagagacggggttttaccgtgttggccaggctgatctcaaactcctaaccaaaagtgatccacccacctcggcctctcaaagttctgggattacaggcatgagccaccgcgcctgccctcccctaactctagaaacttctgaactgtatgtatttctacttaaatgtcccattcttttccc

SEQ ID NO: 24532 - DNA, 601 bp, Human
ccacgatgacagcacattctgtgccatggagaacattcttaaatcaagcctccagtggaggaaggactcaagaatgaaatagcaccagataacggggcatcattagacttgtaaagcaaagcttccattttctatttttatataaaccattattaatgcctttaaaacaactgtgatatctggacaaataaaatagaaatgacttcttaagatgattgcaacttttagtcttgatttataaaaattattctacataattttagtagggtaactgataatttttctcactttttttttgttktagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtca

SEQ ID NO: 24533 - DNA, 601 bp, Human
acgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctrtcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaa

SEQ ID NO: 24534 - DNA, 601 bp, Human
aaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtatt

SEQ ID NO: 24535 - DNA, 601 bp, Human
ttgtttgtttgtttctagagcaaatcatggaggaagataaaaaacatggtgcactggtctcccttcgtcatgtccttcaagaagaagtacccctggatccagctggcaggacacgcaggtagacacagctctcccagactttcccagcatggtgctcagccctctggggaggtgccctggacgctgcattctggggatcaaagctccagagcaagttccctccaagactttctagtctgaaatcacagccacacttgcaggctgcggccttaccaatgccttgtaaatgccatagacaackgacctctctggagtctgtgttacccccatcctccaaaacatgcatcctcccctccctcggtctctggctcttatctctgtctcttccagtctctttctttctgtctctcttcccgttgtattcaataagacagatgaagccatcagtctttatagcttacctgccatttgtcaccctggacaaagaggcaaagctaaccccttcattgagcacctactgtgtgcctaaattgccatggtcctgggggttgcggcattaatggagatgtagtttctgccctgagggagcctgcagctggtg

SEQ ID NO: 24536 - DNA, 601 bp, Human
tcagccctctggggaggtgccctggacgctgcattctggggatcaaagctccagagcaagttccctccaagactttctagtctgaaatcacagccacacttgcaggctgcggccttaccaatgccttgtaaatgccatagacaacggacctctctggagtctgtgttacccccatcctccaaaacatgcatcctcccctccctcggtctctggctcttatctctgtctcttccagtctctttctttctgtctctcttcccgttgtattcaataagacagatgaagccatcagtctttatarcttacctgccatttgtcaccctggacaaagaggcaaagctaaccccttcattgagcacctactgtgtgcctaaattgccatggtcctgggggttgcggcattaatggagatgtagtttctgccctgagggagcctgcagctggtggaagatgcggccaagccaccccataactgcagggcggtgtgcggtgttgggaggaaggtggctaggagctgagtccaggcagtgccggggagaagggacatctggagccgaggccccagagccatctagcccacatgtaggaccctctggaagca

SEQ ID NO: 24537 - DNA, 601 bp, Human
caagggcaggctgaggaggctgttggaccaattagagcctccccatccccaggcatctcccattatttgcagagggttccgggacctgggctttgcccatgatggcccctttccttctccagtgagcagaagccaggggctggcggaaccagaaaaagggcaccggctgggttctgaggccccctagagagaaggaagagagagctgcccttggttcaggtgggatcgctgggggtgcggggagccaccaggtagggaggtcgcaggatggtgacttcctgctgtgtgagctgcaggggasatgggaatcgaggtctttccatttccccagccctggtgagtgggaagagagagtggctagtagaacatgctggtttcccaaaaaagacctgtatctgcctaaaaggaggaggaagcccctgacggaactcaagaaacccacatggcaggtcaccgcagggccccaggtgagcccggagcagtcactgggcctgtgtgcaggactggctcccacccccaggttcctgacaggggctcaggctcaccctgacacctgcccaggggataagcctggagaggactccagggaagaggagagagg

SEQ ID NO: 24538 - DNA, 601 bp, Human
atcactcacagggaaagaatgggggatggagaagcacaggccccactgtttgctcttgagccatccctggccacctccctcccaccatccaagttccttactatctttagcccacagggacctgggatagggcagggaggagaaagaacatgcccccagccagcccgaggcctttgcttttcccgagtctgatttctgacccaggatggcatccactggtgcaccagaatgtgtcctctcaggggaggcccagcccttccttccaacccagacagcagcaggacttcgcaggtgaccacayggagaataatccaagtggtgtccactcagacctggccaaaaaagtacggcctgtgtgaagaacactggctgggcatttctggaagtcggctgtcccaaagacacagccagccaagcacagggccaggctgccccagaacctgcctgctcctgctggggacaggagccccgcttcctgccccagggctgcccccacccagccgcttgacttccgcagcttctctctgattgcaccctagtgctctcaagagagatctagagtgaccgtggctggtacccatgtaacccatcttggcaggca

SEQ ID NO: 24539 - DNA, 601 bp, Human
gctagttccatttgggccatggactgtgccttcccccaaatgcgttcatccagaacccttggctgcagggcctctcccaagactggctgctcatggtcacctctagaatgtggcctttccatgacagggtgaggaggctggagcccagggttacctcacatgctgagtcccagggcaagagagtttgagacatgtcacagagaaagggaagggccggtcaccaaacaatgctgggcatggcgggggcagaagggtggcactaaggagaatgtgatgcagttgctggtggcgtctgcacgtyggggcttcttgggactctggctcccgccgacatgtgctcagtggctctggggcatgctctgagatttgtgacttgtcctggagagtcaacactgtcttcctgacattgggaccaggggcctggggagtgcaggtgagagcccgcccctagcacctaggagctctgggtggctttcgcctgccacctgttggctccctgggctggcctgtctcaaaggagcacttcctccacctgatcttgagtcccctcctcccccagcgtcctgtgagtgggcgagcaggtctctgcttccctgcatgg

SEQ ID NO: 24540 - DNA, 601 bp, Human
cagtgttggaacaaggcctgggagacagatgcaggaagagtggagggccaggtggagggcaggcgggcggggcctctgtgggcagctcccgcccacacagggcaaaggggagaaaacttccccatcctgcaactgacactgctgatttctgcctcctcaagggctgtgggcagcctctgagcctgttgtgtagggagactggggctctaaaaggagagcagaggagcgggggtgggatgactcaccccacctctgctctggagaaggtagaagcgcagagctgtgtgctgggggaggtggygtgtcccggcagctcagggccagcgattcagcccccggctgctcaagtgctctgctgtccctgcccctgttaccttccccagtgtctaggtggtccccgccagttcagctggagctgctcgtgtggaggccagggccgtgaggcagttgagttggaagcattttctcaggctttttggactgggggctcacctatgaggaggcctggtgtcgatggggtggggtgcaccaggcatgtctctgggatgagcagaggctgagggagccccctgcctttcccccacaatacggccttctccat

SEQ ID NO: 24541 - DNA, 601 bp, Human
tcacacacacattcacagatcccacactcatcaatcctataccacacacattcacagatcacactcataaaccctacatgcacacaccttcacagatcacactcaaaccctacatgcacacacattcacaaatcacacacattcacacacatgcagatcaatcacatgcatgcacacacattcatacagcacattaacacaagtcatacgtatacaaacacacacatgtattcatatatccacacacatttttgtgtgcacacccactcatacacaaacatgcatgcctttcccagtctcacacacacacacacacacacacacacacacacacacacacagagctgcagtcctggggctggctaatcccatgggtgggtgggtgtgaagcgggatcctgcggctccctgcagctgtgtaggtagttcaggaaagcagcccctctcgtagggactctcttgtggaggtcctcttgtatggggtcttacatggaggtggcctcagcctcagcctatgcccacagagaaggctgcggagccagcaggaggaactcatagggtcagccctgaggcagccagcagggcggtgcatctttctgcaa

SEQ ID NO: 24542 - DNA, 601 bp, Human
cagggagctcggtccttctcggaatgttctttgctctccttgtcccccagaccctcagctcctcctgtggcctctcctttccacttgatgaagcatcctcctgccacctgccagagccccctttgccccagctgcctctctggacgatgggggtgctgcctggctgcctgaccccaggggccaagcctgggagaacttaaggccacagagctctgtctcaaagccgttcccacccttcttcaacacttctgcttttatttcttggaaaagcattttgttctacactttttggggtctcccytaaggtctagaaagaggccaaatcagcttgggtctgttgttttccacctgcgaagaggaagccccttttttgggctcagcctcgccaggggccccacctgccctgcactgctggaagctggaatgtcacctgagccctttctgtgcccccggccttcctctggccccactgaggtgatgcaggggtatgtgtggccatatttgggaaagcgcctcgctcccatgcagaggctctgagctcacccaggaggggcaggctctttggtgcccactatccctgggccaggctgggaaggcccta

SEQ ID NO: 24543 - DNA, 601 bp, Human
cagggcgtgctccaggcacctcttcctgaagtctctgcatttggagattcgtggagaacctatttaagcccaattttaactgaaagccagtgagtctgatatggaagggaatgtaaaatttgcctgacttcttaagaacaaaacccccagctctgtgccccatgctccttggggcttgccacccactcctttgctgtcagaggtacaggagctgggagagtccaggagctagggacacagagggagactatggaccaaggtgtgtgtgtctggaggaaccactgcccaccccaccaccccrgggtctctggggaactgtcaacctgcccacgggacatgtacatttccccttttgtgctggaagtgtgagtgacacttgctgggggtggagggtgggacacatgaggatgtataagtacagattttaaaaaaggaaatcaacttacacttcctggctcttgtttaaaacagtggtgagctcctgtgtgggccgacttgctaaaggtcacacacgcgcccggtggagcacgagagacctcgtggcagcatgtgatctggaaggcaggcaggacgggggcgttggggagccaaagtcaactct

SEQ ID NO: 24544 - DNA, 601 bp, Human
tcaacttacacttcctggctcttgtttaaaacagtggtgagctcctgtgtgggccgacttgctaaaggtcacacacgcgcccggtggagcacgagagacctcgtggcagcatgtgatctggaaggcaggcaggacgggggcgttggggagccaaagtcaactctgggcctctggagctatagtgacttttgggctagaagggaccctggtggtctgtgcttcagccatttgcagggcaggggcatcattaattcagacgtaaagattctatgaatatggactggccaaaagttatccttaytccatctgtgaaagaagtttgctaaagcaaatcatgatatgaacaaaaattacaggggacctgtttaagagaacaaaatgttccaagcactttaggcagacaccagctgtttgcaaacaatgtgctaatatgcaaatgatgtgcttattaaaggaggcccatggggcctcttattggcaatacttggctgtgggttacattaaatatgtgaacatagtatgaagtagcatcattttagggttattctgttacttagggtttttgttttctgttttttttttctctttttttgtatttacc

SEQ ID NO: 24545 - DNA, 601 bp, Human
ccctggcagcctggaagaccgtgcctgcccagccctcgtcaccacagggactccttgggtcctggcagtgcatgtgccagcaggcaggacaaactctgtgtacctgtgcccaggtgaatgggcgcagggtcctcttgccctgtcctgcggggggccccacgagttcctggcattcagcactgcttagcattctcggaaggtttcttcaactgcttgcttttcccaggcttgcctttagtgtcatgtaagacatttttaagttatatttattttgttgggttttaaaattgcacagaacactaagaccgaaaggctggactcttgtttctccttgaaagctttgcctttgttttgaacttcctttcccacttggtagaaagagcccagaagcagccctggccctgtaagatggactctttcatccttcagttgtatttagctttgagtttctctgcatctgtccaccccatgtgtatataacccagcccctggctctggggtggtcacctcgtcagtgccttttgttctggaggagaggaccccccccgcctgccgagaggctctcttcctgttctgcacccctctccccatgggaccttgg

SEQ ID NO: 24546 - DNA, 601 bp, Human
gtcatgtaagacatttttaagttatatttattttgttgggttttaaaattgcacagaacactaagaccgaaaggctggactcttgtttctccttgaaagctttgcctttgttttgaacttcctttcccacttggtagaaagagcccagaagcagccctggccctgtaagatggactctttcatccttcagttgtatttagctttgagtttctctgcatctgtccaccccatgtgtatataacccagcccctggctctggggtggtcacctcgtcagtgccttttgttctggaggagaggaccccccccgcctgccgagaggctctcttcctgttctgcacccctctccccatgggaccttggagaaaactgaactgttacaaacccctgcacagtgcctgtcaaacagatgcaaaccttcctgaataaagccttggagaccagcgctgtctgtggtgtgatccttctggcccccagccctgagacctggctgaggggcaggctggggagtcttaggaagctagagggcccacatgggggctgttaggggagtgggtgtcagactgggtaacattttaatttgtaaagaatataaaccactc

SEQ ID NO: 24547 - DNA, 601 bp, Human
caaataactcatggtgggtttacaagtcattattctagttagactcttcatccacatatctacagggtaggcaaccgaaatacatattcaataaataacgttgaaaggtccatcaaaccgaagcatcatttactacgaattgatgtgcttaggaaagaaacaactgcctttaaaattctgaggttaaacagttactctaactgttctttagtttcatttcctcccaggatgtactgctcttttttaaatagggcgtgtactagaaatgaagtttaacgtaagtctgttgtttacaatgttmagagagagagggtaagagggaaaaggagagctgagagaatgcagcccacttgcaaaacaggcacctgtttcagtatgaagcagcagggagagggagaatgaagtgtgctttccacttcttcaggtcctttccttgatgaatggtctggaaatgtataaaacaagggcataggcagaccaagggggcacgttccacacaatactgagcacagcatgtcacttgtatcacatattaaacatcggtgaatatctttttgatgttgacacaagagttgggattattgttcgtggtgcaggtggc

SEQ ID NO: 24548 - DNA, 601 bp, Human
tagagaatacaatcaaactttaccacttggaggacacggggttagtccaggaccaaagaggccaatggatttttcaaagtgtgccccagcacaagaggcactggtgttcggtctacatttagttctccccactctgatcccctgactctccagcttccaggaaggttccttctcagagccaaatactctttgtgcaagtgccttcctgagcagaagaactggagaaagggaaccacagagccaggaggaatgtctgagcagagtcaagcaactggcttgaccacagtctgaagcaaggtgycacttaaacagatactgttttctcaaaggggcagaggaatcgtgttgcagatggcagccttttctccttcattttccccacattttctctggccctctaccttgcttcctgggagtttgatttaggattgctgttgaaggcttcctcaggcaaactccagcttaaagccctagacaggtaaaagcacacattggatggcagcatgggtttcttcccattttatgggcatgaaatatgtggtttagaataaggaacaagcattattcctttgccaacagcctcactctaagaggctttttt

SEQ ID NO: 24549 - DNA, 601 bp, Human
cccacttcagcctcccaaagtgctgagatttcaggcgtgagccactatgcctggcctgattccagcttaacttcattttaactagccgacctcgttacaatgacctcatttaacgagatgacctctataaagaccttatctccatataagagcacattcagaggtactagaggtcaggatgccaacatatctttttcagcagaacacaaatcaacctataacaatttctgatactgaacatggatgaacctcagaaatacgacgctcagcagaagaacccagacataaaaggccacaaatygcatgcttccatttatgtgaaattttcagaagatgcaaatccgcagagacagaaaggagattagtggttgccgggggctgggaaaggagcgactgctaatggggacagggctcccttttggggtgatggaagtgttctgaaattagatagaagaggtgtactaaatcccactgaattgtgcactttaaatgggagaattatacggtttgtgaatttcatatatgtatacttgttttttttttttttttttgagatggcgtcttgctctgtcacccaggctggagtacagtggtgcaatct

SEQ ID NO: 24550 - DNA, 601 bp, Human
taggagcttgcagtgagccgagatcgcgtcactgcactccagcctgggcaatggagcgagactccgtctcaaaaaaaaaaaaaaaaaaaaaaaggaaggagttagaggctccagtaagcagtaagctatgatcccgccagagcaggacccggtctcaaaaatagggtggggggtgggggagggggcgtggctgcattcctgatgataccttttgcctccagctccaatatgattggtcccggctccgtaactgacagatgttatgtatcttggcgctcccctcatctcccctaggactggccctggatatggccagggtaccccatggagggtgagcaatggcgctgtagggtgtcctttatgtcaacgctttgccgatgtgcgagcggaggaggcccctagaacgcgcggccgccacattttaaggaagtgacttttttttctttttcttattttagaatgactttattgcttcttatttttaaaatgacacgtgaaaaaggaaaaaaaaagatacttaagagttatacacacgttcagaaggaagagaaaagtacagtgaagggctgggcacccacacctggaatctcagcactttggg

SEQ ID NO: 24551 - DNA, 601 bp, Human
ggactgctggagcccaggagttcaaagccagcctgggcaacagagcgagtccccatctctgcattaattttctttttctttttctttcttttttttttttttatcgagacaagagtctcactctgttgcccaggctggagtgcagtggcgcaatcttggctcactgcaacctctgcctcccaggttcaaatgattcttgtgcgtcagcctctcaaggctgagattacaggcacccgccaccacacctagctaattttttttttttttttttttttttttttttttgtatttttagtagagrcggggttttgccatgttgcctgggctggtctcaaactgctggcctcaagcagtcctcctgcctcccaaagcactgggattacaggcaggagccactgcacccattctgtttccacttttggaggttgtgaatagtgccgttgtgaatgtgtctgtccaagcgtttgcttaaacacttgttttagtttctcttgagtctgtctaggagtgggattgctgggtcattagtaactctatgttgaactttttggggaacactcatatttcgttcgaactgtggccagtgctgagaactagagag

SEQ ID NO: 24552 - DNA, 601 bp, Human
catacgaggtcacgtttctgacttctcttggaaaaatttgaagctggtgcggttgctcacacctgtgattccagcactctgggaggctgaggcaggaggacacttgaggccaggagttttagaccagcctgggcaaaatagggagaccccatctctacaggaaatttaaaaaattagccaggcatggtgttgcatgcctgtaatcccagctcctcaggaggagactgaggcaggaggatcacttgagcccaggaggtcaagactgcagtgagctgtgattgcaccactgcactccagcccrggcacagagcaagaccttgtctccaaaaaaaggaaaaagaaaagaaaaatcctcgccaggcacagtggctcacacgtgtaatcccagcactttgggaggccgaggcatgtggatcacttgaagtcaggagtttgagaccagcctggccaacatggtgaaaccccgtatctactaaaaatacaaaaattagccgggcatggtggcaggcacctgtaatcccagctactcgggaggctgaggcaggagaattgcttgaacccgggaggcagaggttgccaagatcgtcttcatggtgcatga

SEQ ID NO: 24553 - DNA, 601 bp, Human
gagctgagattgcgccactgcactccagtcaaaaaaaaaaagacaaataaatgggtctgggatgaaggaaaaccggccgtgcctttgggacctccaagcaggagggagtctgttgtaaatacccctaggaggtggtggaccatcaacccgatttacagagagggaaactgaggctctgggggacaaagggacttgcccggagccttgagtcctggcagtctcagaggcaggaggggctccgccaggcctggggtgtgagggtgccttatctgggagagggtctccctgccatgcgcctagatggtggaggccctggaggggtccctggctggacccctgcttgccctcagcaccccatcctcatccctccacccagcccccaccccccatactcccacgggccctgcctgggcatgaggcctggctctcagggatgaaaggcccagtttctctggctgttaaggcttccagggctctccttgggctcttgatgttcccccatgcagctctcacacccctgatgggtggggtcagaactagggttaggggtatggggtgcccctcgtcaggtatccctgaggtccaagctgggtccttgcag

SEQ ID NO: 24554 - DNA, 601 bp, Human
tgcctgcctcgctctgacccacccccgcctcccgcatgtcccccagccgtgctcctgggtggtcccgcggcaccccccaccatcgctccgtctggatctggggctcacccacccaccgactagagggcacccccccgcccctcctgccctctgggggtcaggcagcttggggctcagatgttttggtgtaagatgggggtcagtcagctgggcaccgtggctcatgcctgtaatcccagcactttgggaggccgaggcgggtggattaccaggtcaggagattgagaccatcctggctaacatggtgaaaccctgtctctactaaaaatacaaaaaaaaaaaattagatgggcatggtggcgggcgcgtgtagtcccagctactcgggaggctgaagcaggagaatcgcttgaacccgggaggtgtaggttgcagtgagccaagatcatgccactacactccagcctgggcaacagagagagatattgtctcaaaaaaaaaaaaagatagggtcagtccctgggcctttacccagcaagtgtcctagaagcccagactggaggtgcctggagtggcattcgacttccgcgggagtgaagac

SEQ ID NO: 24555 - DNA, 601 bp, Human
ctctactaaaaatacaaaaatagccgggagtggtggctcacacctgtaatcccagtactttgggaggccaaggcgggtggatcacgaggtcaggagttcaagaccagcctggccaacgtggtgagacccagtctgtactaaaaatacaaaattagccgggcgtggtggtgggtgcctgtaatcccagctactagggaggctgaggcatgagaattgcttgaacccaggaggcagaggttgtggtgagcggagatcacgtcattgcactccagcctgggcaaccagagtgaactaagtctcaaaaaaaaaaaaagaaaaaagaaacctgctgggctgtgtcctctgcagcccaaactcccttccttagctgactttcggggtgttccctgagtttttcgtgacagtgggcgcaggcagcaccccgtctccccgaaggattctcaagtctgccgtgggtgcctgtgaacatcctttcacactcactgctttctcttttccctaattcagtcatcggggtccctgtccatcccctctttccagagccttctttctctccagacatgttttatgcccatgccaacaaacgcttttccatgtttta

SEQ ID NO: 24556 - DNA, 601 bp, Human
actgtgcttggctctgccaccacgcacccatctgtgagtaatgcacagagagacatcgtggcatcaacccttgtgcccagtcacgtccagccatgagcattcagtaagaggcttgagccagaccgccatatgcaatttgagagctgcctgaccctagcgggttgactgctctgtacctcagcttccccatatagaaaatcagggaaataaaaacacatgccgattcactgagttaacatctgcatcatggccgggcgcggtggctcacgcctgtaatcccagcactttaggaggccgaggygggcggatcacttgaggtcaggagttcaaaaccagcctggccaacgtgatgaaaccccatctctagtaaaaatacaaaaattagctgagcgtgatcgcaggcgcctgtaatcccagctactagggagagtgaggcagaagaatcacttgaacctgagaggtggaggtcgcagtgaggcaagatcatgccactgcattccagtctgggccacagagcctcaaaaaacaaacaaacaaacaaacaaacaaaaaacattaaaaacatttgcatggtgcatagaaggggcctggcccatcatga

SEQ ID NO: 24557 - DNA, 601 bp, Human
acccaggaggcggagctcgcagtaagctgagattgcgccgctgcactccagcctgggcgacagagtgagactctgtctcaaaaaaaaaaaaaaaaaaagaaaaagaaaaaaaagaagaaagaaattgcttgattccctatgttgtttctttgccctgagaactatttaataaagtagctctaaatccttggctgctcattgaagtcaccagggggctttttaaaaatcccaagagccacatccaacatcagttacttagtagagtctgggttgcagtctgggtttacatttaaattcctcmaatgactgcttggttgggcatggtggctcacacttataatccctgcactttgggaggccaaggagggaagactgattgaggccaagatttggaaaccagcctgggaaacatagtgagaccccactctatgtaaaaattaaaaaataaagcgaggcgtggtgactcacacctcgtaatcccagcactttgggaggctgagccaggaggatcgcttgaggccaggagtttgcagccagcctgggcaacaaagtgagaccccgtctctacaaaaataaaaaaattagcccagtgtggtggcat

SEQ ID NO: 24558 - DNA, 601 bp, Human
ggactggcttaggtacagaagggagtgccagcaggtgcagtggctcatgcctgtaatccttttggaggctgagacgggcggatcacatgaggtcaggagttcgagaccagcctgaccaacatggtgaaaccccatctctactaaaaatacaaaaattaaaccaggtgtgctggtgagcgcttgtaattccagctactcagaaggctgagccaggagaatcgcttgaaccggggaagtggaggttgcagtgagctgagaccatgccactgcactcccgcctgggtgacagagtgagactccrtctcaaaaaaaacaaagggatggtcaaaaggggcgagggcatacactaaccaactccccctgcggccagctgtccagagaccagggtcaccagtgccaacaccaacaccaagtagcaagtgtgggttcaaatcctgccggggtgcggatgggcagtggctttacccctctgagcctcagtttccccctcaggagatggtgtcggcatagttttctgaatgaaacaccgcctccggtggtggtgagaggacaggtgtgcccctgaggggctggcacagaaccctcagaggctgggcacctc

SEQ ID NO: 24559 - DNA, 601 bp, Human
aaggctgagccaggagaatcgcttgaaccggggaagtggaggttgcagtgagctgagaccatgccactgcactcccgcctgggtgacagagtgagactccgtctcaaaaaaaacaaagggatggtcaaaaggggcgagggcatacactaaccaactccccctgcggccagctgtccagagaccagggtcaccagtgccaacaccaacaccaagtagcaagtgtgggttcaaatcctgccggggtgcggatgggcagtggctttacccctctgagcctcagtttccccctcaggagatggtrtcggcatagttttctgaatgaaacaccgcctccggtggtggtgagaggacaggtgtgcccctgaggggctggcacagaaccctcagaggctgggcacctccccagagcaacggcagcccctcggccatctgggaaccccgcgcggggccctagggtggcatccccgggaggtgggcagggttgggtacatgccgaacaactgtgctgaggttaaaattgccttgtgatttttctcctgctctgcccggtcctgccagggctcagaagtaagtgttctcccaggggcttggtggggctggg

SEQ ID NO: 24560 - DNA, 601 bp, Human
agccatgtccccacgctcctgctgttccccagcctggagcaacgtcagccccaaacatcccccaggtctgtgggtaccacttgagcactgcctgtggctatgtgtgccctgtggccactagacccccagggcagctctgggcatgtccccccaccccagaacctcactaggcctttcccaggcctgccagccctgagcttggcttgcttgctttctttttcttgagacggattttccctcttgtcactcaggcgcactgaaacctccacctcctgggttcaagtgattctcctgcctcatccccccgagtagcggggattacaggtgcccgctaccacacccggctaatttttgtatttttagtggagacaaagtttcaccatgttggccaggctggtctcaaactcctgacctcaggcgattcgcctgcctcggcctcccaaagtgctgggattacaggcgtgagccaccacaaccagctgagcttggcatttaagacctgtcttttaggctgggcgcctcccggaaagaggaggttgtaatgagccgagattgggccactgcactccagcataggtgacggagggagtctctgtctcag

SEQ ID NO: 24561 - DNA, 601 bp, Human
caacgtcagccccaaacatcccccaggtctgtgggtaccacttgagcactgcctgtggctatgtgtgccctgtggccactagacccccagggcagctctgggcatgtccccccaccccagaacctcactaggcctttcccaggcctgccagccctgagcttggcttgcttgctttctttttcttgagacggattttccctcttgtcactcaggcgcactgaaacctccacctcctgggttcaagtgattctcctgcctcatccccccgagtagcggggattacaggtgcccgctaccacayccggctaatttttgtatttttagtggagacaaagtttcaccatgttggccaggctggtctcaaactcctgacctcaggcgattcgcctgcctcggcctcccaaagtgctgggattacaggcgtgagccaccacaaccagctgagcttggcatttaagacctgtcttttaggctgggcgcctcccggaaagaggaggttgtaatgagccgagattgggccactgcactccagcataggtgacggagggagtctctgtctcagagaaaaaaaaaaaaaagagagaaagaaaagaccagtctc

SEQ ID NO: 24562 - DNA, 601 bp, Human
ccccccgagtagcggggattacaggtgcccgctaccacacccggctaatttttgtatttttagtggagacaaagtttcaccatgttggccaggctggtctcaaactcctgacctcaggcgattcgcctgcctcggcctcccaaagtgctgggattacaggcgtgagccaccacaaccagctgagcttggcatttaagacctgtcttttaggctgggcgcctcccggaaagaggaggttgtaatgagccgagattgggccactgcactccagcataggtgacggagggagtctctgtctcaragaaaaaaaaaaaaaagagagaaagaaaagaccagtctctcccctcatccactctccaatccttccctgggcccagcaagggacctctggggctgggggtatcctcccagccacccctcacacgggccccattagtggctggcacccacctggagcgtgtgggctgtccctctctgtcattggtgtcgtggtatcgtcctttcctctctcactcagcggcgcctctctcctgcccctctctgtctccggcagacccagaccgtcatgtacgaccttgtatcggagctgcacgctcagcac

SEQ ID NO: 24563 - DNA, 601 bp, Human
gagattgggccactgcactccagcataggtgacggagggagtctctgtctcagagaaaaaaaaaaaaaagagagaaagaaaagaccagtctctcccctcatccactctccaatccttccctgggcccagcaagggacctctggggctgggggtatcctcccagccacccctcacacgggccccattagtggctggcacccacctggagcgtgtgggctgtccctctctgtcattggtgtcgtggtatcgtcctttcctctctcactcagcggcgcctctctcctgcccctctctgtctccsgcagacccagaccgtcatgtacgaccttgtatcggagctgcacgctcagcacgaggagctggaggcccgcctggccaccctggaaagccgcttggatgcgctgggtgcctctctacaggccctgcctggcctcatcgcccaagccatacgcccacccccgcctcccctgcctcccaggcccggccccggcccccaagaccaggcagcccggagctccccctgccggtggacgcccgtggccccctcggactgcgggtgacggccctgcccgccaccagacccctaaatcttggccatcgt

SEQ ID NO: 24564 - DNA, 601 bp, Human
gctggaggcccgcctggccaccctggaaagccgcttggatgcgctgggtgcctctctacaggccctgcctggcctcatcgcccaagccatacgcccacccccgcctcccctgcctcccaggcccggccccggcccccaagaccaggcagcccggagctccccctgccggtggacgcccgtggccccctcggactgcgggtgacggccctgcccgccaccagacccctaaatcttggccatcgtgtggccgccacctccgggaagccttgtacagtggcgcctcttggagttcaagaagccracgctgagtcaggctgagtggactgaggcctgccccgcccagactgcccaggcagagggcagggctggaccatgggtgagggcaggggagcccggagcttcctctggtcacctggtcccccgactctccccaggcccccggtgggcatggagcagcccggggaggggtccgtgctggttctgaataaagcaggacccgcctagtggctgcctgtgtgcatggctggaaggcactggtgatgtcccaggaggtagacctccagccctgggtaccaagatgaatgtgggaatcagaaaaacc

SEQ ID NO: 24565 - DNA, 601 bp, Human
tttatgtagatcatgcgctcagtaatattacccactaaatattaaattgctattaaatattactgcctaagtaattatagtaataaatttcttataaagcaaagtttttggaaagggataataagtgttcaagaatcataccaagcataataaatatagtcccaaattttttcaactctattccttaaatgtatgccctcaacttcatttattcattcatatttattgagcgtatgtctactatacgccaggtggctgtactggttattggaatgtgggtgtgtgtgtgtatttgtgtgcrtgtgtgtgtgtgtgtgtgtgtatgcatgttggcagagaatagtataaaaacaccagcaaaattgtacagaatttttgagagaaaattcttctcattttccattattacatcagttcttagaaacctcaccacttatgaacaattactacaagctctattataattctgctctactggaaattatttccactcaataaacaatcagttacttaacacaagaaatctagatctagaatgaatccttacctgcaagtaatttgaagagttgtattagccttaattgtaagtatgtctttttgt

SEQ ID NO: 24566 - DNA, 601 bp, Human
agaaacagcacctgctactgtgttttttcccaagggctgggtattggtaaggggctagggtattctttatactgcagtctaaaatagatgtatgtcattcggtttaatgcttagtattcaacaagtatgaagcaatggcaataacctacccaaggtcctttgtggacccccagcactcttccaggagggtaacatcacctccacttgtcacagtctctaccaaaaacacacaggtcctaagaaggctccatgcctttcgtgtgtgatcactatgttaaacccaagggtcttctatctttcrtcctggggtaagggttgaaaggcaaaatttaaaggcctcttcttcttgacaaagaagtctacttctccagttatcaaaaatcaatagcatgacttcttgctagcaagtggggaaagatgcattccagaatatcaaggcagggcccgaagtccattatttatgtagatcatgcgctcagtaatattacccactaaatattaaattgctattaaatattactgcctaagtaattatagtaataaatttcttataaagcaaagtttttggaaagggataataagtgttcaagaatcataccaa

SEQ ID NO: 24567 - DNA, 601 bp, Human
tcacttttggaattgtgagtgtcttacagaagaggccatcgctgcactcagtcacctccaccctttgctcactgccactctgattattgggccaaagccagtccaagtccctctgtcccctgaaaaattaatttcagggaggtattaatatgaagtgccagactgtgaggctatttctaagaaaagagaaaatttggttttgaaacttaaataaactcttcaacagacacagtcagtcttctaccggccaggcatggtggctcatgcctataatcccagcactttgggaggccgaggcggrtggatcacctgaggccaggagttcgagaccaggctgggcaacatggtaaaaccctgtctctactaaaaatacaaaaatgagccaggtgtggtggcgcatgcctgtaatcccagctactcaggaggctgaggcatgagaattgcttgaacccgggaggtggaggttgcagtgagccaaaatcacaccactgcacttcagcctgggcaagagggcaaccctgcctcaaaaaaaaaaaaacaaagtcttctaccaacaagtcagattgacatatgatgaaaagttataaactcagcttcagaa

SEQ ID NO: 24568 - DNA, 601 bp, Human
acaagcaaaggaaagaaacattgtcctgaaaagagtctgaagcaatgtctttatttgcacatgagtatgggaattgttttttatgaaatactagtaagaaaaaaaggttcctatgtgcaaaaaactccagagcccttggcaaaaaatgctttcctatgcattcttgggaaaatctcctactctgctgtagataacttatctctccacagaaatttctccataattcacccccaaatcttcctcgatttcaagaattttaggttttcttctcaaacataggaagactttttataagtctcartggccaacagtgaacacagatttaccttggaaacaaagatcagacccaaactaactgggcaaaaaagaggtaacacggcccaagctccagaatcaatgagtcttatttctcagagaaagcctcaggagagaagaattgtgtgtattcctcttggcaaacagcctttagagcaagccctttgttgtactcaattcttctttgagcctattgtcttttataactggtaaagagacgtgggaaatgaattttatttcaccacttaccttgaacatagacataaatgaccgaggccaagtcagt

SEQ ID NO: 24569 - DNA, 601 bp, Human
gcacagaaaagcagccaatctagcccaccacatgccatagccattatcttatgaggccagggctcacttcctggctccatccattgctgaagagaatggggtcagaagactagggaagtaaggtggcgaccagaggggacattaaacacctatccatagagaatacttcagtgtttcctttcccattgtttaacttcatggccaaaatcttggacagcccaactcctagaactttaagcttagacaggaagcagaatttaatggtatacccaaagacaggcagtgtaccaataaacagtgctagggattgccacttcttaatattgcctacctttcatccacatgttatgaaatattacataacttgcttacagagcaagcctttggaagctaaattaaccctttgacgtaagactaaacctatttagtaaatcaattctatttcggtatctcaaaaaaaggaaataaacaaaagaaacccaaaccaccacccagcctctcaaaataaaatatttactgaaactcatgaaatgaattttcacatgtctccaagtttcctgacttaggaagaagtaaataatgagatatgggggatgttcat

SEQ ID NO: 24570 - DNA, 601 bp, Human
ctgaggcaggagaatcatttgaaccggggggcagaagttgcagtgagctgagatagcaccactgcactttagcctgggcaacaagagcaaaactccgtctcaaaaaaaaaaaaaaaaaaagatttcaaggccaatcaaacattactcatacaatgttaacatgctgctggaaacctagtccattcctcagagatagagatgatgtggtgtggagtcatgcttgaaatctcagagagataacatttcacattgctatgcccaacacatctcatcaagcattctcagagtgcttcataatagycagtcaaagtgaagaaagagttaattaaaccacaggggacaaaggcagctaattccctgcaacagcagaagtttgatttccttcccagctggaaagcacagaaaagcagccaatctagcccaccacatgccatagccattatcttatgaggccagggctcacttcctggctccatccattgctgaagagaatggggtcagaagactagggaagtaaggtggcgaccagaggggacattaaacacctatccatagagaatacttcagtgtttcctttcccattgtttaacttcatggccaa

SEQ ID NO: 24571 - DNA, 601 bp, Human
gactgggttcttggctcacgcctgtaatcccagcactttgggaggctgaggcaggtggatcacttgaggtcaggagtttgagaccagcctgaccaacgtggcaaaaccccatctctacgaaaaatacaaaaaattagccaggcatgatggcacgcacctgtagtcccagctatttcagaggctgaggcaggagaatcatttgaaccggggggcagaagttgcagtgagctgagatagcaccactgcactttagcctgggcaacaagagcaaaactccgtctcaaaaaaaaaaaaaaaaaaagatttcaaggccaatcaaacattactcatacaatgttaacatgctgctggaaacctagtccattcctcagagatagagatgatgtggtgtggagtcatgcttgaaatctcagagagataacatttcacattgctatgcccaacacatctcatcaagcattctcagagtgcttcataatagtcagtcaaagtgaagaaagagttaattaaaccacaggggacaaaggcagctaattccctgcaacagcagaagtttgatttccttcccagctggaaagcacagaaaagcagccaatctagc

SEQ ID NO: 24572 - DNA, 601 bp, Human
actgcaacctccacctcctgggttcaagcaattctcctgcctcagcctcctgagtagctgggattacaagctcccaccaccacaccaggctaattttttggatttttagtagagatggggttccaccatgttgaccaggctggtttcgaactcctgatctcaggtgatccacccacctcagactcccaaagtgttgggattacaggcgtgagccaccgcgcccggcctatacatggatttttgactgcagaggagggaaagttaggggaactcccctgagttcccccaatccctgagttgytcacaggtcaactgtatattgctaaatgtttccccagtttgcaaagctcatgcttattcaagtaggcctctcagccttgcaataaaatgaaaatttaaaaactaccttagctaatactatttatcatagtaacaatcctaatagcagcaataactataataagtaatactaaatgaactcttactgtatatcagcacatctcatctttaaagttgaggtttgaacccaagttcctgactacaaagctatgctcttgacctctaggtcatgtggcctccctaacaagaaaaactagaaact

SEQ ID NO: 24573 - DNA, 601 bp, Human
gatttctattttgttcattcagaagaaattttcaagttcttgctagggatgccacgtgacctagaggtcaagagcatagctttgtagtcaggaacttgagttccaatctcagcttcaaagatgagatgagctaataaagtaagtgctcactaaatcatacttgttatagttgttgccacttttatgattacaactctaataaatagcattatctaaggtatttttaaaatttcactgtattgatgcattctcataatataaactccaaaatcctttccaaggcttataagtaggatgccayacaaattaccatgtaaactcagacatttatgtaaatgaaagagaataaacaaaaaattaaggtgattttctcaaggccagttcaatttaattccagttcaattacagttgacccttaaataacacaaacttgaactacatgagtccacttataagcagattttcttccacctctgccacccctgagacagcaaaaccaccccctcctcttcccccttttcctcagcctactcaacgtgaagacaaggatgaagacctttatgatgatccacttacacttaatgaatagtaaatatatttt

SEQ ID NO: 24574 - DNA, 601 bp, Human
aatctcactgccttctcgatctttgccatctcagtaaataacaccatcatttactcagttgctcatgctaacgctcgagtcatcttccactctttttctcttatactccacaaccaatgaattgatcagcggaccctgttgactctaccttcaaaatatatccagaagcagatcacctctcactacctccacctcaactacccttgtctaagccacccctcaactctcacttggataactgcaattagcctcccaactgacctccttatttctgcccctatttccctgaagtattctggaraacaaaagtaattctataaaaacataagccagagcacatctctctctgtgtattttgacaagtgcatcttggcaagtgaaataatttaaataaatttaggacacttagtgatttctattttgttcattcagaagaaattttcaagttcttgctagggatgccacgtgacctagaggtcaagagcatagctttgtagtcaggaacttgagttccaatctcagcttcaaagatgagatgagctaataaagtaagtgctcactaaatcatacttgttatagttgttgccacttttatgattac

SEQ ID NO: 24575 - DNA, 601 bp, Human
acaggcatctccagataaacatatctaacactgtttccctaaatctcactgccttctcgatctttgccatctcagtaaataacaccatcatttactcagttgctcatgctaacgctcgagtcatcttccactctttttctcttatactccacaaccaatgaattgatcagcggaccctgttgactctaccttcaaaatatatccagaagcagatcacctctcactacctccacctcaactacccttgtctaagccacccctcaactctcacttggataactgcaattagcctcccaactgwcctccttatttctgcccctatttccctgaagtattctggagaacaaaagtaattctataaaaacataagccagagcacatctctctctgtgtattttgacaagtgcatcttggcaagtgaaataatttaaataaatttaggacacttagtgatttctattttgttcattcagaagaaattttcaagttcttgctagggatgccacgtgacctagaggtcaagagcatagctttgtagtcaggaacttgagttccaatctcagcttcaaagatgagatgagctaataaagtaagtgctcac

SEQ ID NO: 24576 - DNA, 601 bp, Human
cacttccataatcgtcagtacatgccccgctttaattgtgtgattggactcaaggggtattccatttttatacctatgaaaaaaaattctcaggaattagtatagtcaaaggatttgctctcacacgaaatgatgctttgcatttatttccagtagttaccattttatttctgggggtgggtaaccaaggtacttcgcagggattctgacacgctcccccaccgtggcttccaccagagattccatgccacttccaaaagcaacaaaaggtttttctggaagaaaataaaaaaaaaaaaaaggtcaacttactgtaaatggtcatttgatttagtttttcatttcaagtgaaacgtcaaagaccttgagggtctgagtagctgcagttccaagatttcctgtactatctttcagtgggtcacttttcagcttctcccacacctcccgtgtttctcccacacctcctgtgtttgcatttgcttttctctccccgctagtgcactcccacaagcctagtgattgctcaagtctcaactcaaacacttgctcctctgtgcagctttctctaagtcccccagggatgcttgggtgctccttctcc

SEQ ID NO: 24577 - DNA, 601 bp, Human
tgatacatcaactacaatatcaaactagaagctttgcacaaaatctaaggagaagggtcttacacatctgtgtaccaggtgggcaattccatgagaggggaacatggtagtataacttagcttgacaactgtccctgtgggcattcttatttcacaacatttagctatcgagggtatcactactttaatcttgcatttgtccaccacaaagctcatttacacggcctcttaaacaaacatggccagagcacatggtcctacgtttcacttcagcttcaccacgccagatgacttttgtacrcaggcccagccatgatatgagtgaagcagcaggaggcagaggaacggtggtttggctgatttggaagacaatgtatcataataaatcttgggcagagaggaaaattgaatggactcaccatacacaaccagagagaccacatggctctgcttctcctttgaaatgggattggtaaggatgacagtgtaatttcctgtgtctctttcactcacttccataatcgtcagtacatgccccgctttaattgtgtgattggactcaaggggtattccatttttatacctatgaaaaaaaattctc

SEQ ID NO: 24578 - DNA, 601 bp, Human
caataaagaaacctgttacacatctacacatcaccttagcacctctcacactcacttgaccatggcacccttctccccactccattccaaacacttatttgtacctttcagtttcagaaaacaaagttcaaattatctttacatcaaaaacttactatctttcctttacagactcaaaatcagatcctgaactcctgtcaaaaaggaaaaaagaaaagctcccaaccaagccaacagtgtcaacttcaaaagccttcagagttggaacgtgcctgcacatctctgatacatcaactacaayatcaaactagaagctttgcacaaaatctaaggagaagggtcttacacatctgtgtaccaggtgggcaattccatgagaggggaacatggtagtataacttagcttgacaactgtccctgtgggcattcttatttcacaacatttagctatcgagggtatcactactttaatcttgcatttgtccaccacaaagctcatttacacggcctcttaaacaaacatggccagagcacatggtcctacgtttcacttcagcttcaccacgccagatgacttttgtacacaggcccagccatgata

SEQ ID NO: 24579 - DNA, 601 bp, Human
catttattatgtgccaagcattgtttgaagtgctttgcatgaattcattcacttaatcctcacaaccactattactgtccacagctttatacgtgagaaaaaaatgaaacagaaaaaaatgactcgcccaaggtcactcagttaacgaacggcaaaacctggaacaaacctagacactctgacttctgaacccaaacacgtaaaccacctcatgttaaaggaaggtgtaaatctttagagaatgcattcctgccaccatcatctgagtttttcattctctctccctcttcctccctccctctccactccctttccctcttcccctttcttccttctcccttctctcacttccttctttcttctctccctttttcctttctttcttttttgactccaaagtcaaaactatttccttattactgtcaacctaaagcctcagattatgctttgaagacttgacttcttttttatgtttatttcatatagcagagaatttgctaaagtgaataaaatatttagtggcttcatgaactgatgaaatgggctatttgctgtccgtgttttgtttttatttcctgttcatttcctcctcccatcctac

SEQ ID NO: 24580 - DNA, 601 bp, Human
aataacaactagccaggcatgggggcttatgcctgtaatctcagtattttgggacgccaaggtaggtggatcgcttaagcccaggagatcaagaccagcctgggccacatggtgagaccccatctctaccaaaaaaaaaaaaaaggaataaagtaacgaaataaaataaaaatgacaataagctaataataataataaactaacaagctgaatgactttatggaagtgttgaaatcctgtgcctctcatctgtattacagagatagttctctctgtcctctcaagtttaggagatcagggraaggctacagaaaacagctgaaatagcacagtaaatacatttattatgtgccaagcattgtttgaagtgctttgcatgaattcattcacttaatcctcacaaccactattactgtccacagctttatacgtgagaaaaaaatgaaacagaaaaaaatgactcgcccaaggtcactcagttaacgaacggcaaaacctggaacaaacctagacactctgacttctgaacccaaacacgtaaaccacctcatgttaaaggaaggtgtaaatctttagagaatgcattcctgccaccatcatc

SEQ ID NO: 24581 - DNA, 601 bp, Human
cacaatcagctaaagcttatccataaaactaagatgcacaggcaaaatcggcagcattgggagggcactgctcctatgtccttctgattgcctccataaagcccaccctcatcaactgttccacagcaagcccaccaatatgtactgaagctcaataagccaggcactgtgccagactctgaagactgagatgtaaataccacacagagcttgtggtttaaagcatctgtgaaaccattctctctccagtgtagttagacgcactgacttcacataagcccaggagatacctgagaagttktaatttatgaatgaaagcatcaatgatcaatccaagtcctctttcctaaatgccatgccactcacatgaatggcaaaaacaacagggaattacatagcttagtacccactgtgtgagtgatccaacccaaacctccagagaagagtacttactggtcacgtggaaggagatcaccctctctcctctcccgactttgttgaccgcttcacatttgtacaaagctgacacatttgccgcttggataacaagggtacttacagtctgtgcggggaaaaaacaaatcccaggccataaacaacg

SEQ ID NO: 24582 - DNA, 601 bp, Human
ctctcctgctcagtgggctgcatgtcaggttgcaaagtaatttcaggaccccctaaaatgaagaggccatagttattgaatggtgatttaacttggtacagctcactatcatcttgctgctttcagactactacaaagtaccaaaagaaatgaagctctatccgttccaggtgatgtactacaacttgacaaacaaactagacaattcaggtcccaaaatatcttatttggccaaacacattacttgaaaatgtaaacgaattcctcagatatttaccacatctccactatgagctctacrcaatgtttaatatattaaaaatccaaagcaaaatctctaattctaacagaattttaaaattaggtcttcattaacactaacactcaatgatatgaaagctacatttatgccaatgaattagccctggctataatattccattcagcacaatcagctaaagcttatccataaaactaagatgcacaggcaaaatcggcagcattgggagggcactgctcctatgtccttctgattgcctccataaagcccaccctcatcaactgttccacagcaagcccaccaatatgtactgaagctcaa

SEQ ID NO: 24583 - DNA, 601 bp, Human
tgttctcatggacacagagacctcactgtgctgtgacttcccagtggttgcctatgttctcctcctttccttcatgtttaccactgtgaatttctgacactctcctagctcatagcaggcattccacaaatatttgtctatttaaataaatggatgcccaagataaggcagaagtttccctggttcaagctaatatcccttgcatatactagtgaattactccatcatcaggttttgttattttctcctttcgatatatcatttcattattattagcttctttcttcctcaaggactttcrgtgaagaagtgtgcaccagtttacaacataatctcctagaggacagtaatctttgcatagcacctgaattgcactacatttaaggcattccaactgcctctgcacaatgatccagaattgtctccctacctaggactgtgagctgcctgaccacgcaatgtcttttcttggtcttcctgtcttgagcaaggcagacatagtctccttggtcctgcaaggatgcattcttaagctccatgatcaaaatgtcatttgtgctattagagaacatggtggcattcaatttccaaagagtatcca

SEQ ID NO: 24584 - DNA, 601 bp, Human
tggaattataacttttgaaatggttctggtatcagcaaagttttaaacagtttaaatttagtaaaaaggaacttgttgatatattaacttctgggaaaatacactggtcactgggtaaagttaaatgaaacaagtcagtcaggacactgcaaacagattaatggcttttaacattcatattagtgatactagctggtaatcccatcacaaaagaaaggttcagggtcacctttatggatttttcctctaattagacacagcctccccaggtgaaaacttccctcccatgaagattctagtmaataataccctagaatcccttcaaatttctcttggaagtgccaaattttagtatcattcaaccaataatgccttacatttatttggcaattcttataaaacttgtttacacaatttgtgttcctcactagtgatcttatgtaatgagcagaataggactgttagcgttatctcacagatgaaataaatgatgttcagcgacattaaaccacttgtccatgtccctgcaactaagtaaacagttgaactgtttacagaatctggtgaggctaaaagaccagttcagtgctatttccactaa

SEQ ID NO: 24585 - DNA, 601 bp, Human
tattaatccatctcctaggtattaagcccagcatgcattagctatttttcctgatgctctccttctccccaacccacagtaggccccagtgtgtgttgttcccttccctgtgtctatgtgttcacattgttcagctcccacttataagtgagaatgtgtggcgtttggttttctgttcctgtgttagtttgctgaggataatggcttccagctccatccatgcagctgcaaaggacatgatcagattcctttttacggctgcatagcattccatggtgtatatgtaccacatttttttttmtcccactgaccttctattatgaaaaatgcctccacttttgcacagccaagaacactgcatgcctggcaggtgtagaggccttcgtcctccttcctcactctgcggatagtgaggttccggttcccatccttcaatacaatgcctaacagaggaagaaaacgatcattctcatttatgatgatgtagtctgtgaagtttttcagggaaatttagaaaatataaatgctgcccttcatcttgttctattatctaactctgtagagtcacatgggatctactgctgactaatctcctatatgg

SEQ ID NO: 24586 - DNA, 601 bp, Human
tgctggttaaaagaatacatactcactgagaaaatttacaaagtacaaagaatattaaaaatcatctgtcgttgccctattcaaagtgaatgtgtgtctataagatacaaactaatcttcaaaaaccacaggatgtatctatgacttcccactgaccttctttttttcttttaagttccgggatacatgtgcagaatgctcaggtttgttacacaggtaaacatgtgccatggtgatttgctgcacctattaatccatctcctaggtattaagcccagcatgcattagctatttttcctgrtgctctccttctccccaacccacagtaggccccagtgtgtgttgttcccttccctgtgtctatgtgttcacattgttcagctcccacttataagtgagaatgtgtggcgtttggttttctgttcctgtgttagtttgctgaggataatggcttccagctccatccatgcagctgcaaaggacatgatcagattcctttttacggctgcatagcattccatggtgtatatgtaccacatttttttttatcccactgaccttctattatgaaaaatgcctccacttttgcacagccaagaac

SEQ ID NO: 24587 - DNA, 601 bp, Human
aacaaagacagaatcagggagaagaggctattcatcctgcctgattaagaatttttccacaataagaactgcaggaataggaaatgtgatgcaagcagaattataacaacattaattatgtttgctggttaaaagaatacatactcactgagaaaatttacaaagtacaaagaatattaaaaatcatctgtcgttgccctattcaaagtgaatgtgtgtctataagatacaaactaatcttcaaaaaccacaggatgtatctatgacttcccactgaccttctttttttcttttaagttcygggatacatgtgcagaatgctcaggtttgttacacaggtaaacatgtgccatggtgatttgctgcacctattaatccatctcctaggtattaagcccagcatgcattagctatttttcctgatgctctccttctccccaacccacagtaggccccagtgtgtgttgttcccttccctgtgtctatgtgttcacattgttcagctcccacttataagtgagaatgtgtggcgtttggttttctgttcctgtgttagtttgctgaggataatggcttccagctccatccatgcagctgcaaa

SEQ ID NO: 24588 - DNA, 601 bp, Human
agataaaaaccaaaaattttccatgtcagaagagcaatggtctattgttcacaagtgaatcttaattatctctagtccaattaaaactcggaatccttgtgactatctggatagcattgactgccatgattaggcagcaattctaatgtttttccaaataaatataaaggcatcatttctataagttaatcaagccattcaaacaaagacagaatcagggagaagaggctattcatcctgcctgattaagaatttttccacaataagaactgcaggaataggaaatgtgatgcaagcagamttataacaacattaattatgtttgctggttaaaagaatacatactcactgagaaaatttacaaagtacaaagaatattaaaaatcatctgtcgttgccctattcaaagtgaatgtgtgtctataagatacaaactaatcttcaaaaaccacaggatgtatctatgacttcccactgaccttctttttttcttttaagttccgggatacatgtgcagaatgctcaggtttgttacacaggtaaacatgtgccatggtgatttgctgcacctattaatccatctcctaggtattaagcccag

SEQ ID NO: 24589 - DNA, 601 bp, Human
aacatatctcgatgcaatacttggcatcatagatttggcagagtaaagggaccaaaatctagactttgagagacaagttaggatgagttcatagaaatccatcgatcccttctatcaccatacttctttcttacccttgcataccattcttttaccccacaacacagttttattctttccctggtgggctataaaaaaaaaagccataggaatatacttcttaagataaaatattctgccacaaattacttttcctagctaagaaaatgacagatttcacatcacttctgcatacacacgwattgagataaaaaccaaaaattttccatgtcagaagagcaatggtctattgttcacaagtgaatcttaattatctctagtccaattaaaactcggaatccttgtgactatctggatagcattgactgccatgattaggcagcaattctaatgtttttccaaataaatataaaggcatcatttctataagttaatcaagccattcaaacaaagacagaatcagggagaagaggctattcatcctgcctgattaagaatttttccacaataagaactgcaggaataggaaatgtgatgcaag

SEQ ID NO: 24590 - DNA, 601 bp, Human
gagtattaaatatctagctctgcctttcttagcattcactccaggtaagaagtaactataatctctgtgccagtgttacctagttaggcatctgtaaccagctgcaggccaccaacaagaggtaatgcagagcatcagagacaatctagacgtcattctgcggatttgccctaaaacatgaatcactttggaaatgacaaaactgccatggtctttgaaatctttatttgcaagtgtagtttatgaaatgctaataagcttatacatttgaaaatatgtcaacatatctcgatgcaatacytggcatcatagatttggcagagtaaagggaccaaaatctagactttgagagacaagttaggatgagttcatagaaatccatcgatcccttctatcaccatacttctttcttacccttgcataccattcttttaccccacaacacagttttattctttccctggtgggctataaaaaaaaaagccataggaatatacttcttaagataaaatattctgccacaaattacttttcctagctaagaaaatgacagatttcacatcacttctgcatacacacgaattgagataaaaaccaaaaa

SEQ ID NO: 24591 - DNA, 601 bp, Human
aaagtccagttgaacatagaggataaaaagttcaaagagtctgttttctatgtgtttgtatattaatattctcgcataacatttgggaacccagcaggagtattaaatatctagctctgcctttcttagcattcactccaggtaagaagtaactataatctctgtgccagtgttacctagttaggcatctgtaaccagctgcaggccaccaacaagaggtaatgcagagcatcagagacaatctagacgtcattctgcggatttgccctaaaacatgaatcactttggaaatgacaaaacygccatggtctttgaaatctttatttgcaagtgtagtttatgaaatgctaataagcttatacatttgaaaatatgtcaacatatctcgatgcaatacttggcatcatagatttggcagagtaaagggaccaaaatctagactttgagagacaagttaggatgagttcatagaaatccatcgatcccttctatcaccatacttctttcttacccttgcataccattcttttaccccacaacacagttttattctttccctggtgggctataaaaaaaaaagccataggaatatacttcttaa

SEQ ID NO: 24592 - DNA, 601 bp, Human
ctcagggcttcagaggacagctctgagtggaagaaacaaaatacagaaacaggctttccactaagagtgattagcaaagagatgataaggaagcagtcatcacttggggcctcccatcagaagagtgcaaggagaatcaaaccgggccacaagctgtgcggatggcccactacggcctcaagagagaagaagacaagtaagaaactggtttgcaaaataagtaacaaattggtttgcaaaataaaagttaacttaaccattgagagacaagcacaattatgcttggagtaaattttgtttytctggtggtcctagggaagtaattctctatttatacacacagatttaaaagtccagttgaacatagaggataaaaagttcaaagagtctgttttctatgtgtttgtatattaatattctcgcataacatttgggaacccagcaggagtattaaatatctagctctgcctttcttagcattcactccaggtaagaagtaactataatctctgtgccagtgttacctagttaggcatctgtaaccagctgcaggccaccaacaagaggtaatgcagagcatcagagacaatctagacgtcat

SEQ ID NO: 24593 - DNA, 601 bp, Human
accccatcccttgtggcaggagtctgagtgaggagaagaggaagagccaagatgagcacatcacgcatggcctggtaatgggagtttcaaatcactcatgaaaggaaagagaagaggaaactagaagtcagcaagcaaagctgcagatgctcagggcttcagaggacagctctgagtggaagaaacaaaatacagaaacaggctttccactaagagtgattagcaaagagatgataaggaagcagtcatcacttggggcctcccatcagaagagtgcaaggagaatcaaaccgggccacamgctgtgcggatggcccactacggcctcaagagagaagaagacaagtaagaaactggtttgcaaaataagtaacaaattggtttgcaaaataaaagttaacttaaccattgagagacaagcacaattatgcttggagtaaattttgtttctctggtggtcctagggaagtaattctctatttatacacacagatttaaaagtccagttgaacatagaggataaaaagttcaaagagtctgttttctatgtgtttgtatattaatattctcgcataacatttgggaacccagcaggagtatt

SEQ ID NO: 24594 - DNA, 601 bp, Human
ctagccatcccccctgccttggcctcccaaagtgcagggattacaggcataagccaccacacctggcctacagaattgttaatggaaaatttaaagcttgcaaaacattgctcatgtaaacttacaacaataaaattcttaagtaattaagcatagaagtagtaatgtcttaaaagccaaacatagaaagtgtttagaggaagagcagtctttgatggaaagaaaacagatcattctctacagagaaaaaaaaatatttctatttgaggaaaacaaaagtcttcttttaaactgatagtcratattttgatctgtgcagagtttgcaaaaggatcacataagaaaccaagtagggaaataaacaaaattttttgacctgagagttactaatgaccatgtatctactatgcactcatcactttaaatatgccattccacttaatctcctcaacaactctcagttttcagatgaagaaacagaagaccagagagcttaagctacttgactgagggcacacagctagtcagtggttcagtcaagagataaagaggcctgtccaacatgaactaaccattacatacactaccccatcccttgtgg

SEQ ID NO: 24595 - DNA, 601 bp, Human
aagtagccagaagaacatggcaatcaccgccgtgcctactagaataatgatttccaagttcgtcttttcctgggcacctggaaagacacaattgaatgagtatcaacagttggaaacttatactttttgtttgtaagatgacaaattttagcactaaagcaaaatcccaagcttaccaacttggaaaaatcctagaggacaacagttacacacccgtaacttgaatggagtctacagaattctttttttgaatttaatttatttatttatttatttatttatttatttatttatttatttttttttagagacagggtttctttctatgttccaggctggagtaccatgacacaatcatagcttattgcagcctccaattcctaggctcaagcgattctcccccctcagcctcccgagtagctgggactacaggtgcataccaccaagcccagctaatttttcttttattttctgtagagacagggtctcactacattgcccaggctagtctcgaactcctggcctctagccatcccccctgccttggcctcccaaagtgcagggattacaggcataagccaccacacctggcctacagaat

SEQ ID NO: 24596 - DNA, 601 bp, Human
cgcttaacggtccgtaggatgatgacaagaagtagccagaagaacatggcaatcaccgccgtgcctactagaataatgatttccaagttcgtcttttcctgggcacctggaaagacacaattgaatgagtatcaacagttggaaacttatactttttgtttgtaagatgacaaattttagcactaaagcaaaatcccaagcttaccaacttggaaaaatcctagaggacaacagttacacacccgtaacttgaatggagtctacagaattctttttttgaatttaatttatttatttattkatttatttatttatttatttatttatttatttttagagacagggtttctttctatgttccaggctggagtaccatgacacaatcatagcttattgcagcctccaattcctaggctcaagcgattctcccccctcagcctcccgagtagctgggactacaggtgcataccaccaagcccagctaatttttcttttattttctgtagagacagggtctcactacattgcccaggctagtctcgaactcctggcctctagccatcccccctgccttggcctcccaaagtgcagggattacagg

SEQ ID NO: 24597 - DNA, 601 bp, Human
tagcttcagccggtctctggggaattcccatttgctggcatcataaggcagtcgttcacaatgttcatccaatgggagttcatctggatccatgacgatggacaagtagcctgtcttcagttcccctccattggcctggaaagcatcaatccttccagtcataaacacactgttgtttggctgttgttttgtgtgcttgttattgctgtttattggagcctcattcctgtctcattttccaataaaactcatggagtttgagagtggtcctattataaccctgcttctagtttcccttgtyccccaaaggagctcagaattaaggttttaaagcttaattacactagacagtccaagcccttttcctctctagtggcttctatcaattaaatccctgagatccagccaaaagaaagtgggcaggaacgttattgtattgaaataaaaatgtgcccattgagccaataacaatgggaagaaacaactcaaagaaccccagtcagttttcattaatcatgaaaaccaatgtgcatgggcagaagggaaattatttttttacccgcttaacggtccgtaggatgatgacaagaagtagccagaa

SEQ ID NO: 24598 - DNA, 601 bp, Human
gtaaacacaatatcaaattaatagcaattgaaaatgcacctagcttcagccggtctctggggaattcccatttgctggcatcataaggcagtcgttcacaatgttcatccaatgggagttcatctggatccatgacgatggacaagtagcctgtcttcagttcccctccattggcctggaaagcatcaatccttccagtcataaacacactgttgtttggctgttgttttgtgtgcttgttattgctgtttattggagcctcattcctgtctcattttccaataaaactcatggagtttgrgagtggtcctattataaccctgcttctagtttcccttgtcccccaaaggagctcagaattaaggttttaaagcttaattacactagacagtccaagcccttttcctctctagtggcttctatcaattaaatccctgagatccagccaaaagaaagtgggcaggaacgttattgtattgaaataaaaatgtgcccattgagccaataacaatgggaagaaacaactcaaagaaccccagtcagttttcattaatcatgaaaaccaatgtgcatgggcagaagggaaattatttttttaccc

SEQ ID NO: 24599 - DNA, 601 bp, Human
tttcactcatattcctcactaagcgtttaatatagtgatgaacccaaaaacaccttagaagaaggctacaacctttcattgggacaggagtgtagaaatcagctggtcccaatccccttatattgtagcttttcttttttccagaacacattttcacaagattaaccaaaatttcagaagaaaacccacccatctacttgcttttcagtgcaatctcctgatatgattccattttgggggtaactacccttaagctttcaagttttagggaagtttactcttctctggacatctgttacayaagtaacaaactgtatcatagtagcatgacatttcttaattcagagaaagttttacaataatttaattctagtgccaattaaacctccatgaaatatatttattcctaggaatccgcaaagtattctaagctaagaaaatcaaggccagaggagttgactgctttccctcaaacactatcagagaggcatgttaaaattgggtgaccaaaaccacccacagttactcacctcctggcttggtacaggcacctagaaggttgaccacattgagatggtgaccaatatgaatgaggatcttg

SEQ ID NO: 24600 - DNA, 601 bp, Human
ttttcactcatattcctcactaagcgtttaatatagtgatgaacccaaaaacaccttagaagaaggctacaacctttcattgggacaggagtgtagaaatcagctggtcccaatccccttatattgtagcttttcttttttccagaacacattttcacaagattaaccaaaatttcagaagaaaacccacccatctacttgcttttcagtgcaatctcctgatatgattccattttgggggtaactacccttaagctttcaagttttagggaagtttactcttctctggacatctgttacwcaagtaacaaactgtatcatagtagcatgacatttcttaattcagagaaagttttacaataatttaattctagtgccaattaaacctccatgaaatatatttattcctaggaatccgcaaagtattctaagctaagaaaatcaaggccagaggagttgactgctttccctcaaacactatcagagaggcatgttaaaattgggtgaccaaaaccacccacagttactcacctcctggcttggtacaggcacctagaaggttgaccacattgagatggtgaccaatatgaatgaggatctt

SEQ ID NO: 24601 - DNA, 601 bp, Human
ttatgaggtagtattggacttttcccatgatcaaattccttgtaacaccctatcaccctgtctgctctgacaagagcatgccatagcatgcaggaagcactagccagtaccttcctcttcttctacatcactgagggacttctcctccacaaatccagagctggctgagctctggctactggtgatgctgtccaagcgccgtttcagatccacagggattgctccaacgtagtctttcccttgacggaatcgtgcccctttggtctataaaaaagcaaaggaacaaacaaactccttgaayacaaaatgagtctttaaaagtttacaacctttaaaatgtagtaaaccatggagataattgaaactactaaaaagcagacaaggaggacatcaatttcaggattatgcaatctctgagctgaaacttggggcaagttttgtgcataatagggtttcttccacaaagcctagctccttctttagcttaaagtgacaaatgccacattttgagttgcattcagacacactttcagcattaggatgctcttcacagagggatttacactccacggggccaaatatggctaggggagagacagaa

SEQ ID NO: 24602 - DNA, 601 bp, Human
agggcttccacacttcacttttggggagacagaatggaggcagtctattatagaaattcaggtctctttcaaattatgaggtagtattggacttttcccatgatcaaattccttgtaacaccctatcaccctgtctgctctgacaagagcatgccatagcatgcaggaagcactagccagtaccttcctcttcttctacatcactgagggacttctcctccacaaatccagagctggctgagctctggctactggtgatgctgtccaagcgccgtttcagatccacagggattgctccaaygtagtctttcccttgacggaatcgtgcccctttggtctataaaaaagcaaaggaacaaacaaactccttgaatacaaaatgagtctttaaaagtttacaacctttaaaatgtagtaaaccatggagataattgaaactactaaaaagcagacaaggaggacatcaatttcaggattatgcaatctctgagctgaaacttggggcaagttttgtgcataatagggtttcttccacaaagcctagctccttctttagcttaaagtgacaaatgccacattttgagttgcattcagacacact

SEQ ID NO: 24603 - DNA, 601 bp, Human
cgcctataatcccagcactttgggaggctgaggcaggcggatcacctgagatcaggagttcgagaccagcctggccaacatggtgaaaccccatctttactaaaaatacaaaaaaaaaaaaaattagctgggcatggtggaaggcacctgtaatcccagctactcggaaggctgaggcacaagaatcacttgaacccaaaaggcgaaggtttcagtgagccgagatcgcaccattgcactccagcctgggcaacagcatgagactccacctcaaaaaaataaaaataaacataaaaacaamtaaataaaatatcactggaaacataacttaataaaggccaggatatttatcaagactcgcctgaggaagtatggttggaaggaagacttgataagccgcttggggtagggtagaaacaacagatggctcctaaactgcctttgagaaggttaggtataatgaaaagacttttgcacaggtaaagcatgcaacgtggggcaaaccactctggggctctccaaggcaatggagaggctagtcaactaccagaaaacttgtggcctctctcactaataaatgctgaaccagtattttaagaac

SEQ ID NO: 24604 - DNA, 601 bp, Human
tcacccatctctacatccacaacgctatctctgctccttctgaaggaggcagaaatacagtgtgtcctggagccggctgaagtcctggaagttaggctgggaccacagctccacccaaaaagagcactaaaatatcactcaggccaggcacggaggcttacgcctataatcccagcactttgggaggctgaggcaggcggatcacctgagatcaggagttcgagaccagcctggccaacatggtgaaaccccatctttactaaaaatacaaaaaaaaaaaaaattagctgggcatggtggmaggcacctgtaatcccagctactcggaaggctgaggcacaagaatcacttgaacccaaaaggcgaaggtttcagtgagccgagatcgcaccattgcactccagcctgggcaacagcatgagactccacctcaaaaaaataaaaataaacataaaaacaaataaataaaatatcactggaaacataacttaataaaggccaggatatttatcaagactcgcctgaggaagtatggttggaaggaagacttgataagccgcttggggtagggtagaaacaacagatggctcctaaactgcct

SEQ ID NO: 24605 - DNA, 601 bp, Human
tcaaggggagccagcctgtcacccatctctacatccacaacgctatctctgctccttctgaaggaggcagaaatacagtgtgtcctggagccggctgaagtcctggaagttaggctgggaccacagctccacccaaaaagagcactaaaatatcactcaggccaggcacggaggcttacgcctataatcccagcactttgggaggctgaggcaggcggatcacctgagatcaggagttcgagaccagcctggccaacatggtgaaaccccatctttactaaaaatacaaaaaaaaaaaaaattagctgggcatggtggaaggcacctgtaatcccagctactcggaaggctgaggcacaagaatcacttgaacccaaaaggcgaaggtttcagtgagccgagatcgcaccattgcactccagcctgggcaacagcatgagactccacctcaaaaaaataaaaataaacataaaaacaaataaataaaatatcactggaaacataacttaataaaggccaggatatttatcaagactcgcctgaggaagtatggttggaaggaagacttgataagccgcttggggtagggtagaaacaacag

SEQ ID NO: 24606 - DNA, 601 bp, Human
ctattcttctagacttatgcctcaaggggagccagcctgtcacccatctctacatccacaacgctatctctgctccttctgaaggaggcagaaatacagtgtgtcctggagccggctgaagtcctggaagttaggctgggaccacagctccacccaaaaagagcactaaaatatcactcaggccaggcacggaggcttacgcctataatcccagcactttgggaggctgaggcaggcggatcacctgagatcaggagttcgagaccagcctggccaacatggtgaaaccccatctttactraaaatacaaaaaaaaaaaaaattagctgggcatggtggaaggcacctgtaatcccagctactcggaaggctgaggcacaagaatcacttgaacccaaaaggcgaaggtttcagtgagccgagatcgcaccattgcactccagcctgggcaacagcatgagactccacctcaaaaaaataaaaataaacataaaaacaaataaataaaatatcactggaaacataacttaataaaggccaggatatttatcaagactcgcctgaggaagtatggttggaaggaagacttgataagccgctt

SEQ ID NO: 24607 - DNA, 601 bp, Human
aagggaaacagagtgggtttcttccactattcttctagacttatgcctcaaggggagccagcctgtcacccatctctacatccacaacgctatctctgctccttctgaaggaggcagaaatacagtgtgtcctggagccggctgaagtcctggaagttaggctgggaccacagctccacccaaaaagagcactaaaatatcactcaggccaggcacggaggcttacgcctataatcccagcactttgggaggctgaggcaggcggatcacctgagatcaggagttcgagaccagcctggcyaacatggtgaaaccccatctttactaaaaatacaaaaaaaaaaaaaattagctgggcatggtggaaggcacctgtaatcccagctactcggaaggctgaggcacaagaatcacttgaacccaaaaggcgaaggtttcagtgagccgagatcgcaccattgcactccagcctgggcaacagcatgagactccacctcaaaaaaataaaaataaacataaaaacaaataaataaaatatcactggaaacataacttaataaaggccaggatatttatcaagactcgcctgaggaagtatggt

SEQ ID NO: 24608 - DNA, 601 bp, Human
aggagttaaatgcaaattctctctgtagcctcatgtcaagggaaacagagtgggtttcttccactattcttctagacttatgcctcaaggggagccagcctgtcacccatctctacatccacaacgctatctctgctccttctgaaggaggcagaaatacagtgtgtcctggagccggctgaagtcctggaagttaggctgggaccacagctccacccaaaaagagcactaaaatatcactcaggccaggcacggaggcttacgcctataatcccagcactttgggaggctgaggcaggcrgatcacctgagatcaggagttcgagaccagcctggccaacatggtgaaaccccatctttactaaaaatacaaaaaaaaaaaaaattagctgggcatggtggaaggcacctgtaatcccagctactcggaaggctgaggcacaagaatcacttgaacccaaaaggcgaaggtttcagtgagccgagatcgcaccattgcactccagcctgggcaacagcatgagactccacctcaaaaaaataaaaataaacataaaaacaaataaataaaatatcactggaaacataacttaataaaggc

SEQ ID NO: 24609 - DNA, 601 bp, Human
ctagaccaagtcccagcctcacactaccttctcagcttctaaggaaaaggagttaaatgcaaattctctctgtagcctcatgtcaagggaaacagagtgggtttcttccactattcttctagacttatgcctcaaggggagccagcctgtcacccatctctacatccacaacgctatctctgctccttctgaaggaggcagaaatacagtgtgtcctggagccggctgaagtcctggaagttaggctgggaccacagctccacccaaaaagagcactaaaatatcactcaggccaggcacrgaggcttacgcctataatcccagcactttgggaggctgaggcaggcggatcacctgagatcaggagttcgagaccagcctggccaacatggtgaaaccccatctttactaaaaatacaaaaaaaaaaaaaattagctgggcatggtggaaggcacctgtaatcccagctactcggaaggctgaggcacaagaatcacttgaacccaaaaggcgaaggtttcagtgagccgagatcgcaccattgcactccagcctgggcaacagcatgagactccacctcaaaaaaataaaaataaacat

SEQ ID NO: 24610 - DNA, 601 bp, Human
gataagacttatggcttctttcctggagacaaataccagagtaaacaaaaacttagttgtagtaataaattcgtaagtatttaaaaggctgtgagcctttttctcaacaactcaatctcttaggtttctggctcactggccactgttttttgaaagacaaagagcagggtagaggcagcaccactcagtgtgggcccagctaaatgaagcctagaccacctccccatgtgcttctagaccaagtcccagcctcacactaccttctcagcttctaaggaaaaggagttaaatgcaaattctytctgtagcctcatgtcaagggaaacagagtgggtttcttccactattcttctagacttatgcctcaaggggagccagcctgtcacccatctctacatccacaacgctatctctgctccttctgaaggaggcagaaatacagtgtgtcctggagccggctgaagtcctggaagttaggctgggaccacagctccacccaaaaagagcactaaaatatcactcaggccaggcacggaggcttacgcctataatcccagcactttgggaggctgaggcaggcggatcacctgagatcaggagt

SEQ ID NO: 24611 - DNA, 601 bp, Human
tcaggaagtccttatacagatcttcaggagctgtccaaagaggcaggaggatggagatcagtatttccatgagttagtgtgatgtttctaagtttgctagagtaataatctttttaagacttgggagttaagtttttaggaaatagaagcagagagtcaatgcttctatcttctgtaaatctcctgaatcccagtatcattagccttcatcatacccccttaggaacaatactggtttttccattttagccaaattgaaccagtaaatccaggaggtagaataaggtaacactgacctagrtaatctgggaaataaagaggacatttccaaatttgccacttacactgttttttgtcatgtacccagagggataaacaatagtttcatatcaagaactctaaaaataaaacaacaatattcagggtcattgaatctcttctctccaggttttgtcctgggacaaaggccaaaagtcaaactataatctgcaatagataactaaaaatactagaaatatatttaattcattttcaaacttaaaaagtgctgtaaatacattaaatctggcctgggagggtgttttttcctgagagataacag

SEQ ID NO: 24612 - DNA, 601 bp, Human
atgctccaaggtcaggaagtccttatacagatcttcaggagctgtccaaagaggcaggaggatggagatcagtatttccatgagttagtgtgatgtttctaagtttgctagagtaataatctttttaagacttgggagttaagtttttaggaaatagaagcagagagtcaatgcttctatcttctgtaaatctcctgaatcccagtatcattagccttcatcatacccccttaggaacaatactggtttttccattttagccaaattgaaccagtaaatccaggaggtagaataaggtaayactgacctagataatctgggaaataaagaggacatttccaaatttgccacttacactgttttttgtcatgtacccagagggataaacaatagtttcatatcaagaactctaaaaataaaacaacaatattcagggtcattgaatctcttctctccaggttttgtcctgggacaaaggccaaaagtcaaactataatctgcaatagataactaaaaatactagaaatatatttaattcattttcaaacttaaaaagtgctgtaaatacattaaatctggcctgggagggtgttttttcctg

SEQ ID NO: 24613 - DNA, 601 bp, Human
tattcagaagcacattatctagcacaattgagcaacactggcaattccaaaaaacagacagtgtttttgacttttccccccaaacaaaaagtttccttttttaacccgacaaccaagtggattcaagaaatagtctggtagatgtaaggaaagttaaagcattcccacattcatttccattctcttcctagtccccaaaaggaaccctgactaagtggcgaattccggccataaaaaaatggtaataataagtcataatctccaagaagtgtaaagggcctttctctttgggaaaaccctrtaaggtcccagttctcctccttccccttgggagagagaacataagagctacctagcagaaacatcaaagagcctgaggcctttaatgctatgagaaggggaaaacatgggttgaagatttcattctaatttaggaaaaacaaaaaaaaatatgacttaagtctttctttcttcattaagctgcatgaatacattctgtcaactgatagttcttcctgatccttaatttgaagtattgttacctaatataaaattacaccttttatcctttccaggggaatcactgccaccagccttgctc

SEQ ID NO: 24614 - DNA, 601 bp, Human
aactttttttttttttttttttttttgagaaggaatctcactctcgcccaggctggagtgcagtggtgcaatctcagttcactgcaaccttcacctcccaggttcaagtgattctcctgcctctgcctcccaagtagttgggaccacaggtgtgccaccacgcccagctaattattatatttttagtagagacggggtttcaccatggtggccaggctggtctcaaactcctgacctcaggtgatccacacaccttggcctcccaaagtgctggaattacaggcatgagccaacacacccrgccaaaaggagaattcttaaatcattggagaagtgatcatgtaagccaggcattgctgaccttcccacacctcaaatctgtatggcactctcctctgaacaaggcatattcagaagcacattatctagcacaattgagcaacactggcaattccaaaaaacagacagtgtttttgacttttccccccaaacaaaaagtttccttttttaacccgacaaccaagtggattcaagaaatagtctggtagatgtaaggaaagttaaagcattcccacattcatttccattctcttcctagtcc

SEQ ID NO: 24615 - DNA, 601 bp, Human
aaactttttttttttttttttttttttgagaaggaatctcactctcgcccaggctggagtgcagtggtgcaatctcagttcactgcaaccttcacctcccaggttcaagtgattctcctgcctctgcctcccaagtagttgggaccacaggtgtgccaccacgcccagctaattattatatttttagtagagacggggtttcaccatggtggccaggctggtctcaaactcctgacctcaggtgatccacacaccttggcctcccaaagtgctggaattacaggcatgagccaacacaccyagccaaaaggagaattcttaaatcattggagaagtgatcatgtaagccaggcattgctgaccttcccacacctcaaatctgtatggcactctcctctgaacaaggcatattcagaagcacattatctagcacaattgagcaacactggcaattccaaaaaacagacagtgtttttgacttttccccccaaacaaaaagtttccttttttaacccgacaaccaagtggattcaagaaatagtctggtagatgtaaggaaagttaaagcattcccacattcatttccattctcttcctagtc

SEQ ID NO: 24616 - DNA, 601 bp, Human
tcacatccacacattccttttacctggccccatatttggtttaaaacgtgttattctaaggaggtccgagaacgggatttgttttttgaatgaatgcacggaaatcagaaacaaggggctctcattggtttagtgctctttgttggtttcccccttccgtatgaagctgaagccagactggctctgataaacaattcccaatgtggcttcccctgatttcaaagtgctgggttattataaaggtctattaaggcaatttcagcctatcacaagtcaggttgattttctagtgcattaatartacaatgagattcatcttgacttctttctcttccttttagcttctcagtttctcctttctctgtatcctccaaacttcagctaacttcctactactcggcagctttagctccacatgatattttgtaagaaaatgagtcttggggagcacaagaaatgaatcaatggcttagaagaaaactttttttttttttttttttttttgagaaggaatctcactctcgcccaggctggagtgcagtggtgcaatctcagttcactgcaaccttcacctcccaggttcaagtgattctcctgcctc

SEQ ID NO: 24617 - DNA, 601 bp, Human
caatgaagaaggtctatataatggaaagtcttccaggcaaggagaatttgcgagcaaagaaagagaacacaggaatacttcttaaagtcttacatttctggtgtagtataatcaggggccctcattctagttccttctttcaatcgcctacaaaattcttcatcaatctttaccccaggatatggagaagcacctagaataaaacagggaggagacattctttgatttgattttctcttatagaaaaccctgagcctgaatcttgcacatcctcatcacctatgtatctatttttttttttcaaagcttccgagaagttttgcctgatagacatgaagtacaggagaggaaaagacaacttttgtcttcctctttggagtctggatggaaggacaaaaagaaatgacttacctaaggaaaatatttcccacagcaaaacaccaaaagaccagacgtcactctggattgtgtacactctgtcaaaaattgtttctggggccatccatttcaaagggaggcgagcctacaggggtagaagacaaggattcagaacccaaattagcaaatatctgaagaaaaaaacttcctctgttcctgaaca

SEQ ID NO: 24618 - DNA, 601 bp, Human
gttagcagcccttctatatatccaacatcgtatttggtgcttccattacacaaacatgatttcttctcctgctcagcaccatatgcaaagcacccggtgagccaggaggctgccgactcggatcatcactctacttggtcacagaaaacacatggaatgtagttcatgatcaaatggctttctgataaagggggaggcaataatggtgtgtgggaacaactgtcacactaaaaggccagctcaacttgaactggaaatgtgtaaacacaggagtggaattgtagtctcatctcattactgwttctctctgagggccctccttggcatgggaggaaacaacatggacttaggggtcagaggaactggattcatctcaaggatgtgattttaagcagctcacttaataggtatcttttactgagtgctttcaagggccaggtgcttagaaatagattatatcttataactctcaaaacagccattttcaaacagcaccactgaccttgtctcatttcacagataaagaaactgaggcagagggtagatgatttgccccaagttgcacagctgctacaagacagacttgggggtcctactcatt

SEQ ID NO: 24619 - DNA, 601 bp, Human
gctggataaaagagaaactgggctggaaaaaccaattcaaaaatcacagacagaaaataggagccaggcctgtgctgggagtgtggtgtcacatttgtccacgcttctggggataaacgttagcagcccttctatatatccaacatcgtatttggtgcttccattacacaaacatgatttcttctcctgctcagcaccatatgcaaagcacccggtgagccaggaggctgccgactcggatcatcactctacttggtcacagaaaacacatggaatgtagttcatgatcaaatggctttcygataaagggggaggcaataatggtgtgtgggaacaactgtcacactaaaaggccagctcaacttgaactggaaatgtgtaaacacaggagtggaattgtagtctcatctcattactgtttctctctgagggccctccttggcatgggaggaaacaacatggacttaggggtcagaggaactggattcatctcaaggatgtgattttaagcagctcacttaataggtatcttttactgagtgctttcaagggccaggtgcttagaaatagattatatcttataactctcaaaacagccatt

SEQ ID NO: 24620 - DNA, 601 bp, Human
gcatagaccttgggccaaaggagaagaatggaaattaattctctctcccctaccccaagaggctggttcctccctatagagagaggagagaatgagattttccggtgacatcctcactcaggaaactccacaagttaagaggatatgatacacagggtgcaagcaaagcctactttctaagtccaacccctaaaagtaacagttgtcaaacactactggtaccgtagtcaatcattcctgcattcacttgttcaggaagccctcactgataatctgccgcaagcctgacactgtgccagawgctgtctaagcagcatctcatgatgtgttcaccacggtacctctctaggggtgagtattactatcccaactcttcagatgaggaaaccaaggcatagaaaatttgaggaacttatccaaaatcacataactggaatgtttggattattattttgagggcaatgaagagccactgaaggattttaggcatgggattgacaagatcagatatgccctttagagaattgactctggattgaaaagaataagactagaggcataagacccaagagacaaatactgcacttcttcaggagaaaga

SEQ ID NO: 24621 - DNA, 601 bp, Human
gcaaaggccccaactgatggaacatgtttatggcctcgcagattgacaaatttgtatacagtgacaggcgccaaagggccacttgcatgatattcaaggaaattgggatgttcttaaatttcacttgtgcttttcctattgtggcaatttgggaattacggggcatgtgtatggttgtaataaagctcttgagcaactttaaactttaataacttgaagcatgtgtgcagtcaagccagacatatcaaacgctgctttttactcatcaaaaccacattccttggaaggactgagaaccccwgtcactcagcagcaactagaaaatgttttcaatggcatggaatcctgacagacggtaatcatgtcaaagcctagaaatgcaggctgtgttgatctaaaacttcaggatttacactttcacaagccattctaaggtgttttttcccggtaataggtgttttccccaacttcttcatgttaaaactgcaaaagggaattttagtaactcgtgtttatacatagtttaaaagttacttcaaataatgagaaatacaattttttctttcaattcaaccccaacaaaactaatgtaggtgtctca

SEQ ID NO: 24622 - DNA, 601 bp, Human
gacaattcttttgctttttaccctcaccccattcccaactccatatggctgccatctccctggagaccgcagccccgtatctctcccagttgttaatcagcatagcaggtttacagggacaaggtctattttcaggtactcgcatgaattagtagttgcagataagtcctcttactcaggtccaagtctttcaagcctcaaatgagatgaaaggcagttctctcgagttatgcaaaggccccaactgatggaacatgtttatggcctcgcagattgacaaatttgtatacagtgacaggcrccaaagggccacttgcatgatattcaaggaaattgggatgttcttaaatttcacttgtgcttttcctattgtggcaatttgggaattacggggcatgtgtatggttgtaataaagctcttgagcaactttaaactttaataacttgaagcatgtgtgcagtcaagccagacatatcaaacgctgctttttactcatcaaaaccacattccttggaaggactgagaacccctgtcactcagcagcaactagaaaatgttttcaatggcatggaatcctgacagacggtaatcatgtcaaag

SEQ ID NO: 24623 - DNA, 601 bp, Human
gtagatctccaaataggaggcccggaccaggtactgttggttctgggagcgggagatgtgggtgaagatgtgctcaaaggcattcgggatgaccccgcgcagctcgggctccacccaggtcccctgcatggtataggtcttgccagtgcccgtctggccataggcaaacaccgtgccattgaaaccctggagcacggagtctatcaggggcctcacggtttcgtcatacaggtcggcctgcttggagctggcatcatacacggcgtcaaaggtgaaggtcttgggcagctcccccggggcrgcgcgggggttccgcagggtcacctggcccagtttcacgtccatggtcaggatctgctcgtgaccagcagcctcctccttcctgctgagggggcggcaccgggccaccaccttgagggcctcgctggccttggtcttactggccatcttgctgctctgaccttcctgcccccgagcccctccgcagcctgggcggtcctgctatcctgctcgctaggtcgggatcagcggggccggcccagcccccaggcgcagctcttcaatccgcatgcagcctcctagggtggggacgctgggaggt

SEQ ID NO: 24624 - DNA, 601 bp, Human
gggccatgcctttgccaggctctgccccatgtggatggagaccccagcccctaagagctggcctactccagaggcgttagtcacacagatggaggcacatcacactgccttccaagctgcctcaccctctccccaagtagtataatggttgattggtaagaccaacaaactgtggctcttgatgatttagggaaacagtcatacagttggcaaagaactcacaccaccttgtggaaggcccaggaattagtaccaggtggcttgtggaggctgatgttatggagagctatcacgtcctctygcccaccagctagcagtgcccctgccaaagggaagaccctgggctagtagacctgtgggacccagggtggcatgtctgagattctcagcactgtaattccagagatccagagtccaccatggtttacggccctgcacctcccagacatgagctgcaggccacactctccaaggggacctggcacctggaggccctacctgctcggcaatctcctgcctcttcagttccaacatcttctgctgttcgttggtgtgatccatgatgttcctgcccccgatgaggagcttgctctccatggcc

SEQ ID NO: 24625 - DNA, 601 bp, Human
ggaaagctcaggggactggctcactctgcctgtctcgggacctggcttcaccatggcccatggcccacatccactgctcccacccaatcctgcagagcccctgggaaccctcctctcagttcccagggccatgcctttgccaggctctgccccatgtggatggagaccccagcccctaagagctggcctactccagaggcgttagtcacacagatggaggcacatcacactgccttccaagctgcctcaccctctccccaagtagtataatggttgattggtaagaccaacaaactgtggytcttgatgatttagggaaacagtcatacagttggcaaagaactcacaccaccttgtggaaggcccaggaattagtaccaggtggcttgtggaggctgatgttatggagagctatcacgtcctctcgcccaccagctagcagtgcccctgccaaagggaagaccctgggctagtagacctgtgggacccagggtggcatgtctgagattctcagcactgtaattccagagatccagagtccaccatggtttacggccctgcacctcccagacatgagctgcaggccacactctccaagggg

SEQ ID NO: 24626 - DNA, 601 bp, Human
gccccggagctccatagtctcctcgtcccggagcatcatctcctgctgcatctcccgctcacgacgtttctaggccaaggacgggcagtgtggctcaaaggagcagtgcatactcgggagggccaggaaagctcaggggactggctcactctgcctgtctcgggacctggcttcaccatggcccatggcccacatccactgctcccacccaatcctgcagagcccctgggaaccctcctctcagttcccagggccatgcctttgccaggctctgccccatgtggatggagaccccagcccctaagagctggcctactccagaggcgttagtcacacagatggaggcacatcacactgccttccaagctgcctcaccctctccccaagtagtataatggttgattggtaagaccaacaaactgtggctcttgatgatttagggaaacagtcatacagttggcaaagaactcacaccaccttgtggaaggcccaggaattagtaccaggtggcttgtggaggctgatgttatggagagctatcacgtcctctcgcccaccagctagcagtgcccctgccaaagggaagaccctgggctagtag

SEQ ID NO: 24627 - DNA, 601 bp, Human
agtttcttggttttgacctccacctcctgctgcagggatgtgtaggtgccccggagctccatagtctcctcgtcccggagcatcatctcctgctgcatctcccgctcacgacgtttctaggccaaggacgggcagtgtggctcaaaggagcagtgcatactcgggagggccaggaaagctcaggggactggctcactctgcctgtctcgggacctggcttcaccatggcccatggcccacatccactgctcccacccaatcctgcagagcccctgggaaccctcctctcagttcccagggycatgcctttgccaggctctgccccatgtggatggagaccccagcccctaagagctggcctactccagaggcgttagtcacacagatggaggcacatcacactgccttccaagctgcctcaccctctccccaagtagtataatggttgattggtaagaccaacaaactgtggctcttgatgatttagggaaacagtcatacagttggcaaagaactcacaccaccttgtggaaggcccaggaattagtaccaggtggcttgtggaggctgatgttatggagagctatcacgtcctctcgcc

SEQ ID NO: 24628 - DNA, 601 bp, Human
gccttcggagttacttttggccagcacctagcgtccattttgaggggttcatcaaatacaggcagaggaggtagaagaaactccagcacgtgggcccatccctcagccctcagacgcattttattcctaaaggactcatgggagaggagacagtcaggatgaggccttaggggaggagaggcctgagtaatgatggctggctgtggggacccgggatgaaaagagctgcgggccctacttgagcttgagttcgcgggtctgctcgttctgcgcctcctccaggtcctgccgcacgcggatrtactcatcatgctggtcctggatctccgccttcaccgcctgcagcttggcgtagagctgggtggggacaggtgccactcagaggctgcttggtgtggcaacgaggccccagtcacccagcctgggccgcagggctgcaggctcagagtctaccgactcagcccaggatgaggctgcgggtccttttctgaactccccgctgtgcccaacccaccacgaattgggctgggctatttaaagtggtgccccgccctccttcactgaggcctgtgaccattgtctgctctttctcagctgctat

SEQ ID NO: 24629 - DNA, 601 bp, Human
gtagctgggactacaggcgcccgccaccactctcggctaattttttatatttttagtagaggcggagtttctccgtgttagccaggatagtctcgatctcctgacctcgtgatccacctgcctcagcctcccaaagtgctgggattacaggcatgagccactgcgcccggccttttttgtttttgttttttttttttttttgagacgttgtctcgctctgtcgcccaggctggattgcagtggcatgatctcggctcactgccacctccacctcccaggttcaagcaattctgcctcagcytcctgagtagctgggattacaagtgcgcgccaccatgcccggctaatttttgtatttttagtagagatggggtttcaccatgttgatcaggctggtctcaaactcctgacctcaggtgatccacctgcctcggctcccaaagtgctgggattacaggcatgagccactgcgcccggccctaaaaataatttttaaaaaatttaaaatcactgattcttatgcaaagatggtagcctcagggccttcggagttacttttggccagcacctagcgtccattttgaggggttcatcaaataca

SEQ ID NO: 24630 - DNA, 601 bp, Human
tttttcttctgagatggagtctcactctgttgcccaggctggagtgcagtggtgcaatctcggctcactgcaacctccacctcccaggttcaagcaattctcctgcctcagcctcccaagtagctgggactataggcacccatcaccacgcctggctaatttttgtatttttagtagagacaggggttcaccatgttaaccaggctggtctcgaactcctgacctcaggtgatccacctgcctcggcctcccacagtgctgggattacaggtgtgagacacctcgcccggcctccctcccrtaggctctttctcccctctccgcttcttaccctgtacctggggtgggaccccattgccatggcaacccgagcatactggctgataggcctcttgtagcccactgcagatgttggccgcttcttcatctggctgctactgctgtaggaaagaggctatattagaaaggatttctgtggaacacaaacagcaaatgacatcatgaggacctaaatatcattcaggtagctaggaggccctgcagactgcaagttctggaattttcttctccttgctctaatacagcttgacaactgaagcta

SEQ ID NO: 24631 - DNA, 601 bp, Human
gccaggcttgaacagtgcccagtcactgtgccttctagggactcagccagtcttgggtgtagcagggctgatgaggtggttaggggaagcagaggctgtgagcatcccctcccataggctcttttttttttttcttctgagatggagtctcactctgttgcccaggctggagtgcagtggtgcaatctcggctcactgcaacctccacctcccaggttcaagcaattctcctgcctcagcctcccaagtagctgggactataggcacccatcaccacgcctggctaatttttgtatttttrgtagagacaggggttcaccatgttaaccaggctggtctcgaactcctgacctcaggtgatccacctgcctcggcctcccacagtgctgggattacaggtgtgagacacctcgcccggcctccctcccgtaggctctttctcccctctccgcttcttaccctgtacctggggtgggaccccattgccatggcaacccgagcatactggctgataggcctcttgtagcccactgcagatgttggccgcttcttcatctggctgctactgctgtaggaaagaggctatattagaaaggatttc

SEQ ID NO: 24632 - DNA, 601 bp, Human
tcatgccaggcttgaacagtgcccagtcactgtgccttctagggactcagccagtcttgggtgtagcagggctgatgaggtggttaggggaagcagaggctgtgagcatcccctcccataggctcttttttttttttcttctgagatggagtctcactctgttgcccaggctggagtgcagtggtgcaatctcggctcactgcaacctccacctcccaggttcaagcaattctcctgcctcagcctcccaagtagctgggactataggcacccatcaccacgcctggctaatttttgtatwtttagtagagacaggggttcaccatgttaaccaggctggtctcgaactcctgacctcaggtgatccacctgcctcggcctcccacagtgctgggattacaggtgtgagacacctcgcccggcctccctcccgtaggctctttctcccctctccgcttcttaccctgtacctggggtgggaccccattgccatggcaacccgagcatactggctgataggcctcttgtagcccactgcagatgttggccgcttcttcatctggctgctactgctgtaggaaagaggctatattagaaagga

SEQ ID NO: 24633 - DNA, 601 bp, Human
atcatgccaggcttgaacagtgcccagtcactgtgccttctagggactcagccagtcttgggtgtagcagggctgatgaggtggttaggggaagcagaggctgtgagcatcccctcccataggctcttttttttttttcttctgagatggagtctcactctgttgcccaggctggagtgcagtggtgcaatctcggctcactgcaacctccacctcccaggttcaagcaattctcctgcctcagcctcccaagtagctgggactataggcacccatcaccacgcctggctaatttttgtaattttagtagagacaggggttcaccatgttaaccaggctggtctcgaactcctgacctcaggtgatccacctgcctcggcctcccacagtgctgggattacaggtgtgagacacctcgcccggcctccctcccgtaggctctttctcccctctccgcttcttaccctgtacctggggtgggaccccattgccatggcaacccgagcatactggctgataggcctcttgtagcccactgcagatgttggccgcttcttcatctggctgctactgctgtaggaaagaggctatattagaaagg

SEQ ID NO: 24634 - DNA, 601 bp, Human
tccttgaaaaggagcccaagaggctgaatgaggttgtctgaggctcagaaagtggagagtggggctgtgtccacggggagcagatgcccaacactgtcaggatgtctcttgtcctcagggaacaccaagcagtctcccagtcccagaaagtgctcaggggctgctcgccatcagtgtgggagaagatggaggttatggagtgcggtgggtagaaaagggactgtcttctcaggcactggctaccttcccttctggaggcagctgacagggggacaagcctgagatctgactgggggagctmtcaagtcagaagaaaaagaggctacgcagtgaccacggtaggcccagacggctcaggcgagggcatctccccaacacgaactgagctccgcgaataaataacatgaattaaataaaggaggcgaagaagagcaggcagaggcaccatctgccagattctcacccctgcacacacgcacacgcacatgcacgcacacgcacacgcaccaagcggcagatgagatgagccagggttggctgccccatcccaggagtctattggatgggcagcctgacgtgatggttgtcactcatggtccgc

SEQ ID NO: 24635 - DNA, 601 bp, Human
agcgaggggtagaatgacattgactcctcccactgtgaacggggtctaggcagctgcagggagaaatgatcgaagcaggcaggagcagcctcttgaaaatggggagttgccttgagagcctgtcgaccaaaatgactcctcggaggggacagaaacaaaggaatccagtggagggacttccgttgatgactgttcaagttgtctcaattgctgttccatttcctgcaggttccaaggcgatggtaattgcttggtccacagttcccatccaaggtgggcagaaagcagagtttgggaagcygtgagttcttgtcaaagctgaagggcatgagctatgttggtgaggttattaatgtccttgaaaaggagcccaagaggctgaatgaggttgtctgaggctcagaaagtggagagtggggctgtgtccacggggagcagatgcccaacactgtcaggatgtctcttgtcctcagggaacaccaagcagtctcccagtcccagaaagtgctcaggggctgctcgccatcagtgtgggagaagatggaggttatggagtgcggtgggtagaaaagggactgtcttctcaggcactggctacctt

SEQ ID NO: 24636 - DNA, 601 bp, Human
agatctgtcagtctcatggtttcaccccaacgacagcactcttcatattctaggaactggagactcacactattagggcactttgaaatcctaattcactcgcttgctttcgttattacctcttcacccgtcctccaaaatatacacttaaaaagccagtcaatgaacattaaccatttttttttgtagaaatttacttatcacttgagatacctagagacattttgggccatcacaaaggaaggtaaggagtatccccctaggaaccaatttgcgtaactagtgaataaaggatctattktcaacaaaataataccttaaagatgcaattcagaaacaggggtaacaggcaaagctggaaaagattgtgcctgggcttctgtttcctgtgacagatgaagggaaaaagcaatagatgttaatatcttcgtttagcgaggggtagaatgacattgactcctcccactgtgaacggggtctaggcagctgcagggagaaatgatcgaagcaggcaggagcagcctcttgaaaatggggagttgccttgagagcctgtcgaccaaaatgactcctcggaggggacagaaacaaaggaatccag

SEQ ID NO: 24637 - DNA, 601 bp, Human
taaatttacctttggtttgcccatcatttccttcattttccagataaccctttaaaatgaatttgattttcaaacaataaaaaacaaaacagcaacaaaactccctctgacctcctctcaccttctttagtccttgccaaagtgttaatattgcaaaagtactgtgagaatttcctgtattgtggttcctggaacactttagaggcttgtgattctactgcttcttattcacactataatacatgtctcaccaatagatgattcaagaacatcatttaaatacacaatttttcattctctwtttttgctaaatttcttcatactcaactttcagattctttaatctccagctcagcttcaacaattcaacgctgttctttctgaaaaagtacacatcgtgccttctctacttcgctcttggaacataatttctcatggcaggtatgtgtgatttcagtcactaaattaaaaataaccagaaaagctatttcttggattggctgattttggggtaatgctttaagagaaaaggacatgattaacagtggatgtttttaggattttcatgcattagcactttccacattcattatattttcct

SEQ ID NO: 24638 - DNA, 601 bp, Human
ttcttatagcttttactaaactgagtattgagccagcatttactccaggacccaacatagaactccagaaaggtaggtcacattttttggaaaacttagcattggtaaaagattaaataggcagtttcttgtttttcacacagagaggcatgatggaatattatacttagtaatagaaatttgcctaccagtgtaggatagtctcattttacattgctcaatctaatgtaaaaatgattaaattacactgaatgtgtatcatttgtacatttaactaatcaggaaaatagtagcctgaaaygaaagatatgtttcctatatgagtgctcataattaagtaacaaaaaataaaccacaggaaatgttacagttaatcctcattacctgcctgaatttgcttataacctatacttttgcatctcactacttttccttttccagaatatactgcacagatttctaaaccttacttatccagtgaaagccagctcaaagtccaattttcgtttttggagatggagttttgctcttgtcgtccaggctggagtgcagtggcacgatcttggctcactgccacatcagcctccctggttcaagtgat

SEQ ID NO: 24639 - DNA, 601 bp, Human
cagtccaaaaaaatagtatatttattattttatttattctggtagaccccaatattctcagcatgctcttatgttttatatactatagactcattgtctgtatgtgtgtactttttgaatctcattttcatttataaacatgagatttgcagcatcacacagggacaaagtttatgctctggtttgttttcctagactagattagataatacatcttaaataaaatagaagaaaagcatatcacatatttaaaccattaatgacaacagaaaaacagcaaggaaaaaatccctggcctcartgctattgattagtgagaaaataactgggtattttgtagcattacactagaaaatcatgaaaattgtggttactgaaaaaaaaaggactcaatatgttagtatctcactcaaatgcttttaaaatttatatcatttaattgaaaaatgccctgaacattcttacttcctttttgtgtatgtgaacattttcttcttcattacagatttccatcatttgaaacttttaatacaaagaactgcatagcgtataatccaaatggaaatgctttagatgaatcctgtgaagataaaaatcgtta

SEQ ID NO: 24640 - DNA, 601 bp, Human
tcctttttgtgtatgtgaacattttcttcttcattacagatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaatgatacagttgcatgttatattattactaattgtctacttctggagtctataaaatgtttttaaacagtgtcatatacaattgtcatgwatgtgaaacaatgtgttttaaaattgatgaaattcgttcacctacatttgagaattataaaattaacataaagaattttgtattttcatttaatgtatatatttaatgttaaattcaatgtagttttattacacatttatgtaattttatttacattcttgctaattctcagcagaaatttaaataagatttaattcacatcaaataaaatttagaaaataaaatttaactcacactgcccaggctggagcatagtggcaagatcatagctcattgcaagctcaagtgatcctcctgact

SEQ ID NO: 24641 - DNA, 601 bp, Human
tgctgagaccgctcccggatgaggttctccagctccgcgttgtcccgctccagctgacgcactttctccaggtagctggccaggcggtcgttcaggaactgcatagtctccttctcgctaccattgaaggagccctcgcagaaccagttgcagttgctcacattggcggggatgttgcaggccccgggcagggtgcagctgtggcagctggggggcacgcagggccgggaggagcagctggtgcggcagctcaggctgggcaggcagaagttgtagggcatagtgctgggagggagggagkgagtgcctggctgaagacagagtctaaattctccaagccacagagctgtgggtctccttcctctagggagcatttatatcccactgcagagggtgtggacacagtatgtaatgtcttttttctttttatttcttcacttcttttcaaacgccctttccttcagtctgttatttgccttcctctgaagagtcccttctcccataaaattctttacttgggcttcttgctaagtcaggactcctccgcagacagtccacccatgaaatcagagttctgtggtaggccttcaaagaggctaca

SEQ ID NO: 24642 - DNA, 601 bp, Human
gtcatggcccctcccaagagagaggaagaatctcacaaacactcttcaccaatactttgaaagagtagagactcacatttataaggtttgatattttttttcttggcctttgccaaaaaaaaaaaaaaaagactttacaaagcaataacactgcaatgctaggactcattctacaactattgatcaactgcaagcacatggagctgctccgggcaactcaaataatgtgctagtttaaagtgaaagatgtttcctgtctgggaacatgaacaggtcttatctctctccaatttttctcttrccgtgatgttttcaaaggaaaccctcagtcttgtactcatactctgcattctgctgccccaaatcactaaagcaaccctgagccagaggctgagacaggtttgtgcatttctcatttctagtctcacctgctcatggttgctcttgaggcagagcagctcctccttcagggactccacctgggcctccaggtcggacttgcacagggtcagctcatccaggatcctgcgcagaccgttgatgtccgactccaccagctgccgcagggacagctcggtctggtacctgcgcaaggacaggg

SEQ ID NO: 24643 - DNA, 601 bp, Human
gtgaggacctcagaatgccaaaaaaaataggctgtgcaatttcagaccatatatcaaaaaactcttgctgtcaagtaagaggtaagagcatgtcatggcccctcccaagagagaggaagaatctcacaaacactcttcaccaatactttgaaagagtagagactcacatttataaggtttgatattttttttcttggcctttgccaaaaaaaaaaaaaaaagactttacaaagcaataacactgcaatgctaggactcattctacaactattgatcaactgcaagcacatggagctgctcygggcaactcaaataatgtgctagtttaaagtgaaagatgtttcctgtctgggaacatgaacaggtcttatctctctccaatttttctcttaccgtgatgttttcaaaggaaaccctcagtcttgtactcatactctgcattctgctgccccaaatcactaaagcaaccctgagccagaggctgagacaggtttgtgcatttctcatttctagtctcacctgctcatggttgctcttgaggcagagcagctcctccttcagggactccacctgggcctccaggtcggacttgcacagggtc

SEQ ID NO: 24644 - DNA, 601 bp, Human
gatattcaactttcccagtttacaattggctgtgaggacctcagaatgccaaaaaaaataggctgtgcaatttcagaccatatatcaaaaaactcttgctgtcaagtaagaggtaagagcatgtcatggcccctcccaagagagaggaagaatctcacaaacactcttcaccaatactttgaaagagtagagactcacatttataaggtttgatattttttttcttggcctttgccaaaaaaaaaaaaaaaagactttacaaagcaataacactgcaatgctaggactcattctacaactrttgatcaactgcaagcacatggagctgctccgggcaactcaaataatgtgctagtttaaagtgaaagatgtttcctgtctgggaacatgaacaggtcttatctctctccaatttttctcttaccgtgatgttttcaaaggaaaccctcagtcttgtactcatactctgcattctgctgccccaaatcactaaagcaaccctgagccagaggctgagacaggtttgtgcatttctcatttctagtctcacctgctcatggttgctcttgaggcagagcagctcctccttcagggactccac

SEQ ID NO: 24645 - DNA, 601 bp, Human
aatacaaatgaaaaaggcatctgctttgccaaggaaatgatatttattaggaggttaaaagggaggcccactggcacatcagagagttctctgggtgagcataggaaggaacagacccccaggaaggaaagggtgagcaggacagtctggagtagttggggaggctacaggctttgggtgagtttcttggctgccttacgcgggcaactccagccatgcaaatgatgttttcaggccccttttgttgaaccagagccaggtcacagctctggagtcctgggccctgcatccttgctcctcyggcattccctaggttctagcgcacgaaggaattgcagggcccacagcgggggcgtggggcacagggtgtgcagggggcaggagggacacaagaggtacagggattggagagacagggtccgatgggcttgctgcacgcgttggtcgtggcacagggattgctgggcagactggagacaaaagaatgatgtggaaaagtgagttaagggcaattttaaaatcatatgccagagatatccccaagggtaagaatgcctgggtcaagggacttgacctggcctagaacagaaaaggcacagac

SEQ ID NO: 24646 - DNA, 601 bp, Human
ttcactctaacaccagcctgcatccttcctttgtggctctacaacagattttctaagactacttgatgtcatacctaagccagtgaatctatgtctttatcattctcagcattactgtgaacagacttagatccattcacagtttagtatgtcaaatatagataagtagttcattaagctggcagtgtggtgcccacctcctcaccttctgctggagctcctcaatggtcttgaagtaggactggtagctggggcacagcaagggctcctgctgctgagaccgctcccggatgaggttctycagctccgcgttgtcccgctccagctgacgcaccttctccaggtagctggccaggcggtcgttcaggaactgcatagtctccttctcgctgccattgaaggagccctcgcagaaccagttgcagttgctcacattggcagggatgttgcaggccccgggcagggtgtagccgtggcagctggggggcacacagggccgggaggagcagctggtgcggcagctcaggctgggcaggcagaagttgtagggcatggtgcagggaggcagtggagctctggaagtcagtttcaaaacctgatt

SEQ ID NO: 24647 - DNA, 601 bp, Human
ttcagagttagagccagtattctcattaaatgactgtagatagatacctttatctctctgaggcttgatttccttaactgtaaaatgaagacaaaactaacaccttatagggttggactgaagatgatatatgtaaaattatgttgtaaaatgtaagatcccaggaaaatgcaaaggattctcatgattgtaataatggtcatacctaaaagtattgattgattctctgaaaggcaatggattttgcctcctgtttttgtggtttaataacttctttttggggggttgacagtgactaacrtatacaaagagaccaatgtgaaaatcactttcaaacttactccagacgttgggttgaaaaggagtaagaatggatggtgtcttacaatcaaacttaaagcacagggctgcgcacagtggctcacgcctgtaatcccagcagtttgggaggctgaggcgggtggatcacttgaggtcaggagttcaagaccagcctgaccaacatggtaaaacccggtctccactaaaaatataaaaattagctgggcctgctggcgcatgcctgtaatcccagctacgaggaaggctgaggcaggaaaat

SEQ ID NO: 24648 - DNA, 601 bp, Human
tcattgttacagtttcattttcctttttgtggtgacaagacagtcctgaagacagaaagatttatttggccatcaacatccaaaaaatctctactggaggaaggagtcaagtcccatgactatcttttgtaaaagaaagtatctttagcccagataatgttagcaacaaatatcctacacttcccacggctgtaatataaaactctcgcctctacagacagattggcatctgaaacttgattttcaaagtctctgttttatcctacagtagaacagtgcctgtcccttgcaggggtgccgyccgccaggtactcacttgcagtcctcgctctccagcaggctccggtatgtgttgatctcacactccagccgcgcccgcacgtccagcagcacctgatactcctggttctgccgctccaggtcactgcggatctccgccagctgggactccacgttggtgatcaggctctgcacctgggacagctgggagctgtagcgggcctcgctctctgtcagcgtgttttccagagagtatcgctgtggtgggaaagatcaggaatgtcagagagctgctccttatagggttcctccatggggttcg

SEQ ID NO: 24649 - DNA, 601 bp, Human
tgacactcaaatgctcatctataagaaggtgataatgattcccactctgcctgcctcagatgattctaacaagaattaatgaaacggtggatttgaaagttctgtttaaatcagaaaaagtgatcattgttacagtttcattttcctttttgtggtgacaagacagtcctgaagacagaaagatttatttggccatcaacatccaaaaaatctctactggaggaaggagtcaagtcccatgactatcttttgtaaaagaaagtatctttagcccagataatgttagcaacaaatatcctayacttcccacggctgtaatataaaactctcgcctctacagacagattggcatctgaaacttgattttcaaagtctctgttttatcctacagtagaacagtgcctgtcccttgcaggggtgccgtccgccaggtactcacttgcagtcctcgctctccagcaggctccggtatgtgttgatctcacactccagccgcgcccgcacgtccagcagcacctgatactcctggttctgccgctccaggtcactgcggatctccgccagctgggactccacgttggtgatcaggctctgcacctgg

SEQ ID NO: 24650 - DNA, 601 bp, Human
gaataattccaaaagcaagcagttgagaagtggttgtgttttcctctaaagggatttcctatttgtgcagaaagttatgtgatttcatcaggtttgtttctccaaacatgagaagtttgctcccgatgagccaaaaggatgataggcatccagggattaggagaagcccagataagtgagttgtccttcctttccccacctcctgcaggagatccgcattctccaatcccacatctcagacacctccgtggttgtcaagctggacaacagccgggacctgaacatggactgcatcgttgcygagatcaaggcacagtatgatgacattgccacccgtagccgggctgaggccgagtcctggtatcgcagcaaggtgagcggcacaggacacctgcctgctagacatggcagtgggagggatgtgaggtatctagtagaaaaggcttctttgtctagggattctgatccctaaggatggtaagagaaaaaccaatagctctcatgttggggtggcagggcaggactgccacgtgtggttgcacaggccgagcactgcacaatctgtgcaatcatctgagctgtcctgaatgaatgggatgtc

SEQ ID NO: 24651 - DNA, 601 bp, Human
gggcctgaataattccaaaagcaagcagttgagaagtggttgtgttttcctctaaagggatttcctatttgtgcagaaagttatgtgatttcatcaggtttgtttctccaaacatgagaagtttgctcccgatgagccaaaaggatgataggcatccagggattaggagaagcccagataagtgagttgtccttcctttccccacctcctgcaggagatccgcattctccaatcccacatctcagacacctccgtggttgtcaagctggacaacagccgggacctgaacatggactgcatsgttgctgagatcaaggcacagtatgatgacattgccacccgtagccgggctgaggccgagtcctggtatcgcagcaaggtgagcggcacaggacacctgcctgctagacatggcagtgggagggatgtgaggtatctagtagaaaaggcttctttgtctagggattctgatccctaaggatggtaagagaaaaaccaatagctctcatgttggggtggcagggcaggactgccacgtgtggttgcacaggccgagcactgcacaatctgtgcaatcatctgagctgtcctgaatgaatgg

SEQ ID NO: 24652 - DNA, 601 bp, Human
ggactgcagcatagaccccacacagcatcaaacagaattgaacccattgctctggcccagggctttctctggcagcaatagccttcctacatggggttggtctaggagaatggaaagaggccccccatacagggtctgagcccctggaaagcatctggaccatgctggctgcacatgggcctgaataattccaaaagcaagcagttgagaagtggttgtgttttcctctaaagggatttcctatttgtgcagaaagttatgtgatttcatcaggtttgtttctccaaacatgagaagtttrctcccgatgagccaaaaggatgataggcatccagggattaggagaagcccagataagtgagttgtccttcctttccccacctcctgcaggagatccgcattctccaatcccacatctcagacacctccgtggttgtcaagctggacaacagccgggacctgaacatggactgcatcgttgctgagatcaaggcacagtatgatgacattgccacccgtagccgggctgaggccgagtcctggtatcgcagcaaggtgagcggcacaggacacctgcctgctagacatggcagtgggaggg

SEQ ID NO: 24653 - DNA, 601 bp, Human
tggactgcagcatagaccccacacagcatcaaacagaattgaacccattgctctggcccagggctttctctggcagcaatagccttcctacatggggttggtctaggagaatggaaagaggccccccatacagggtctgagcccctggaaagcatctggaccatgctggctgcacatgggcctgaataattccaaaagcaagcagttgagaagtggttgtgttttcctctaaagggatttcctatttgtgcagaaagttatgtgatttcatcaggtttgtttctccaaacatgagaagttygctcccgatgagccaaaaggatgataggcatccagggattaggagaagcccagataagtgagttgtccttcctttccccacctcctgcaggagatccgcattctccaatcccacatctcagacacctccgtggttgtcaagctggacaacagccgggacctgaacatggactgcatcgttgctgagatcaaggcacagtatgatgacattgccacccgtagccgggctgaggccgagtcctggtatcgcagcaaggtgagcggcacaggacacctgcctgctagacatggcagtgggagg

SEQ ID NO: 24654 - DNA, 601 bp, Human
cttcccctgagccagtggactgcagcatagaccccacacagcatcaaacagaattgaacccattgctctggcccagggctttctctggcagcaatagccttcctacatggggttggtctaggagaatggaaagaggccccccatacagggtctgagcccctggaaagcatctggaccatgctggctgcacatgggcctgaataattccaaaagcaagcagttgagaagtggttgtgttttcctctaaagggatttcctatttgtgcagaaagttatgtgatttcatcaggtttgtttctcyaaacatgagaagtttgctcccgatgagccaaaaggatgataggcatccagggattaggagaagcccagataagtgagttgtccttcctttccccacctcctgcaggagatccgcattctccaatcccacatctcagacacctccgtggttgtcaagctggacaacagccgggacctgaacatggactgcatcgttgctgagatcaaggcacagtatgatgacattgccacccgtagccgggctgaggccgagtcctggtatcgcagcaaggtgagcggcacaggacacctgcctgctaga

SEQ ID NO: 24655 - DNA, 601 bp, Human
gccctgagcccgccctgagtcccgccacccatcctctttgtcctgccacatggcagccaggtcctcagagccctctgaggaaagccggcctcacagccccttctaccccacccaggatgtggactgtgcctacctccgcaagtcagacctggaggccaacgtggaggccctgatccaggagattgacttcctgaggcggctgtacgaggaggtgaggggctctcagccatggtgggcacagatccccccatgggatccctgaccctctgcccagacacccacaggcatgaaccaggcctgstgacatatgaacccaggctcacggctggagggttggcagggagcaaggagagggaaggaacagggaggcaaacggatggaaagccaaaaaggaacaaatttagtaaggggcaggagagtgagcaccccagacacctgtgccttgggaacctgccctgcgtccttcccctgagccagtggactgcagcatagaccccacacagcatcaaacagaattgaacccattgctctggcccagggctttctctggcagcaatagccttcctacatggggttggtctaggagaatggaaagaggccc

SEQ ID NO: 24656 - DNA, 601 bp, Human
acgagtttgtggctctaaagaaggtgagtgaagcccagctggccctgagcccgccctgagtcccgccacccatcctctttgtcctgccacatggcagccaggtcctcagagccctctgaggaaagccggcctcacagccccttctaccccacccaggatgtggactgtgcctacctccgcaagtcagacctggaggccaacgtggaggccctgatccaggagattgacttcctgaggcggctgtacgaggaggtgaggggctctcagccatggtgggcacagatccccccatgggatcccygaccctctgcccagacacccacaggcatgaaccaggcctggtgacatatgaacccaggctcacggctggagggttggcagggagcaaggagagggaaggaacagggaggcaaacggatggaaagccaaaaaggaacaaatttagtaaggggcaggagagtgagcaccccagacacctgtgccttgggaacctgccctgcgtccttcccctgagccagtggactgcagcatagaccccacacagcatcaaacagaattgaacccattgctctggcccagggctttctctggcagcaatagc

SEQ ID NO: 24657 - DNA, 601 bp, Human
gaagaagaagtagcacttcgagccacagcagagaacgagtttgtggctctaaagaaggtgagtgaagcccagctggccctgagcccgccctgagtcccgccacccatcctctttgtcctgccacatggcagccaggtcctcagagccctctgaggaaagccggcctcacagccccttctaccccacccaggatgtggactgtgcctacctccgcaagtcagacctggaggccaacgtggaggccctgatccaggagattgacttcctgaggcggctgtacgaggaggtgaggggctctcarccatggtgggcacagatccccccatgggatccctgaccctctgcccagacacccacaggcatgaaccaggcctggtgacatatgaacccaggctcacggctggagggttggcagggagcaaggagagggaaggaacagggaggcaaacggatggaaagccaaaaaggaacaaatttagtaaggggcaggagagtgagcaccccagacacctgtgccttgggaacctgccctgcgtccttcccctgagccagtggactgcagcatagaccccacacagcatcaaacagaattgaacccatt

SEQ ID NO: 24658 - DNA, 601 bp, Human
gggggaggtctaggaaagagactcctttgcatatatgctcatggccaagatcaagagctgttcagacaaggtcttgttctccctgctcacctcaggtatgaagaagaagtagcacttcgagccacagcagagaacgagtttgtggctctaaagaaggtgagtgaagcccagctggccctgagcccgccctgagtcccgccacccatcctctttgtcctgccacatggcagccaggtcctcagagccctctgaggaaagccggcctcacagccccttctaccccacccaggatgtggactgygcctacctccgcaagtcagacctggaggccaacgtggaggccctgatccaggagattgacttcctgaggcggctgtacgaggaggtgaggggctctcagccatggtgggcacagatccccccatgggatccctgaccctctgcccagacacccacaggcatgaaccaggcctggtgacatatgaacccaggctcacggctggagggttggcagggagcaaggagagggaaggaacagggaggcaaacggatggaaagccaaaaaggaacaaatttagtaaggggcaggagagtgagcacc

SEQ ID NO: 24659 - DNA, 601 bp, Human
tcccagtagtacccaggccagcagcctggttcctgcagagccccacccatttcacttgggggcaggagacaagcagggggaggtctaggaaagagactcctttgcatatatgctcatggccaagatcaagagctgttcagacaaggtcttgttctccctgctcacctcaggtatgaagaagaagtagcacttcgagccacagcagagaacgagtttgtggctctaaagaaggtgagtgaagcccagctggccctgagcccgccctgagtcccgccacccatcctctttgtcctgccacatrgcagccaggtcctcagagccctctgaggaaagccggcctcacagccccttctaccccacccaggatgtggactgtgcctacctccgcaagtcagacctggaggccaacgtggaggccctgatccaggagattgacttcctgaggcggctgtacgaggaggtgaggggctctcagccatggtgggcacagatccccccatgggatccctgaccctctgcccagacacccacaggcatgaaccaggcctggtgacatatgaacccaggctcacggctggagggttggcagggagcaaggaga

SEQ ID NO: 24660 - DNA, 601 bp, Human
gagaggggagaatggcatgaacctgggaggcggagcttgcagtgagccgagaccgcgccactgtgctccaacctgggcgacagagcgagactccatctcaaaaacaaaaacaaaaaaaaacaggggagtaggcacttcatttctccagtgcatcccagtagtacccaggccagcagcctggttcctgcagagccccacccatttcacttgggggcaggagacaagcagggggaggtctaggaaagagactcctttgcatatatgctcatggccaagatcaagagctgttcagacaaggtcytgttctccctgctcacctcaggtatgaagaagaagtagcacttcgagccacagcagagaacgagtttgtggctctaaagaaggtgagtgaagcccagctggccctgagcccgccctgagtcccgccacccatcctctttgtcctgccacatggcagccaggtcctcagagccctctgaggaaagccggcctcacagccccttctaccccacccaggatgtggactgtgcctacctccgcaagtcagacctggaggccaacgtggaggccctgatccaggagattgacttcctgaggcggc

SEQ ID NO: 24661 - DNA, 601 bp, Human
ttgtggagcctgcagtctgctggaaggcagtcatgacagagctacagatctagcccttcagctacaaagtgtgatatatggtatgaagaatacgcactggatcctcagaaggaatctgcttttgaggggtggccagcttccttcagtaacattctctccatggactccccaggcccagcatacccctccctccctgtctctgagctgcctcccacagctcaggccaggaggggagagacagagcgaggatcccaccacctgcagctgagtgggggcaggggagggctcaaaggaagaaaasatggagacctaggcgagaaaaacagcacctcccactccccaaccacacacattcacacactcagcttccagatcctgctctcccaacctccaccaaaacaggggagtgaattagccaggcgtggtggtgggcacctgtagtcccagctactcgggaggctgagaggggagaatggcatgaacctgggaggcggagcttgcagtgagccgagaccgcgccactgtgctccaacctgggcgacagagcgagactccatctcaaaaacaaaaacaaaaaaaaacaggggagtaggcacttcat

SEQ ID NO: 24662 - DNA, 601 bp, Human
cagtgcgggttcttgtggagcctgcagtctgctggaaggcagtcatgacagagctacagatctagcccttcagctacaaagtgtgatatatggtatgaagaatacgcactggatcctcagaaggaatctgcttttgaggggtggccagcttccttcagtaacattctctccatggactccccaggcccagcatacccctccctccctgtctctgagctgcctcccacagctcaggccaggaggggagagacagagcgaggatcccaccacctgcagctgagtgggggcaggggagggctcraaggaagaaaacatggagacctaggcgagaaaaacagcacctcccactccccaaccacacacattcacacactcagcttccagatcctgctctcccaacctccaccaaaacaggggagtgaattagccaggcgtggtggtgggcacctgtagtcccagctactcgggaggctgagaggggagaatggcatgaacctgggaggcggagcttgcagtgagccgagaccgcgccactgtgctccaacctgggcgacagagcgagactccatctcaaaaacaaaaacaaaaaaaaacaggggag

SEQ ID NO: 24663 - DNA, 601 bp, Human
cttcctaagtttgctctctcactcagctaacactatctgatcacctaccacatgcagcacgctgtgctggtgatagtgacacagggccacgcaagccacacagtgcgggttcttgtggagcctgcagtctgctggaaggcagtcatgacagagctacagatctagcccttcagctacaaagtgtgatatatggtatgaagaatacgcactggatcctcagaaggaatctgcttttgaggggtggccagcttccttcagtaacattctctccatggactccccaggcccagcatacccctcyctccctgtctctgagctgcctcccacagctcaggccaggaggggagagacagagcgaggatcccaccacctgcagctgagtgggggcaggggagggctcaaaggaagaaaacatggagacctaggcgagaaaaacagcacctcccactccccaaccacacacattcacacactcagcttccagatcctgctctcccaacctccaccaaaacaggggagtgaattagccaggcgtggtggtgggcacctgtagtcccagctactcgggaggctgagaggggagaatggcatgaacctggga

SEQ ID NO: 24664 - DNA, 601 bp, Human
gacaaagctgcagttctaccaaaactgcgagtgctgccagagtaacctggagcccctgtttgctggctacatcgagactctgcggcgggaggccgagtgcgtggaggctgacagtgggaggctggcctcagagctcaaccacgtgcaggaggtgctggagggctacaagaagaagtgagtgtgggcaggaggggttctgggcacaggaaatagcacggtggcagctccctgagcccggaggagtatccagtctgcagctggcatctctgcctgagagtggagaagaacctgtaccccctgyttgagacacaggggtcccttgggtgtgggggatggaggctcagcttgtctttccaccagcagatcagggaaacaatgctctctccctttctccatccatttttcacaaaaacttgtattcctgggtccctttgagaccagatctcaaagtcctggacatgtgtcttcctaagtttgctctctcactcagctaacactatctgatcacctaccacatgcagcacgctgtgctggtgatagtgacacagggccacgcaagccacacagtgcgggttcttgtggagcctgcagtctgctggaa

SEQ ID NO: 24665 - DNA, 601 bp, Human
tggagacaaagctgcagttctaccaaaactgcgagtgctgccagagtaacctggagcccctgtttgctggctacatcgagactctgcggcgggaggccgagtgcgtggaggctgacagtgggaggctggcctcagagctcaaccacgtgcaggaggtgctggagggctacaagaagaagtgagtgtgggcaggaggggttctgggcacaggaaatagcacggtggcagctccctgagcccggaggagtatccagtctgcagctggcatctctgcctgagagtggagaagaacctgtacccyctgtttgagacacaggggtcccttgggtgtgggggatggaggctcagcttgtctttccaccagcagatcagggaaacaatgctctctccctttctccatccatttttcacaaaaacttgtattcctgggtccctttgagaccagatctcaaagtcctggacatgtgtcttcctaagtttgctctctcactcagctaacactatctgatcacctaccacatgcagcacgctgtgctggtgatagtgacacagggccacgcaagccacacagtgcgggttcttgtggagcctgcagtctgct

SEQ ID NO: 24666 - DNA, 601 bp, Human
tcctctgatgctgcaagaagaggttcttaggctctgcctctgggtggcaggtgcgcttcctggagcagcagaacaagctgctggagacaaagctgcagttctaccaaaactgcgagtgctgccagagtaacctggagcccctgtttgctggctacatcgagactctgcggcgggaggccgagtgcgtggaggctgacagtgggaggctggcctcagagctcaaccacgtgcaggaggtgctggagggctacaagaagaagtgagtgtgggcaggaggggttctgggcacaggaaatagcayggtggcagctccctgagcccggaggagtatccagtctgcagctggcatctctgcctgagagtggagaagaacctgtaccccctgtttgagacacaggggtcccttgggtgtgggggatggaggctcagcttgtctttccaccagcagatcagggaaacaatgctctctccctttctccatccatttttcacaaaaacttgtattcctgggtccctttgagaccagatctcaaagtcctggacatgtgtcttcctaagtttgctctctcactcagctaacactatctgatcacctaccaca

SEQ ID NO: 24667 - DNA, 601 bp, Human
gacataacgccttccagggaagactctgggtcagagagttgggggctttcaggccctcgtgctgggaacccctcttgtcctctgatgctgcaagaagaggttcttaggctctgcctctgggtggcaggtgcgcttcctggagcagcagaacaagctgctggagacaaagctgcagttctaccaaaactgcgagtgctgccagagtaacctggagcccctgtttgctggctacatcgagactctgcggcgggaggccgagtgcgtggaggctgacagtgggaggctggcctcagagctcaaycacgtgcaggaggtgctggagggctacaagaagaagtgagtgtgggcaggaggggttctgggcacaggaaatagcacggtggcagctccctgagcccggaggagtatccagtctgcagctggcatctctgcctgagagtggagaagaacctgtaccccctgtttgagacacaggggtcccttgggtgtgggggatggaggctcagcttgtctttccaccagcagatcagggaaacaatgctctctccctttctccatccatttttcacaaaaacttgtattcctgggtccctttgagacc

SEQ ID NO: 24668 - DNA, 601 bp, Human
acttagaagagattaactcccaggaagaacttccaggtggtgaactggttaagccctggtggcatttttgagagagatgacataacgccttccagggaagactctgggtcagagagttgggggctttcaggccctcgtgctgggaacccctcttgtcctctgatgctgcaagaagaggttcttaggctctgcctctgggtggcaggtgcgcttcctggagcagcagaacaagctgctggagacaaagctgcagttctaccaaaactgcgagtgctgccagagtaacctggagcccctgttygctggctacatcgagactctgcggcgggaggccgagtgcgtggaggctgacagtgggaggctggcctcagagctcaaccacgtgcaggaggtgctggagggctacaagaagaagtgagtgtgggcaggaggggttctgggcacaggaaatagcacggtggcagctccctgagcccggaggagtatccagtctgcagctggcatctctgcctgagagtggagaagaacctgtaccccctgtttgagacacaggggtcccttgggtgtgggggatggaggctcagcttgtctttccaccagc

SEQ ID NO: 24669 - DNA, 601 bp, Human
ctcttcaagcattttccatgacaccaggtaaactgacttagaagagattaactcccaggaagaacttccaggtggtgaactggttaagccctggtggcatttttgagagagatgacataacgccttccagggaagactctgggtcagagagttgggggctttcaggccctcgtgctgggaacccctcttgtcctctgatgctgcaagaagaggttcttaggctctgcctctgggtggcaggtgcgcttcctggagcagcagaacaagctgctggagacaaagctgcagttctaccaaaacygcgagtgctgccagagtaacctggagcccctgtttgctggctacatcgagactctgcggcgggaggccgagtgcgtggaggctgacagtgggaggctggcctcagagctcaaccacgtgcaggaggtgctggagggctacaagaagaagtgagtgtgggcaggaggggttctgggcacaggaaatagcacggtggcagctccctgagcccggaggagtatccagtctgcagctggcatctctgcctgagagtggagaagaacctgtaccccctgtttgagacacaggggtcccttgggtg

SEQ ID NO: 24670 - DNA, 601 bp, Human
taaagggttcttttaatcctcatagtaaggtgagctttaacctcgccactctacagaggaggtgagtgctttatccaagggcacattgttaacaagtggcagcagaatctggactcttcaagcattttccatgacaccaggtaaactgacttagaagagattaactcccaggaagaacttccaggtggtgaactggttaagccctggtggcatttttgagagagatgacataacgccttccagggaagactctgggtcagagagttgggggctttcaggccctcgtgctgggaacccctcttgtcctctgatgctgcaagaagaggttcttaggctctgcctctgggtggcaggtgcgcttcctggagcagcagaacaagctgctggagacaaagctgcagttctaccaaaactgcgagtgctgccagagtaacctggagcccctgtttgctggctacatcgagactctgcggcgggaggccgagtgcgtggaggctgacagtgggaggctggcctcagagctcaaccacgtgcaggaggtgctggagggctacaagaagaagtgagtgtgggcaggaggggttctgggcacaggaaatag

SEQ ID NO: 24671 - DNA, 601 bp, Human
tggggtgcctttctgttaaagggttcttttaatcctcatagtaaggtgagctttaacctcgccactctacagaggaggtgagtgctttatccaagggcacattgttaacaagtggcagcagaatctggactcttcaagcattttccatgacaccaggtaaactgacttagaagagattaactcccaggaagaacttccaggtggtgaactggttaagccctggtggcatttttgagagagatgacataacgccttccagggaagactctgggtcagagagttgggggctttcaggccctcrtgctgggaacccctcttgtcctctgatgctgcaagaagaggttcttaggctctgcctctgggtggcaggtgcgcttcctggagcagcagaacaagctgctggagacaaagctgcagttctaccaaaactgcgagtgctgccagagtaacctggagcccctgtttgctggctacatcgagactctgcggcgggaggccgagtgcgtggaggctgacagtgggaggctggcctcagagctcaaccacgtgcaggaggtgctggagggctacaagaagaagtgagtgtgggcaggaggggttc

SEQ ID NO: 24672 - DNA, 601 bp, Human
cacgcgggagtgcccagagggagggggagggggggagagcatggggctaaagtgattcatttcagatatctgtagctcagggggtgggcttcgcggggttccaggccaggaaaacggcaagggtggctgatgccaagtaaactccaggccagggacggggaaagtggtcctggggagtcttggggatccactttatgcacctccaggtgctggaagctgagatggggagagggtgatgtgggagaggagaagacaagtctaaagccaggtgcctgtttccaggagcttccggcttggcagycctgctgtgttgggaaattgtttccagtgggctgatgaagtcttctttatccttgcacagtgactgccagccccccaggatctctcagagcctccgactgggtcattttgaactgctccttcagccgccctgaccgcccagcctctgtgcattggttccggaaccggggccagggccgagtccctgtccgggagtccccccatcaccacttagcggaaagcttcctcttcctgccccaagtcagccccatggactctgggccctggggctgcatcctcacctacagagatggcttcaacg

SEQ ID NO: 24673 - DNA, 601 bp, Human
gctggcagggcaaagactaggcaaacccaccctgtgatgccaggccactgggcacaagttccagagcctgcccatctcggcccccacttttctcacccccataataaagaaacgaaactgaaaatctcctcttgagtcacaagataaaagttccaccgttctctatgggactcccctgctctcaattggcgggagggtctgggaagttagaaggaaaggtgacaaaaattctgaatggttcgaaagaggtagaatatatttctagaatccttgtctactttgcagccagggcttgggttaragttgcaggaagtggcctggatttgggaggagtgaataaatccgtcccttggtcagcaaatatttactgagcaagggttttccaagacagtataaaacaaacacagaaaaaagaatactcagagagtatgtgttgactggttgataactatcagccatgacagattagccatgtctgcagcacgcacctgcggccactcagtagtagcaccccacggcaggtgcttaataatgtatagagattgaatgaatacgtgaacatgctaatggataatacatctcctgaaggccaatcctgagt

SEQ ID NO: 24674 - DNA, 601 bp, Human
caccgttctctatgggactcccctgctctcaattggcgggagggtctgggaagttagaaggaaaggtgacaaaaattctgaatggttcgaaagaggtagaatatatttctagaatccttgtctactttgcagccagggcttgggttaaagttgcaggaagtggcctggatttgggaggagtgaataaatccgtcccttggtcagcaaatatttactgagcaagggttttccaagacagtataaaacaaacacagaaaaaagaatactcagagagtatgtgttgactggttgataactatcrgccatgacagattagccatgtctgcagcacgcacctgcggccactcagtagtagcaccccacggcaggtgcttaataatgtatagagattgaatgaatacgtgaacatgctaatggataatacatctcctgaaggccaatcctgagttttcacttgctttctggatacctctaactagatgttataccacctctcagccgccttaccctgaaccccagctttttctcccaccaatccccttgctgactcagcctgtcagtaatccactggtatccatccacctcgaaacctggcctcctc

SEQ ID NO: 24675 - DNA, 601 bp, Human
gaataaatccgtcccttggtcagcaaatatttactgagcaagggttttccaagacagtataaaacaaacacagaaaaaagaatactcagagagtatgtgttgactggttgataactatcagccatgacagattagccatgtctgcagcacgcacctgcggccactcagtagtagcaccccacggcaggtgcttaataatgtatagagattgaatgaatacgtgaacatgctaatggataatacatctcctgaaggccaatcctgagttttcacttgctttctggatacctctaactagatrttataccacctctcagccgccttaccctgaaccccagctttttctcccaccaatccccttgctgactcagcctgtcagtaatccactggtatccatccacctcgaaacctggcctcctcctctctacatcccatcagtcatcaaagtccaccagttctttctgtccaatgccctcttgaaggtcaactgttttatgtagacggctcaatgagagagatactgttaccccgaagactttctcaaaacagctgggaagtgccagactctgggtctaaactcaggtgtctgcatcaccaaatc

SEQ ID NO: 24676 - DNA, 601 bp, Human
ttatcctccttccagaacagcccctgccacccccatcccagcgcttttctttccagtcagggacctgatctctggcttttgcctagggttgacccgtttccgccactgatcagctgaatgaccctgggacaagtcccttaaactctctggatctcattgcatctgtaaagtctgagagaatgacaaagtgtcctttctagtcctgaccctatgcctcatcctgtactttctccataggtgcccaacgctctgggagagccccaggtgccctcccagcaggccacctcctgctgtttctcayccttggtgtcctttctctgctccttttggtgactggagcctttggctttcacctttggagaagacaggtgagccagggacatggcaaccccgccccccagcagctcccgctcttccatcctcagagtgctgatggcaccccttcctcaggaaggtgaccaaatgggaccctgaacttgccctcagagccccccttcttcataagcctctcactccagggatggcttgtgcctgggtaggctggaaggggggttgggagaaagccaggaccagatggggagggcaggggcgctgagaaaaa

SEQ ID NO: 24677 - DNA, 601 bp, Human
acgacttggactgtgcttctaggaagcaaaacttgtcagtccctgtaagtctttcctcttttttttttgtaacccagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactggtatgtatcaggatagaggtgaatcaagctgatattttgcaacttctcagttttattytaactttaatgatctctgtgacttttatactagctttaagaggttttcattccagtgtgctacagcatctgatagactgctgttgggagtggggtaaggaaaaatactacattgaggacagagctgatggctttttttggtattctcttaacagaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaa

SEQ ID NO: 24678 - DNA, 601 bp, Human
tgtgtggttcagattggttgatttgtaaccctagttgtgcataagaattgcccagatattttttttaaatgccagtgtccaggcatttttttttcaatccctatgattccagtgtgcagacaaggttgaaaatccctatttataatgctccctgttacaattgcttttcaactaagagatgtctgtacttttggtacctagatgatgtaagagccaggaaggtgcttgctgtttgggtttgaccaagtgtcactttttaataatctgccactcttggcagggagctcactcagtgggtttratgtggtggatgctggctcgggaagttctgcgcatgcgtggcaccatttcccgtgaacacccatgggaggtcatgcctgatctgtacttctacagagatcctgaagaggtaagcttctccaaaggcttgtggttacataagcaaattggacgacttggactgtgcttctaggaagcaaaacttgtcagtccctgtaagtctttcctcttttttttttgtaacccagattgaaaaagaagagcaggctgctgctgagaaggcagtgaccaaggaggaatttcagggtgaatggactgctcc

SEQ ID NO: 24679 - DNA, 601 bp, Human
cttctgcctttgtccgtgtttcttgctcaggcctcaggcacttggcctttgttttcacaccaacttgatgggttctactataagatgctaaaaaggtgggttgtgtgtggttcagattggttgatttgtaaccctagttgtgcataagaattgcccagatattttttttaaatgccagtgtccaggcatttttttttcaatccctatgattccagtgtgcagacaaggttgaaaatccctatttataatgctccctgttacaattgcttttcaactaagagatgtctgtacttttggtacytagatgatgtaagagccaggaaggtgcttgctgtttgggtttgaccaagtgtcactttttaataatctgccactcttggcagggagctcactcagtgggtttgatgtggtggatgctggctcgggaagttctgcgcatgcgtggcaccatttcccgtgaacacccatgggaggtcatgcctgatctgtacttctacagagatcctgaagaggtaagcttctccaaaggcttgtggttacataagcaaattggacgacttggactgtgcttctaggaagcaaaacttgtcagtccctgtaa

SEQ ID NO: 24680 - DNA, 601 bp, Human
ctctggcccaatgagtggagtttgatagtaattcttgctacaagtataacattactgcatgacagctttgtggagaaatgaaaacatttggaaaatagtgtgttcttctgcctttgtccgtgtttcttgctcaggcctcaggcacttggcctttgttttcacaccaacttgatgggttctactataagatgctaaaaaggtgggttgtgtgtggttcagattggttgatttgtaaccctagttgtgcataagaattgcccagatattttttttaaatgccagtgtccaggcatttttttttcaatccctatgattccagtgtgcagacaaggttgaaaatccctatttataatgctccctgttacaattgcttttcaactaagagatgtctgtacttttggtacctagatgatgtaagagccaggaaggtgcttgctgtttgggtttgaccaagtgtcactttttaataatctgccactcttggcagggagctcactcagtgggtttgatgtggtggatgctggctcgggaagttctgcgcatgcgtggcaccatttcccgtgaacacccatgggaggtcatgcctgatctgtacttctac

SEQ ID NO: 24681 - DNA, 601 bp, Human
catcccatgcaacaacaaggtaatgattttaggatctagagtttgtgaatgcgtgctctagaaaaaacattcctgtgcacattgttagagcttggagttgaggctactgactggccgatgaactcgcaagtgtaggtagtgtgctacatgaggggcaagttttcgctaacaccacaagggtctctggcccaatgagtggagtttgatagtaattcttgctacaagtataacattactgcatgacagctttgtggagaaatgaaaacatttggaaaatagtgtgttcttctgcctttgtccrtgtttcttgctcaggcctcaggcacttggcctttgttttcacaccaacttgatgggttctactataagatgctaaaaaggtgggttgtgtgtggttcagattggttgatttgtaaccctagttgtgcataagaattgcccagatattttttttaaatgccagtgtccaggcatttttttttcaatccctatgattccagtgtgcagacaaggttgaaaatccctatttataatgctccctgttacaattgcttttcaactaagagatgtctgtacttttggtacctagatgatgtaagag

SEQ ID NO: 24682 - DNA, 601 bp, Human
atttcaatgttgacaggacgggttcccatgtgtgtttttgcagagggttattcctgaaactgacttgttactaggaccacatagtttggtacacagtagaaaaaaggcagttagttattgctgtagaatgaactgagtgacagttcttgcttgcttgagaaaaatatactgagcatctagattgggccaggtagtgttgctaggtgctcgggatatatagtagaaaaacaagcctgtcttttttaatgtatgcaggaaatctctggagaagtaagaggggttaaggaaagctgggtatgtkcctgctttacatggagtagtagtgattaagttggccagtgcccagaagtgcttactgggtgccaggattgttgctgtggaatatcgagtaccactaacttttaaattcttcaaagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgc

SEQ ID NO: 24683 - DNA, 601 bp, Human
taaaaattatgtagtaagactttatttcaatgttgacaggacgggttcccatgtgtgtttttgcagagggttattcctgaaactgacttgttactaggaccacatagtttggtacacagtagaaaaaaggcagttagttattgctgtagaatgaactgagtgacagttcttgcttgcttgagaaaaatatactgagcatctagattgggccaggtagtgttgctaggtgctcgggatatatagtagaaaaacaagcctgtcttttttaatgtatgcaggaaatctctggagaagtaagagrggttaaggaaagctgggtatgtgcctgctttacatggagtagtagtgattaagttggccagtgcccagaagtgcttactgggtgccaggattgttgctgtggaatatcgagtaccactaacttttaaattcttcaaagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatct

SEQ ID NO: 24684 - DNA, 601 bp, Human
gtgggcaacgtggcaaaactccgtctctaccaaaattaacaaaaacgagctgggtgtggtgttggcgtgcctgtagtctcagctgaggctaaggtgggaagattgctagaacacaggaggttgaggcagcagggagccaagactgtccactgcatcccagcctgagtgacagagtgaggccttgtctcaaagagaacctctgccaacttgaatgaaaaataccttaatttgtatttttaagaaatgactagttagtaaaacttgaatcttttttgccacagctctattttaataattttttctgttgagaaaactagtagatttcttgaattctaagagttctaacagggattttattcatcttaactattttgacagatttaaaaattatgtagtaagactttatttcaatgttgacaggacgggttcccatgtgtgtttttgcagagggttattcctgaaactgacttgttactaggaccacatagtttggtacacagtagaaaaaaggcagttagttattgctgtagaatgaactgagtgacagttcttgcttgcttgagaaaaatatactgagcatctagattgggccaggtagtgt

SEQ ID NO: 24685 - DNA, 601 bp, Human
tctgagccaggagatccctcaagtccaggagctgggggctgcagtaagttatgattttgccactgcactccaagcctggggcacagagtgagatcctgtttcttaaaaaagccagtcatgggtggctcatgcttttgtaatatggggtactttgtgaggctgaggctggtggcttgcttgagcccagaagttcgagaccagggtgggcaacgtggcaaaactccgtctctaccaaaattaacaaaaacgagctgggtgtggtgttggcgtgcctgtagtctcagctgaggctaaggtgggragattgctagaacacaggaggttgaggcagcagggagccaagactgtccactgcatcccagcctgagtgacagagtgaggccttgtctcaaagagaacctctgccaacttgaatgaaaaataccttaatttgtatttttaagaaatgactagttagtaaaacttgaatcttttttgccacagctctattttaataattttttctgttgagaaaactagtagatttcttgaattctaagagttctaacagggattttattcatcttaactattttgacagatttaaaaattatgtagtaag

SEQ ID NO: 24686 - DNA, 601 bp, Human
attgggagtctgagccaggagatccctcaagtccaggagctgggggctgcagtaagttatgattttgccactgcactccaagcctggggcacagagtgagatcctgtttcttaaaaaagccagtcatgggtggctcatgcttttgtaatatggggtactttgtgaggctgaggctggtggcttgcttgagcccagaagttcgagaccagggtgggcaacgtggcaaaactccgtctctaccaaaattaacaaaaacgagctgggtgtggtgttggcgtgcctgtagtctcagctgaggctraggtgggaagattgctagaacacaggaggttgaggcagcagggagccaagactgtccactgcatcccagcctgagtgacagagtgaggccttgtctcaaagagaacctctgccaacttgaatgaaaaataccttaatttgtatttttaagaaatgactagttagtaaaacttgaatcttttttgccacagctctattttaataattttttctgttgagaaaactagtagatttcttgaattctaagagttctaacagggattttattcatcttaactattttgacagatttaaaaattat

SEQ ID NO: 24687 - DNA, 601 bp, Human
tgttgaactttataatttcattttgtgtagacttgtgccactaaatatctagaaattctattaaagtggcttatcacattttcccatggtcaaagtttttaccttaaaacaatgaaatactgggacagaaattttttaagaatcttagccagtcatgacggcatgcacccatagttcccgttaattgggagtctgagccaggagatccctcaagtccaggagctgggggctgcagtaagttatgattttgccactgcactccaagcctggggcacagagtgagatcctgtttcttaaaaaagccagtcatgggtggctcatgcttttgtaatatggggtactttgtgaggctgaggctggtggcttgcttgagcccagaagttcgagaccagggtgggcaacgtggcaaaactccgtctctaccaaaattaacaaaaacgagctgggtgtggtgttggcgtgcctgtagtctcagctgaggctaaggtgggaagattgctagaacacaggaggttgaggcagcagggagccaagactgtccactgcatcccagcctgagtgacagagtgaggccttgtctcaaagagaacctctgccaact

SEQ ID NO: 24688 - DNA, 601 bp, Human
atgttgaactttataatttcattttgtgtagacttgtgccactaaatatctagaaattctattaaagtggcttatcacattttcccatggtcaaagtttttaccttaaaacaatgaaatactgggacagaaattttttaagaatcttagccagtcatgacggcatgcacccatagttcccgttaattgggagtctgagccaggagatccctcaagtccaggagctgggggctgcagtaagttatgattttgccactgcactccaagcctggggcacagagtgagatcctgtttcttaaaamagccagtcatgggtggctcatgcttttgtaatatggggtactttgtgaggctgaggctggtggcttgcttgagcccagaagttcgagaccagggtgggcaacgtggcaaaactccgtctctaccaaaattaacaaaaacgagctgggtgtggtgttggcgtgcctgtagtctcagctgaggctaaggtgggaagattgctagaacacaggaggttgaggcagcagggagccaagactgtccactgcatcccagcctgagtgacagagtgaggccttgtctcaaagagaacctctgccaac

SEQ ID NO: 24689 - DNA, 601 bp, Human
aaaccctgctgatgtcagtgttatatcctccaggaatactggccaggtttgtggaacagtggttagtttttatattatagaaataaagcttacagacattgtgagacatagaaagacataagaaaacagaaataactcaggccgggcgcggtggctacgcctgtaatcccagcactttgggaggtggagtccggcgtattacgaggtcaggagatccacaccacggtgaagccccatctctactaaaaatacaaaaaattagttgggcgtgggggcgggtgcctgtagtcccagctactcrggaggccaaggtggagaatggcgtgaacccggtgggcggagcttgcagtgagctgagatgcgccactgtactccagcctgggtgacagagccgagactctgtctcaaaaaaaaaaaaaaagaaaatagaaaactcaaactccactgttagagatcttaagttggactgagccatagaaatcgcccttatgacctatgaccttcctttttttttttttttttttttttccttcaagacagtctctcgctctgttgcctgttgtccatcctggactgcagtggtgtgatatcggctcattgc

SEQ ID NO: 24690 - DNA, 601 bp, Human
ttaggcatctatatcataaatctcaagaggacctgggagaagcttctgctggcagctcgtgcaattgttgccattgaaaaccctgctgatgtcagtgttatatcctccaggaatactggccaggtttgtggaacagtggttagtttttatattatagaaataaagcttacagacattgtgagacatagaaagacataagaaaacagaaataactcaggccgggcgcggtggctacgcctgtaatcccagcactttgggaggtggagtccggcgtattacgaggtcaggagatccacaccayggtgaagccccatctctactaaaaatacaaaaaattagttgggcgtgggggcgggtgcctgtagtcccagctactcaggaggccaaggtggagaatggcgtgaacccggtgggcggagcttgcagtgagctgagatgcgccactgtactccagcctgggtgacagagccgagactctgtctcaaaaaaaaaaaaaaagaaaatagaaaactcaaactccactgttagagatcttaagttggactgagccatagaaatcgcccttatgacctatgaccttccttttttttttttttttttt

SEQ ID NO: 24691 - DNA, 601 bp, Human
ggtcaagtgttacaaatccttctgccctcacttaggcatctatatcataaatctcaagaggacctgggagaagcttctgctggcagctcgtgcaattgttgccattgaaaaccctgctgatgtcagtgttatatcctccaggaatactggccaggtttgtggaacagtggttagtttttatattatagaaataaagcttacagacattgtgagacatagaaagacataagaaaacagaaataactcaggccgggcgcggtggctacgcctgtaatcccagcactttgggaggtggagtccrgcgtattacgaggtcaggagatccacaccacggtgaagccccatctctactaaaaatacaaaaaattagttgggcgtgggggcgggtgcctgtagtcccagctactcaggaggccaaggtggagaatggcgtgaacccggtgggcggagcttgcagtgagctgagatgcgccactgtactccagcctgggtgacagagccgagactctgtctcaaaaaaaaaaaaaaagaaaatagaaaactcaaactccactgttagagatcttaagttggactgagccatagaaatcgcccttatgac

SEQ ID NO: 24692 - DNA, 601 bp, Human
cagtagagcttgcctctatgactggagtttggtagtactcgctgccacatagagtaaacttgagaagaatgtttgcacagccaggtcaagtgttacaaatccttctgccctcacttaggcatctatatcataaatctcaagaggacctgggagaagcttctgctggcagctcgtgcaattgttgccattgaaaaccctgctgatgtcagtgttatatcctccaggaatactggccaggtttgtggaacagtggttagtttttatattatagaaataaagcttacagacattgtgagacattgaaagacataagaaaacagaaataactcaggccgggcgcggtggctacgcctgtaatcccagcactttgggaggtggagtccggcgtattacgaggtcaggagatccacaccacggtgaagccccatctctactaaaaatacaaaaaattagttgggcgtgggggcgggtgcctgtagtcccagctactcaggaggccaaggtggagaatggcgtgaacccggtgggcggagcttgcagtgagctgagatgcgccactgtactccagcctgggtgacagagccgagactctgtctcaaaa

SEQ ID NO: 24693 - DNA, 601 bp, Human
cagattataaaagggaaagagtggcagaaagccaggaagtggattcttaagaaccaatgatggaataagtacagggaaagagaaaggaaagatggatttagccaactgaatctaggctgcacactattaaagctcagggtggaggccagtcttggctcatgaacttctgagtgtcggaagtgtgctatatcaatggcaggattttcgctaacaccagtagagcttgcctctatgactggagtttggtagtactcgctgccacatagagtaaacttgagaagaatgtttgcacagccaggtyaagtgttacaaatccttctgccctcacttaggcatctatatcataaatctcaagaggacctgggagaagcttctgctggcagctcgtgcaattgttgccattgaaaaccctgctgatgtcagtgttatatcctccaggaatactggccaggtttgtggaacagtggttagtttttatattatagaaataaagcttacagacattgtgagacatagaaagacataagaaaacagaaataactcaggccgggcgcggtggctacgcctgtaatcccagcactttgggaggtggagtccggcg

SEQ ID NO: 24694 - DNA, 601 bp, Human
tcagttgtctgagttacgggacttgggttgggtcatgaacatgagaaagttcattggctgagtttctaatagctcgcatagtgccttcaacttcataggtacttacacaggctattgaactgaattttgagtggaaagtggggtaagaggtgggaatgaacaatatggtttggaagaaccagaggatggaaggcattaagttggctaaggcacttacttattttagagataaagctaccaaggacttgggagtgacatgctgtaaaggagttttaggatgaatcttgcatcagtgcagatkataaaagggaaagagtggcagaaagccaggaagtggattcttaagaaccaatgatggaataagtacagggaaagagaaaggaaagatggatttagccaactgaatctaggctgcacactattaaagctcagggtggaggccagtcttggctcatgaacttctgagtgtcggaagtgtgctatatcaatggcaggattttcgctaacaccagtagagcttgcctctatgactggagtttggtagtactcgctgccacatagagtaaacttgagaagaatgtttgcacagccaggtcaagtg

SEQ ID NO: 24695 - DNA, 601 bp, Human
cacaatgtccggagcccttgatgtcctgcaaatgaaggaggaggatgtccttaagttccttgcagcaggaacccacttaggtggcaccaatcttgacttccagatggaacagtacatctataaaaggaaaagtgatggttagtcattgctttaattttttgttactccagctgtaagtacaaattttgagcttgctattctcgtggttagttctgggtaatttctttctatcttccttaaatgaagccagacccctacgttgaaaacatactttaaataaatgttcttgttattgagagaraagatttctgctccaggggaggaatatgtcagttgtctgagttacgggacttgggttgggtcatgaacatgagaaagttcattggctgagtttctaatagctcgcatagtgccttcaacttcataggtacttacacaggctattgaactgaattttgagtggaaagtggggtaagaggtgggaatgaacaatatggtttggaagaaccagaggatggaaggcattaagttggctaaggcacttacttattttagagataaagctaccaaggacttgggagtgacatgctgtaaaggagtt

SEQ ID NO: 24696 - DNA, 601 bp, Human
tttccttaattcctatcttgagaagtgttgaatttccattcgctaatttcgtgtagttttattactcggttactctgccgtccacactatttcctcagtaagatgtgcgctgttccgtaatacacgacatgtatgggttaactttctgtttacccttcactacactgtaagctcaatgcctgacactatagcagatggagtttttggttgcttttaagggtgtgccctacttaactcaatggaatgaaaagaaataggttgctctcttatttcagattcccgtcgtaacttaaagggaaaytttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggttagtcattgctttaattttttgttactccagctgtaagtacaaattttgagcttgctattctcgtggttagttctgggtaatttctttctatcttccttaaatgaagccagacccctacgttgaaaacatactttaaataaatgttcttgttattgag

SEQ ID NO: 24697 - DNA, 601 bp, Human
aacttgagttccgcgctctggacaggaattatgcacagggcgtcgctgtggcactagaaaccccaaagtcacaagcgccccagatccgaccaggatgccgctaccggctacagcccagaaggcccgctcctgcggcgcaagcccgccttcctgaagaaaaagcccagtcccggcagcgttcttctccggctccgcccttcttccgctcgactttctttgccattggctgacaacggagtacataaggacgtcatttcctgccgcctgtcttttccgtgctacctgcagaggggtccatacrgcgttgttctgggtgagttccgtgtagcgtccctggcgccttccagggctagaaaaatgagcttttcctgctcaaatgaagggtgagaagactagtgatgaaagccggtcagactggatctgtctcccgcccggcgcgccccaccttaggcctgcggcccgcacgtggccaggctcgggctggcgggttcccagagtgccccgggagcgggtggaggccgccctccagcggaggctccgagctggggttcggaccaggccgcgggtgggcgggagtgcagaaagcgggctaacatcctgt

SEQ ID NO: 24698 - DNA, 601 bp, Human
agagccagcagaggcaagtggcttcttcctgcagggaagctgacacttgaccaagcaggagctgcagcttcaagattttgtttttaaggtaattatgaacctggagaacatacaccactcattctgaggcatttacagaaatgtcaaaccaatagaccaaaacttctcttgtttttaaaaaattaaaatcaaactctcctcagatgttacaggtatatttttgggctgctgtcacctgggcaagcgcagatatgggtggttctagcaggagctccgggatatcttcagctcgcaggacaayagagagttttccgcctgaaaccaaccagagacacgaacagcaggtgagcgagggcaggaggctctgactgtggaaaccactgggggattcatttcctatggacctgaagaaatcatccaaatgactttactctagctgaaagattttagaagacaaggtggcttaaaaaaataatgttcctttagagagtgttttgtgaaaatcaggactatgaaatgcagagcagttggagagttggcaaggagagaactccttcctaaacttctttttttttttttttttttttttgagacggagtct

SEQ ID NO: 24699 - DNA, 601 bp, Human
ggctgaggcaggagaatcgcttgaacccgggaggtggaggctgcagtgagccaagatcacgccactgcaccccagcctgggcaaccgaggaagactccatctcaaaaaaaaaaattaccatcataaccattaaatgtatagttcagtggtgttaagtggacgcttatcgttatggaaccatcacccccattgatgagttgcctttttaaaactcagaatgaaccccagaatctcaattctcggcagatttctacacaagcaagcagaggatctatgtaaatattcaccttaacaagctaamccttgtatcccttctaggaaagactgcctaacatccgatgttctctagggatgcttgcaatggaaatctccccagacacaactcagccggtctctgctgttgatggaagttcagtttatgcagtagccaaagcattaaatgtctaatctgctctctgaaaccttcgctgcattcatcattaatgtggaaaagggctcaaattacctgcaatttactcagcttctgccgcagacttgcctcattttggcattcataagacaaatcaagagagaggaaatcgaccgtgtcctgaaaatagta

SEQ ID NO: 24700 - DNA, 601 bp, Human
gtttgagaccaacgtgaccaacatggtgaaaccttgcctctaccaaaaatacaaaaattagccaggcgtgtttgtgtgttcctgtcatctcagctactggagaggctgaggcaggagaatcgcttgaacccgggaggtggaggctgcagtgagccaagatcacgccactgcaccccagcctgggcaaccgaggaagactccatctcaaaaaaaaaaattaccatcataaccattaaatgtatagttcagtggtgttaagtggacgcttatcgttatggaaccatcacccccattgatgagytgcctttttaaaactcagaatgaaccccagaatctcaattctcggcagatttctacacaagcaagcagaggatctatgtaaatattcaccttaacaagctaaaccttgtatcccttctaggaaagactgcctaacatccgatgttctctagggatgcttgcaatggaaatctccccagacacaactcagccggtctctgctgttgatggaagttcagtttatgcagtagccaaagcattaaatgtctaatctgctctctgaaaccttcgctgcattcatcattaatgtggaaaagggctc

SEQ ID NO: 24701 - DNA, 601 bp, Human
gacaaaaggcagctttagtcatcacaggcacaagcagacctcgaagaccctagagtgttacgtaaggcccagaaaccttgtcagccagcccgcaagcacaggccctgggcagcaagcaagtttaggttcaggtgaggcattcacaaaaacaactgaaactgatcatatgtgatttaaaaaataccaccctcattatcatgttccaaacccttggacttctttttctttttctttatttttttttgagacaagtctctctctgtcccctgggctggagtgcagtggcgccatctcggctcaytgcaacctccacctcccgggttcaagcgattgttgtgcctcagcctcccaaggagctgggattacaggttcgtgccactatacttggttaatttttgtatttttagtagagacggggtttcgccatgttgggcaggctggtcttgaactcctggcctcaagtgatccgcctgcctcaacctcccaaagtgctgggattacagatgtgagacttatttttcttttgaaaagacagtgtggtgtcttagaatgagaaagccctagttcaaatcccaaccctggagctcaccaccttggttaa

SEQ ID NO: 24702 - DNA, 601 bp, Human
aggccgagcgggttgcccatgactgcgcagttagtggagctgtgactccacacagtcctcatccctccctgtgctgggtcaatgcagtggggacaaatgacccagggtggcgtgcttagggaagcaagggttttctccttcctgaaagacggatatgccatgaggcagccggtgatgtcccagggctggagagctagaggagcctcggaggcccccagcctgtcttctgccaagcggagaactccctgggagcacagctttttctgataagtggatgggggacctcctcgtgtgcctcctrcagaaccgagaaccctggagtgtgccgcagctcttcatttctgggcttgaggctgttctcaggccctcagacagctgtgtgccgttggggagtggccgctgagggcccctgaggctcagagagggctgtgcaggtgctccggggagagggtgggaatgggggcaggtgcctgctcctccctgccctgctttcgccctcttccctcgcagcccacaggaagaggccccttcaaggggagggtggggttccaggacagggagggaggggacactgggaaggtgggcagcacgattcaggctc

SEQ ID NO: 24703 - DNA, 601 bp, Human
actgttctctgtattagattgcccttgaatattgtcttcagtgttagtaccatactttattcttcttataattcattatttgtaaaacatagctaataataacaatgactccaatttattgagccttgattctgcgctggccactgtaataagaatggatgtgtattatctcatttaattttcccaacaaatttatgagatgggtactacaatgatttatcctcatcctacacaggaggaaactgagactaaaagaaacgggggctgggtgtggtggctcatgcctgtaatcccagcactytgggaggccgaggcaggtggatcacgaggtcagaagttcgagaccagactgaccaacatggggaaaccccgtctctactaaaaatacaaaattagccaggcgtggtggtgggggcctgtaatcccagctactcaggaggctgaagcaggagaatcacttgaacccgggaggcagaggttgtggtgagctgagatcacgccattgcactccagcctgggcaacaagagtgaaactccgtctaaaaaaagaaaaagaaatggaaaacttcctgatttcagggagccagcagctatttatcag

SEQ ID NO: 24704 - DNA, 601 bp, Human
tggtcaggctgaagggccaggctgccagtcagagaacaagacatgctgcaggattgaagggacaaaaagggacataataatgaatgacgctggcagttacaaatgccccctacggatgactactgtgtttaatcagaaaagattccagaaacactgagtcaaaagtcatatctgcaaagccatgggcaggaagtaactggcagatgggaaaattattattattaccccttctgaggtgagtgattcttgctctttcatggttaaaacaggaacaatgctactgttctctgtattagattgmccttgaatattgtcttcagtgttagtaccatactttattcttcttataattcattatttgtaaaacatagctaataataacaatgactccaatttattgagccttgattctgcgctggccactgtaataagaatggatgtgtattatctcatttaattttcccaacaaatttatgagatgggtactacaatgatttatcctcatcctacacaggaggaaactgagactaaaagaaacgggggctgggtgtggtggctcatgcctgtaatcccagcactctgggaggccgaggcaggtgga

SEQ ID NO: 24705 - DNA, 601 bp, Human
atttattcatgatgttccagctcaccctagtaatggtctttttgaagagttctgtaattttgctacgtgtgttagtgtcatcttccccaaaaggttataacatgtccagggcatggctgtgacccctctttaacacctagcacgggacacaggaaatagtattattattattattattatttttgagatgaaagtctcgctttgtcacccaggctgcccaggctggagtgcagtggcataatctcggctcactacaacctccgcctcccaggatgaagtgattctcttgcctcagcctccyaagtagatgggattacaggcgcccaccaacatatctggctaatttttgtattttagtagagacaggatttcaccatgttggccaggctggtcttgaactcctgacctcccaggtgatctgcctgccttggcctcccaaagtgctgggattacaggcgtgagccaccatgcccggccggaaatactcatctttaagaatggaacccaaacagtgacagggaaaaggcagactaacatgtccatcctgaagaacgctgccaaagaaagctggtgggttttctgggagattccgaagaaaaag

SEQ ID NO: 24706 - DNA, 601 bp, Human
tggtgccgaaatcatggctcactgcaaccttgacctcctggactcaagctcccaccttagcctcctgagcagctgggactataggtgtgtgtcaccatgccctaataatttttttttcttcacagacaaggtctttctatgttgcccaggctagtctcaaactcctagcctcaagaaatcctcctgcctcagacttccaaagtgctgggattatagacatgagccaccacaccctaaatctttgattcacaatctgtttccattaggctggaaggaaagatggacaagagtaagaacaagygcccagaggaaaaacagacctgaacatatctcctggctgcctccacatcctcctggttagagggatctctgggttcagcccagtcactgctgatggtgatggaaatcacgccaccttgactggcgcggtacacatcgttgtacagatgccaggcctcagcatgagcctttattagattgtggccaacaatgtagggggcagtgccaggcctattggagactcctggaaacatacacatggatgtcaacagagaatggatagaatggatgtgactgagattgttagtccctgcctgcagat

SEQ ID NO: 24707 - DNA, 601 bp, Human
gtgggagctggattttttttttttttttttttttgagacaaagagtcttgctccatcgtccaggctggagtgcagtggcatgatctcggctcactgcaacctctgcctcccgagctcaagcaattctctggcctcagcctcccaagtagctgggattacaggcccccgccaccgcacccagctaatttttgtatttttagtagagacagggtttcgccatgttggccagcctggtcttgaactcatgacttcaagtgatccgcccaccttggcctcccaaagtgctgggattacaggcgtsagccaccgcacccggcctgggagctggatttttaatcctcagctggactatatgggggcgtctaggggcaggactcaaagactatgttgagaattcacacttgattcccgccagccttggagcggtgggcatgttcccgtgggcagtgactgccgcttcctgcgcttcctcacaccacacctctcaccccacctgcatgattctcaagcccccagcatgcgccctgggggccgacagcttggctgcaaatctcagctctatctcttaatagctgggtgatcttgccctaatctttgcgcc

SEQ ID NO: 24708 - DNA, 601 bp, Human
cgccctgtcctcctgaggacactgcacgccccctgaggctggagtgcagtggtgcaatcatagctcactgcaacctcagtctcctgggctcaagcaatcctctcacctcagcctcccaagtagttgggaatataggtgtgcgtcaccatgcctagataatttttaaattttttgtaaagacaaagtctcattatattgcccaggctggtcttgaactcctggtctcaagcaatcctcctgcctcagcctcccaaagtgctgagattacttgtgagcctgggaactttggcttcttaacctrtagatggagcattttccaggcactctgagtgaaaagcctctcctgtagaacctgactaatacacttgtgtgcagcatgtacaggtgatcctgaatgcatgcgcatgcccacagggagacctggggcttctggtttaggtgtggcccagagatgccctgctgaggcctctgacactttcatcttgacctttctgctaccattaacctgagggatcaagaaccttccttccctggggtttctgagatgatgggagaaaaccaaagcacagcctcctcctgtccctgacgcttctgctcagaa

SEQ ID NO: 24709 - DNA, 601 bp, Human
ccctgtccccagcttgagcccagggaagccattcctgactttatcctacaggggtccttgtagaaggaagccagtggaattagggaggggcaggattaaggaagcttctagctcaacttattaatttcaactagaagcatgaattttcctgagcagaatcttgggggcaaacaagaagtgcagataaaagcacagaagccacagccaacagtgtgggcaggtggggaggggcaaggcctgaaagccctgtttgctttctcagagagaaggcttgtggcctggggtgagatctctgccctgygcactgttggcagggcacagcaggagtgagactggccttgctggctgcatgggagctaggtgaggcttgtgactgccagctttcccaacttccctagcaacctgtatgacacagcagaggaagccataatacccctgggaacagaactccactggcctgagaaccagccccctattcccccacagtggccacagcaagcctcacccgaggagagtctgagctcagatatgcctaatgctgccccaacctgatggtctttctctacctttgctggtagctgaagacaaaagacataaactc

SEQ ID NO: 24710 - DNA, 601 bp, Human
tttgactattgattttatttaaagacattttactcttcattaatacctatcctgtgaagagaacctacagaatatggccattaagcctcttctttaaaatacttttaaaaggtgggtttcaaaagttttatgccttggagccaagctccaaatcaacaccttgatcaagatataatcccatcactttggcaactaatatttatccttgggaattgaggcaaatatcagacagtgtagtaatttattcactttttcctccttcggtgagtattaagggagccatccctttgtcttaatccayaccagtctctgtattagtatctgtatcagaatttgattttgatcaaaatcagaatcaaatatttatatcaactttttattatctagttttgttctagttaagtcccagacccagactcagactgaaaggctttgtaatgtcttctcaacccactattatgtttccctcattaaagaaccggaacattccatttaaattacttaaaacatcctcaggaccatgtgtcattcctatttcatttttaatagccaaatacacaagtctttgttgtgatcatgctattaatgactttttaatctt

SEQ ID NO: 24711 - DNA, 601 bp, Human
acctctcttacctcttccagatattcgaacaccattattgatagcattcttgttttgataaggtttctcctggcccacaatcattccagtgaatggtgcgtacacagtagatccagcagagcacaagatgtccacaccctggtgaggcctctgacttctaggatgtaaataagaacgaacagactgaggaactgccttaggggagctttactgcctgggaacatggtgttagcccactgtttgcagacgaggtaccaaagcttgaagctgccagaacatgttgggatgtcccaggatgcckcactctgtttagcccaattttaacctccctccccgcaggtgctaataaccatatcataaagatgaaagcatttaaaatggtacttggtacataataagccttaagcaaatattagctactattattttatggcatgttgggggaatgaggcagtccatgtaagtgcattttctagatacctagatcttgacatcttcaagcccactttgaaaacagctgtctttttatgggaacctatcataaaagtatcacatgttaccctagtcttatttttcttgcagtgatctagaaaagtgattg

SEQ ID NO: 24712 - DNA, 601 bp, Human
aagtccatctgaggaagaatagataaatagatgaaagtatacgcatataatggaatatcatgcatcagaaagaacgtggatacaaaaacataaactgcataatcacgatgtggaatgaaagaagacccaaagagtgcatgctgtttaattctatttataccatttttagaaacaggaagaactaatacatggtgttagaacttgagatagtgattatcttgctgggaataatgactaagtggtagcacaagggatctctgggatgtgggtgatgttctttttcttgatttgggtgctgatyacacaggtgtgttcactttttgaaattcacggagctatacatggatgtgttgtgcacttttatgtgtgtatttataccttgatggagtaaccaaacaacaaaaccaatacctggagtaccaggagatctagctttacctaaaacttagaagctttcaaaaatatttcacattcaactcttgcagaagtgccagcatttatgatttgtgggatttgagtaaatgcaagtatctatccattatggttagcattgctgaaagtggctttgtttatagattgttaagcaaaaccacatgggcca

SEQ ID NO: 24713 - DNA, 601 bp, Human
gaaactgcccaaaagtccatctgaggaagaatagataaatagatgaaagtatacgcatataatggaatatcatgcatcagaaagaacgtggatacaaaaacataaactgcataatcacgatgtggaatgaaagaagacccaaagagtgcatgctgtttaattctatttataccatttttagaaacaggaagaactaatacatggtgttagaacttgagatagtgattatcttgctgggaataatgactaagtggtagcacaagggatctctgggatgtgggtgatgttctttttcttgatytgggtgctgattacacaggtgtgttcactttttgaaattcacggagctatacatggatgtgttgtgcacttttatgtgtgtatttataccttgatggagtaaccaaacaacaaaaccaatacctggagtaccaggagatctagctttacctaaaacttagaagctttcaaaaatatttcacattcaactcttgcagaagtgccagcatttatgatttgtgggatttgagtaaatgcaagtatctatccattatggttagcattgctgaaagtggctttgtttatagattgttaagcaaaa

SEQ ID NO: 24714 - DNA, 601 bp, Human
agtgtcacaaatctctgagatttagacgaatctgattactgcttctgctctcactgaccttggcattaactgttaagtgccactacagaggacacagttcaatggcagaagtttcccttgtgacattggcctacagaggacaaccactatgtagctcctcaaggatgtgggttcgctcaaaagatgcctctcacaggcttggtgaggagggtctcctctggactcactcccaataggaatgcatatatatgttcattaaaaggtataaggaagttcgtagcagcaattttataatcatctwaaactggaaactgcccaaaagtccatctgaggaagaatagataaatagatgaaagtatacgcatataatggaatatcatgcatcagaaagaacgtggatacaaaaacataaactgcataatcacgatgtggaatgaaagaagacccaaagagtgcatgctgtttaattctatttataccatttttagaaacaggaagaactaatacatggtgttagaacttgagatagtgattatcttgctgggaataatgactaagtggtagcacaagggatctctgggatgtgggtgatgttcttttt

SEQ ID NO: 24715 - DNA, 601 bp, Human
gcagggactacaggcgcccgccaccacatctggctaattttttgtattttttagtagagacggggtttcaccgtgttagccaggatggtctcgatctcctgacctcgtgatccatccacctcggcctcccaaagtgctgggattacaggcacgagccaccgtgcccagccgaaaatttaaaattatatatatgacttctgttatatttctattggatagttctgctgtagaagagctaaaactccatcaggtaggttttacgaataaatattaaacaaaagatgtgcaagacctctacackgaaaactacaacaaccattaatataacagtgaaggaagacctaagtaagtggaggacataatatgttcattgattggaggactcactactttaaaaatattagttctcaatttgatctgtatatttactgcagattcagtcaaagccccagcaggatttttggtggaaattagcaaacagattctgtaatttatttggaaatgcaaataaccaagaattgccaaggcagtctgaaagaagaagaaagtcaattccaattatgcattctggaactggggaaataacctcttggtagattgg

SEQ ID NO: 24716 - DNA, 601 bp, Human
agcataaaaataaggctgtaaaattatgctgtccaatatggtagccactagccacatgtggttatgcagcacttgaaaggtagttaatatgaattgagatgtgctttaatggtaaaatacacagtggattttgaagacttagtatttaaaaatgtaaaatatctcaataatttttgtattacatattgatataatactttgaaaatattgagttaaataaaatactaaaataccatgtttttttacttcaacatggctactagaaaatttaaaataataataataataattattattattwtttttttgagacggagtcttgctgtgtcacccaggctggagtgcagtggcgcgatctcggctcactgcaggctccgcctcccgggttcacgccattctcctgcctcagcctcctgagtagcagggactacaggcgcccgccaccacatctggctaattttttgtattttttagtagagacggggtttcaccgtgttagccaggatggtctcgatctcctgacctcgtgatccatccacctcggcctcccaaagtgctgggattacaggcacgagccaccgtgcccagccgaaaatttaaa

SEQ ID NO: 24717 - DNA, 601 bp, Human
ggtcaagtgagcataaaaataaggctgtaaaattatgctgtccaatatggtagccactagccacatgtggttatgcagcacttgaaaggtagttaatatgaattgagatgtgctttaatggtaaaatacacagtggattttgaagacttagtatttaaaaatgtaaaatatctcaataatttttgtattacatattgatataatactttgaaaatattgagttaaataaaatactaaaataccatgtttttttacttcaacatggctactagaaaatttaaaataataataataataattattattattatttttttgagacggagtcttgctgtgtcacccaggctggagtgcagtggcgcgatctcggctcactgcaggctccgcctcccgggttcacgccattctcctgcctcagcctcctgagtagcagggactacaggcgcccgccaccacatctggctaattttttgtattttttagtagagacggggtttcaccgtgttagccaggatggtctcgatctcctgacctcgtgatccatccacctcggcctcccaaagtgctgggattacaggcacgagccaccgtgcccagccga

SEQ ID NO: 24718 - DNA, 601 bp, Human
ccggtcaagtgagcataaaaataaggctgtaaaattatgctgtccaatatggtagccactagccacatgtggttatgcagcacttgaaaggtagttaatatgaattgagatgtgctttaatggtaaaatacacagtggattttgaagacttagtatttaaaaatgtaaaatatctcaataatttttgtattacatattgatataatactttgaaaatattgagttaaataaaatactaaaataccatgtttttttacttcaacatggctactagaaaatttaaaataataataataataaatattattattatttttttgagacggagtcttgctgtgtcacccaggctggagtgcagtggcgcgatctcggctcactgcaggctccgcctcccgggttcacgccattctcctgcctcagcctcctgagtagcagggactacaggcgcccgccaccacatctggctaattttttgtattttttagtagagacggggtttcaccgtgttagccaggatggtctcgatctcctgacctcgtgatccatccacctcggcctcccaaagtgctgggattacaggcacgagccaccgtgcccagcc

SEQ ID NO: 24719 - DNA, 601 bp, Human
aaccggtcaagtgagcataaaaataaggctgtaaaattatgctgtccaatatggtagccactagccacatgtggttatgcagcacttgaaaggtagttaatatgaattgagatgtgctttaatggtaaaatacacagtggattttgaagacttagtatttaaaaatgtaaaatatctcaataatttttgtattacatattgatataatactttgaaaatattgagttaaataaaatactaaaataccatgtttttttacttcaacatggctactagaaaatttaaaataataataataatwattattattattatttttttgagacggagtcttgctgtgtcacccaggctggagtgcagtggcgcgatctcggctcactgcaggctccgcctcccgggttcacgccattctcctgcctcagcctcctgagtagcagggactacaggcgcccgccaccacatctggctaattttttgtattttttagtagagacggggtttcaccgtgttagccaggatggtctcgatctcctgacctcgtgatccatccacctcggcctcccaaagtgctgggattacaggcacgagccaccgtgcccag

SEQ ID NO: 24720 - DNA, 601 bp, Human
gccaggaaacatagatagaaacccaccaataataggagactttgatacactagtggcactgcaaaccggtcaagtgagcataaaaataaggctgtaaaattatgctgtccaatatggtagccactagccacatgtggttatgcagcacttgaaaggtagttaatatgaattgagatgtgctttaatggtaaaatacacagtggattttgaagacttagtatttaaaaatgtaaaatatctcaataatttttgtattacatattgatataatactttgaaaatattgagttaaataaaataytaaaataccatgtttttttacttcaacatggctactagaaaatttaaaataataataataataattattattattatttttttgagacggagtcttgctgtgtcacccaggctggagtgcagtggcgcgatctcggctcactgcaggctccgcctcccgggttcacgccattctcctgcctcagcctcctgagtagcagggactacaggcgcccgccaccacatctggctaattttttgtattttttagtagagacggggtttcaccgtgttagccaggatggtctcgatctcctgacct

SEQ ID NO: 24721 - DNA, 601 bp, Human
tttttcttattttcaagcagaaaggttgctagttttagaggtgtcaaaaatgcagcctggcccagcgtaagttctcttgtttatttatcttagatcttcgggactgagaaatctaaaaaataaaaccactcagattccataggtgacagatcaaagagcccgaagcaaccagttcacatgaacatcagagtgacaatgagttaaaatcaaaatgttttctttcttgcatttatcatgtttctatttaaactcaaatttcctttttttaattaaaaaatttttgtgggtacataggtgtatwtgtttatgaggtacgtgagatgttttgatacaggcatgcaatgtgtaataatcatgtcatggaaaatggggtatccatcccttcatgcatttttcctttgtgaacacaaatttcttgaagagaagggtatgcatccaggtttttaagatgactttttattttgaagatctgaccattggccttcgatttacaggtatgcagtagggtcactcgagtcacagttttcaatgtgcacatgcgattgtatgccaggataaactttctgcaagggcaatagagttccaagtttttctcccttct

SEQ ID NO: 24722 - DNA, 601 bp, Human
ctaaggggacagaagggaaaactcggtgtctagccctagctggggcaccacacacaagtacttccatccctgcactcacaatgttccgggacgcccctccatgcccagcacccacagcccactgcctctcaaccgcatctccctggtgcctcacgcccatttcccctccatccctcgctccctgcagcaggacaatcacaagataagaagtgccaggtccccacctttgcactcagttctccccttgctaactgggcaccctggggaagcttccctggggaagcttgggcaggaagtggcrggagtctgggggtggtttaatcaagccctctccccattctctccttccagccccaaaaggtcccctcaacccagatcaggacagcccctaatgatatttacaagccccctccctgccatctcctgtcagtatcccaggggtaacttacatagagaataaagagggcattggcactgccattgagctgtgccagttggctcctgatctggttcatgaggttgttgtgacatgggtggcgtatggcacaggtggcgttgacaggggtgatggggagggggctccccgccccatgtttccagt

SEQ ID NO: 24723 - DNA, 601 bp, Human
tcagaacctctgcacctgacttagcaacctgcccctgccctacccacctccacaaacccctgctgcaggtccagccatcagaccctggccatcccaggctgcagggaagatcacggggaagagaacgaagaacctaccaaagctttccaggcctctcctcctcccagtgtcttccttcccaggcctgaaggtggcttctctgcctccccaagagcctgaatgccaagtgacctccttctggaaacttctgccagattgttcctatgcccaagttctctgatcatcctcaaaagaagacagmcttccatcccagaggcccctctctatcttccactcatcaaacttctaggggacaaggagtcctttgggatcctagcccctctggcccacctaagtcccaacctaaggggcagcaaaggcacagatggtgataatttgctgggggctggtccactcccctgggccctgctgtctcaccctgtggtcagggctcttgtagatgacttgtgtagtttgttcactgcacaaagtgagcaaggggccaaagggacaagtagaggcagaagtccagcccacgctccccagtccacaatctcccaga

SEQ ID NO: 24724 - DNA, 601 bp, Human
tgtccgggccacaggaggagcttccctgctgtgtcggagcatgctgggtgcaggggcagggttgttccagggcgctatttcagaggcagcatggggacacagaaacaaggacagggtgggccacaaggactgtcttgcccactgctccagggggcacaatatctgccaggaacagtgcgcctcacaacacaatgctggggcgcccaagaacagtgtgaaccagccccctggaagcaagacagaaaggcacccggcctctccacaaattggcccagcccctgcagcctggaccctgacacgmtaaagcaagtcacagtaggggatgggggtggagcaaggccccccactcccactcaggcctccccattctctcagatccgacccttctctgagcttcacccgtaaggcttattccacttgtaacattgtcgacttccagaccaggccctgctaagccctggccctggcgcttgtgtcgggagccatcatcatattttgttgagtagggaccagggaaaggggaattaacttggccactgaaagcaccaataagttaatataaataggatatcataataaatagaaatcatgccaggtcaga

SEQ ID NO: 24725 - DNA, 601 bp, Human
ttgaaagtaacaattcagaagattacaatcctactagtacttactcacatctataaaataacattacaccatggaatatgtaagcactatgcaatgaaaaaagtcaccccgaaaagaaaatgagtaaaaagaaggggggtataagagagagggaaagagggaagaaaggagggaaacaaggggaaaaggcaactatagaataaaaaaggtagtccatctcagattctataaatgtttatgaaaaatgtttttgtttttgtacatggttggtacgatattcactgtagcaataaattatacrgctatttatatgacagaaaaacaaatattacattaaaagtactcacattataaagcagcactaatcataataataaagtaatttaatgaatgaccttggagaaaagagatctatttaaatatggaaataatataaaaactaaaccaacgggcaggaggatgataatttctttatataaataagctataaaatatctacataaacattcttaatatatttaagatgtaacataatacatttaaaaatatttggatttcattgatatgacattctaaaaaggtaacattatagagacagaaa

SEQ ID NO: 24726 - DNA, 601 bp, Human
tactgtcatttttcagtagcttcccagataagactacaccctagagcaaggggcatctgagaaattctggaaggtacgcaggagtcaagggggctaaagaaagagtatggaactgagggaaggagcctgaattctgggctattttgactggccagaagaaaagtttgcttccttctgatcttggctaccatctacaattcatagggaggttgctgagtgaattaaaagtaatagcataacacatgaaattcaaaaaactagaaagcaccacaatactaacaagtgacacttgacttacttkaaaattgagtttgttttcaaatacttacaaacgttttgttcatttagtgtgaatttacttgtagaacttccaaaatcatgtagagaatttattgttatttcataatcaccatgtgaaagagctggaattttaatactggttttctccaactgataacaagaacgggacctgtaataagaaattgaattttaattagcaaataaaattaatagtataattttcataaaaatttggttaacacaaaatacaatggaaaatactttatgccctctttgttgcaaaaacatgataggttgtacc

SEQ ID NO: 24727 - DNA, 601 bp, Human
acaatgttaacttgctttctagaaactcagatagggaagaaatttaatgaaaatcttttttattttcttctaatgctaattcagctttacccataatctacgtgctcctgcttccttaggacataagaagataagagtattcccagcttttttttacaggacccacattctgcttcagaatgacccaaattttcaggtgattttaagaaatgcagaaattaaaaatcttatgaagaatttttcatgcttacacatggtaagtacaaactttactgtgtgtgtgtgtgtgtgtgtgtgtgtrtatatatatatataaaatcttgtttgctttatataatttagaaagcatctttagatccacagacacttaattttcatacttttatttagtagcaaattgtcaagagatccagatcctctaaaggacagctatacatgcattgcagagcttctcttgcacacagtaggtgctcaaagatttgctgatgtatccatctcctccgttccttacactcacctaatttgcttttcaattttcttatcccaatactgttattctaatcatgatcaggaccattattatttataatgctaccaatac

SEQ ID NO: 24728 - DNA, 601 bp, Human
aggagaccactggagcaatcctggctagagtgacaaggatataaactaagatgccatctatggaaaagatgtcatggatatttcaaagaaatgactacatcaaagaaataaacggttggttctaatgaaaaagggaaacaaccaatattctctcaagtttctagctcagaaagcagcaagaggagcaaaaggaatcgggaatcactgtgaagagacacagaagcctggctatggatgagtaagggtcaggggaagaagacaccatggagtcagaacgtggatgcagacttaaaaggaactsattgagtgtagtggtagaaaagagcatgaacacaaagacataaaccagccaaagctccttttaggggctgccaatagacaattacatcttcaaggagccaaaaacaccaacatgaatccagagagggaatcctagaagcagaaggaaaccagagaaaatccaggatcatcgaaataaaaacaaatagttgttacctgtgccaaataaaacagtttatagaggaagactgtggaaaaaccactggcgaggctactgttaatatctgagaaagaagtttaggagaacagtgggctctgaagc

SEQ ID NO: 24729 - DNA, 601 bp, Human
taatggtccaaagataaggtgtgttccacaggttttgtaggagcaagatatatacgataaattttttaaaagtgtatgtggttttatttacttatgaagggataatggtgaggaagcagaagcagattacaggtcagtgtctaaagttaatgccacaggtttatgtctaagaagtctaagggttgaaattcagtgggtttatatatacatgtgaacaatccacaccccccaaaaatcactaattaaataattccattccttttattcaatgtatttagggcatatgtcttactttccatcrgcctaaatatatgcccaagtactccacaccctaaaaaacaacttactttaatctagtccccttccttcctctaatccttttatccatagagtgatctatctctacaatgactaccagcctttcaggatttcattttatggtcaacaattttccaggccccctattcgaaactgccaacattctccctgtatatgagttttacttaatgtacggatgctttttggtatgcttgcagatccccgtgttcctggcaataactatgcagcctctaggggtctgctctgtgagccagaaattggg

SEQ ID NO: 24730 - DNA, 601 bp, Human
ctgataacactttttcttgactcacacaacaaaatgttatgtctgagcctacaagtatcactttatcttgaggaaaaaccttagtctgagaatcaggtatccctagaaagaaaaagaggaattataaacattttatatagaagtattttacataaacttttctgcattttaagactttcttttcataagatgacttttaaaatagcccagtatatacactacaaactgttaggtgctttgtaatgataatggtccaaagataaggtgtgttccacaggttttgtaggagcaagatatatatgataaattttttaaaagtgtatgtggttttatttacttatgaagggataatggtgaggaagcagaagcagattacaggtcagtgtctaaagttaatgccacaggtttatgtctaagaagtctaagggttgaaattcagtgggtttatatatacatgtgaacaatccacaccccccaaaaatcactaattaaataattccattccttttattcaatgtatttagggcatatgtcttactttccatcggcctaaatatatgcccaagtactccacaccctaaaaaacaacttactttaatct

SEQ ID NO: 24731 - DNA, 601 bp, Human
actttaaaaaaggtatactttaactggaaaatgaattcacataatttctaaacaatgcagggttaagaaatattatatcctatccttaacaaagctgttaactaagaatttaaactaaacattagaagctagatgtttcaaatctgattacaaaaccaacaaattacacagatacaggttatgtggaaaacaagcttgcaattcattttaaaacaagcaaatattctagtgcctttgtatagcctttatattaaagaacaaagaaatgagaaagaaacagaatcactcctcccacccccccactccagaagaattaaggctttcaaggaagaccaaaacaggttaataggaattctctctttaaaatcatatacttacatccagcaaaaataacggttccaaatatgttatcttcggttgtaaaaactacatttgttccactacttgcagaaacagaaatattacgaatcttgattgcaacattttccccatcaagatggatcaaggggcagtttgtatggccaatcagtgctgataacactttttcttgactcacacaacaaaatgttatgtctgagcctacaagtatcactttatcttg

SEQ ID NO: 24732 - DNA, 601 bp, Human
gactgtatgtacaggggatgctggaagggcaacatgagcaagttcctttgtagtgacagggcagttctgtatcttgcatgtggtggtggttacctgaatctatacctataaattgcatagaactacacacacacacacacacacacacacacacacacacacacacacgagtacaaatgaatgcacataaaaactgagcaaggtcagtagtctagttaacagtgttttaagagtgtcaattccctggttctgatattgtactagaattatataagatgacaccactgggaatagccagggcatgggttcacaaggctcttattattgtaactaccagtgagtcaacaattacttcaaaataaaagtttttaaaaattgggcagaagatatttcagaaatcaaaaattatcagaaagagtaaattactaattcaagtatttaaattcaataaaatagtaaaacttgaaattatacatttaaagtttttataaataaaatttatgaaattaatattaagtaactataaagaaaataatcagcaaaaagtaatccctataagcatttttcattaaagcatttcaccacttttaaagttattttt

SEQ ID NO: 24733 - DNA, 601 bp, Human
atcaatttgcttaattctttttgagaactattttatccaaaataatcacaaaggaagtctttaagagaatcttacctgctcttgtactgaattagatttcttaatttcaatttcacataaaaaattaatctttgcaaagttgcctggtaaatgccaagaaagtttaacagctgttgaattaatatccttcactttgaatgaagtaggagtatggggataaactgcaaatataatttttaaagattaaacacttatttaaagggaaaaactatcttctaatatgacaaatgagaagaaaacwtaaaaaacaacgaggcatcattagtgctgaccaacaacatcctacccagtatttgtggaattgacaaacctaatttctactactgacatcttgccaacatttttaaacaatcgatcatgctcaaagctcttaaattagtgtcaggaatactcaaaggtagttaagatcacagtatctacctttaaggaacttctaatttacttagggaatgaccaaaaaaaaaaaaaaaaaaagaaaagaaaaaagaaagaaaggtaattaataagaatataaatgccaagttctaaatgaatgatacag

SEQ ID NO: 24734 - DNA, 601 bp, Human
aggttatattttacagttgtgactgattttctagacatcagtaaatttccaaatgaatagttaagtacacctcatttatttcagacttaccacaaattacaagatagtataatataaaagtcaacctaaatatttaaaatgtattaaaaagtcatgttgtgacttttaagtaccaattacagcttgttcccactgccacacttcacagttttaaaaaatcacttctgctgtctagtgccaattcatccattaatgatgctaaaagttacagcaaaaactactcattcattcacaaatttayggagcaccagctatgtgccaggtactatagtgcatctgggaacattctgaggagtaaaagtcatatttacaattgtttttcaaatgatacaatgctgttattacatggatagtaatgtctttcttggttcttagtaaatctctataataaataatctgagagcttaagcatatcaatttgcttaattctttttgagaactattttatccaaaataatcacaaaggaagtctttaagagaatcttacctgctcttgtactgaattagatttcttaatttcaatttcacataaaaaattaat

SEQ ID NO: 24735 - DNA, 601 bp, Human
aaatctaatatagaaaacaattgttcatgtttttgatattcataaaatacttaaaaatatggcaacaaaaaatgttccagcagagaaaaattagtaaaatatgcaattcatatttcatctaaatactttacaaaatcatacaaaactttataactggcatgttataatgcaatttattgaagggaaataaattacacatgaagtatataaaaatttactttcctattaatagaaaaaaatataacaaacacttaggattctaacctacagattttgactgaagtgagggagatggaattcrtgaaatcttcaggtcctttacaggccttataagatcaaactcgagaaggctcagatctgacacaggagatcctcaaatgactgtggggagttaggagtgacgaggaatttggggggtttaggaaccaggttagattctcaccaatattgcaacaaaagccagtctgggaagtttcagctccttgataacccaagtaccatgcgtaagttaagcagtttagcaaagtaatgtaaatgttcacagaaaaattagatatttaccttccaatagattattaaattttttccatcagaactccac

SEQ ID NO: 24736 - DNA, 601 bp, Human
ctcaccatttggaatttccatactcgctattttggaaggtggtgatgagcccacagaatttttagccactacgctgatgatgtagtcattcttatcaagtcgtatctctgctttgtgctgaggatcagggatttcagaaagggactgtgtttcctcatctgatgaacacgatacattgtaggaaagtatttttccattagcttcattaatgggtaaaggctatgaaaaacagacaaattgttataaaaccctgcaaaacgtgactgtgactaggcaaggtaattgggtttaaactggacaytatattaacaataacaaggttggccaggcgtggtgactcacgcttataattccagcacttaggccgaggcaggtggatcacttgaagtcaggagttcgagaccagcctggccaacatggtgaaacccagtctctcccaaaaatactaaaattaaccaggtgtggtggtgagcgcctgtaatcccagctacttgggaggctgaggcaggacaatcacttgaagccaggaggtgaaggttgcagtgagccaagatcatgccactgtactccagtctgagcaacagagcgagactccatctca

SEQ ID NO: 24737 - DNA, 601 bp, Human
ttttctaaggcctatattgaagatctaatttataccttaagaagactttttttaatcaataaagaatttctattaataaggaatttcttatcaaaaaaggtgctaattaaaataagcgttttttttttttcctgcccaacaatttgcaaaacagcctagctgacctaaaataaactttcctagtcttggggaagtgtcttggagaagcgtctgaatatcatttgaataaactcttaaaatatttcttcctaaaagtactatccaccactgtaactctccaatattatccactatagttacygagtacagtaatgattgtatccatcagtgcacatgcttcaagtcaatactaatgacttctttctcaatgaactgtagacatcaatctgctcattctgccttctaggtcagcagcaacaaggtatacgagaagaaggctgacatgacaaaagagcaagtaacatcagacatttctcactttagtttcccgttcttatatactaaatcatctcaagcactcaccatttggaatttccatactcgctattttggaaggtggtgatgagcccacagaatttttagccactacgctgatgatgta

SEQ ID NO: 24738 - DNA, 601 bp, Human
gacagtggacagtctgaagccctcctctcatcactcactatgaatgcgtgcagagaacaagcggggcccagtacaatgtgcagagtaggcacacaacaaacttgtggaaacagcagaagaactagccccctctttctttcaacgaagactgcagcccaagagctgggctgaaggggttgtctggctgaccaggggtagggtgggggcaagggagaaagctgtggagacacccagaggcgatgaggtgggatggccagtgtggacactgagaaggagaagtctgcacagcgtcctaggagayaccaaggggcaaggggcaaggggcaaggggcaaaggctgagggcagaagacaggcgcagaggccctggcaaggttttgtttccctgtcttgccagatcttggcctaggtaagaagtggaaccccaggctgggggtgaagaattggggtagaagatagggcagtgtggtcaaaagggagaagaaaatttcccaccgtaacaggagaaaagaggtagattttataactgatttgtatttaagggttcagtaaaaacaaacatagaaaggtttctaagaataaatttttagacgagtaattgt

SEQ ID NO: 24739 - DNA, 601 bp, Human
caggctgcatcccatagagggacactcaccggcagctcacaagctcctgagcatcaggctcatggaacgcaaggcctcccacccacactgcgctcagtccagccgatgcccccttgccctgcatcagggttaagtggtaaggggttcacggtctttgtgctcagtctctccctaaccttggtaacctggaccctgggcaaacaaggcaaaggcccttgtgtgagaccaggctacagttccgtagtttttttttttcatgaacatttatttaattttccacataatttttaatgttacttamcattccattttataggtgtaccatcatttactcattcccttatttgctatttgggtttttaatttttcacaattatcaataatactgtcatgaacattcttagattaaatctgtgttgttctctgattatttctaagaataaatttctagaccagtaattaccagatcaaagggtttggatccttccatgtgctgccacaactaccctcccaggaaagtcaaacctatttatacccatccagcagtaaagagaatcacttcactgcacccagtcttacgtgttgccttttaaaaatattt

SEQ ID NO: 24740 - DNA, 601 bp, Human
acacgcaggggggattggcagcatatggcattgcatttaatttgcagaatgcaattattctggtgtggttaaagcattagttctccaatcaagtgcctataaaacaccagtggcctacaggctccaatttgagacagtagtcaacttctaacatcatacaacccaagaaaaactgaatcaacttgtctaaaatattaacttttcttcttgtaatcactttccttaaacgtttgttatgtgctggcacgtcctaagtatgcagtaatgcaactcaagctcagccaactgtgtttagttttgyaacatttttctttggagaaaggtatgcttgaggttatcattttatactgcatgtacatctgtaaatctgtacctctttttatgttaaaattatttattaacaatattttatagggctctgacactttaaaaaaagaggctgagaaggttagagcattaggaatgtgctaaggtcaaaaaagagagtggacagcttaatgagtagagaacaggatgagagaggaataaaaggtgtgcctactatgtgccacttgctgttccagaagctcagcagtaaataaaagacaatattcccagcctc

SEQ ID NO: 24741 - DNA, 601 bp, Human
aaaagcaaacaaacccactgctctctcctcttgttccaagaagcagaattaaaagttgcactctgccttgaagcttcagtgttaaaggaattaggtcttagagtttattcctctttataacatcaccattaagtgtccttgggtgagttaactccacaagatatagaaatactttgaattaactccacaggacatagaggtacttccaattgaagtaccttaacttaaattcaaaaggctgcttttaaatgtctcctgaatacaatgcaatgtgtacaatgtgagcaacacagacatgcayaaaacgtcaagcatggagacacttgcagagtggtggggaagacagacgaacaagggtaaccataacagtgtgttatattagaggtatgtatcagatgccatggaatcttaagtgaggggccaaatgagtctaaaaagatcagaaacagctacaataagggccatctgaataaggccttgaagggcaattagatgctcatcagtggtggtcgagaaagaagataatgccgggggacacgcaggggggattggcagcatatggcattgcatttaatttgcagaatgcaattattctggtgtg

SEQ ID NO: 24742 - DNA, 601 bp, Human
atttgtatttcacatctttattgatagtcctgaagaagttaatagttttttaaacttgtaaaagtactaattaaatatttttgacatccaagttcagatttaattttcctgaggacgagtaaaattgtgaaatgtaaacattcaacaaatgatttcagagtaagcaggcccagtgcagtggctgatgcctgtaatcccagcactttaggaggctgaggtgggaggatcatttgagcccaggaattttgagaccagcctgggcaacataatgaaacctcatctctacaaaaaaaaaaaaaaattagctgagcatggtggcatgcacctgtagtcccagctacccaggaggctgaggtgggaggatcacctgagcccaggaggttgaggctgaagagagccatgatctcaccactgcactccagcctgggtgacagagtaagaccctctctcaaaaaaaaaaaaaaaaaaaaaaaaaaagaggaggaggagaaaaaagtagtaatcaaatactttttaatttatcaaattattttaccttccttcaattatacatcttatttttagaattcaatcataccattgttgccaatttataatttct

SEQ ID NO: 24743 - DNA, 601 bp, Human
cccttttagacaaacacatatctagggaagcaatctatgcaaaatctttcagtggctattcagatagacttcatttgtatttcacatctttattgatagtcctgaagaagttaatagttttttaaacttgtaaaagtactaattaaatatttttgacatccaagttcagatttaattttcctgaggacgagtaaaattgtgaaatgtaaacattcaacaaatgatttcagagtaagcaggcccagtgcagtggctgatgcctgtaatcccagcactttaggaggctgaggtgggaggatcrtttgagcccaggaattttgagaccagcctgggcaacataatgaaacctcatctctacaaaaaaaaaaaaaaattagctgagcatggtggcatgcacctgtagtcccagctacccaggaggctgaggtgggaggatcacctgagcccaggaggttgaggctgaagagagccatgatctcaccactgcactccagcctgggtgacagagtaagaccctctctcaaaaaaaaaaaaaaaaaaaaaaaaaaagaggaggaggagaaaaaagtagtaatcaaatactttttaatttatcaaatta

SEQ ID NO: 24744 - DNA, 601 bp, Human
gttaggcccttcagttctaaggaacgttcttcaatcgacccctccgttcagaccagattgatcctcaccactcagcctccaaggcctggtctggcaggtactggagaagttccttctcaacaatgcctgactgcccacacagatttcacaatcttccactcatttaagtcatttgccccacttccacccacaaatttctgaatcttctttttcagtgttgttttgcctcttctgttctctccttgtggctttattagagtttgggggtgtttccccttctttatgctaactttagtgaccmatctaccatgtctcactggaaatccagatgctagaattttaactggttcaagtgtaaaatttccaagcatgtgaggcaagtcacactaggctctggatgtttgtggaatttgatattcaggatgtccctcattcaccagcaatcatgaaggttcaggaaatgcagaacttggggaccgaaggggaggcacacactttctgcaggtgttctagggagtgactgagacagtgctcggccagcactgccataccgtggtggagttctctatttctcagacaggcattaaataattaaaatgat

SEQ ID NO: 24745 - DNA, 601 bp, Human
tactggggaaattatttctgtatcttctattttaggaaatgctgatcgagtttccagaacctcaacattatttggggtacaaggattcatttccaatgttttaagagcactgcttccctagaaataaatttaaacacagtgattaaaaatagcactaaatgccattgcaatgctcctcctataaaaagggacacatttttccccaatctgcttgtaaacaggtgtctctactactctgtatttcacacaacagcacagccacttttttcttccgtatcagtattttccttgttattaatayttgtgggagaaaaaagagcactgtataatttaaaattaataattttagaaactgagatgttttaaagtatataattttcccaatactttttaattaaaatgacatttgcatgttaaaaacttttcacaaaagattaaaaaaagaagccagcacatcaaagataaatataagaaaataaaagattacctcacagacactcttttgaaactgtaatgctttacagttttctggatttggaatatcagggtagaaggtttctttaatcctttaaataaaaaattattacagtaaatttaatag

SEQ ID NO: 24746 - DNA, 601 bp, Human
tttttcattactgaacatttctatgaactattatatagttttaatatactatgtatgtacaaaatgaattgcatttcattccaaatttccacagatcataaagctcagaaatttagctgaatcctagcagttaaaatcaggattcatacacagagaacctaaatagattttgtcacttgtcactctggcttttttccacaacatggtttttaaaaagatacaatatgagcttcaaaaaaaattaattgatccattatttgcaaatacattacagaatctcagatgataaaaaacaaacaamcaaccaaaaaaaacaaacaaaaaagacatatcttattcggacacttaaaattttcaagtacttttgccttaaatatgaaaaggtaaaatacataggcaacctgagggcagggaaaatacaagatacactttttagtttttccttctgcttttccaagaaccacaatcactccagacatcgcttatgagaaacaagggtgggcagaggatgctgtgctgaaggcaatcaattctgcacagctcaccaagcaattgctgcacctgcaacacaggtatgcccatggattcagatcagtttatg

SEQ ID NO: 24747 - DNA, 601 bp, Human
gtttcaatctactaaaaatcagtcatattactttgtagaggacatcacacatacagtttccaactaatctactttttttactaggactgatagtacagtaagaaagaaatctaaggataagagtatgtgctactcaagacaaaaggtgtataatccaacctttaacagcccaaaccagcatttctctgttggaggaaggtgtaggctttggaaagataggctcacttacttgcagatagtacaagcaaagcaattgggatggtaggtcttgcccagagcagtcaccacttcgccctccacraactccccacagccatggcagcgtgtcccgtacatccgctggtagtccagggtgcagagatactctccgttctttatgaagaagcccccttgtgccaggtcacagccacacactgtagagagacaagttcacatctggtcattatctgccacactgccgggcagcactgcctttgagtgaatactgactggttgctcaccctgtgatctcaatggtttggggctagggaggggatggctacaaagagctatttattattgggctctgaccctccctttgggagctatgcaatatctcata

SEQ ID NO: 24748 - DNA, 601 bp, Human
cttggtggtgagtctcctagttacaggaatcaaacctatcttaagttttataacatgcagacctcaaaacacaaaaaccacaaaaagccccacattttcccactcacacttcacatagttttcttgttctctgactgatcattttactatttattttattttattttttttgagatggagtcttgctgtgtcacccagattggagtgcagtggcacgatctcggctcactgcaacctccgcctcccgggttcaagccattctcctgcctcagcctcccaagcagctgagattacaggcacytgccacctcgcctggctaatttttttgtatttttagtagagacagggtttcaccatgttggccaggctggtctcaaactcttgagctcaggtgatgtacctgcctcggcctcccaaagtgctgggattataagggtgagccaccacgcccagcctgactgatcattttaatcaagctggtttgcacagttaagatacaaccttggtagatgacagatacatagagaacagggttggcaaatatttccccccaaagatgagattgtaaattttttaagactttgcggaccatatggtctct

SEQ ID NO: 24749 - DNA, 601 bp, Human
acatacaatgctgaaaaacagacaacacgtctcctctgaattggggtttttagaaaggcatagcaaatagatctccacttgaaaaggcactggattgcaaaattgccaaattagaattgatcaataaagcagctgacccttggtggtgagtctcctagttacaggaatcaaacctatcttaagttttataacatgcagacctcaaaacacaaaaaccacaaaaagccccacattttcccactcacacttcacatagttttcttgttctctgactgatcattttactatttattttattttwttttttttgagatggagtcttgctgtgtcacccagattggagtgcagtggcacgatctcggctcactgcaacctccgcctcccgggttcaagccattctcctgcctcagcctcccaagcagctgagattacaggcacctgccacctcgcctggctaatttttttgtatttttagtagagacagggtttcaccatgttggccaggctggtctcaaactcttgagctcaggtgatgtacctgcctcggcctcccaaagtgctgggattataagggtgagccaccacgcccagcctgactgat

SEQ ID NO: 24750 - DNA, 601 bp, Human
ttcccttctagagcttacatctctctggcttagaaacatacaatgctgaaaaacagacaacacgtctcctctgaattggggtttttagaaaggcatagcaaatagatctccacttgaaaaggcactggattgcaaaattgccaaattagaattgatcaataaagcagctgacccttggtggtgagtctcctagttacaggaatcaaacctatcttaagttttataacatgcagacctcaaaacacaaaaaccacaaaaagccccacattttcccactcacacttcacatagttttcttgtyctctgactgatcattttactatttattttattttattttttttgagatggagtcttgctgtgtcacccagattggagtgcagtggcacgatctcggctcactgcaacctccgcctcccgggttcaagccattctcctgcctcagcctcccaagcagctgagattacaggcacctgccacctcgcctggctaatttttttgtatttttagtagagacagggtttcaccatgttggccaggctggtctcaaactcttgagctcaggtgatgtacctgcctcggcctcccaaagtgctgggat

SEQ ID NO: 24751 - DNA, 601 bp, Human
aacttctcaactaaaaaggaggccccaattcagacagaattatcgtcattcggcagcagtagaggcagtagcagtaagtgctcctttgctggctcaaatgtccagggacagggccatagttaataaatcgttttttatcattataccaacttcaaagcaatgacctctcagggtcaggatcagaagggctcttagagtttactgggaacacggccttccaacctggctgactgacaacatacatgagaaccctccagaaactactaaattagcatgcaggttttgggggaaaataggctasaaattgatctttgtggagagactcccatctctagtccactcccacccatccaggagattccagtgatgagcgaggcttgaaaaatgactcgcatctagttcacagcttctcattctaaggtggaggcaattgtctggaaaaagctaaatcacataggtctcaattcaacctgggaagtaagactgggacttggggctccatgccagcccaggactcttaaccaggctgtgtgccacagcctgaaaagggaaaaatcagggcagaactttgcttttgattaaatacagaaaaatattcagt

SEQ ID NO: 24752 - DNA, 601 bp, Human
agccctactgcttcacactcattagctaaacctgaacaagtcttaaatctgttctgtaaggagggagtcaggaagttaaggatccattcaacacaacacgcacaggttcttttgcctccgaccaggccaggagtggacccagacacagcgtttaaagaggcactcgtgctccgtggctgaccctgcacttgcaggaccctgagaataagtgccctttacctgttgcatgcccagaggcacctcgcttaccccacccaagcccaagccttccttcccatccaagcttattattttagacccragtcccacacgaatcctctatgggacaagccagaatccagttctcaacttgggctgggccttctgaagggtgggttttgttgttttgtaaatggcccttttcagtaatttcctccctccctatatcctctgcccatactggataacttccttcttttatttgcatgaatgtttataatagaaagagacctggatttagagttagaaaacctgagttctaacgttaacttgggaatgtcccttaaaccgtgagcctcaaagtcactcataaatagagatattaactcctggttcccttcaa

SEQ ID NO: 24753 - DNA, 601 bp, Human
cttatgggttttgctaattttattaataaacccttgtttgattaataactcttttccagctaaaaacagtaaaatgcttacacagatggtgctgtttgactagaagagaatcctctctcaaagcctctctgagaagttccagaatttcagagaacataaaaactgatcatatatatatatatataatcagtttcataaaaactatgatcatatatatatggtcctttatatatatatgtatgcttattttttttgtcttttttgttttttttcttcctttttgtggagaacggggtctcgytatattgcccaggcacgtcttgaattcctcagctcaagctatcctcccgcctctgcctccctgagagctgggattacaggtgtgagccaccacgcccggcatatatatgtgtgtgtgtgtgtgtgtgtgtgtgtgtgtgtgtgtgtatatatatatatggtctattttatatatatatataaaatagagttgaggattccctatgttgcccaggatggtcttgaactcctcggttcaagcagtcttcccaactcagcttcccaaagtgctgggattccaatggctccctggtaaaaagta

SEQ ID NO: 24754 - DNA, 601 bp, Human
caaagtgaacaactcattacaggtacacatagtgccatgtgcaaagagaaatcaagaaatgacatgcacaggtagttgagacccagtaattaccacaacggaacgagcaatagctcttatgggttttgctaattttattaataaacccttgtttgattaataactcttttccagctaaaaacagtaaaatgcttacacagatggtgctgtttgactagaagagaatcctctctcaaagcctctctgagaagttccagaatttcagagaacataaaaactgatcatatatatatatatataatcagtttcataaaaactatgatcatatatatatggtcctttatatatatatgtatgcttattttttttgtcttttttgttttttttcttcctttttgtggagaacggggtctcgctatattgcccaggcacgtcttgaattcctcagctcaagctatcctcccgcctctgcctccctgagagctgggattacaggtgtgagccaccacgcccggcatatatatgtgtgtgtgtgtgtgtgtgtgtgtgtgtgtgtgtgtgtatatatatatatggtctattttatatatatatataaaat

SEQ ID NO: 24755 - DNA, 601 bp, Human
agcaaagtgaacaactcattacaggtacacatagtgccatgtgcaaagagaaatcaagaaatgacatgcacaggtagttgagacccagtaattaccacaacggaacgagcaatagctcttatgggttttgctaattttattaataaacccttgtttgattaataactcttttccagctaaaaacagtaaaatgcttacacagatggtgctgtttgactagaagagaatcctctctcaaagcctctctgagaagttccagaatttcagagaacataaaaactgatcatatatatatatatataatcagtttcataaaaactatgatcatatatatatggtcctttatatatatatgtatgcttattttttttgtcttttttgttttttttcttcctttttgtggagaacggggtctcgctatattgcccaggcacgtcttgaattcctcagctcaagctatcctcccgcctctgcctccctgagagctgggattacaggtgtgagccaccacgcccggcatatatatgtgtgtgtgtgtgtgtgtgtgtgtgtgtgtgtgtgtgtatatatatatatggtctattttatatatatatataaa

SEQ ID NO: 24756 - DNA, 601 bp, Human
aacaaaaaaatcaaacaaaaagcagacagacgtataggtcccttcagcactaactctggctcaaaggctaactacaaagcacaggaaatcctctgaatgcagagggcccaggggtcaggtgcaggctcaggagaagcattcgccgtgaaggttctgctgagcaggagtcactggccaggacaccgggtctgcgcacaatggcactattgttctccagaggtcaggcacacaaggaatgtgactcggacagaacatcagatgctgaagaagatgaaactgctctttcttcaaagatgtgccragagggcacacaaaggctacggaagcacaactccagaaggtttagagcaatccctggaattccaaatgcagcctcaacagatagccatttatttgtagcccgaatgtgctgcatttgtgcactgcttgaaaccttctctctccagcctccagaaccactctgaattgcagagctgcacccggagcctctgagtctgtttctagcagagacagggttgattggcactcctgtgtctttgcttttgagtgctagaattgacatgctaaaatctaagcccacagaccaaataaagaataaatc

SEQ ID NO: 24757 - DNA, 601 bp, Human
tagaaattgccacatgctcagtatttcccccaagtctggcctctgataattgctttacatagattagcttgcttaatcctcactaacaccctatgaggtagattctatcatcaccctatctgttttacagatgaagaaactaggaccatttttcttatttttttaatatatatagatgaggtctcaactatgttgtccagggtggtcttcaactcctggcctgaagcaatcctccggccctcagcctcccaaaatgttgggattacaggtatgagcactgtacctggtccaggaaactagsagcagaatggctgtcacatggtcaaagtcaaacaatcggcatgtggtgatccctgggttgagaccaggtaatttgattccagaatgctggctcacactcctgtgctagactgttgccccatgcgctctactttattttttctttcacatgctaactttcttaagttgctgaaaactgtaattaccaaaatttagggggtgtgttctctctcctcatgatgccatgaatatacttaaagcttatcactagactaagacccccaggagaccctcactcccttatttgctctgcccagctcac

SEQ ID NO: 24758 - DNA, 601 bp, Human
cgattggccaggggaaacggacttgggtaggaagcgaccacagagaaccttcaaccctgagatgggaccggggaggggaggaccccaaggggctgagaggctctggtcccgcagcagatgggtctgcaggccgagtattaacgagccccaagaggacaggtagcaacaatggtagaaattgccacatgctcagtatttcccccaagtctggcctctgataattgctttacatagattagcttgcttaatcctcactaacaccctatgaggtagattctatcatcaccctatctgttttacwgatgaagaaactaggaccatttttcttatttttttaatatatatagatgaggtctcaactatgttgtccagggtggtcttcaactcctggcctgaagcaatcctccggccctcagcctcccaaaatgttgggattacaggtatgagcactgtacctggtccaggaaactagcagcagaatggctgtcacatggtcaaagtcaaacaatcggcatgtggtgatccctgggttgagaccaggtaatttgattccagaatgctggctcacactcctgtgctagactgttgccccatgcgctct

SEQ ID NO: 24759 - DNA, 601 bp, Human
tttgttgaatagctgatttgtcagctatttgttaacatctttgtggactaaaatcagtctacagatgattctaattcaaaaaataaaagagaaaaaaatgagagtgagccgattggccaggggaaacggacttgggtaggaagcgaccacagagaaccttcaaccctgagatgggaccggggaggggaggaccccaaggggctgagaggctctggtcccgcagcagatgggtctgcaggccgagtattaacgagccccaagaggacaggtagcaacaatggtagaaattgccacatgctcrgtatttcccccaagtctggcctctgataattgctttacatagattagcttgcttaatcctcactaacaccctatgaggtagattctatcatcaccctatctgttttacagatgaagaaactaggaccatttttcttatttttttaatatatatagatgaggtctcaactatgttgtccagggtggtcttcaactcctggcctgaagcaatcctccggccctcagcctcccaaaatgttgggattacaggtatgagcactgtacctggtccaggaaactagcagcagaatggctgtcacat

SEQ ID NO: 24760 - DNA, 601 bp, Human
ccttttcttctccaagacctcaaagcactgtgagatgctagattgtttatattctgttttaacctttgttgaatagctgatttgtcagctatttgttaacatctttgtggactaaaatcagtctacagatgattctaattcaaaaaataaaagagaaaaaaatgagagtgagccgattggccaggggaaacggacttgggtaggaagcgaccacagagaaccttcaaccctgagatgggaccggggaggggaggaccccaaggggctgagaggctctggtcccgcagcagatgggtctgcrggccgagtattaacgagccccaagaggacaggtagcaacaatggtagaaattgccacatgctcagtatttcccccaagtctggcctctgataattgctttacatagattagcttgcttaatcctcactaacaccctatgaggtagattctatcatcaccctatctgttttacagatgaagaaactaggaccatttttcttatttttttaatatatatagatgaggtctcaactatgttgtccagggtggtcttcaactcctggcctgaagcaatcctccggccctcagcctcccaaaatg

SEQ ID NO: 24761 - DNA, 601 bp, Human
tagccagcatttttcttaagcacttattatgtgcccagtactgttctaatgtaaatagctcacttactctttacagaaaacttctagcataggtattcttgttctctatcttgagtttgcagataaggagattgaggtatataatttccccaaagttatgtggttagtcagcatcggtctggtttttctttttttctttttttgtggtggtggtttttgttttgtttgctttgttttgtttttgagacagggtgtcactctatcacccaggccggagtacaatggcatgatcatggctcamtgcagcctcaacctcctgggctcaagtgatcctcccatctcagcctcccaagttgctgggactacaggcgtgtgccatcattcctggctaatttttgtattttttttctgtagagatggaattttggtatgttgtccaggctggtctcaaactcttggtctcaagcaatccacccaccttggccttggcctcctaaagtgctggtattacggacatgagtcaccatgtctggcagagtctggttttaaatgcagagattttcacctcaaagcccaaactcttgagtgcttaatgttttac

SEQ ID NO: 24762 - DNA, 601 bp, Human
aaatggcaatatgtataaaggccaggtgcggtggctcacatctgtaatcccagcaccttgtgaggccaaggcgggtggatcacttgaggtcaggagttcacgaccagcctggccaacatggagaaaccccaactctactgaaaatacaaaaattagcccagcatggtggcacatgcccgtagtctcagctacttgggaagctgaggcagcagaactgcttgaacctgggaggcagaggttgcagtgagccaagattgcaccactacactccagctgggtgacagagtgagactccacctcaaaaaaaaaaaaaaaaaaaggcaatatgtatatgaggtctataaaagaagtgtgttaaactttaatggaataaataatagaacagcttgtaaatttctctcagttgcaagatgcaagtattgggaaagagttcactaatatatctgatttctgatcccaggggcaccctctatgcatagagaaaaccatgggacataattccaggttatgacagtaagtatgctgattacgagagtagccagcatttttcttaagcacttattatgtgcccagtactgttctaatgtaaatagctcactta

SEQ ID NO: 24763 - DNA, 601 bp, Human
agaacacagccaggggtggacttctcagttttagaatttgcccttttccccacattctatagtaagtgggcggactgtctgtattctaagccttcacaagctccagggtctcctctgcagctacagcctgtctctagggggtctcagctgggtgaaggctggtctcaaggtcagggcccaggtctgcacctgcactgacagcaaggccctggaggcaccaatggctgcacagaactaatctgactcttgcagtgtttcttaaatggcaatatgtataaaggccaggtgcggtggctcacayctgtaatcccagcaccttgtgaggccaaggcgggtggatcacttgaggtcaggagttcacgaccagcctggccaacatggagaaaccccaactctactgaaaatacaaaaattagcccagcatggtggcacatgcccgtagtctcagctacttgggaagctgaggcagcagaactgcttgaacctgggaggcagaggttgcagtgagccaagattgcaccactacactccagctgggtgacagagtgagactccacctcaaaaaaaaaaaaaaaaaaaggcaatatgtatatgaggtcta

SEQ ID NO: 24764 - DNA, 601 bp, Human
cctcagagccctaccactctgtaaaattatattacatatctgtttctttactgtctgtctcccacgtgatgccacaagctccatgagggcaaggactgtttgtttacaactacatattcccagtgatgacagcagctcctgggacacagtagttgctcaagtattttccagatgaataaaatgtttacaattaaaatgcaaaaagctttcaaatagaaatgaaattcaaacagagctatggagaacacagccaggggtggacttctcagttttagaatttgcccttttccccacattctayagtaagtgggcggactgtctgtattctaagccttcacaagctccagggtctcctctgcagctacagcctgtctctagggggtctcagctgggtgaaggctggtctcaaggtcagggcccaggtctgcacctgcactgacagcaaggccctggaggcaccaatggctgcacagaactaatctgactcttgcagtgtttcttaaatggcaatatgtataaaggccaggtgcggtggctcacatctgtaatcccagcaccttgtgaggccaaggcgggtggatcacttgaggtcaggagttca

SEQ ID NO: 24765 - DNA, 601 bp, Human
cacgccactgcactccagcctgggagacagagcgagactctgtctcaaaaaaaaaaaaaaaaaaaaaagaaccatgactagatatgattgtgatacatacttaggtgattaagctagacaagttggaaccatttcccttatatattcaaactacgctcattttactatgatgagttacagcatctactgaaacataggatcttgttcacatggttgttgactaaattacaaccacagcaatcaccataaaatagtttgataactaaaataggactttggtgaccaggcatggggcatcctrccttggctgcatcgccaatctcactatcattcacctcgccaatctcactatcattcacctctggcttccatcctcctaggcacacaggcttccttggggccatcaacaggccaagctttctgtcacctcagggcctttgcacttgctgtctcttctgctgccagtgcttttcacccagacacctgcagggctcattccctgtcagcgctgatgtctctgctcaaacccactgtcacacagcatctccgtgaccattctgtccagaggagcaacccagcccctggtacgctttctctttac

SEQ ID NO: 24766 - DNA, 601 bp, Human
aaaatcaataggcacaagtttgcaaggactagataaatttcattaatataatgtacacaacacttgtgaataatgaacttaggaggtagatttttccttaaactctttctataagtatcaattgatttaaaatccacttgtattgcttgtgaaagatattccaaaaataacttattaaaaatagcacaatgaagattaggacattttggaaaattgaaggccttttaggttgttaacagaaatgtgataagatcgtgtctttgtaaagctgactcgctaaattttcagtattagcttctgrgtttgctaatacttctttttaggccgagtaggttcactactgataatatagtaaagacacagacataattggaaagcatggagcaaagaatgaaacagctgaaatatgacattttagcacagaattcatgaaaatggtagatgtaaaatcacataacttcacagaagtaatatttcagaacacctactactctgcaatagcccttttgcatgatggacaacatgatcttacaagaaaaatgaaagtgcttcagtgttaagattggttgttaagaattataactacaacccagaaatagtc

SEQ ID NO: 24767 - DNA, 601 bp, Human
ctatatgcttagaaaacatcatttgaaaggattcagcagcctcttgactgataacagactgtccttctgggctgctgcaggcccttgctacaggaaggagggtatgaagaggaccccttcatggtggccgttcctttcattccttttctcctggcccacatcctgggaaaagacttggagaaatgttcaatcccacagtcattccttcagcagaactgcatgagggaaggaaggtgtggcactacctgggtggataccaccttgctctgcctggccctccagcagcctttcaacacatgcrctgcacacatgcccccatgtggtctctctttccttcccacaacaacccaaaccttccacacccctctgacctccagcaccaatgccatctcctctagagcccagcaggtattctgccatattctagttactattaacagacacctgtcttgccttgcctgccagatttcaagccccttgaagactgggaccacctcttgcctatctagatggtttatacatagtagtcattcaaaaaatatagatcttatgtaactagcattgaagacagcagcaaggtagtttaaggacaaaccttcat

SEQ ID NO: 24768 - DNA, 601 bp, Human
tcctttcccgtggaatactctgtaggttccaccacaagtgaacagtcaaggcaggtgccttacaagcaggtggctggctctcgaatcagggaaggttgggggtttgctgcttacctgagttgatgggagaatcgtagcgactggctaacagagatgacctttcccggctctctttctccatctcttctttcaagatcaactgtcccaggcctgagttaagctattcacagaaaaaaggaaaaaaaaaaaaaaaagaaagcaaagcttgcaattactttcatggagctgcagtttctttgtrgcagatcccacaagaagtttctcttgctggagggcctgaatgcatgtggccccagagcctggtagttcctgaagaggtaggtcaagtttgggaccctaaaccctcttagccctttcagtttcaaagctccatttccctaagtcaggctctgtgttagaagaacgttttccttcctctgctttccctaaagagccaggagacctcagaaggcatgtgtgagtgtgtgtggatttttgatgtgggaagggaagactggggctggtatcctttaaaaagaaattgccttgatttgtttaaaaa

SEQ ID NO: 24769 - DNA, 601 bp, Human
tgtaaaccaccgaatccaagatcaatgccagtgaggcatctatgaagggtagcgggaattccaggtaagggtgtgggctccggggttataatatgtggacttctaaatcctagtcttgctagttattggcgtatcacgctgggtatgttaactcaatttctataccagcctcctgatttctaaaatagagatgaaaatgctgcagttgctaataacaaccacatctacttcactggcatgttgtgaacattaaataaaatgtttagcaaaaatgcttgcatggagtgaacattaaatgcattttttttttttgagacagagtctcactctcacccaggctggagtgcagtggcgcaatcttggctcaatgtaagctcagctttctgggttcacgccattctcctgcctcagcctcccgagtagccgggactgcaggagcccgccaccacacctggctgatttttgtattttttagtagagacggggtttcactgtgttagccaggatggtctcgatctcctgaccttgtgatctgcccgccttggtctccccactaaatgcatttttaaaggaactcttagaggagaaaattatgctctag

SEQ ID NO: 24770 - DNA, 601 bp, Human
caacttaatacctctgtatctccggacatggtgtttaatctttctgaagtcctcatttcttcatctatgcaggtacaatgttatacattcttatagagcagaatctcagaattccaaggaactctaaagatttgtaaaccaccgaatccaagatcaatgccagtgaggcatctatgaagggtagcgggaattccaggtaagggtgtgggctccggggttataatatgtggacttctaaatcctagtcttgctagttattggcgtatcacgctgggtatgttaactcaatttctataccagyctcctgatttctaaaatagagatgaaaatgctgcagttgctaataacaaccacatctacttcactggcatgttgtgaacattaaataaaatgtttagcaaaaatgcttgcatggagtgaacattaaatgcattttttttttttgagacagagtctcactctcacccaggctggagtgcagtggcgcaatcttggctcaatgtaagctcagctttctgggttcacgccattctcctgcctcagcctcccgagtagccgggactgcaggagcccgccaccacacctggctgatttttgtatt

SEQ ID NO: 24771 - DNA, 601 bp, Human
ggagcagccctgggcttgaattctggttctgcaacttaatacctctgtatctccggacatggtgtttaatctttctgaagtcctcatttcttcatctatgcaggtacaatgttatacattcttatagagcagaatctcagaattccaaggaactctaaagatttgtaaaccaccgaatccaagatcaatgccagtgaggcatctatgaagggtagcgggaattccaggtaagggtgtgggctccggggttataatatgtggacttctaaatcctagtcttgctagttattggcgtatcacrctgggtatgttaactcaatttctataccagcctcctgatttctaaaatagagatgaaaatgctgcagttgctaataacaaccacatctacttcactggcatgttgtgaacattaaataaaatgtttagcaaaaatgcttgcatggagtgaacattaaatgcattttttttttttgagacagagtctcactctcacccaggctggagtgcagtggcgcaatcttggctcaatgtaagctcagctttctgggttcacgccattctcctgcctcagcctcccgagtagccgggactgcaggag

SEQ ID NO: 24772 - DNA, 601 bp, Human
aacacgaagccattcaagaaaggcgggtgtgaaatcactgccaccccatggacagacccctcactcttccttcttagccgcagcgctacttaataaatatatttatactttgaaattatgataaccgatttttcccatgcggcatcctaagggcacttgccagctcttatccggacagtcagcactgttgttggacaacagataaaggaaaagaaaaagaagaaaacaacgcagctcctgttgtatacataaggtaatgtgaaaagctcacatgtggacactactctgtgtttcggaacayagaaatttctacgccatgcttcttggcaagtgttactgttggctggcccgacatttgactcatggtgttttaaccagactttctctttttggtgttgctgagcgacggtagtttgcaaattctccaatcaagtttgggcctcaatatgacatcctatggggcaccgccactgtcagtcctttctctaattgccattcacgagtgggacttagaagagttttgcttttttcttcatgtcgttgcgtctccaaagaggtaacctgtcaaactcctgtatggacattccaaagatttcccgaa

SEQ ID NO: 24773 - DNA, 601 bp, Human
atggagttccattcctgccagggcacggctgagtaacacgaagccattcaagaaaggcgggtgtgaaatcactgccaccccatggacagacccctcactcttccttcttagccgcagcgctacttaataaatatatttatactttgaaattatgataaccgatttttcccatgcggcatcctaagggcacttgccagctcttatccggacagtcagcactgttgttggacaacagataaaggaaaagaaaaagaagaaaacaacgcagctcctgttgtatacataaggtaatgtgaaaagstcacatgtggacactactctgtgtttcggaacatagaaatttctacgccatgcttcttggcaagtgttactgttggctggcccgacatttgactcatggtgttttaaccagactttctctttttggtgttgctgagcgacggtagtttgcaaattctccaatcaagtttgggcctcaatatgacatcctatggggcaccgccactgtcagtcctttctctaattgccattcacgagtgggacttagaagagttttgcttttttcttcatgtcgttgcgtctccaaagaggtaacctgtca

SEQ ID NO: 24774 - DNA, 601 bp, Human
agggaaggtttcctttcattcctgttccttctcttttgcttttgaacagtttttaaatatactaatagctaagtcatttgccagccaggtcccggtgaacagtagagaacaaggagcttgctaagaattaattttgctgtttttcaccccattcaaacagagctgccctgttccctgatggagttccattcctgccagggcacggctgagtaacacgaagccattcaagaaaggcgggtgtgaaatcactgccaccccatggacagacccctcactcttccttcttagccgcagcgctacwtaataaatatatttatactttgaaattatgataaccgatttttcccatgcggcatcctaagggcacttgccagctcttatccggacagtcagcactgttgttggacaacagataaaggaaaagaaaaagaagaaaacaacgcagctcctgttgtatacataaggtaatgtgaaaagctcacatgtggacactactctgtgtttcggaacatagaaatttctacgccatgcttcttggcaagtgttactgttggctggcccgacatttgactcatggtgttttaaccagactttctctttt

SEQ ID NO: 24775 - DNA, 601 bp, Human
cacacacccatgaattcgacagagctgggcaagaagaaagctgaaaaggccaaattaaatacgttcgaaggagtctactttggagttgcagagatttaaaagagaaaaacatgtctttccttagcctattattgaaagaaaccttaaaaaccaacaacagcatgggcttgatctgattcataggatgccagagagacagcagaggataacgactggaagaactagagtcagtaggacatgggacttgtttttgttttttgctttttggttttttttggccatgaatgatatggcccctatrcaaaatcacctaatggcatgccactgggccaatctgggggcaatttgtgtttttcctttctttgcaaaggtggagctccagacagctcctgtcctaggcggggagcaggaaccagacctgctatgggaagcagaaagagttaagggaaggtttcctttcattcctgttccttctcttttgcttttgaacagtttttaaatatactaatagctaagtcatttgccagccaggtcccggtgaacagtagagaacaaggagcttgctaagaattaattttgctgtttttcaccccattcaaac

SEQ ID NO: 24776 - DNA, 601 bp, Human
acacacacccatgaattcgacagagctgggcaagaagaaagctgaaaaggccaaattaaatacgttcgaaggagtctactttggagttgcagagatttaaaagagaaaaacatgtctttccttagcctattattgaaagaaaccttaaaaaccaacaacagcatgggcttgatctgattcataggatgccagagagacagcagaggataacgactggaagaactagagtcagtaggacatgggacttgtttttgttttttgctttttggttttttttggccatgaatgatatggcccctaygcaaaatcacctaatggcatgccactgggccaatctgggggcaatttgtgtttttcctttctttgcaaaggtggagctccagacagctcctgtcctaggcggggagcaggaaccagacctgctatgggaagcagaaagagttaagggaaggtttcctttcattcctgttccttctcttttgcttttgaacagtttttaaatatactaatagctaagtcatttgccagccaggtcccggtgaacagtagagaacaaggagcttgctaagaattaattttgctgtttttcaccccattcaaa

SEQ ID NO: 24777 - DNA, 601 bp, Human
ctaaactgcaaactgcagtgtggcttccaaccaagcaagagctggtctcatctgctcatggccaccctgtcagagccatttgctaaacatgttagtagatccaacacacacacacacacacacacacacacacacacacacgagagtagtcctcattcagtgcatagcaatggaaggctaggacaatttagattccttaggtaagagcacaggaggatgctatagaacagtgactgttcattccatcccccaaatgacagcggtgagccacgtgtcagaggctgcaacacagactcagaarctattctacttgcttttttaccactggtgtcagagagacagcttgtaatcctaatatttggtgccagcaggaagaacttcagagcttttgttcttagtggcatatgaaggtaaattcaaatgttttcttcttcggctttaaaacagagcttaaattcttaagcacagccccaaagcatgataataaagtggcttaccctcctgggtgtggagttacacaaactctccctcatctaactcacgtcgggaatcatgatgtggtttcatatgcacgcacgtgttggggaaaccctaggctcat

SEQ ID NO: 24778 - DNA, 601 bp, Human
aagcatggaataagcaagaggccactgagacaccaaaggctaaactgcaaactgcagtgtggcttccaaccaagcaagagctggtctcatctgctcatggccaccctgtcagagccatttgctaaacatgttagtagatccaacacacacacacacacacacacacacacacacacacacgagagtagtcctcattcagtgcatagcaatggaaggctaggacaatttagattccttaggtaagagcacaggaggatgctatagaacagtgactgttcattccatcccccaaatgacagcrgtgagccacgtgtcagaggctgcaacacagactcagaaactattctacttgcttttttaccactggtgtcagagagacagcttgtaatcctaatatttggtgccagcaggaagaacttcagagcttttgttcttagtggcatatgaaggtaaattcaaatgttttcttcttcggctttaaaacagagcttaaattcttaagcacagccccaaagcatgataataaagtggcttaccctcctgggtgtggagttacacaaactctccctcatctaactcacgtcgggaatcatgatgtggt

SEQ ID NO: 24779 - DNA, 601 bp, Human
ccaggtggccaccattgttattgacaggtaaggaagcactggaaatgcaccatcctctccatccccacactttccagagtaaagcaaggatgaggacacccaggcattgtgccaaggctgccattgcaggagggcacagagagaggatgggatagaaaaagcatggaataagcaagaggccactgagacaccaaaggctaaactgcaaactgcagtgtggcttccaaccaagcaagagctggtctcatctgctcatggccaccctgtcagagccatttgctaaacatgttagtagatccaccacacacacacacacacacacacacacacacacacacgagagtagtcctcattcagtgcatagcaatggaaggctaggacaatttagattccttaggtaagagcacaggaggatgctatagaacagtgactgttcattccatcccccaaatgacagcggtgagccacgtgtcagaggctgcaacacagactcagaaactattctacttgcttttttaccactggtgtcagagagacagcttgtaatcctaatatttggtgccagcaggaagaacttcagagcttttgttcttagtggcat

SEQ ID NO: 24780 - DNA, 601 bp, Human
acccaggtggccaccattgttattgacaggtaaggaagcactggaaatgcaccatcctctccatccccacactttccagagtaaagcaaggatgaggacacccaggcattgtgccaaggctgccattgcaggagggcacagagagaggatgggatagaaaaagcatggaataagcaagaggccactgagacaccaaaggctaaactgcaaactgcagtgtggcttccaaccaagcaagagctggtctcatctgctcatggccaccctgtcagagccatttgctaaacatgttagtagatcaaacacacacacacacacacacacacacacacacacacacgagagtagtcctcattcagtgcatagcaatggaaggctaggacaatttagattccttaggtaagagcacaggaggatgctatagaacagtgactgttcattccatcccccaaatgacagcggtgagccacgtgtcagaggctgcaacacagactcagaaactattctacttgcttttttaccactggtgtcagagagacagcttgtaatcctaatatttggtgccagcaggaagaacttcagagcttttgttcttagtggc

SEQ ID NO: 24781 - DNA, 601 bp, Human
gaataaagcacacaactttattcacgaagttgtgagtatgacagtgatgcagagtatatgacaaaggagtgcagtgagtgctgctggcaacaggagcggggagcaggtagggatcacaggcacagcagcgcggagccggcagggccacctcctcctctacacacaagcatgtggcacttagcgcgccaacacacacctgctcagtttcacagggaacacgacacagcttttcaaaaggaattcttctaaacatttgctttcatatttccaaaaggggagggagggcaggaagaaccacacrccttccaacatttgaaaaaattccataaacccaacttaaaatcaaagaactcagagagcttcaatgcggagtcatcagcaactcgcaggaaccacacacatgattggacaagtctgtacataaaaccccaaaagaacatcagttttgtggacaatggtttcctctgctgtaaagaaacgtatgcatatatgatcagtaagcagctcacatctttctgaatgtcaaggtctacaggattgtctctgtccacctttggtcaatgggttcaggaagtgactcatgggaactgcactcttagga

SEQ ID NO: 24782 - DNA, 601 bp, Human
cccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggactgcggaagggacgagggttccctggagtcttacggtccaacatcaggaccaagtcccatggacatgctgacagggtccccagggagaccgtgtcastagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtcccccagctt

SEQ ID NO: 24783 - DNA, 601 bp, Human
aacttaaaaaagaatgatgacagcttgggtggagccatccttgcctctttactgtttgatggcttgatgtagtcttctgaaacctctttggcctctacaggtcacaaatctcaagggtttctagacttcccataagtacagttgtcttttacactacaaatcaatgacaacaaattggggatcaccaagccactttacaattgagtaaattcaatgcacctgctgcttgtactgctctaggaatgaaaacacacagacagctctctttcccaaacttactagactggtgcaaaggtcattrtggttttggcaaaaaaaccccaccaaaacctaacattttcttttctcttatccatcttcatacccaggacagactgacttacccttgcaaaacactttactctggtatctgttaatgatccctcaggccattgctacttgtttattccaagagtatcacggacaatttcctgatttaactcttctaaacttttctcacttacaaaaaacgctgcaagtctggactttggtttgaatattctttaaagttctctagttctttttcatgcgggtccacttactccacctcatttttaaaata

SEQ ID NO: 24784 - DNA, 601 bp, Human
aacaaactacaaagttgggaagagggaaatgaaagaacttaaaaaagaatgatgacagcttgggtggagccatccttgcctctttactgtttgatggcttgatgtagtcttctgaaacctctttggcctctacaggtcacaaatctcaagggtttctagacttcccataagtacagttgtcttttacactacaaatcaatgacaacaaattggggatcaccaagccactttacaattgagtaaattcaatgcacctgctgcttgtactgctctaggaatgaaaacacacagacagctctcyttcccaaacttactagactggtgcaaaggtcattgtggttttggcaaaaaaaccccaccaaaacctaacattttcttttctcttatccatcttcatacccaggacagactgacttacccttgcaaaacactttactctggtatctgttaatgatccctcaggccattgctacttgtttattccaagagtatcacggacaatttcctgatttaactcttctaaacttttctcacttacaaaaaacgctgcaagtctggactttggtttgaatattctttaaagttctctagttctttttca

SEQ ID NO: 24785 - DNA, 601 bp, Human
aaaagagagcacattatgaaataaaatcagtaagaagaaaagactttaacataaatattttctcaagctctttaaggttcttctcatttaccttttattaaacagtggtttcagcctcttcactagagccaactctttctctgactctttacccttttctcctaccaagtcgcaagttttttcttctgtctgccaggattctctcactgccacagccaggagtagtagtagcagtccagtcctccagcagctgtagaaagggaacatcctttgggagagagtgtgtgttggggagggcagrtaggatcaggagagagaggaaagagataaagcgtatgaatgtgtaataaatcgatggtattttaattatccagaaagtacaagattctctggcatatgcaacacatagtacattttaatatctctgtaacaagagcatctgcagcagaaaattcatttatatgtaacttgtagtctaatgtataggtgagtctttcagaacaaactacaaagttgggaagagggaaatgaaagaacttaaaaaagaatgatgacagcttgggtggagccatccttgcctctttactgtttgatggcttga

SEQ ID NO: 24786 - DNA, 601 bp, Human
agtcccagctactcaggaggctgaggctggagaatcgcttgaacccaagaggctgaggttgcagtgagccgagattgtgccactgcactccaggctgggtgacagagagagactccgtctcaaaacaaaacaaaacaattctggctagagtcttcattttgcataagtttttcactgattttaatgcacaactgtcctgagctgtggcttacagaggagctgtggaattaggcatcctgtggtatattacagtctcaggtgtgccgaaccacacgtatgatatgctgaagacactagaaamggccaagacatacaggattgtcagagggattgacttgggatcagttagtcaatcgatggtaggaaggggagttttcttacttccgttgaagatgtgagtctcgttgagtctccctaccactgtctccttcccattacttttgttgatttgcaccaggcctgccccagaagtgtggttgccagcttcccggcacaccctgaagatgtagatgtatgtgtctgaaccctggcccacagtgctctcaaagctgtaaagagaagtgggaagaaagaagaggagagttactagctatcagcctca

SEQ ID NO: 24787 - DNA, 601 bp, Human
cttacatggtcctctccagcaatatgacttttaagaaatatcaccaccatagcacaaaaatcagtgggtaaagttttgcagactgagtagtttgcaaaaaaaagtttgagctcttaaaatttaactggtaaactttgattaatttgatgaaaagtggtggtggtggttggtatttttaagtctagtgtgaaactcattaaaagtatttgggtgaataaaaggactctaggctacagaattctggctagagttggctgggcgcggtggttcatgcctgtaatcccagcaccttgggaggccraggtgggcagatcacgaggtcaaagatcaagaccatcatggccaacattgtgaaaccctgtctctgctaaaaatacaaaaattagctgggcatgatggcacacacctgtagtcccagctactcaggaggctgaggctggagaatcgcttgaacccaagaggctgaggttgcagtgagccgagattgtgccactgcactccaggctgggtgacagagagagactccgtctcaaaacaaaacaaaacaattctggctagagtcttcattttgcataagtttttcactgattttaatgcacaa

SEQ ID NO: 24788 - DNA, 601 bp, Human
aacctggtcacatgatccccagccccaaacccttttgttacttttttattgtattatttaccaggagtaaatagctaccttgtataacttatttatctgtatgggagggaattggaccataggtgcttacatggtcctctccagcaatatgacttttaagaaatatcaccaccatagcacaaaaatcagtgggtaaagttttgcagactgagtagtttgcaaaaaaaagtttgagctcttaaaatttaactggtaaactttgattaatttgatgaaaagtggtggtggtggttggtatttktaagtctagtgtgaaactcattaaaagtatttgggtgaataaaaggactctaggctacagaattctggctagagttggctgggcgcggtggttcatgcctgtaatcccagcaccttgggaggccaaggtgggcagatcacgaggtcaaagatcaagaccatcatggccaacattgtgaaaccctgtctctgctaaaaatacaaaaattagctgggcatgatggcacacacctgtagtcccagctactcaggaggctgaggctggagaatcgcttgaacccaagaggctgaggttgcagtg

SEQ ID NO: 24789 - DNA, 601 bp, Human
aaattgcctagtcctgcagtaggggaaaaaagcacctccaaatgcaaatctataccggcaactaaacattaaatctcatttttcaaaaacttgcagtcagaatttttttttttttttttagacggagttttgcccttgttgcccaggctggagtgcaatggtgcgacctcagctcactgcaacctccacctcccaggttcaagtgattctactgcctcagcctcccaagtagctgggattacaggcatgtgccactgtgctggctaattttgtatttttagtagagacggagtttcatcaygttggtcaggttggtctcaaactcctgaccttaggtgatccatctgccttggcttcccaaagtgctgggattacaggcgtgagccctgtgtcctggcagaattattttatagccagaggatttaaaaagttatccccatcaattacagcataatgtacacatacaatttgtgcttatgtaccaccatatagttactgaccttaaaaacaaaaggaaggaaggtctgttctgataaaggaaggcatactcacgtgacaagtaagatggaacccacactgaggtgggagatctctggtgaac

SEQ ID NO: 24790 - DNA, 601 bp, Human
cttgtttgcaggctacaaattcaaccagctgccctgttacttactgctaccaggttgccaagatcctgccagaaggctaagtggggaaactgctccattcctttggctcccactaccagtcgctggtataggaaccccccaacaacataaacagcaaccagtgatgcaaacctgtagagagagaaagacatctatacttaagaactgggaaatagtaaaaactcagataggataacctctgcatttattgtcagctgtttcctaagatacattccctgaaaaggaaaaatgagtagtgatwctaaatgaaaaagggggctggtaactcttagaaaaccagttagagtgctgtcagtccaagagaagcaaaggcccagacaaaatgtgacagcgtgtgattctatggccaagaataatcaccattaagtatatgattccatttctctagaagttctcataatctaatgaaataatataaaaattgcctagtcctgcagtaggggaaaaaagcacctccaaatgcaaatctataccggcaactaaacattaaatctcatttttcaaaaacttgcagtcagaatttttttttttttttttagac

SEQ ID NO: 24791 - DNA, 601 bp, Human
accccctcagtgtgaacaaacgaggatggttggtcacccaaccttgtttgcaggctacaaattcaaccagctgccctgttacttactgctaccaggttgccaagatcctgccagaaggctaagtggggaaactgctccattcctttggctcccactaccagtcgctggtataggaaccccccaacaacataaacagcaaccagtgatgcaaacctgtagagagagaaagacatctatacttaagaactgggaaatagtaaaaactcagataggataacctctgcatttattgtcagctgtytcctaagatacattccctgaaaaggaaaaatgagtagtgatactaaatgaaaaagggggctggtaactcttagaaaaccagttagagtgctgtcagtccaagagaagcaaaggcccagacaaaatgtgacagcgtgtgattctatggccaagaataatcaccattaagtatatgattccatttctctagaagttctcataatctaatgaaataatataaaaattgcctagtcctgcagtaggggaaaaaagcacctccaaatgcaaatctataccggcaactaaacattaaatctcattt

SEQ ID NO: 24792 - DNA, 601 bp, Human
aggcattttggctgtatgtggacagataagaccacagtccttagcccaatcccagctatacagtcaccccaatttccacaaatgatgtgatggtaccgtataatcctgtaattgggaaatttcacatttttcctgtcctaatctcagaggtgggagaagcaagtctagaacatctccaggctcagactaaacgagagtacttggactgcaaccaagtaatcactgcaaagtagttccaagcagcaagaaataccagattctcatggaggctactatagggtacagaataacaacatgaaarcaatcaaccctgtataaataatgtttcttggcattttttttttaattaaagaaatccagtgtctcaaaaacttgtgaaaatgtgtttaaaaaacaaacggccagtgagcctgctacaccattttgcccatatgcctattgtaacttctgatgtcaagagacaatgcaaaagcctctgttttcacaggccctattatattaactctgacttacaactgtacctctctagagaaaaaacagaaaataaggaacaaagggaaggcagttttactagtgagaagatgcaaatcaaaagcaaact

SEQ ID NO: 24793 - DNA, 601 bp, Human
ttggtttcagttgtcttactctattccagtctttgcccactttcacacaaatgacaaggccaatatgttttgtttgttttttaatcattaagagtttttgtacaaaaagtgatggttttttttcttcattttaaaacaccagggtgtgggggagggatgcaaacaaataacaaaaaagatgcttttgtaacattattttccctgtttagaaagaaaaaaatcactccaatagtattgaaaagtccaaagatgaaatagtttcattttcttttcctaaggcttataaaaggccccctgcctrttgattccatccctcttttgtgtccagtggagccatgttactcttcagtggcccaggggttcactattaaagaaagatcagtccaggtttctgggcacatggcctaaacaggaagatggaagcatcagaggattaaaaacctttccccacagaaatgtgggcaagaagacacttccctgagccagcagaagggacaggtgcagcagcattccacacccagcgcagaggacagcagagccctcgatgtcccacttctgcttccgttccctttctagaagattgaaaaaaaggtcaaaacca

SEQ ID NO: 24794 - DNA, 601 bp, Human
gagtataagtacctgccttaggcactattccttatataacaaaaatattaaatatttttttcctcagtaaaaggatgaaaattggtttcagttgtcttactctattccagtctttgcccactttcacacaaatgacaaggccaatatgttttgtttgttttttaatcattaagagtttttgtacaaaaagtgatggttttttttcttcattttaaaacaccagggtgtgggggagggatgcaaacaaataacaaaaaagatgcttttgtaacattattttccctgtttagaaagaaaaaaatcactccaatagtattgaaaagtccaaagatgaaatagtttcattttcttttcctaaggcttataaaaggccccctgcctgttgattccatccctcttttgtgtccagtggagccatgttactcttcagtggcccaggggttcactattaaagaaagatcagtccaggtttctgggcacatggcctaaacaggaagatggaagcatcagaggattaaaaacctttccccacagaaatgtgggcaagaagacacttccctgagccagcagaagggacaggtgcagcagcattccacaccca

SEQ ID NO: 24795 - DNA, 601 bp, Human
ccactgttcccctccaatttatgttattttctaccctgtttttcagttccatctctgctctgtcctatagctttataaaaccagagtgtgtggggctgaggtcaggagtataagtacctgccttaggcactattccttatataacaaaaatattaaatatttttttcctcagtaaaaggatgaaaattggtttcagttgtcttactctattccagtctttgcccactttcacacaaatgacaaggccaatatgttttgtttgttttttaatcattaagagtttttgtacaaaaagtgatggttttttttcttcattttaaaacaccagggtgtgggggagggatgcaaacaaataacaaaaaagatgcttttgtaacattattttccctgtttagaaagaaaaaaatcactccaatagtattgaaaagtccaaagatgaaatagtttcattttcttttcctaaggcttataaaaggccccctgcctgttgattccatccctcttttgtgtccagtggagccatgttactcttcagtggcccaggggttcactattaaagaaagatcagtccaggtttctgggcacatggcctaaacaggaa

SEQ ID NO: 24796 - DNA, 601 bp, Human
tggggcacatgtggctgttgtcattctttctgcatcccactgttcccctccaatttatgttattttctaccctgtttttcagttccatctctgctctgtcctatagctttataaaaccagagtgtgtggggctgaggtcaggagtataagtacctgccttaggcactattccttatataacaaaaatattaaatatttttttcctcagtaaaaggatgaaaattggtttcagttgtcttactctattccagtctttgcccactttcacacaaatgacaaggccaatatgttttgtttgttgtttaatcattaagagtttttgtacaaaaagtgatggttttttttcttcattttaaaacaccagggtgtgggggagggatgcaaacaaataacaaaaaagatgcttttgtaacattattttccctgtttagaaagaaaaaaatcactccaatagtattgaaaagtccaaagatgaaatagtttcattttcttttcctaaggcttataaaaggccccctgcctgttgattccatccctcttttgtgtccagtggagccatgttactcttcagtggcccaggggttcactattaaagaaagat

SEQ ID NO: 24797 - DNA, 601 bp, Human
gggctcggaccatcgctggggcagcgatggggctctgggaagaaaccacagagagaaaaaacaaagggccccccctcagcaccccttgtgggtgaagattttgcaggagaggtttccttggggttcccgagtgcggggcagatggggtggaggaggtctgcatctggccgaagaatggaaggatgtccaggtgatcagacacctgcaggctgcaatctgggaggtggatgggggcagtgggctgttagtgactgcattctagcacctgggcacatagcaggtgtgtgtgtgtgtgtgtgttcgtgtgcgtgcacacacatggctgcccatgcaccttcctctgtaagcctcagtcgacttttcttcattaatccccactaaggacactttttatttttcgttacttttttttttttaagagacgggactctcactatattgcccaggctggtctcaaacttctgggcacaagagattctcccaacttggccttccaaagtgctgggtttacaggcgtgagccactgcgcccggccccaactacagaaactttttagatgcatttgtcctcatcccatccttcccttggcattttaatccaa

SEQ ID NO: 24798 - DNA, 601 bp, Human
actcaccacacactacacacacaccacacacaccacaccaagcacacaccacacacatcacacactacacaaaccacacaccacacacttcatacactacacacactacccacacaccacacacacaccacaccaaacacacacaccacacacacaccacactacaaaaaccacacaccacacactgcatacgctacacacacactacacacacaccacacaaacaccacaccaaacacacaccacacatccaccacgctacaaaaactacacaccacacactgcacatgccacacacacrctacccacacaccacaccaaacacacaccacacacaccacacacaccacacactacataaaccacacatcacacactgcacatactacccacgtaccacacacacaccacacacctcataaactacacaccacacactgcacacactacccacacaccacacacactacacacactacacacaccacacacatacaccacacactgcacatgctacccacacaccaaacacacactacacactacacactgcacaaaccacacacacactacaccctatatacactgtacacatacatgc

SEQ ID NO: 24799 - DNA, 601 bp, Human
acccacacaccacaccaaacacacaccacacacaccacacacaccacacactacataaaccacacatcacacactgcacatactacccacgtaccacacacacaccacacacctcataaactacacaccacacactgcacacactacccacacaccacacacactacacacactacacacaccacacacatacaccacacactgcacatgctacccacacaccaaacacacactacacactacacactgcacaaaccacacacacactacaccctatatacactgtacacatacatgcgcyacccccacatcacaacacaaaccacacaccccacacacaacaaacatgcacaacacacgctacacaaaccacacaccacacacacaacacaccaaacacacaccacacacacataccacactacaaaaaccacacatcacacactgcacatgctacacacacacaccacaccaaacacacaccacacactacacaaaccacacaccacacactgcacatactacccacgcaccacacacacaccacacaccacataaactacacacacagtgcacacactacccacatgccacacactac

SEQ ID NO: 24800 - DNA, 601 bp, Human
ccacgcacacactacaccctatacacactacacatacatgcactacccacacatcacaacacaaaccacacactccacacacaacaaacatgcacaacacacactacaaaaaccacacactgcacacacaccacacagtacccaaaccacacgccacacaccacacactctacctacacactacccacacaccaaatacacaccacacaccaaacacacaccacacaaaccagacaccatgcacacaccacacacacaaaccacacactatacccaccacacactgcacacacacaccacrtactacagaaaccacacaacacacactgcagacactacctctacaccaaacacacaccatgcgctacacacaaattacatgctacacaaaccacacacactacaccctacacaccctgcacacatacatgcactacccacacaccacacacataccacacactacacacagcacacacacaccacacatgatacaaaccacacaccgcatacacaccacatactacactcacaccacacaaaccacaccacacacacaccacacaccacacacaccacgtactacgcaaaccacatacca

SEQ ID NO: 24801 - DNA, 601 bp, Human
acatactacactcacaccacacaaaccacaccacacacacaccacacaccacacacaccacgtactacgcaaaccacataccacacacgacccaaactacacaacaccccacacacactgcacacatacatgtactacccacacatcacacacacaccacacatgacacagaccacacaccacatacaccacgctctacacccacaccacacaaaccacacatcacacacacaacacacactgcacacataccatacacaaaaaccacacactacacacatacatcacaaacacaccacayactacacaaaccacacacatcacactacacacatgcaccacacacccacaccacacacacacacacacacatacctacacacacacacactcacatgcccggcggagggtaaaccaagcaggcatgggagaggagagccgcttgggaagtgatgaggtgtggggagcccacgctgacgccagagccacagggtttgtagccagtgttacctggtgccagctgcagcctcagtttcttcatctgcaaaatgagcaaaattacagtcctcaccctctcgctttgcgggagggactggcaagt

SEQ ID NO: 24802 - DNA, 601 bp, Human
cgtcaagtgctctggccacgacactgtgattttcattacgatggcgctctggtggctccgtggagggctccggggtgaccaagaggaggaagggtaaagggaattctgaatctggaggcagggagcggaggcgataccgttgaggagtaccattgccagcaatggaggtggacaaggaggagggtgggtggggtgggaccgggaccgtagcccagtgctgctttctcagccctccctttccccgcctcgtatagacacccccaacatcgtggtgcccccagaggtggtggcaggcacggargtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcctccttccccaacaccaccctgcagttcgagggctacgccagcatggacgtcaagtgtgagcctgggtgcgggcggggcggggtggggcggggtggggcggggtcc

SEQ ID NO: 24803 - DNA, 601 bp, Human
gaggagtaccattgccagcaatggaggtggacaaggaggagggtgggtggggtgggaccgggaccgtagcccagtgctgctttctcagccctccctttccccgcctcgtatagacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactrctgcacttcgtgcccacgagggaggccaacggccacaggctgggctgccaggcctccttccccaacaccaccctgcagttcgagggctacgccagcatggacgtcaagtgtgagcctgggtgcgggcggggcggggtggggcggggtggggcggggtccggggagggggtggacctggggatgcggccggaggcggggccgggccgtgatgggggcggggccatgcccagggccaggcagggattggggggttgggtgggacgggggcggaaccaggcagtcctggggcggggccaaggc

SEQ ID NO: 24804 - DNA, 601 bp, Human
aggagtaccattgccagcaatggaggtggacaaggaggagggtgggtggggtgggaccgggaccgtagcccagtgctgctttctcagccctccctttccccgcctcgtatagacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgmtgcacttcgtgcccacgagggaggccaacggccacaggctgggctgccaggcctccttccccaacaccaccctgcagttcgagggctacgccagcatggacgtcaagtgtgagcctgggtgcgggcggggcggggtggggcggggtggggcggggtccggggagggggtggacctggggatgcggccggaggcggggccgggccgtgatgggggcggggccatgcccagggccaggcagggattggggggttgggtgggacgggggcggaaccaggcagtcctggggcggggccaaggct

SEQ ID NO: 24805 - DNA, 601 bp, Human
atgagccaccgtgcctgtccaggaatctgcatttttaaatgaattccattgtagttctaatgagagggttgaggggacttcaggcctcatccagccccttgtatgcacatttatattactgggccagcaagaagggagctggtcagaagaggattcttagctgagaaccaaagagataccattcattcattcacaaatgtgtactgaggcaaagtgcccagcactggggatattaataatgacagccgcagccaacatttactccacagctcttgagtgctttttttttttttttttttttgagacagagtctggctctgtcgccaggctggaaggcaatggagcaatcttggctcactgcaacctcccacttccctgttcaagcaattctcctgcctcagcctcccaagtagctagaattataggcgcacaccaccacacctggctaatttttgtatttgtagtagagacagggtttcaccatgttggccagaatagtctcaaattcctgacctcgtgatctgcccacctcggcctcccaaagtgctgggattacaggcgtgagccaccacactcagcctaatttttgtatttttagtag

SEQ ID NO: 24806 - DNA, 601 bp, Human
catttatattactgggccagcaagaagggagctggtcagaagaggattcttagctgagaaccaaagagataccattcattcattcacaaatgtgtactgaggcaaagtgcccagcactggggatattaataatgacagccgcagccaacatttactccacagctcttgagtgctttttttttttttttttttttgagacagagtctggctctgtcgccaggctggaaggcaatggagcaatcttggctcactgcaacctcccacttccctgttcaagcaattctcctgcctcagcctcccragtagctagaattataggcgcacaccaccacacctggctaatttttgtatttgtagtagagacagggtttcaccatgttggccagaatagtctcaaattcctgacctcgtgatctgcccacctcggcctcccaaagtgctgggattacaggcgtgagccaccacactcagcctaatttttgtatttttagtagagacagggtttcaccatgttggtcaggctgctctcgatctcctgacctcaggtgacctgcctacctcagcctcccaaagtgctgggattacaggtgtgagccaccac

SEQ ID NO: 24807 - DNA, 601 bp, Human
tttgtagtagagacagggtttcaccatgttggccagaatagtctcaaattcctgacctcgtgatctgcccacctcggcctcccaaagtgctgggattacaggcgtgagccaccacactcagcctaatttttgtatttttagtagagacagggtttcaccatgttggtcaggctgctctcgatctcctgacctcaggtgacctgcctacctcagcctcccaaagtgctgggattacaggtgtgagccaccacgctcggactcctgcatgcttttgacatgcaatcttccccccggcattcccacggctggctctgcccacctcctaggctcgctgaagccttcccccatcatcctatcccaaactgtaactaccctgattttccataccctcagcccctttatttttctctacacacttcttcccatcttacaaattacatattttatttaattacatcggctgtttccacatgggccttgttcaagctagagcaatgcctgtcactcagcaggttctcagtgaatgttggatgatcacccctatgaggttggaactattatgaagcccattttccagatgagaaaaatgaggcccagagag

SEQ ID NO: 24808 - DNA, 601 bp, Human
tcccaaactgtaactaccctgattttccataccctcagcccctttatttttctctacacacttcttcccatcttacaaattacatattttatttaattacatcggctgtttccacatgggccttgttcaagctagagcaatgcctgtcactcagcaggttctcagtgaatgttggatgatcacccctatgaggttggaactattatgaagcccattttccagatgagaaaaatgaggcccagagaggttaagatgtgggtccacacacaactggacaggggtagagtagggatctgaagayaagcatgctggctaccaagctgctgttcttggaaatgagatagccaggactggggtcacctgagccttcctgaaccggtgtgctaggtttggggtgggatctggggtcatatctggggatggtagttggctggcagaagaagcacctcctgggttctgaccatcagtcccgtcctaccccgcagatgcaccctggaagccaacagtgaacgggacaatggtggccgtagagggggagacggtctctatcttgtgctccacacagagcaacccggaccctattctcaccatcttcaaggag

SEQ ID NO: 24809 - DNA, 601 bp, Human
atgatggagagtactggtgtgtggctgagaaccagtatggccagagggccaccgccttcaacctgtctgtggagtgtgagtaccttccgctcccctatgctggggatggacggttccgtgggggacaccagggttactgtgggtgcccacgcatcccaatcagtattggctttgcctgtcctccgcagagacaaggaagggagggcagggaagctgaattcacagcaggaaaataaaatcccatctgagaatattgtgttcccacatccgggagtgggcttttttttttttttttttttttgagacagagtattgagtcttgctctgtcacctaggctggagtgcagtggcaggatctcggctcactgcaattgctgcctcctgggttcaagcaattctcctgccccagcctcctgagtagctgggattacaggcgctcgccaccacacctggcaaatttttgtatttttagtagagacggggtttcgccatgttggcctggcttgtctcaaacccctgacttcagatgatctgcctgcctcagtctcccaaagtcctaggattacaggcgtgagccaccacgcgcagcctggggtgggct

SEQ ID NO: 24810 - DNA, 601 bp, Human
gtagctgggattacaggcgctcgccaccacacctggcaaatttttgtatttttagtagagacggggtttcgccatgttggcctggcttgtctcaaacccctgacttcagatgatctgcctgcctcagtctcccaaagtcctaggattacaggcgtgagccaccacgcgcagcctggggtgggcttttgaccagtgaaatttctggatcctgtggccactgcccctctgcactaaccgaaacaatgaccatgatctctaacctgtgtagagtgtcgctatgtaccaggcactgttggaagcrctgtacagcaacccactcatttaatcctcatgacatcttcatgagggaggttctattactgtttccctgtttacggagaaggaaactgagacccagagaggttatgccacttgcctaagttcccacagccaggaaatggcagaatttgaggtttgaatccaggcagtctggttccattcttcttccctgcccaaggctgacctcatcctatgttatgacagcagaatacattgatggggtaattgctatacacaaaaggctgtgcggctctgtgagaggtggaggatagggctgagaaga

SEQ ID NO: 24811 - DNA, 601 bp, Human
ggggctgatgtgatcctggcgcggggctgcgtggtcccctgctccctccaactgtgcgtgctatcctgggccagcttccccctctggttgtcccctgatccctgttacaccccacaccagtgattcttcagtttaagagtcagagagaggagccgatgggagtacttgaacaagcctgcagcaccaactcacatacattttccggtggggtgcagatctctcctttatagtaagagcagcaggcagcaaatgcgcgttaggggcctgccctgggccagaccttgaatcctctacagctgtyttctggttcagttcttatttttattattattattattttttttttgagactgagtctcgctctgtcacccaggccagagtgcagtggcacgatcttggctcactgcaacctctgcctcccagattcaagcgattctcctgcctcagcctcccaactagctgggattacaggcatgcgtcaccatgcccagctaattttttatttttagtagagacggggtttctccatgttgcccaggctgttctccaactcctagtctcaagtgatccacccgcctcggcctcccaaagtgctgggatt

SEQ ID NO: 24812 - DNA, 601 bp, Human
tgcagcaccaactcacatacattttccggtggggtgcagatctctcctttatagtaagagcagcaggcagcaaatgcgcgttaggggcctgccctgggccagaccttgaatcctctacagctgttttctggttcagttcttatttttattattattattattttttttttgagactgagtctcgctctgtcacccaggccagagtgcagtggcacgatcttggctcactgcaacctctgcctcccagattcaagcgattctcctgcctcagcctcccaactagctgggattacaggcatgygtcaccatgcccagctaattttttatttttagtagagacggggtttctccatgttgcccaggctgttctccaactcctagtctcaagtgatccacccgcctcggcctcccaaagtgctgggattacaggtgtgagccaccatgcccagcctatctggctcattttcaattctagggtcaccctgtgaaacaggggtgtgttataattatcccctttaccaaggagaaaactcaagggcggaattccctgaggccaggcagctataaaagtgggtccgagcccgataattccagactcctg

SEQ ID NO: 24813 - DNA, 601 bp, Human
gtggggtgcagatctctcctttatagtaagagcagcaggcagcaaatgcgcgttaggggcctgccctgggccagaccttgaatcctctacagctgttttctggttcagttcttatttttattattattattattttttttttgagactgagtctcgctctgtcacccaggccagagtgcagtggcacgatcttggctcactgcaacctctgcctcccagattcaagcgattctcctgcctcagcctcccaactagctgggattacaggcatgcgtcaccatgcccagctaattttttattkttagtagagacggggtttctccatgttgcccaggctgttctccaactcctagtctcaagtgatccacccgcctcggcctcccaaagtgctgggattacaggtgtgagccaccatgcccagcctatctggctcattttcaattctagggtcaccctgtgaaacaggggtgtgttataattatcccctttaccaaggagaaaactcaagggcggaattccctgaggccaggcagctataaaagtgggtccgagcccgataattccagactcctgtctgccccagctgttaaacctctggctg

SEQ ID NO: 24814 - DNA, 601 bp, Human
gtgatccacccgcctcggcctcccaaagtgctgggattacaggtgtgagccaccatgcccagcctatctggctcattttcaattctagggtcaccctgtgaaacaggggtgtgttataattatcccctttaccaaggagaaaactcaagggcggaattccctgaggccaggcagctataaaagtgggtccgagcccgataattccagactcctgtctgccccagctgttaaacctctggctgcctcacctccctcacagctcttagcactctaggactcaatccggcttctcttgaaaackaacacgcaggcagatgtggagtgtgcaggcctcacctgctagacttgaggggagcagtggccctgtcccctgccccacctgccagctccctactcttcacccaggcctgtgtcaaagtgcttgcccttggagagtgcgaccctcaggccccctccctctccacacagtcaatgttccctggcaccaggtctccaatgttcactgacagtggtggtgacccttgagcagggccttctgtcttacctgccaaccccagagccctgaacggcacggggcatgcaggaagtgtgcaaccttacc

SEQ ID NO: 24815 - DNA, 601 bp, Human
tgtcccagccccccactccagcctggatgacagagcaagactgtcccacccccccactccagcctggatgacagagcaagactgtcccatccccccactccagcctggatgacagagcaagactgtcccacccccctactccagcctggatgacagagcaagactgtcccatccccccactccagcctggatgacagagcaagactgtcccacccccacactccagcctggatgacagagcaagactgtcccacccccccactcccccacaaaaaagaagaactaagagaacaatactgartgttcatagtgctacatactctgtggatattggatgtcatcatctttctcactgatttttcctttggactccaggttaaatatttgttgtgtgttttgctgctgaggttttgctcatgtgacctctctgctggaatggttctgtctatccacccatgagtacttgggtgggatgttacgtatttttaattttaattttttatttttttgagacagggtcttgctctgttgcccaggctggaatgcagtggtttgatcatcgctcactgcagcctcaacctcctgggctcaactgattctc

SEQ ID NO: 24816 - DNA, 601 bp, Human
gttctgtctatccacccatgagtacttgggtgggatgttacgtatttttaattttaattttttatttttttgagacagggtcttgctctgttgcccaggctggaatgcagtggtttgatcatcgctcactgcagcctcaacctcctgggctcaactgattctcacacttcagcctcctgagtagctgggactacaggcacacatcaccatgcccagttaatgttttaattttttgtagagatggggtcttgctctgttgcccaggctggtctcaaactcctgggctcaagtgatcctcctkccttggcctcccaaagtgctggaatgacaggtgtgagccactgcacccggctgggatgttaagtgtttacaacacacttgcgcgcctatcttcggagtcccgtagccccttgtgagttactgactgtaaccccctggtttgcacagatgagaactccatcctagaggcccaggagcctgagtggcctcacccagccagtagatggcagagctgggattcaagccaaatccatcccaccacaaactcctcattctttgtacctttgtcttacaggtttgtctagagtcccataacagtttc

SEQ ID NO: 24817 - DNA, 601 bp, Human
tgctctgttgcccaggctggaatgcagtggtttgatcatcgctcactgcagcctcaacctcctgggctcaactgattctcacacttcagcctcctgagtagctgggactacaggcacacatcaccatgcccagttaatgttttaattttttgtagagatggggtcttgctctgttgcccaggctggtctcaaactcctgggctcaagtgatcctcctgccttggcctcccaaagtgctggaatgacaggtgtgagccactgcacccggctgggatgttaagtgtttacaacacacttgcgygcctatcttcggagtcccgtagccccttgtgagttactgactgtaaccccctggtttgcacagatgagaactccatcctagaggcccaggagcctgagtggcctcacccagccagtagatggcagagctgggattcaagccaaatccatcccaccacaaactcctcattctttgtacctttgtcttacaggtttgtctagagtcccataacagtttccgcagcttcacaggttgtctgaaaagatactaagcacgtgcaccggcagggtgtcggcgttccgccgacatccaggtcgaaca

SEQ ID NO: 24818 - DNA, 601 bp, Human
caccaccctgatttgacagcaaaatctcgcctaaagaacacaaggctgtttgtaatctatactgatttcatttagggtgaatattcgtactttttgctgtatacattacattgaactatgtgaaattttttctgcatgtcaaaaatggtcaaatgtggctgggcgcagtggcttatgcctgtaatcccagcactttgggaggctgaggcgggaggatcactagaggccaagagtgcaaatgagctatagtactgccactgcacttcagcctgggcgacagggccagaccctgtctctaaaygataaaaaataaaggatttgtattttaggtgaaccacggagcaacagaaggagggttttgagcagagagtgccatgatctgatttatgtattacaaggtgaatgaggttagagagagtgtaagagccagggcccaggagaaacggcccgtccctgtgacatagtgctctgtccaggctgaagctgaggctagagtcgcctcaaaagtggcaccagaagaattgccccaagagagcaccccaaaccaccccgaaatgaggccacttgggattccaaagagagaggcactaaaccaccaggt

SEQ ID NO: 24819 - DNA, 601 bp, Human
ggaggctgaggcgggaggatcactagaggccaagagtgcaaatgagctatagtactgccactgcacttcagcctgggcgacagggccagaccctgtctctaaatgataaaaaataaaggatttgtattttaggtgaaccacggagcaacagaaggagggttttgagcagagagtgccatgatctgatttatgtattacaaggtgaatgaggttagagagagtgtaagagccagggcccaggagaaacggcccgtccctgtgacatagtgctctgtccaggctgaagctgaggctagagtcrcctcaaaagtggcaccagaagaattgccccaagagagcaccccaaaccaccccgaaatgaggccacttgggattccaaagagagaggcactaaaccaccaggtgatcatcagtccaaagcatttgggaggggaacttgcacagtgctacggcgagagaaagggagggtctacccagacacgtccgtgagggtcagggtatgggtttacatgagggtttaaggaatttggcccagggctggggctggtttctttcattctttcatttttgttgttgttgttgtttggggtttttttgagac

SEQ ID NO: 24820 - DNA, 601 bp, Human
caaagattacacacatctggggcaaaaaaaaataggccttggccgggcgcgttgactcacgcctgttatcccgcactttaggaggccaaggaggaaggattgcttgaggccaggaatctgacaccagcctgggcaacatagcaagaccacatctctaaaaaaaatttttttttaattagccaggcatggtggcacacactgtagtcccagctacttgggaggctgaggtggaacgattcttgagctcaggaattagaggccagcctgggcaacatagggagaccccatctacaaaaaaacraaaaaattagctactagtggcacgtgcctgttgtcccagctactcgggaggctgaggagggaagatcgcttgagcctgggaggttgaggctgtagtgagctatgatttcaccactgtactccagcctaggtgacaaagagagaccctgtctctaaaaacaaacaaacagacagacagacagacagaaagcctctccagccccaaaccatacccacctggcccaactcagctgcagccgtgtttctttcttgtggcacacacacatcagctgtcctgagaaataaattaacccctctgctc

SEQ ID NO: 24821 - DNA, 601 bp, Human
ctaaatacgtacttgaaattatgtcataaagctaaacacgtattctagaaatggtagagtacacttctagtaaaatatatatacaagttgttgatcatttgtattagctttttgaaattgctgaagacaggttaaaagcttaggtattaaacgttgaatttaaagctttaatctggtagaaacatctgtactctgattataattttctaatttttaagtatattagaaaatataattgtattgcatgagtagatagaagggaattataggaagtcagaattaatattttcaaaggggctgrgcacagtggctcatgcctgtaattccagcactttgggaaaccaaggcaggaggattgctggaggtcaggagctcaagaccagcctaagcaacagagcgagaccccgtctctccaaaaaaaaaaaaaaaaaaagtaataataataataaacttaaaaatttgtaaaaagaatatttcagaggtccaatactttttgctgtgtgccctaagaaaatacttatttgaaagatggaatacttgctatctaatggaattgtgataggaattattttataaatcaaagatttgttttctgtgtcct

SEQ ID NO: 24822 - DNA, 601 bp, Human
taaaagcttaggtattaaacgttgaatttaaagctttaatctggtagaaacatctgtactctgattataattttctaatttttaagtatattagaaaatataattgtattgcatgagtagatagaagggaattataggaagtcagaattaatattttcaaaggggctgggcacagtggctcatgcctgtaattccagcactttgggaaaccaaggcaggaggattgctggaggtcaggagctcaagaccagcctaagcaacagagcgagaccccgtctctccaaaaaaaaaaaaaaaaaaagtaataataataataaacttaaaaatttgtaaaaagaatatttcagaggtccaatactttttgctgtgtgccctaagaaaatacttatttgaaagatggaatacttgctatctaatggaattgtgataggaattattttataaatcaaagatttgttttctgtgtcctctgtgtgcacaactctgtgctgggtgctagtaggtgtgtttaaagatgaggaaggagcgacatggtcctacccttagagtaactgtagaaacaagaagagaataagcaaatgacttaatactgacccaagaa

SEQ ID NO: 24823 - DNA, 601 bp, Human
gtcagaattaatattttcaaaggggctgggcacagtggctcatgcctgtaattccagcactttgggaaaccaaggcaggaggattgctggaggtcaggagctcaagaccagcctaagcaacagagcgagaccccgtctctccaaaaaaaaaaaaaaaaaaagtaataataataataaacttaaaaatttgtaaaaagaatatttcagaggtccaatactttttgctgtgtgccctaagaaaatacttatttgaaagatggaatacttgctatctaatggaattgtgataggaattattttrtaaatcaaagatttgttttctgtgtcctctgtgtgcacaactctgtgctgggtgctagtaggtgtgtttaaagatgaggaaggagcgacatggtcctacccttagagtaactgtagaaacaagaagagaataagcaaatgacttaatactgacccaagaaaaacttttgatcccatatgcattgtaatagggcttttaaaaaattacataactgcttttttgtatagtgatagatcatacaatctaaaaataatatttcaagaatgaaatcactcttaagacagcccataatcagcttaa

SEQ ID NO: 24824 - DNA, 601 bp, Human
acttctttccatctttggcatcagaaaagtaacaaaggaaccttgttctttgaaagttgtcataagtttcccaagcaataaaggtctcaaatagaattacatccttaaagccataatcataagcagctagatttgcatttgttggagcagagtagaactgagcagttgctgcaggctgaccacttttcctggggtgctgggagggcagctagccaacacagacatgctgaaggacagtgagggtgacagaggaagtgagctcaggtacaccttgctggactgctgagcacatatggaagtsacactgaacattcagaaattatttttatggaattccatgctttcatagactcttttctgttgttgtggtatttgataaaattccctaaaagcattttttagagggccagctattaaaatctttaacagggaaaaggttgcttttcatagttagagtttatatgtgcatggtttgtgcatacagacatttgtctctttttcttccgtgtcctctcctctcccgcagtgaagttattcgaagtcattgaaactgaaaaaacactctacctaatcatggaatatgcaagtggaggtaagaaca

SEQ ID NO: 24825 - DNA, 601 bp, Human
ttgcccaggctcaagtgcagtggcgccatctcagctcactgcaacctctgcttcctgggttcaagcaattctcctgcctcagcttcctgagtagctgggactgcaggcgcacaccacacctggctaatttttctaatttttatagagacaaggttttgccacattggccaggctggtcttgaactcctgacctcaagtgatccacctgccttggcctcccaaattgctgggattataggtgtgagccacagcacctggcctctttaacagtgttttgttgagtttattaaaacaatttccrggacatatgttttattgttgatgtgtttgccattgtgaaaagttttattaaattggccacccattccaccattgcatctcccccacccgccagcctgctgccttttgatttggtaaactcatagaattttagaattgaaaataatcttagaaattttagggcagcggtctaatttttacagatgaaactgaagctcagaaagtttgttctatgccaaggggtccatagctagttagtttcaggacctgaactagaactaagggctttctgaactggcctgtcagtgtccttccatccagc

SEQ ID NO: 24826 - DNA, 601 bp, Human
tcctgaattataatttagtaattatgagtgtgacatatggttccacaaatctcttaagaggtttatattgaattcaaatttagaaaaaaaaatctgtcaattatattgacagacttggattttatctgtgttactctacaacagctggtaggcttaatcgtttaatttttttaagtgaaaactctcctatatgatattcactcatgtttagttgtttttgcttattaaccacttgttttgacattgtgtgcttttctgcaaataggtcattcgcatagaaaatgctgacactttaccgagstgacatttaacttcataattcatcatagttaagtgaattgtgtcgtgtaaacttgacagtatgtaatgccttttaaaagatcattatgcaggctgggcacggtggctcacgcgtgtaatcccagcactttgggaggccaagacgggcagatcacttgaggccaggagttcgagaccagcctggccaacgtggtgaaacccccatctctactaaaaatacaaaaattagccgggtgtggtgacgcacgcctgtaatcccagctactcaggaggctgaggcacgagaattgcttgaacgttg

SEQ ID NO: 24827 - DNA, 601 bp, Human
taaccacttgttttgacattgtgtgcttttctgcaaataggtcattcgcatagaaaatgctgacactttaccgagctgacatttaacttcataattcatcatagttaagtgaattgtgtcgtgtaaacttgacagtatgtaatgccttttaaaagatcattatgcaggctgggcacggtggctcacgcgtgtaatcccagcactttgggaggccaagacgggcagatcacttgaggccaggagttcgagaccagcctggccaacgtggtgaaacccccatctctactaaaaatacaaaaaytagccgggtgtggtgacgcacgcctgtaatcccagctactcaggaggctgaggcacgagaattgcttgaacgttggaggcagaggttgcagtgagccaagatcgggccactgcactacagcctgggcaacagcacaactctgtctcaaaaaaaaaaaaaaaaaagcattatgcaatcaagtaataacatgaaaatatttgtgcccattcattatgtaaaatttattctttcagagttagggttaataagagtttcaaagtcagataattgtgtaattcatgatgactttcaagtatcaaa

SEQ ID NO: 24828 - DNA, 601 bp, Human
gacactttaccgagctgacatttaacttcataattcatcatagttaagtgaattgtgtcgtgtaaacttgacagtatgtaatgccttttaaaagatcattatgcaggctgggcacggtggctcacgcgtgtaatcccagcactttgggaggccaagacgggcagatcacttgaggccaggagttcgagaccagcctggccaacgtggtgaaacccccatctctactaaaaatacaaaaattagccgggtgtggtgacgcacgcctgtaatcccagctactcaggaggctgaggcacgagarttgcttgaacgttggaggcagaggttgcagtgagccaagatcgggccactgcactacagcctgggcaacagcacaactctgtctcaaaaaaaaaaaaaaaaaagcattatgcaatcaagtaataacatgaaaatatttgtgcccattcattatgtaaaatttattctttcagagttagggttaataagagtttcaaagtcagataattgtgtaattcatgatgactttcaagtatcaaaatattttagtttaatattttcactaagctgatggaggtattccttatttgtatgaagtaaa

SEQ ID NO: 24829 - DNA, 601 bp, Human
tcaccacggcctacaggactcttcctagcctcatgaactaccctcttcccctcattcacacttctccagccctgtggccttcttgctctttctcttaattactgtggaatcttaccccagataactacattgtccacaccctcaagtagtcagcaaaacacaagggtgtgcacacacaggctcacttgtctgtctctcctactttttctccacagcacttactgtcctctgatacactatatgtttattcatttattgccccctcccccaactagaatgtaaactctatgaggaaaaggaycttgtgttcactgctgcatctccccagaacctacctagaacagtgccttgcagttagtagacattcaggaaatatttgttgaatgaatgaatatactcaggaaatgctttgttgtcataatcctgcagtgaggatgtcctcttctaacacaaataacttcatccattttaattttctgttttaattgcttagtttttattaaagcctattgaaaacgctctttaaaataagagttatataatttaagtatagggaatttaattttaaggcttttcttcagcttaaagattttgttggtga

SEQ ID NO: 24830 - DNA, 601 bp, Human
ctcttaattactgtggaatcttaccccagataactacattgtccacaccctcaagtagtcagcaaaacacaagggtgtgcacacacaggctcacttgtctgtctctcctactttttctccacagcacttactgtcctctgatacactatatgtttattcatttattgccccctcccccaactagaatgtaaactctatgaggaaaaggatcttgtgttcactgctgcatctccccagaacctacctagaacagtgccttgcagttagtagacattcaggaaatatttgttgaatgaatgartatactcaggaaatgctttgttgtcataatcctgcagtgaggatgtcctcttctaacacaaataacttcatccattttaattttctgttttaattgcttagtttttattaaagcctattgaaaacgctctttaaaataagagttatataatttaagtatagggaatttaattttaaggcttttcttcagcttaaagattttgttggtgaatttaaatgcctgtagttaaagccagcttagttcaaattccacatatttctggctaactttatatctatatttaaaaattagagcattgct

SEQ ID NO: 24831 - DNA, 601 bp, Human
cttactgtcctctgatacactatatgtttattcatttattgccccctcccccaactagaatgtaaactctatgaggaaaaggatcttgtgttcactgctgcatctccccagaacctacctagaacagtgccttgcagttagtagacattcaggaaatatttgttgaatgaatgaatatactcaggaaatgctttgttgtcataatcctgcagtgaggatgtcctcttctaacacaaataacttcatccattttaattttctgttttaattgcttagtttttattaaagcctattgaaaackctctttaaaataagagttatataatttaagtatagggaatttaattttaaggcttttcttcagcttaaagattttgttggtgaatttaaatgcctgtagttaaagccagcttagttcaaattccacatatttctggctaactttatatctatatttaaaaattagagcattgctaaaagtgaaacatcaatttatgggaaaattaatactcagaagtaggatttctacttacttttatttctctcacctataggtgaagtatttgactatttggttgcacatggcaggatgaaggaaaaa

SEQ ID NO: 24832 - DNA, 601 bp, Human
taagcaggttttaagcaaacaggttacttgactctcctgtctttattaataataattactgttatctattgaccatgccacacactgagataagtactttaccaacattaaggtaaatcttacagctgccttgtgagttaaggactgttatatccatttgctaaaaaataagacaactgagacatgggaagattaaataacttgcccagaattgcctttctttttttctttttcccccttattgtggagaacggggtctcgctgtattgcccaggcaggtcccagaattgcctttcaagtrggagacctgccatagactcagagtcccaaaccctctgaccccaaaactcagatttgcaatcattatattgtgctattatttagactgggaatcagcaaacttctgtaaagggccagatagtgaacattttaggctttgtgggccacactgtctctgtcgcaactatttaactctcttgttgtagcttagaagcagtcgtaggctgggtgcgatggctcatgcctgtaatcccagcactttgggaggctgaggtgggcggatcacctgagggtcaggagttcgagaccagcctggtcaaca

SEQ ID NO: 24833 - DNA, 601 bp, Human
aagacaactgagacatgggaagattaaataacttgcccagaattgcctttctttttttctttttcccccttattgtggagaacggggtctcgctgtattgcccaggcaggtcccagaattgcctttcaagtaggagacctgccatagactcagagtcccaaaccctctgaccccaaaactcagatttgcaatcattatattgtgctattatttagactgggaatcagcaaacttctgtaaagggccagatagtgaacattttaggctttgtgggccacactgtctctgtcgcaactatttmactctcttgttgtagcttagaagcagtcgtaggctgggtgcgatggctcatgcctgtaatcccagcactttgggaggctgaggtgggcggatcacctgagggtcaggagttcgagaccagcctggtcaacatggtgaaaaccctgtctctacaaaaacacaaaaattagccgggcatgatggcaggtgcctgtaatcccagctactggggaggctgaggcaggagaatcgcttgaacctgggaggcggaaattgtagtgagccaagaccgtaccattgcacttcagcctgggtgacagag

SEQ ID NO: 24834 - DNA, 601 bp, Human
ctgggtgcgatggctcatgcctgtaatcccagcactttgggaggctgaggtgggcggatcacctgagggtcaggagttcgagaccagcctggtcaacatggtgaaaaccctgtctctacaaaaacacaaaaattagccgggcatgatggcaggtgcctgtaatcccagctactggggaggctgaggcaggagaatcgcttgaacctgggaggcggaaattgtagtgagccaagaccgtaccattgcacttcagcctgggtgacagagactccatctcaaaaaaaaaaaaaaaaaaaaaaaagaagcagctgtagacaataccaaatgaatgaacgtgactgtgttccaacaaaactttatttacaaaaacagggatgggccggatgtagccagaggccataatttgccaacccctgatttagacgaaggaaaggagcagtgcttcactgcttttaaattaattctgtattctcacaaggcctacattgaaatggaattatagcctcattttttcttagaacctttatattttgttttattcatatacagggttgtcaagctggacagactattaaagttcaagtctcctttgatttgctta

SEQ ID NO: 24835 - DNA, 601 bp, Human
tcttataaacgttgcttatattttgctgttgcttaaatactaatggtactttgaattcaaatctagtaaaaccaaagtaaaaatcagctttggctatcatttaacttctctgatcctgtttttaaagctataaaaaaaaaagaaattattcttgatgaattccatagttctttgcaattctaatataatttgattgtatggtctattaaaggaaattcagatttttattagaaaaaaagtgtgtggctctttccataactgtactcttaatttttataaattggccacctaaaagggaacmtttttttgcttcatacaatttacattccttcctactcagatgaatctgacttgcaaacatgtgtgaagatggcttattgactatgaggaaggggctggtgtcacccagcaagagcttactaacctaaatcttgaggaaattactctaatttttattgtaaattccctgcagaaattctgaagcctttatttgaggagcctgttagttggactaggaaagatggtttgtatgtatgtgttttttcaattagcaaattgatttagagtgctttagaattgaccccttcttccatggtatttg

SEQ ID NO: 24836 - DNA, 601 bp, Human
ctagttactgcttatgacattttaattttttggttgagctcattcttttccaagaaaaagaatagatttccagctccatctttttttttttttttttttttttttttttttgagacaaatctcgctttgtcgcccaggctggagtgcagtggcgcgatctcggctcactgcaagctccgccccctgggttcacgccattcttctgcctcagcctcccaagtagctgggaatacagatgcctgccactacgcccggctaattttttgtatatttagtagagacaggatttcactgtgttagycaggatggtctcgatctcctgacttcgtgatccacccgcctcggcctcccaaagtgctgggattacaggcgtgagccacgcgcccggcacagctccatcttttttacttacctctttattggtgggctggtaatattgatgatttgacgctcttttatgtatgattgaaagtgaattaggttaaatcatagtttaacctaaataacatctgttagaaatcaccatttctacctggtaatagaatgcaaaaaaagcagtaagttcaagttgagtcttttcagcttattgtggcatcaggtt

SEQ ID NO: 24837 - DNA, 601 bp, Human
attttttggttgagctcattcttttccaagaaaaagaatagatttccagctccatctttttttttttttttttttttttttttttttgagacaaatctcgctttgtcgcccaggctggagtgcagtggcgcgatctcggctcactgcaagctccgccccctgggttcacgccattcttctgcctcagcctcccaagtagctgggaatacagatgcctgccactacgcccggctaattttttgtatatttagtagagacaggatttcactgtgttagtcaggatggtctcgatctcctgacytcgtgatccacccgcctcggcctcccaaagtgctgggattacaggcgtgagccacgcgcccggcacagctccatcttttttacttacctctttattggtgggctggtaatattgatgatttgacgctcttttatgtatgattgaaagtgaattaggttaaatcatagtttaacctaaataacatctgttagaaatcaccatttctacctggtaatagaatgcaaaaaaagcagtaagttcaagttgagtcttttcagcttattgtggcatcaggttagctttgagctgttttggagctaa

SEQ ID NO: 24838 - DNA, 601 bp, Human
taacctcagttttgtgtatatgtaatcatatgtgtctaaatatacatgcagaataccaaagaaaagactagatgcaagtacagcaaaatagcaagacatgttacctctgcttagtggtaatgcaggaatatatttctatagacttttctgtatttcctgaaatttctacaatgaccatataaagctttaatattagaagactttttttaagtgaccgtaagtgtgaaatttcagtaaaacaattgtttaatcataggcatgactgcaagttgactaaataaaagcatactatttactgaargtgggaggaatccttaatagtgcacgtagtagttttcatagttcacgtacgtcgcaacattcattcctccattttaataaaggaagaggaaactgaccctcagagaagttaactaacttttgctttccatgatccacatcagttagaaggaagactgttgcagggagcaggctgagaagggcacttacagaagagagccaacctggattaacacctgggtatgggcaactctctaaccgctggtttggtttggagttgactctatgggtatggaaaggttgcaccaggccgggcgcagtg

SEQ ID NO: 24839 - DNA, 601 bp, Human
cagattgtgtctgcagttcaatactgccatcagaaacggatcgtacatcgagacctcaaggtgagtagaagtgcctcactcagtgtatgctctgtctgtttgtgtgcagttctctcagtggtcattacacaaatgaggtatagattagccttattagcattttttaaaatcccacaataattgaatcctcttaatcaagttatgggaaagagcattaaaaataaagaaaaataaaggttattgaaagtattttacatttcagttacggtgactggtggttgatctctggagaacagtcatyacacagccaaacaaatgggggcctccagaaatgtatggtcacgcccacagcatcctcagtgccacccggcattcatttctgctgctttcatcagtattctctcccgttaacagcagtgcctgtttgagacctctttcaaggtcctcagcctctgccctcactctggcataggatgaggtttcgtatcgcacagagaaaatagaaacaccatgcagaaactctcattttctaccaggccctcaaacctagcagcacctacccccatccatcacttctttcctcctgttacaggaaagtggg

SEQ ID NO: 24840 - DNA, 601 bp, Human
tgtgtcttaacttggcactcactttcactctccccttacgtaattgccattgacttgcttgttctctgcacccgcccctagagcattcacattcactctctcaactgcagtggccaactgtatgctgatggccccaaatccattcctacggccagagcactcttctgggatccaggacccagctgagcaaagggtgtcttcatataagcatcccttgggtgcagcaggttcaaatcctataaacatgaatgttcacttctcattcaggtgtctgatgtccctcaagtgccttactctcctstgctacccactcagtcaccaggtccttttgctgctgtgttccaagtatctcttaagctcactcttttatgtccctgttacactatccaaggccagaccaccattatctcataggtgattccgacactactttcttatatgttcttctctgtttctagtgcctcttcctcccatgtatgttttctacactgcacccaaaatggtcttttaaggaaacacaaataagatggtcatttctctgcttgaacaactcttcattggcttcccattgctcttacgatgaaaacccaaacttctcaag

SEQ ID NO: 24841 - DNA, 601 bp, Human
tcctacggccagagcactcttctgggatccaggacccagctgagcaaagggtgtcttcatataagcatcccttgggtgcagcaggttcaaatcctataaacatgaatgttcacttctcattcaggtgtctgatgtccctcaagtgccttactctcctgtgctacccactcagtcaccaggtccttttgctgctgtgttccaagtatctcttaagctcactcttttatgtccctgttacactatccaaggccagaccaccattatctcataggtgattccgacactactttcttatatgttyttctctgtttctagtgcctcttcctcccatgtatgttttctacactgcacccaaaatggtcttttaaggaaacacaaataagatggtcatttctctgcttgaacaactcttcattggcttcccattgctcttacgatgaaaacccaaacttctcaagtacaatcctttgtgattaagccctgaccatctccccagccccctctacacatctctatctcacatactgtctttcaatttcttgtgtgaaacatactgtgtctcacatgggttctcagactctttattctgcctgaaataccc

SEQ ID NO: 24842 - DNA, 601 bp, Human
gtcttcatataagcatcccttgggtgcagcaggttcaaatcctataaacatgaatgttcacttctcattcaggtgtctgatgtccctcaagtgccttactctcctgtgctacccactcagtcaccaggtccttttgctgctgtgttccaagtatctcttaagctcactcttttatgtccctgttacactatccaaggccagaccaccattatctcataggtgattccgacactactttcttatatgttcttctctgtttctagtgcctcttcctcccatgtatgttttctacactgcaccsaaaatggtcttttaaggaaacacaaataagatggtcatttctctgcttgaacaactcttcattggcttcccattgctcttacgatgaaaacccaaacttctcaagtacaatcctttgtgattaagccctgaccatctccccagccccctctacacatctctatctcacatactgtctttcaatttcttgtgtgaaacatactgtgtctcacatgggttctcagactctttattctgcctgaaatacccctcatcaacacatccattatgatcagatgcaccttctggtgctttgatttca

SEQ ID NO: 24843 - DNA, 601 bp, Human
ttgagatggagtattgctctgtcgcccaggctggagtgcagtggcacgatcttggctcactgcaacctctgcctcccgagttcaagcaattctcctgcctcagcctcctgagtagctgggattacaggtgtgtaccaccacacccagctgatttttgtatttttagtaaagacagggtatcaccatgttggccaggctggtcttgaactcctggcctcagatgattcgtccacctcggcctcccaaagtgctgggatcataggtgtgagccaccgtgcccagcccccatattattattatyaattgaaaaactcaaggcttttcttgatcttgggacattgatgtttaaattagtgctagaattaatctgtacttcatgtttgttattgttaatattataaaataaggagttctgacttgtctcctgtttttttctctagaaagaatgttttcacattaattaggaggtaacttcatatcattacagaaagcttttctaaaatgcctaatcctgtcataattctaattctattttggctaaatttcatttttgtcttgatgttttccctctaggctgaaaatctattgttagatgccgata

SEQ ID NO: 24844 - DNA, 601 bp, Human
tccatgcctgcatgttcatgtgtttttgtctaagtaacatatttctgttttgactcatgtctgtgcctaaaatgtgaataatggaaagttaagcacaagttatatgaacagtttatctgttctgtcatatttaggaacgtaactacctgcagtttcctataatggcacccagtaactctgaaacaagtgcccatttatgttacaaaatatatgtaatatgtcatcttttaggtcaaatgaaaattattttaccctacaaaagaatgatttctggccgggcgtggtggctcacgcctgtaaacccagcactttgggaggccaaggcgggcagatcacctgaggtcgggaggtcgaggccagcctgaccaacatggagaaaccccatctctactaaaactacaaaattagccaggcacggtggctcatgcctgtaatcccagctactcgggaggctgaggcaggagaattgcttgaatctgggaggtggaggttgcggtgagccaagatcgcgccattgcactccagcctgggcaacaagagtgaaactccgtctcaaaaaaaaaaaaaaaaaaaggatgatttcttacccaaacaaaacaca

SEQ ID NO: 24845 - DNA, 601 bp, Human
ggccgggcgtggtggctcacgcctgtaatcccagcactttgggaggccaaggcgggcagatcacctgaggtcgggaggtcgaggccagcctgaccaacatggagaaaccccatctctactaaaactacaaaattagccaggcacggtggctcatgcctgtaatcccagctactcgggaggctgaggcaggagaattgcttgaatctgggaggtggaggttgcggtgagccaagatcgcgccattgcactccagcctgggcaacaagagtgaaactccgtctcaaaaaaaaaaaaaaaaaaaggatgatttcttacccaaacaaaacacataaactgtattatgcccttcttttagatattatggtgggaatgggatattcacaagaagaaattcaagaatctcttagtaagatgaaatacgatgaaatcacagctacatatttgttattggggagaaaatcttcagaggtaagagtaatcagaaagagctgaaataccctgtatgtaattattagtttatataaactgttttcttagtttttatcttttgaatatttgtaacatttgatacatcattttttagatttacttgcaaatagca

SEQ ID NO: 24846 - DNA, 601 bp, Human
tgcttgaatctgggaggtggaggttgcggtgagccaagatcgcgccattgcactccagcctgggcaacaagagtgaaactccgtctcaaaaaaaaaaaaaaaaaaaggatgatttcttacccaaacaaaacacataaactgtattatgcccttcttttagatattatggtgggaatgggatattcacaagaagaaattcaagaatctcttagtaagatgaaatacgatgaaatcacagctacatatttgttattggggagaaaatcttcagaggtaagagtaatcagaaagagctgaaatrccctgtatgtaattattagtttatataaactgttttcttagtttttatcttttgaatatttgtaacatttgatacatcattttttagatttacttgcaaatagcaaatctaaatcctatgactattataagctattttaacttaacccttaatgatggatattggccaggcgtggtggctcatgcctgtaatcccagcactttgggaggccaaggcggacagatcacttgagaccaggagttcgagaccagactggccaacatagggaaactctgtctctgctaaaacaaacaaacaaac

SEQ ID NO: 24847 - DNA, 601 bp, Human
gtagagacggggtttcaccacatttggccaggctggtcttcagctcctggccttaagtgatccacctgccttggcctcccagagcgctggaattacaggcatgagccaccgtgcctggccagcattttttcttagtgttcctgcaggtgctgccatgattacatattacttcaaggctcttatcttctttatacatgcagtagatttttgctggataaagcttagttgagtggaaaccttaccatttgcccttctagaacctctgctttaatctgtagttttcctttttttttttttttttaaatggagatgggggtctcgctatgttgcccaagctggtctcaaactcccaagttcaaactattctctcaccacagccttctaaagtgctaggattacagacgtgagccaccatgcccagcgctagaactgggcgctgtaccgaactgaatagaactgctagtctgtagttctattcactctcttcacctctgcattggatttactttgtagagtagcactgtccagtagaactttctgagatgattacagttttgtgtatctgtgctgtccagtcaagaagctactggccacttgtggc

SEQ ID NO: 24848 - DNA, 601 bp, Human
cacctgccttggcctcccagagcgctggaattacaggcatgagccaccgtgcctggccagcattttttcttagtgttcctgcaggtgctgccatgattacatattacttcaaggctcttatcttctttatacatgcagtagatttttgctggataaagcttagttgagtggaaaccttaccatttgcccttctagaacctctgctttaatctgtagttttcctttttttttttttttttaaatggagatgggggtctcgctatgttgcccaagctggtctcaaactcccaagttcaaactrttctctcaccacagccttctaaagtgctaggattacagacgtgagccaccatgcccagcgctagaactgggcgctgtaccgaactgaatagaactgctagtctgtagttctattcactctcttcacctctgcattggatttactttgtagagtagcactgtccagtagaactttctgagatgattacagttttgtgtatctgtgctgtccagtcaagaagctactggccacttgtggctatcaagtacttgaactgaggaaatgatttttaccttttttatttctatttattttttatta

SEQ ID NO: 24849 - DNA, 601 bp, Human
ccagagcgctggaattacaggcatgagccaccgtgcctggccagcattttttcttagtgttcctgcaggtgctgccatgattacatattacttcaaggctcttatcttctttatacatgcagtagatttttgctggataaagcttagttgagtggaaaccttaccatttgcccttctagaacctctgctttaatctgtagttttcctttttttttttttttttaaatggagatgggggtctcgctatgttgcccaagctggtctcaaactcccaagttcaaactattctctcaccacagcsttctaaagtgctaggattacagacgtgagccaccatgcccagcgctagaactgggcgctgtaccgaactgaatagaactgctagtctgtagttctattcactctcttcacctctgcattggatttactttgtagagtagcactgtccagtagaactttctgagatgattacagttttgtgtatctgtgctgtccagtcaagaagctactggccacttgtggctatcaagtacttgaactgaggaaatgatttttaccttttttatttctatttattttttattatttttatttatttatt

SEQ ID NO: 24850 - DNA, 601 bp, Human
actttctgagatgattacagttttgtgtatctgtgctgtccagtcaagaagctactggccacttgtggctatcaagtacttgaactgaggaaatgatttttaccttttttatttctatttattttttattatttttatttatttatttatttatttatttttcagatggaatctggctctgtcgcccaggctggaatgcagtggcatgatcttggctcactgcaacctccacctcccaggtcccagcagttctcctgcctcagcctcctgagtagctgggattacaggcatgcacaaccayacccggctaatttttgtatttttaatagagacagggtttcaccatattggctaggctggtcttgaacttgggagctcaagcaatccactcaccttggcctccaaaagtgatgggattacaggtgtgagccaccgcgcctggccttatttatttgtttattttttgagatggaattttgctcttgttacccaggctggagtgcaatggcatgatctcggctcactgcaacctcagcctccgaagtagctgggactataggcacacaccaccacacctggccaatattgtatttttagtaga

SEQ ID NO: 24851 - DNA, 601 bp, Human
aaatctatttttttttttttttttgagatggagtttcactcttgtcacccaggctggagtgcaatagcgcgatctcggctcactgcaacctccgcctcctgggttctagcaattctcctgcctcagcctcccgagtagctgggactacaggcatgcatcaccatgcccagctaatttttttatttttagtagagacggggtttcaccacatttggccaggctggtcccgaactcctgaactcaggtgatccatccacctcagcctcccaaagtgctcggattacaggcatgagtcactgcrctcggcctcattttatttctcttctctggacattttccatcttaatactttcatcttgagatttgacacttaggactgcacagggcattttaggtgtggacagctttgattttgtactaaaaatgattacacttggcttgatttccatttctcttccttctgttgcttgcctttctacatggtttagactgaagcaacagtgtactaatatcactagtaaaccatctacagtgcctgctattctagggtgtaactgagagctcagaactcattctcacatcaggatttgtgctcctagca

SEQ ID NO: 24852 - DNA, 601 bp, Human
ggctccatctcaaaaaaaaaaaaaaaaaaatgaaatttctgtgtgacacatccataccatggactactactcacaataaaaaggaacaggctgggcgcggtggctcacgcctgtaatcccaacactttgagaggccgaggcaggcagatcacgaggtcaagagatcgagaccatctggccaacatggtgaaaccccgtctctactaaaattacaaaaaattagccgggcatggtggcaggcgcctgtagtcccagctacttgtgaggctgaggcaggagaatcgcttgaacctgggaggtrgaggttgcagtgagccaagattgagccactgcactccacagcctggccacagagcgagactccgtctcgaaaaaaaaaaaaaggaacaaactatgatgtgcacaactcagatggatctcaagggaattatactgcgtgaaagtacacaaaaggttacattccatggatgcccattcatataacattcttgaaatgacagaattctagagatggcgagcaggttagcggttgcaggggtttagcaaaagggagagtaagagggaagtggctgtggctatgaaagggtagtctacagggtct

SEQ ID NO: 24853 - DNA, 601 bp, Human
ggaacaggctgggcgcggtggctcacgcctgtaatcccaacactttgagaggccgaggcaggcagatcacgaggtcaagagatcgagaccatctggccaacatggtgaaaccccgtctctactaaaattacaaaaaattagccgggcatggtggcaggcgcctgtagtcccagctacttgtgaggctgaggcaggagaatcgcttgaacctgggaggtggaggttgcagtgagccaagattgagccactgcactccacagcctggccacagagcgagactccgtctcgaaaaaaaaaaaaaggaacaaactatgatgtgcacaactcagatggatctcaagggaattatactgcgtgaaagtacacaaaaggttacattccatggatgcccattcatataacattcttgaaatgacagaattctagagatggcgagcaggttagcggttgcaggggtttagcaaaagggagagtaagagggaagtggctgtggctatgaaagggtagtctacagggtctttgagatggaaatgttctgaatcttgactgatggtgaccacatgaatctgaacatgtaataaaagagtatagaatgagatac

SEQ ID NO: 24854 - DNA, 601 bp, Human
aactcagatggatctcaagggaattatactgcgtgaaagtacacaaaaggttacattccatggatgcccattcatataacattcttgaaatgacagaattctagagatggcgagcaggttagcggttgcaggggtttagcaaaagggagagtaagagggaagtggctgtggctatgaaagggtagtctacagggtctttgagatggaaatgttctgaatcttgactgatggtgaccacatgaatctgaacatgtaataaaagagtatagaatgagatacacaaacatacaaattagtgcargtaaaactggggaaatctgaacgaggtcagtggattagatcaaggtctgtttctcttcagaatctcaaatcttaaaaggttttgtattttctaaacacaaataaaagctggaaagccaatcagtagtaatctgaaagttcacaatgtcagtagacgtctcatggtattgggaagaaagataagcattgaggctaatatcaccctatgcttgattaagtttttgttttatatgttaaaatcactaaaccgaaagcttagttgttgttctcccacaaataaaattaagccctcatttacttt

SEQ ID NO: 24855 - DNA, 601 bp, Human
tcttgttacacaggctggagtgcaatggtgcgatctcagctcaccgcaacctctacctcccaggtttaagtgattctcctacctcagcctcctggcctcctgagtagctgggattacaggcatgcaccaccacagccagctaattttgtatttttagcagagacgggttttctccatgttggtcaggctggtctcgaactcctcacctcaggagatccgcccacctctgcctcccaaagtattgggattacaggtgtgagctaccgcgcccagccgttgtatagcttttttaaagaaatayctattgaaggtgccgattttaaaattaggttgtcaggccgggcacctcaggaggctgaggcaggagaatcgcttgaacccaggagggggaggttgcagtgagccgagatcgcaccgctgcattccagcatggcgacagagcaacactgcatctcaaaaaagaaaaaaaaaattagccaaatgtggtggcacatgcctgtattcccagctacttgggaggctgtggtgggaggattgcttgatcctgggaggcagagccaagattgctccactgcactccagcctgggtgacagagtaaga

SEQ ID NO: 24856 - DNA, 601 bp, Human
tatttttagcagagacgggttttctccatgttggtcaggctggtctcgaactcctcacctcaggagatccgcccacctctgcctcccaaagtattgggattacaggtgtgagctaccgcgcccagccgttgtatagcttttttaaagaaatatctattgaaggtgccgattttaaaattaggttgtcaggccgggcacctcaggaggctgaggcaggagaatcgcttgaacccaggagggggaggttgcagtgagccgagatcgcaccgctgcattccagcatggcgacagagcaacactscatctcaaaaaagaaaaaaaaaattagccaaatgtggtggcacatgcctgtattcccagctacttgggaggctgtggtgggaggattgcttgatcctgggaggcagagccaagattgctccactgcactccagcctgggtgacagagtaagaccttgcctcaaaaaacaagtaaataaaagactggcattcctatttatgtagataagttcattttttctcattgtactgtatttaccaaataaatttaagacaaaaatgcccttttttatagagtaacacagcatctggtggaatgaca

SEQ ID NO: 24857 - DNA, 601 bp, Human
ctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggcgtgtggccccatctccatgtgcctcccgtctgggtgggtgtgagagtggacggtatgtgtgtgaagtggtgtatatggaagcatctccctacactggcagccagtcattrctagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaatcttgcattgtctcctaatgctgtatttaacacatcctcaa

SEQ ID NO: 24858 - DNA, 601 bp, Human
ttcctgagagactgctagaatggacggcccacaaggacagagacgattatctttttctcgctgctgaattctcaaaagctcaaagagtgcttggcactcatagatgtgcacaatgtttgctgaatgggaatgagtaagtgaatctttctatgatgtatcatcctggagaaattgaagctattttttttttaattcttcaatcttgttagaaagatagccttttttaggcgtgcaagttgtgaattttttttcagaaagtctttccctagttagtccacacttatgcacactgaattgtttrgggtctgctgacaatgtcattcgtagaactctctggagcttccattgagggatgtaattttctgtatgttccttcacccatttcttcctgatggtgtgtacagcagtgttctgcctggcaagactgcgttttgaaaggtttcacatatatcttttttgaaaagcaccatgagctatttaactgaatccagatgagtcacattctgctcatagcacagattaactttcatactcattctagcaagtgctaaactgtgtatagtggcagatggttgcaaatcccggattttgaaacggagcc

SEQ ID NO: 24859 - DNA, 601 bp, Human
tgtttggggtctgctgacaatgtcattcgtagaactctctggagcttccattgagggatgtaattttctgtatgttccttcacccatttcttcctgatggtgtgtacagcagtgttctgcctggcaagactgcgttttgaaaggtttcacatatatcttttttgaaaagcaccatgagctatttaactgaatccagatgagtcacattctgctcatagcacagattaactttcatactcattctagcaagtgctaaactgtgtatagtggcagatggttgcaaatcccggattttgaaacrgagcctgtcttataaaactattctcactgccttgtgagggtacaaaccctgcacacattcaagcattaaatgaaaattttaatggagagcattcagaatgtgaaaacaattagataagctatttttcataagaccacacatgcctgcaataggtcagagggccaacttttctggtctggccactcctctgtgctatttacaccttttgctaggagtgggtgtgtgagggactggctgcacccaggggaaatcactcccaggtggactcaaatttgcagacccaaagctcttcagtgggcg

SEQ ID NO: 24860 - DNA, 601 bp, Human
cggaggacattttcttgacgttctgcatgtcttaccaaccatctgagtcccttaatttctgctactccctccacacccttcctggagaggcacttggaataagagaagatccaatgcaatgcaggcatcattatcatgggaaggagaagactgagaaaggaagagcgagtagagagggagtgaccgttttggagtggtctgagcgctacagattggtccccaggtgggcctgtttgcaagcaagctgtggccccgaccagagtccctaatgctcatccatgtatattcagtgggtatagcmcctctttagccagggttcttactttttcatccaagaaaaatgaaatttgttcctaaaggccagtgtcctcatcagccctcgcccaacgtcccgcctcatcgttacattttccattgtctttgctgtgaacccaaccctgactcctgaggtcagcctgcaggagcggcccctgacttcatgcttgcactcagtccattagggcagacagctgtaaacggaagcgagtgctcactgtctctctggagcattatgtggatgaaggaagccaagaaattgggtttaaaaatctggagtccgtta

SEQ ID NO: 24861 - DNA, 601 bp, Human
cgagtagagagggagtgaccgttttggagtggtctgagcgctacagattggtccccaggtgggcctgtttgcaagcaagctgtggccccgaccagagtccctaatgctcatccatgtatattcagtgggtatagcccctctttagccagggttcttactttttcatccaagaaaaatgaaatttgttcctaaaggccagtgtcctcatcagccctcgcccaacgtcccgcctcatcgttacattttccattgtctttgctgtgaacccaaccctgactcctgaggtcagcctgcaggagcrgcccctgacttcatgcttgcactcagtccattagggcagacagctgtaaacggaagcgagtgctcactgtctctctggagcattatgtggatgaaggaagccaagaaattgggtttaaaaatctggagtccgttattagaagcctgaggtctcttgagtgatctgagcattacaaatcttcagcccaggatacagccatttacgtttaataggaggttgatggatgtgggtaattttcaaatctaatatgaaatctatttttaaaggaatttgatgtcatcgaaattaaactgggggaaa

SEQ ID NO: 24862 - DNA, 601 bp, Human
gtagagagggagtgaccgttttggagtggtctgagcgctacagattggtccccaggtgggcctgtttgcaagcaagctgtggccccgaccagagtccctaatgctcatccatgtatattcagtgggtatagcccctctttagccagggttcttactttttcatccaagaaaaatgaaatttgttcctaaaggccagtgtcctcatcagccctcgcccaacgtcccgcctcatcgttacattttccattgtctttgctgtgaacccaaccctgactcctgaggtcagcctgcaggagcggcscctgacttcatgcttgcactcagtccattagggcagacagctgtaaacggaagcgagtgctcactgtctctctggagcattatgtggatgaaggaagccaagaaattgggtttaaaaatctggagtccgttattagaagcctgaggtctcttgagtgatctgagcattacaaatcttcagcccaggatacagccatttacgtttaataggaggttgatggatgtgggtaattttcaaatctaatatgaaatctatttttaaaggaatttgatgtcatcgaaattaaactgggggaaaaaa

SEQ ID NO: 24863 - DNA, 601 bp, Human
cggcccctgacttcatgcttgcactcagtccattagggcagacagctgtaaacggaagcgagtgctcactgtctctctggagcattatgtggatgaaggaagccaagaaattgggtttaaaaatctggagtccgttattagaagcctgaggtctcttgagtgatctgagcattacaaatcttcagcccaggatacagccatttacgtttaataggaggttgatggatgtgggtaattttcaaatctaatatgaaatctatttttaaaggaatttgatgtcatcgaaattaaactgggggaraaaagatcaaggcagaatcctactgaagaaaagattcttggccaggatttgttcttgctcctcatctgggcacaatttctcctcatggagagtgctatcatcagtttaaggcatgaattattaaggcagtagtgcaaagcacagaaactgcgactgccttgcctgcccaggtagagccctagggccaaatcagatgtgggttcatcccctgtgctgggctccaggatccctgattctggtaccatgatgagtgctctcaaaaattggtgtgaagcccacgggttcgactgagccaagaga

SEQ ID NO: 24864 - DNA, 601 bp, Human
tagggcagacagctgtaaacggaagcgagtgctcactgtctctctggagcattatgtggatgaaggaagccaagaaattgggtttaaaaatctggagtccgttattagaagcctgaggtctcttgagtgatctgagcattacaaatcttcagcccaggatacagccatttacgtttaataggaggttgatggatgtgggtaattttcaaatctaatatgaaatctatttttaaaggaatttgatgtcatcgaaattaaactgggggaaaaaagatcaaggcagaatcctactgaagaaaasattcttggccaggatttgttcttgctcctcatctgggcacaatttctcctcatggagagtgctatcatcagtttaaggcatgaattattaaggcagtagtgcaaagcacagaaactgcgactgccttgcctgcccaggtagagccctagggccaaatcagatgtgggttcatcccctgtgctgggctccaggatccctgattctggtaccatgatgagtgctctcaaaaattggtgtgaagcccacgggttcgactgagccaagagacgtgacgtccaggcttggcaatgtcactcatat

SEQ ID NO: 24865 - DNA, 601 bp, Human
atgatgagtgctctcaaaaattggtgtgaagcccacgggttcgactgagccaagagacgtgacgtccaggcttggcaatgtcactcatattggttatgtgaccctgagcagctactttctacttctcaggacctggatttcctaaactgtaggaacaggacttcctgccttaacaccctgttgcctctccagtttttttgaaacttactatctgtgcactcagctggtatcaaaatgtactacctggggtcactgatctttcatggtttcagtcttacctgctcagggctccaactctttsacaagttagcactcagaaagatcgtttgatttgttttctgacagtcctgtcatctgacctcacagagctttagtggacactctgggccttaccagattaagttgtgtccatcctgtgggtgccatgtcagagcacctatcatggtaccagatacaggatgcacagtaggtcctcaataaatatttagtgaatgaataagtgagtgagtgaatatctgagaagcacacacatgaggaaatatgacaaaagggtggtgagaaggcaaagagccactgttaaacgtctgctaaaaagaaccat

SEQ ID NO: 24866 - DNA, 601 bp, Human
acaggacttcctgccttaacaccctgttgcctctccagtttttttgaaacttactatctgtgcactcagctggtatcaaaatgtactacctggggtcactgatctttcatggtttcagtcttacctgctcagggctccaactctttcacaagttagcactcagaaagatcgtttgatttgttttctgacagtcctgtcatctgacctcacagagctttagtggacactctgggccttaccagattaagttgtgtccatcctgtgggtgccatgtcagagcacctatcatggtaccagatayaggatgcacagtaggtcctcaataaatatttagtgaatgaataagtgagtgagtgaatatctgagaagcacacacatgaggaaatatgacaaaagggtggtgagaaggcaaagagccactgttaaacgtctgctaaaaagaaccatttggagaaggttttttttttttttttttttccagacagaatctcattctattgcccaggctggagtgcagtggagcaatcttggctcactacaacctctgtctcccaggctcaggtgattgtctcacttcggcctccctagtagctgggactac

SEQ ID NO: 24867 - DNA, 601 bp, Human
actcagaaagatcgtttgatttgttttctgacagtcctgtcatctgacctcacagagctttagtggacactctgggccttaccagattaagttgtgtccatcctgtgggtgccatgtcagagcacctatcatggtaccagatacaggatgcacagtaggtcctcaataaatatttagtgaatgaataagtgagtgagtgaatatctgagaagcacacacatgaggaaatatgacaaaagggtggtgagaaggcaaagagccactgttaaacgtctgctaaaaagaaccatttggagaaggttttttttttttttttttttccagacagaatctcattctattgcccaggctggagtgcagtggagcaatcttggctcactacaacctctgtctcccaggctcaggtgattgtctcacttcggcctccctagtagctgggactacaggcgtgcaccatcatgcctgactagtttttgtatttttagtagagacggggtttcaccatgttgtccaggctggtctcaaactcctggactcaagtgattctccctcctcagtctcccaaagtgctgggattacaggcatgagccaccacgcccag

SEQ ID NO: 24868 - DNA, 601 bp, Human
ataacataaaatgtaccattttaaccatttttaagtatctagtccagtggtattaagcacattcacattgttgtgcaaccatcaccaccttcaatctccagaacttcttcaccccaaactgagactctatacccattaaacaataattccccagctcctcctcctccatctcctggcagccaccaatctactttttgtctatgaatttgactattctaggtgcctcatataagtggaatcatagaatatttgtccttttgtaaccagcttatattgcttggcataatgtcttcaaggttcrttcagttgtaggacgtgtcagaatttccttcctttttaaggctgaataatattccattgtatctatacatcatcctttgtactcatcctttgatagatccctgggttgcttccaccttttgacttttatttattaatgcagctatgaacttgggtgtgtatacccagaaatggaattgctggatcatatggttaattctatatttaattttttgaggaaccgccatgctgttttccacagtggctgaatgctgggttttaaaaagagagttgactaaagatcatttcacctttccctgat

SEQ ID NO: 24869 - DNA, 601 bp, Human
aatttccttcctttttaaggctgaataatattccattgtatctatacatcatcctttgtactcatcctttgatagatccctgggttgcttccaccttttgacttttatttattaatgcagctatgaacttgggtgtgtatacccagaaatggaattgctggatcatatggttaattctatatttaattttttgaggaaccgccatgctgttttccacagtggctgaatgctgggttttaaaaagagagttgactaaagatcatttcacctttccctgatggtgtaatggagtgattcctayaggcagtagactgcgggcccttcctgttctgtgtttgtctgtctgtctgtgactggtgttttattgccaggcctattttcctccatcaaagctcttggcttgtttcctggcactcagttatggcctgcacaggtgaggctgctgatgagtttcaggtagatgaatagaaactgcacacagctaacaatatcctgcctctcctcacatgggagtgagctccagagagagtgccaagggtcagtgacacagcaaggtgatgtcttttcttctacaccagccctgcatgttgtgaccttctct

SEQ ID NO: 24870 - DNA, 601 bp, Human
ggacttttattttttacctgacaagtccaaaggtggttggtcctatggatggctcagtgactcagtgatattatcaagaacccagactctttctgtctttctattctggcaaagtatgttgcatttacattttcatccttgtcacctcttggttacaagatggttgctgcagctaccagcatcatatccttacactacaagactcaaaggcagaaaggacagagagcagagaaaagcatttctctttatacacttttgtctttttttttttttttttttgagacagagtctcactctgttrcccaggctggagtgcagtggcacaatctcagctcactgcaacctctgcctcctgggttcaagcgattctcatgcctcaggctcccaagtagctgggattgcagacgcatgccaccatgcccagctaattttgtttttttgtttgtttgtttttagtagaggtggggtttcaccatgttagccaggctggtcttgaactcctggcctcaagtgatctgcccaccttggccttccaaagtgctgggattacaggcatgagccactgtgcctggccacctttgtcttttcaggaagaaaaatc

SEQ ID NO: 24871 - DNA, 601 bp, Human
aagctctctacatgctttgagcccaagtgatcaggttaacctgagagagatactggattttcttagcttttccatctttcttggaaggaggtaggctggggagcgtggctctcaccccagctctcagctctttggccactgactcagttcagctcagctcaactgagccttggcttgctctttggccatcaaagagggaaaatgctggagaatccacaggtatacttcaggtgccaggccctcttttaaacaagctcctggagagcaggagctattttctctgtgtcctgtagctcacctkgtttcctgaagatttagtgaagtttgcctgcctttccacctctactgcaaagtcttcttcaagacataaccctggccttgtcacctccaccaacattctcacctctagtcacctgtttagagccttcactgatccatcctggggcttgcaaagcccgcacgtccagtcatgctcaggtgggccagctccctctgcctcccagcctcatctctctcctcacactccagccatactcagctcctcacagctccccaggcatgcccctcgccctcatccccaggcatttgtgttcactgtccc

SEQ ID NO: 24872 - DNA, 601 bp, Human
ctggccttgtcacctccaccaacattctcacctctagtcacctgtttagagccttcactgatccatcctggggcttgcaaagcccgcacgtccagtcatgctcaggtgggccagctccctctgcctcccagcctcatctctctcctcacactccagccatactcagctcctcacagctccccaggcatgcccctcgccctcatccccaggcatttgtgttcactgtcccctcatccctgggcgtttgtgttcactgtcccctcatccccgggcatttgtgttcactgtcccctcatccccrggcatttgtgttcactgttccctcatccccaagcacttgtgttttttgtctcctcaccctcaggtgtttgcgtttgctgtcctcgagtcctcatgttcttcttcctgttgagctcccttacctatggaactcctcctcctccctggggcctcctgttggccttatctcttcttggaagaccctctcaccccaggactcagtgaggcccctgctctgtgctctgcattgtcttttagttgctgtccttgtctgactcctcaccagagcctgaacccattgaggcagggcctccatctcagt

SEQ ID NO: 24873 - DNA, 601 bp, Human
tcctcaccctcaggtgtttgcgtttgctgtcctcgagtcctcatgttcttcttcctgttgagctcccttacctatggaactcctcctcctccctggggcctcctgttggccttatctcttcttggaagaccctctcaccccaggactcagtgaggcccctgctctgtgctctgcattgtcttttagttgctgtccttgtctgactcctcaccagagcctgaacccattgaggcagggcctccatctcagtcgtcattaaatctctgaatctagctcaaggcctggcacttggctggcagayaaacgaatgaatgatccgtcccggcttgcctcagcaggcagcacccaccagccctctccatgggggctcatgggagccccgaggggctgccatcagccctgggagaggtccagagtctgaaggaaggtctgcccttcttcccctcagggatcaactactgtgcactgaacaaaccgggctgtgagcatgagtgcgtcaacatggaggagagctactactgccgctgccaccgtggctacactctggaccccaatggcaaaacctgcagccgtgagtgtaccctaggggtggggtgctgat

SEQ ID NO: 24874 - DNA, 601 bp, Human
tatgaggcaccatctccacaggtcctggccagcaggataggagcgcctgagtgtggtgatggaccctatgcccttggcatgcgggagagggggcccatctccatgacatggcctatgcagaaggggccctttatgtgcctttccactcagcaagccccacatctgctccctttggagaaagagatagattgtgagtgaggacagtgcagctgttgagccctgggctccacgctgccagcagggaagtttcccagatgaaataagaggtccagggcagtcctcaggaaagcgtggctcctcyagtgtccagagagaacaaagtgcccggtaaaggctttctaaggactgatctcagaggccaaagggcttttgaactggaaagtggtgccaaagtcagtgcctgctgtacgttgcctctgcatgtctctgagtccttttgagaggccagcgggaagcgggtctcccattcaacaggagatgccctggtgaccatggatctgtgtgtatcctgcctgtttcccggagtgtcaggtctgccagctgatggccctggcaattttcccagggcaggtggtcctgacctggctgagcccacgcagat

SEQ ID NO: 24875 - DNA, 601 bp, Human
agccccacatctgctccctttggagaaagagatagattgtgagtgaggacagtgcagctgttgagccctgggctccacgctgccagcagggaagtttcccagatgaaataagaggtccagggcagtcctcaggaaagcgtggctcctctagtgtccagagagaacaaagtgcccggtaaaggctttctaaggactgatctcagaggccaaagggcttttgaactggaaagtggtgccaaagtcagtgcctgctgtacgttgcctctgcatgtctctgagtccttttgagaggccagcgggragcgggtctcccattcaacaggagatgccctggtgaccatggatctgtgtgtatcctgcctgtttcccggagtgtcaggtctgccagctgatggccctggcaattttcccagggcaggtggtcctgacctggctgagcccacgcagatcaccagggacatggcttgactgcccctcccagcatgcttccgggggccagaagagctctaagaacggaccacaagagatcgggaccctcccttctctctgggatctagtcaactctaagaaagtacaaaccaagctgtttctgtctcgcagt

SEQ ID NO: 24876 - DNA, 601 bp, Human
tgagccctgggctccacgctgccagcagggaagtttcccagatgaaataagaggtccagggcagtcctcaggaaagcgtggctcctctagtgtccagagagaacaaagtgcccggtaaaggctttctaaggactgatctcagaggccaaagggcttttgaactggaaagtggtgccaaagtcagtgcctgctgtacgttgcctctgcatgtctctgagtccttttgagaggccagcgggaagcgggtctcccattcaacaggagatgccctggtgaccatggatctgtgtgtatcctgcckgtttcccggagtgtcaggtctgccagctgatggccctggcaattttcccagggcaggtggtcctgacctggctgagcccacgcagatcaccagggacatggcttgactgcccctcccagcatgcttccgggggccagaagagctctaagaacggaccacaagagatcgggaccctcccttctctctgggatctagtcaactctaagaaagtacaaaccaagctgtttctgtctcgcagtccttagagaaagccacaggcttctgctttctcagaggaatcagggagcccaggccataaag

SEQ ID NO: 24877 - DNA, 601 bp, Human
cagggcagtcctcaggaaagcgtggctcctctagtgtccagagagaacaaagtgcccggtaaaggctttctaaggactgatctcagaggccaaagggcttttgaactggaaagtggtgccaaagtcagtgcctgctgtacgttgcctctgcatgtctctgagtccttttgagaggccagcgggaagcgggtctcccattcaacaggagatgccctggtgaccatggatctgtgtgtatcctgcctgtttcccggagtgtcaggtctgccagctgatggccctggcaattttcccagggcargtggtcctgacctggctgagcccacgcagatcaccagggacatggcttgactgcccctcccagcatgcttccgggggccagaagagctctaagaacggaccacaagagatcgggaccctcccttctctctgggatctagtcaactctaagaaagtacaaaccaagctgtttctgtctcgcagtccttagagaaagccacaggcttctgctttctcagaggaatcagggagcccaggccataaagacagcaagcaattctgaggcgctcactctgtgcaggcaatgccctgagcacttccc

SEQ ID NO: 24878 - DNA, 601 bp, Human
aggaaacgatggcaaagaggccgtgggactgcccagcatccatagctaggaagtggcagaggtgtgatttgaacccaggtagtttgatgccagaacctgcattctaagcactactctattagctgtgtggctttgatcttgaccttcctgagcctcactttcctctctgtgaaatgggaattgcacctgctctcagaggtgccctgagactgtggattctgtgcgccatggccctggcagagtgctgctgtcgtcaacaccagggacagcattccccagccattggagttgtatgctttamccttcaaagaaagaaatgggaaagaaggctgggcatggtgtcaggcacctgtaaccccagctagctactctggaggctggggcaggagaatcgcttgaatccaggaggtggaggttgcagtgagccgagatctcgccactgcactccagcctgggtgaaaagggaaagaaaaccaacaagccaggctgattttctagagggatcagtgatgtggggtagaatgacaccttccctgtggcttgttatgcctccggttttgtttttgaatcttggttgctggtggggtattgccccctcggc

SEQ ID NO: 24879 - DNA, 601 bp, Human
catgacggtcacttgatccaatcactgtcgcccagaggtctcactgataaagggctgcctggcttttggttttgcaggggtggattactgcctgctgagtgaccatggttgtgaatactcctgtgtcaacatggacagatcctttgcctgtcagtgtcctgagggacacgtgctccgcagcgatgggaagacgtgtgcaagtaagtgtctgaaggacaagcaggacctgcacaggtgttccgtgggtgccggtgtgggtgcgctgccgacgtgtatatgtgcctgtgtgtcctgtctccargctttgctgggcctgcatgaatgtgtgtgacagcatctcttagccattgagccttggtggctgcttcaccaactcccctcaatcttccttcccccgtgccctgaagtggctttttgctgtttccacctccctgtcattctgaagctggacagagcccttgtcctcagctctctctgctctacccccagccagctagtatggcacatgaataataataatgtggacccctcactgactgctagctgcatgctgggcactgtgctaagcacacatgctgttgcattcaggggacagatgagg

SEQ ID NO: 24880 - DNA, 601 bp, Human
tggttatagggccaagttccctgaccactggtataattgtaggcacaacctaatttatccactttttatatcatctattcatctaggcagatgagctggctgcacagctgggcgtgcctctctatgctgcctgtgagaaaatatttccagtttgggacagatccttggatcttagcaaatgggttatccatgttatagctttcggtggctccctgcccagctgcctcccagactgctgctgcagccagctcagggagggatcgggcacagggggtgcagaaagagggtgggtgtgttgaaytgcatcgacattgacagcatgccaaagccagatgtaaggggtttgttggtttgtttaattctccatcattttagattattctgagaataagaggagtcattcttctgtccacctcgttcctgtaataatcaagaactgactacaagatggttgtaggaccctacgaaattctcatgagcccttctaaacaaatgcagctccatctcctttgaatcaggtgccccttcctctcccctgcccaggtccacatctggattttgacctgaccacttttaagtgttgcccattttctcatttaaa

SEQ ID NO: 24881 - DNA, 601 bp, Human
ctccagccccctgaccgcaagctctgctttcccagattttccccagaggcctttttgcctcgggcagttagatgcacagactcagggtgtggggggtcggggaggggatggggcgatctcttttaccagctgcagctgagcagactccttccctctctagacgtttccctgagattgaccttgtgcaagggcatcccagcaccaagaaagactctataggcctgatgtgcatggaccacactgcccactggcctgcaagctgctggaggttggaggtcagaggccaacatgaaatgactgrgagcgtgaatggacagaggccacctgtctttttgccccacggcccctggcacagggtccgctccccgcttgataaccttcagtggctctccactgtctcccagaataaatttccattgcactccttgatttggcagagtgcagaaccccctcttccacttctttagcctcaccccaggccctccctgaagccgcctcctgttctttagccaaagtggcaagtcccccattctctgaacaggcctggtgccttccagcccatcccaatgtcacccccatgggtaacctcctctcccacctg

SEQ ID NO: 24882 - DNA, 601 bp, Human
tttctttctcacagttctggaggctggaagtccaggatccaggtgctggcatggctgggttctggtgagggccctcttcttggtttgcagacagccagcacccagctgtgtcctcatattgcatgggttgtagggggtgagagagcaaaagagtgcaggcaagttctctggtgtctcttcttataagaacactaatcctatcaggtcaggatcctgccctcacaaccccatctaaacctaattacctcccaaagactccacctctgaataccctcacatcagggttagggattcagatgtraattttgggggaaacagtctgtagcagggagtagggggaggggaccaccctcactctcatgtattcacattacaggcttgatgcaacagaaggaaactagagattttcccttattttgtgggaaacggacacatggaggaaagtgatgcctccaagctggccctggtcggggagtcagtggcagagccaggaccagagccgagtcccctgattttaggatcttttgcccagtgtgagatgccctggaaaagcacatctcagttcagctgcttcttggtttgtctgagaaaaagcctatat

SEQ ID NO: 24883 - DNA, 601 bp, Human
tgtttaaagcttctcggggaagaaggatagcagagacagcgtccattccttatggtgagagtggtgatgtgagaaggatggagccgtgggagcaccccctagtctagagaaagagaagtttaatccaacacccagaggagggggctgtgggagcctcccctagtctagagaaagatgtttaatccgacacccagagagtgagtacagtgagccagccagagatggaggggaaatgcttcactaggggccagagagcgaactgcaggaagttctgtgctctgagtacggggtactgaatgcragagggaggcggtgggtgagaaacgagcctggggacgccggcgggacacatcacccacctacagccttcagagacttcctggctggcctctcttgagaaaatgatttttgtctagtttgtcttctgagaatctgccaggctgcctcagcacactcccttaagctaggatgatctgtggatgtgcagctggaccagggacacggaggtctatttgaatatagtcccatctctgcccccaggacagctaagaccagtcacctctgaaggttcagggacattgggaaagtcacttcccctctg

SEQ ID NO: 24884 - DNA, 601 bp, Human
ccaaacaaggatattgcctggctcagataagtgctccgtaaacacttgctgaatgaatggacttactgtggtgcccaccatagtctcccaggctgaagacacccagtggtactgagtcaggggtggtggctctgtttgcctgttaggggaccactgaagcattttcctataggggagtatctttgccctgggtagaaactgactccaagttggtttccagacttggtggatagaaagctagcgcctatggtcaggaggttaactatcatccacctttggcattctctaatttcccatccayggttctttgaatttataagtggcccagaacatccctgaagggcagaaactggacattttgctgaacaaatgtgagtcgtgcattttgcaaggtgggtgtgtgggagagagtgggaagcctagctggccacaaacatccacacatcccatggggttcttatttaaaacatctgcacaaaacccctgtgaggtggatctaattaccctcaattttcagaatagcaaactgaggaaatgtttccttttgttcaacaggtctttcctagggatctgttaggtgccaggcattatggccactgcc

SEQ ID NO: 24885 - DNA, 601 bp, Human
ctccagcccagtagccactctccatccttctatcctgctcttcctccatagcactttttcccacatgacatatcacatatttgtctgttttccacgcatccctcttctcctgacacctgctgccaaatgtaagcttcacaaaagcagaaactttgtttcgttcattgctatatccccagagtctaaaacagtgcctggctcattgcagggactcacaaaatatttgtgaactgactgaatacatgaatgaattggttacctaagtgtaatatatacatacatacataagtagatatgtaartaagttgatattatagttacataatagccagttaggttaatcttattttctaatatttacaagtaatttatctctcattctgtaacttgtattctcatgttttttgttcatttttcttgtggagatgatttatattgtttgatttttatgtgccatgtgtatattaagaatttttgctcactttgggagtccgaggtgggtggattgcttgagcccaggaattcgagaccagcctgggcaacatggtgaaatcccgtctccacaaaaaattagcctggtgtggtggtgcacgcttgtagt

SEQ ID NO: 24886 - DNA, 601 bp, Human
taaagtcctcctttattaccactgtcacaagtgtcagttcctgccttgggtgctctgaaagtgtttagctagagatcagttcagtagccccttgctttttcgggaatttctcagtcaaggcctgagttttgggttctttgcttctcttcattttctgccagccatcagccctttccacagtagctgtgtgggtgcccggaaactcgcacagtgctagtcactggactgaattagaacctctgccagcaatcactacaaggactgaaggttaattacagagctttctcctcttggcagaccrtaaaagtaagggcaaagggtgaaagggtgtattcgtccattttcacactgccgataaagacatacccgagactgggcaatttacaaaagaaagaggtttgatggactcacagttccacttggctggagaggcctcaaaatcatggcagaaggtgacgggcacatctcacatggtggcagacaagagaagagaacttgtgcagggaaaccccctttataaaaccatcagatcttgtggagacttattcacaatcagaatagcacaggaaagccccgtccccatgattcaattacctcccac

SEQ ID NO: 24887 - DNA, 601 bp, Human
tttctgcaaacatctgcacactcacacacacactgtttattcattcaacacatttattgctcagtaaattgaacacaaggtacaacttctacctctggaatttgatcctaaatcagatttcaccattcctgcttcctagagggatgtgttctcactgattccaattttgtgtgaagcctctccttttaaggggtaatgacaggaaagagccataggctctcatgctatggaggagcactcgggagacagctgtgtcatcaacctgccagatgaccgtgggcagcagtgaagctctctgagkatctaattcttcattgataccttgagaataattatccctgtcttccttgtctcacagggtgttgtgagggttaaagggctgtaagtacttcgaagagtttaaattacctcacacatgagaaatgttcattagacaatctgaactggagtgtttgggatgtctgtggcaaaagaaattagaagctaaagcacatctaataataggatagtaagtcaaggacacctaatcacccatcgtaccattcagactcatgggagctagagctttctgagaggagctttttccccatcctgagtatga

SEQ ID NO: 24888 - DNA, 601 bp, Human
ggatgtctgtggcaaaagaaattagaagctaaagcacatctaataataggatagtaagtcaaggacacctaatcacccatcgtaccattcagactcatgggagctagagctttctgagaggagctttttccccatcctgagtatgagactgcaaaagacattatgaaggaggtttgaagagaggtgtgttttctttaaaagagattacttccacaatctctactcacatgactattcaattcacctcatttctacactgatgggattgttcaactccctacattttcctcagggaaggatrtctgcaaatcaacccaccatggctgcgaacacatttgtgttaataatgggaattcctacatctgcaaatgctcagagggatttgttctagctgaggacggaagacggtgcaagagtaagtgatctgaacttggctctctgctttaattttgttttggagcaactgctttttggagtattttcaggcaacaaatccctcacctctgcttctcccataaatataaatgcatatgcacaaatacagaatggggaagagagggcttaactgcagcacctgtgaaaacactttcggttttaattg

SEQ ID NO: 24889 - DNA, 601 bp, Human
tgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtaatatggggtggaggtgcggtttacaccactcaaggttcaggtttcttaaactcactcagtggtctcagctggccataagggtaagcttctttgmgtgtacagaaaggcctcctggcaactgccattatacatctttactaccctgccacctagaagccttaacaggaccccacaggagttaaataaagtgctcaggaaggagtctggctactagaagggtaggctaagctgaccacaggcgggtatcctctcactgtgatttactagccagtgtgtgatctccagtgtaagaatcgcctagatatacacaatagttccgaaacactggtcggcttgctctagaatcaactgaagactttgttaaattgtttctgatgggaacttttactgtgta

SEQ ID NO: 24890 - DNA, 601 bp, Human
aagtacatttttaagaatctagtctaataaattagctagaataagttatcagtgctgaaaaatgtttggactccagcagaacatattcttattgtgttttactttcaaatgaagagtatataggggaagggagtctaaggattgagtaagaaaagcttttaaagcaaacgcatatccctgttgaaatttaaggctgatcttgggtttgttctttttcctgactttaggggtttccaatggtctgtagattatccttttcagcttagcacttcctcacaaagttgtgtcatcttagcagaartgggcaaaaagcagcttcacttggcctcaggtcacttacgtttcctaccctgtagctttgagtagaaactaggttattaggtcataaattgacttgattcttagaattcttccagaagagattcccatttagcaagccataaaatagggctcatttctatgaatccagaaggctaattcagggggaagttgcagatttgttaaatggcccagcccagggctgagcaacaggttagtagtttagttccccagcgtctcccagatgcctcacttctctcttggatccctcccttttgttcat

SEQ ID NO: 24891 - DNA, 601 bp, Human
ccaccgtgtccggccagcatgaacctttagtgataaattctcaaccaaaaaaaagtgtctccttcatgggcagggccagcaatgcctagaaacagtacaaaaagaagggctgggcaccatggttcccacctgtaacccaaccattttgggaggctgcggtgggaggattgctcgagcccaggagttcgagaccagtttaggcaacaaagtgaaaccctgtctctgaaaaaaaatttaacaattagctaggcatgatggcacacacctgtagtctcagctacttgggagactgagcggggakgatcgtttgagccctggaggtcacggcttcagtgagccatgattgcgccactgcactccaacctgggtgacaaagcaagaccctgtctcaaaaaaagaaaaaaaaaaggtgggggaaacaggggaggtgggaaagaaaaaagtaatagctaccattgtttgcgcccttgctctgtgccaagcagtataataagtgttttgacacaccagcatgcttcatcctcacaaacaccctagagaaatgatcatttaactaaaaatcaatcattatataaatcaggagagctgaagtgcaatttca

SEQ ID NO: 24892 - DNA, 601 bp, Human
cgagaccagtttaggcaacaaagtgaaaccctgtctctgaaaaaaaatttaacaattagctaggcatgatggcacacacctgtagtctcagctacttgggagactgagcggggaggatcgtttgagccctggaggtcacggcttcagtgagccatgattgcgccactgcactccaacctgggtgacaaagcaagaccctgtctcaaaaaaagaaaaaaaaaaggtgggggaaacaggggaggtgggaaagaaaaaagtaatagctaccattgtttgcgcccttgctctgtgccaagcagtmtaataagtgttttgacacaccagcatgcttcatcctcacaaacaccctagagaaatgatcatttaactaaaaatcaatcattatataaatcaggagagctgaagtgcaatttcagaatatacctataattggagtggaaaggggcgtacctagttcttccaagcccactgttaaaattaatgcctttctgcatggactacttgtttacagaatatcagactgccctttagacttcagattttgttatgcatgcttttctccagtttactaactgtgccagatatgcttacagatagcagt

SEQ ID NO: 24893 - DNA, 601 bp, Human
ctagaagactccgatggaagacaggactctccagcaggggaactgccaaaaacggtccaacagccaacaggtacagtttttaaggcagtgtttttagaaattttggtggagggaaccatggtttccctccagataaaagctgtaaagaagtgaatgtaagtatgttcaaattatgataatgaaggccttttttccctcaaaaagatagttaacatttactcttacattaagccatatttggtaactagcatcgtttcaggtgacagtgtttttttgtttttgtttttgttgttgttgtttytttgagacagtttcattctgttgcccaggctggagtgcagtggtacgatttcagctcactgcaacctccacctcctgggctcaagtgattctcctgccccagcctcccgagtagctggaattacaggcacccaccaccatgcccagctaatttttgtatttttagtagagacggggttttaccatgttggccaggctggtcttgaactcctgacctcaagcgatccacccaccttggcctcccaaagtgctgggattacagacatgagccactgtgcccggctgtttttgtttttttttt

SEQ ID NO: 24894 - DNA, 601 bp, Human
tgtttttttgagacagtttcattctgttgcccaggctggagtgcagtggtacgatttcagctcactgcaacctccacctcctgggctcaagtgattctcctgccccagcctcccgagtagctggaattacaggcacccaccaccatgcccagctaatttttgtatttttagtagagacggggttttaccatgttggccaggctggtcttgaactcctgacctcaagcgatccacccaccttggcctcccaaagtgctgggattacagacatgagccactgtgcccggctgtttttgttttkttttttgttgttgttgttttttgtttttttaataaagatgtttactccactgaagataacagtctttttgcttcagtatgtcccaaagtaaagctctgtaccaagtgctaggaataccaagtaccttactctgctgatggctgttttataaccaaaagcgttaagcaggtttgattgcagttttctttctctttacagaatctgagccagtcaccataaatatccaagacctactttcctgttctaattttgcagtgcaacacagatatctgtttgaagaagacaatcttttacggtcta

SEQ ID NO: 24895 - DNA, 601 bp, Human
ccaaagtaaagctctgtaccaagtgctaggaataccaagtaccttactctgctgatggctgttttataaccaaaagcgttaagcaggtttgattgcagttttctttctctttacagaatctgagccagtcaccataaatatccaagacctactttcctgttctaattttgcagtgcaacacagatatctgtttgaagaagacaatcttttacggtctacacaaaagctttcccattcaacaaaaccttcaggtaattccaagtaaaatattactataagataacttgatctcagcctttcrgcttgccaacaaccttagctttaaggaggaaaggaaagaaggaagtaggaaatagtatagaggaaaagagaagaaagaatttaagtaaaatgagaactaaaacataaactaaaagaaactcaagtagtgttcctcagtaatccacagtaagggccacttccagtgttggaagcatatacagtgctttcctggtatttactggatctggctgcatggaaaaagtggaacatgtctttcattatggtttcctccatatgctgattcattcctattattatgcgtctgggaagtctggtggat

SEQ ID NO: 24896 - DNA, 601 bp, Human
ggaacatgtctttcattatggtttcctccatatgctgattcattcctattattatgcgtctgggaagtctggtggattctagaggtgaacactttccatctgctttctcaggaagccctttggaagaaaaacacgatcaatgcaaatgtgaaaaccttataatgttccagaaccttgcaaacgaagaagtaagaaaattaacacagcgctatatccttttcttgcattatgcttctgtatggaatgcaaagaatattatcaaaacttcacacactctatgtaggttttatcaactgaagtmaatcccacgaagtcacaaagaacagtgatctccaggaaaggctttttgctttaaaaagcagcctcacaggtgtttgagaggcaagggcaagccaagcttattagcagcagtcaagcacttagttgccatcggctgttctcgggggcttagcaataaggcctgtcagtcagcatacaaagtaaggaaaaaagagacactggcctaactccgtctctgctaggaaggtgtgtaggacatgatgaggtctgaagtgcatcaaaggtacggtaagtatagacaaagaatgttgtagaatgaaga

SEQ ID NO: 24897 - DNA, 601 bp, Human
aacaacagcatagggcaattccatttctgaaagctggaaatacgctcccttaagtaaaatgaaataatctttctgagtggttaattgacgaatatgggctctcattctgccctcaagagggcagatagagggtactgaggagcttacagggaagaccaatacctattctaatgcccttttcttctcgcttgcctgtcccaccccaaagttctactcacaagagactaaagaagacatatttttacataggtcagaattcctcaaaaccgtggccttatgtagcatcatggtgaaaactccstatcgccctttgcttctgacttcatatcttactttccaaggccgaattctttcattgtcttctcttcaccagattcccaacattatcaattctggctcctagaagtgtgctatggcaaactaatttgcaagcattaagggtggaagtggaatcacaattaaaaaaaaaaaaaaaaagactgcagctgggtgctgtggctcacacctgtaatcctagcactttgggaggccgaggtggccttgcttgagcttaggagttcgagatcagcctgggcaacatactgaggccttgtctcttaaa

SEQ ID NO: 24898 - DNA, 601 bp, Human
catatcttactttccaaggccgaattctttcattgtcttctcttcaccagattcccaacattatcaattctggctcctagaagtgtgctatggcaaactaatttgcaagcattaagggtggaagtggaatcacaattaaaaaaaaaaaaaaaaagactgcagctgggtgctgtggctcacacctgtaatcctagcactttgggaggccgaggtggccttgcttgagcttaggagttcgagatcagcctgggcaacatactgaggccttgtctcttaaaaaataataaataaaataaggccrggcacggtggctcacgtctgtaatcccagcactttgggaggccgaggcaggcagatcacctgaggtggggagttcgagaccagcctggccaacatggagaaaccccacctctactaaaaatacaaaattagctgggcgtggtggcgcatgcctgtaatcccagctactcgggaggctgaggcaggagaatcgcttgaacccaggaggcggaggttgcagtgagccaagatcgcgccattgcactccaacctgggcaacaagagcgaaactctgtctcaaaaaaagagaaaaaaaacaaaa

SEQ ID NO: 24899 - DNA, 601 bp, Human
cttactttccaaggccgaattctttcattgtcttctcttcaccagattcccaacattatcaattctggctcctagaagtgtgctatggcaaactaatttgcaagcattaagggtggaagtggaatcacaattaaaaaaaaaaaaaaaaagactgcagctgggtgctgtggctcacacctgtaatcctagcactttgggaggccgaggtggccttgcttgagcttaggagttcgagatcagcctgggcaacatactgaggccttgtctcttaaaaaataataaataaaataaggccgggcayggtggctcacgtctgtaatcccagcactttgggaggccgaggcaggcagatcacctgaggtggggagttcgagaccagcctggccaacatggagaaaccccacctctactaaaaatacaaaattagctgggcgtggtggcgcatgcctgtaatcccagctactcgggaggctgaggcaggagaatcgcttgaacccaggaggcggaggttgcagtgagccaagatcgcgccattgcactccaacctgggcaacaagagcgaaactctgtctcaaaaaaagagaaaaaaaacaaaaataaa

SEQ ID NO: 24900 - DNA, 601 bp, Human
catacttgacagaaatgggaaaaaaaaccaaaaccttttagatttcagaagccaaaattttacgtggataaatcaagttatatttaaatgtaaataaaaatagacaattcttcatcttccttaatttgagatttactagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaraacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtattggactttaccttgatatat

SEQ ID NO: 24901 - DNA, 601 bp, Human
atcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtaytggactttaccttgatatatgtatatggatgtatgcataaaatcataggacatatgtacttgtggaacaagttggattttttatacaatattaaaattcaccacttcagagaatggtattcagtgcaaaaattcttagtttaactttaaatggaagatatgtatgtatgagaaatggccaacatgcctatgaaaaaaatgctgaatctcatcagtaatcaggaaaatgcaggttaaaacaataccatttttcacccatcagcttagcaaaaatgagtatattttttaacaagtgttggta

SEQ ID NO: 24902 - DNA, 601 bp, Human
tgatgggtgcagcaaaccaccagcgcacatgtatccctatgtaacaaacctgcacattctgcacatgtatcccagaacttaaagtaaaataataataattttttaaaaagatctgaataggaaacatttgtcatctattgtctctaagggtagccactataagacttcaaaagaacattggtctttacagtcttttatcttaacctgaacatttcctttctatggatcccaggtctttaggcaaatgcaaccaattatcaaccagaaaatatttaaacttacctatagcctggaagccccycaccaccaccggctttgagttgtcccaccttttaggaccaaaccaatgtatttcttaaatgtatttgattgatgtctcatacctccttaaattgtataaaaacaagctgcaccctgaccatcttgagcacatgtactcaggacctcttgagggctgtgtcacagaccatggtcactcatgtttgtctcagaataaatctcttcaaatactaaaaaaaaaaaaaaaaaaacctccagaattttacttcattcctggaaagtcccatagatctagagctaggaagaagaattatgttgaaaa

SEQ ID NO: 24903 - DNA, 601 bp, Human
ccaggcgcagtggctcacgcctgtaatcccaacacttcgagaggctgagggagaaggatcacttgagctccggagttctagaccagcctgggcaacatagggagacctcatctctataaaaagtttaaaaattagccaggcatggtggcaggcacctgtagtcccagctgcttagggggctgaggcaggaggatcgcttaaagctagagagtcaaggctgcagtgagccacaatcacaccactgcactccagcctggatgatagaatgagacccagtctctaaaagccaaaaaaaaaaaamaggaatcaaaattctttctttctttaaaaaaaaaaaaaacaactccagcagccataaaaaagaatgagtccatgtcctttgcagggacatggatgaagctggaagccgtcattctcagcaaactgacacaggaacagaaaaccagacaccacatgttctcactcataagtgggagttgaacaatgagaactcatggacatagggaggggaacatcacacaccagcgcctgtcagggggtggggggcaagaggagggagagcattaggacaaatacctaatctatgtggggcttaaaacct

SEQ ID NO: 24904 - DNA, 601 bp, Human
cactcaaggctctttcctttcctaataaggaggcagaagttgatgctactctaggaaggtaatacttagtaggaaaaaaaggtgattcaaaattaatgcctagactaagcagtttatagaaaaaaattaaagccttacctggaacagcctaccttatgtctctgtctagttttcttttaaaagcagaaaattatcttcttgtttttagcctgctgcttggaggtatttaattaacaaaaagaaaatcttcctttcagtaacactttaggaatcgcaaggtaccaacacatcaacctgtgargctggaggtgcagaggtggtttttatattcattttacaggtgagaaacctgaggttcaaggaggtgtgagaactagaaagtggtagagcatggattggactccaggtttcctgactcccagtccctgggagcttgctactgaatcccagttacctctctctgaggcaacattttcctccacaaaaatcaacattctctcatgtattcagtaaacatcctgcttgttgactttaagtcaccgccctgaaatatgctgtatgtcatgcatttagttaagtcaaaaggaattaaacccaggcg

SEQ ID NO: 24905 - DNA, 601 bp, Human
cccataggtctccacgtagaaaacatgctcctctaggggctcactggccatcatcttgagggacgccatgtctgcccggtccacgcccacagcatagagctcaataccagatgcttgggcccgagccgccacctcattcacctggtcctggggcctcccatctgtaacaatgatggccaccttagggatgttagaagagggctctcgagcccctgcctccactgtgaaggcttcgtccattgctgtctggatggctaggcctgacatggtgcctgttgacaagggtgtgattcgacccacrgcctgcttcagggactgcttatctgtgtaggcctggagttggaactcgatcttcacagtgctagcatagttcaccactgccacccgcgtgtcggctggcccaatgtccagagtgtcgattatccgggagacaaaagttttcactttggtgaattccaggggccgtacgctacgagaactatcaatgataaacaccaggtccaagggtctgctcttgcaaacacctgcaaaagaccaagcaatgatcagaccacaattagaaatgcagtaatcctcacttccagagaactctgggattcca

SEQ ID NO: 24906 - DNA, 601 bp, Human
cgcattggatatatttaagtttttcattaaatttccaccaaaaaagaataatactcttttctctgggtacacaatgtctgaatataacatcctttctagttggaagcaaagactgaccaacttaccacagaaggtttcctggaatctagaggaaagtttctcaatgaccccataggtctccacgtagaaaacatgctcctctaggggctcactggccatcatcttgagggacgccatgtctgcccggtccacgcccacagcatagagctcaataccagatgcttgggcccgagccgccacytcattcacctggtcctggggcctcccatctgtaacaatgatggccaccttagggatgttagaagagggctctcgagcccctgcctccactgtgaaggcttcgtccattgctgtctggatggctaggcctgacatggtgcctgttgacaagggtgtgattcgacccacggcctgcttcagggactgcttatctgtgtaggcctggagttggaactcgatcttcacagtgctagcatagttcaccactgccacccgcgtgtcggctggcccaatgtccagagtgtcgattatccgggagaca

SEQ ID NO: 24907 - DNA, 601 bp, Human
gtatcaggggaaaaaaatgtagtggtggggcagaggggacaggagaggcatcttgagttttgtttttcctgaccctgacagggaacagcagggtcatttatcctggatatttgcagaccttcacagttctaacgcaaacatgaagattttatgagcaaaccaagttccatataatgcagctctatattcctaaaccaatagagtgtgtttaggttggtcgcacacacgcgcgcatgcacacgtgcacacacacacacgcattggatatatttaagtttttcattaaatttccaccaaaaaggaataatactcttttctctgggtacacaatgtctgaatataacatcctttctagttggaagcaaagactgaccaacttaccacagaaggtttcctggaatctagaggaaagtttctcaatgaccccataggtctccacgtagaaaacatgctcctctaggggctcactggccatcatcttgagggacgccatgtctgcccggtccacgcccacagcatagagctcaataccagatgcttgggcccgagccgccacctcattcacctggtcctggggcctcccatctgtaacaatgatggc

SEQ ID NO: 24908 - DNA, 601 bp, Human
aatatgtatcaggggaaaaaaatgtagtggtggggcagaggggacaggagaggcatcttgagttttgtttttcctgaccctgacagggaacagcagggtcatttatcctggatatttgcagaccttcacagttctaacgcaaacatgaagattttatgagcaaaccaagttccatataatgcagctctatattcctaaaccaatagagtgtgtttaggttggtcgcacacacgcgcgcatgcacacgtgcacacacacacacgcattggatatatttaagtttttcattaaatttccaccaaaaaagaataatactcttttctctgggtacacaatgtctgaatataacatcctttctagttggaagcaaagactgaccaacttaccacagaaggtttcctggaatctagaggaaagtttctcaatgaccccataggtctccacgtagaaaacatgctcctctaggggctcactggccatcatcttgagggacgccatgtctgcccggtccacgcccacagcatagagctcaataccagatgcttgggcccgagccgccacctcattcacctggtcctggggcctcccatctgtaacaatg

SEQ ID NO: 24909 - DNA, 601 bp, Human
atctgtagtcctagatttggtcaattcatgctaaaaattccaataaaattagcatgtccttattcaaattccatcctaaaggatggaaggagtagcagagttaacagaatgatttcttaagatcatcttgctttctttcaagtgagctgaaaccctaatctgcctggtccctgaatcctgttcttcaacaaagagtaatcagataaacagcccagtctgaaaaccagagcattcactaaatgcacactcgggctgacggtgacattggaatagaggcctgctgactctcccaaggacagaygcttctccctgtcttctgcaggagaacaaacagagttctgttagatctagagatggtaaaactaaaaaaatatgtatcaggggaaaaaaatgtagtggtggggcagaggggacaggagaggcatcttgagttttgtttttcctgaccctgacagggaacagcagggtcatttatcctggatatttgcagaccttcacagttctaacgcaaacatgaagattttatgagcaaaccaagttccatataatgcagctctatattcctaaaccaatagagtgtgtttaggttggtcgcacacac

SEQ ID NO: 24910 - DNA, 601 bp, Human
tttcacattaacctagattaaaagtctccttgaaatgtataattgtaattaattattggttcatttgtttgtctcacccccacccccagaatgttacttaatggtatggagggattacctttatctttgtatcatcagagatcaataaatgcatgctgaataaataagtgtgaaataaattatattgcaaaaagatatctatgtttaaaaattcacctgaactagaaatttgtccacaactgcttggatattcacatagagggaacaaaagattatctccagatgataaaaaaataaagcmtgagtcccacagatcataattctgatcagtgactaaaattaaactccagcattgaatggatctgtagtcctagatttggtcaattcatgctaaaaattccaataaaattagcatgtccttattcaaattccatcctaaaggatggaaggagtagcagagttaacagaatgatttcttaagatcatcttgctttctttcaagtgagctgaaaccctaatctgcctggtccctgaatcctgttcttcaacaaagagtaatcagataaacagcccagtctgaaaaccagagcattcactaaat

SEQ ID NO: 24911 - DNA, 601 bp, Human
atatctcattggatatttttttcctagtgacctcttttgaaagatgaatcaatgaattaagtcatttctgagaaaccaaggaggcctgttgaaggaggctggccctcctgtggcaggtaacccaacctccactgcccttggcaacaggacaaggctaatattttcccaagaagggccttttcatggaatgatctttccaacccgttgactacaacaagctgccgctcagtcttttttccatagagaggacgtttttcccccagaacaagcaggtcttttgtaccagaaggaaaagattgcyactcaccacttgttactttatagccttcgaagcccaaccccaggtgctagctttgaaacccaactttgccacagaccagcatgttgatggagaggctctcacccacaagcatggagtgggagggtgatttcctgggagaaagaaagccactttctttttggaagccaacgaatgccaagtagatgccaccaaagccagtgatggcttgtgaaagcccagtgtcctgggacaggaaagacaaggggatcccagccaagtctgactgcaatgaggccaaacgttgccccagagcaagacttc

SEQ ID NO: 24912 - DNA, 601 bp, Human
actgtcttctgaatatgtaaggtgggtgaagtcatccatacgctaaatccatagtgaactcatatgctaatacaaacaggtaaaaagaaaagaacaaaataaatgagattacattagctaaactacatctccatcttattgctcctggagccatttatatctcattggatatttttttcctagtgacctcttttgaaagatgaatcaatgaattaagtcatttctgagaaaccaaggaggcctgttgaaggaggctggccctcctgtggcaggtaacccaacctccactgcccttggcaayaggacaaggctaatattttcccaagaagggccttttcatggaatgatctttccaacccgttgactacaacaagctgccgctcagtcttttttccatagagaggacgtttttcccccagaacaagcaggtcttttgtaccagaaggaaaagattgccactcaccacttgttactttatagccttcgaagcccaaccccaggtgctagctttgaaacccaactttgccacagaccagcatgttgatggagaggctctcacccacaagcatggagtgggagggtgatttcctgggagaaagaa

SEQ ID NO: 24913 - DNA, 601 bp, Human
actataaaaaaatggttatttgttttctgcctctggcttattagcaatgctactcttaaactagaaattgttgctaatttaaaagtacacatcttgctatatagactttctcaagggagaaagggaatttggagtttggagctgaagccaaacacttacataggccaggcaattggatgttttatttggcttatccgcctccccatgaaaaaaagatttgtgcttccccaccacaagaaatgggagaacaataaatgcacagcctgaagtgacgtgagctagttgtcccattgtagccagaatctgatttccaaggttctatagcctatgtctaaacagaattctcacacaagtctgggtctaagcctagaacgaactcacaggtgggcagtggtacatatttgaacatgcaaatggtagaggacagttcgggtaactgtcttctgaatatgtaaggtgggtgaagtcatccatacgctaaatccatagtgaactcatatgctaatacaaacaggtaaaaagaaaagaacaaaataaatgagattacattagctaaactacatctccatcttattgctcctggagccatttatatctcatt

SEQ ID NO: 24914 - DNA, 601 bp, Human
tgggaattataggcatgagctactgcactcagcctggacctctttcttagtagccttttctcctacgattttatttaaaacttacaaagtatggaaataagctgatttatctatcatttcacttttctccctaagctccttttcagggaaaactgctgatgaacaccagtaaaccagccaaaaggcagttaggtaaaaaggggtcagagagtcaaagcacaaggccagtccaaaacctggagcataggttcccaagtatttgattcagtcacggccccctacacaggcctcacctgaacaygttttcttgtcggcattcaaggtgtatccttggctacactcacagtggtgcttgccttccccatcactgatgcagacgtgctggcactggtgtgttccaagcacacaggggtccagcgctgtgagaggaagtttacaacagtcagcactgacacttaggaaacatctcagataccgtctcccatgtcaatagacattgctctctgggctcctttccgagtccatctttacttcactataaaaaaatggttatttgttttctgcctctggcttattagcaatgctactcttaaactagaaa

SEQ ID NO: 24915 - DNA, 601 bp, Human
ccaccacacctggctttttttttttaattattttttgtagagatggggtctcaccatgttctcgaggctaatctcgaattagcctcaaactatcctaccatctcagcctcccaaaatgtgggaattataggcatgagctactgcactcagcctggacctctttcttagtagccttttctcctacgattttatttaaaacttacaaagtatggaaataagctgatttatctatcatttcacttttctccctaagctccttttcagggaaaactgctgatgaacaccagtaaaccagccaaarggcagttaggtaaaaaggggtcagagagtcaaagcacaaggccagtccaaaacctggagcataggttcccaagtatttgattcagtcacggccccctacacaggcctcacctgaacacgttttcttgtcggcattcaaggtgtatccttggctacactcacagtggtgcttgccttccccatcactgatgcagacgtgctggcactggtgtgttccaagcacacaggggtccagcgctgtgagaggaagtttacaacagtcagcactgacacttaggaaacatctcagataccgtctccc

SEQ ID NO: 24916 - DNA, 601 bp, Human
ttgactccatgtatgtatctatgtaccagaccagtgagtacccctctaacttctttgctacttctagattccatgagcatctatgactagagaggaagagggtagcttgcatgtaatgaaataaaatccaggaaaattttcaaatcctcaaaagggctaagaatcttggacccgtttcttttcctttttgtgtgtgtgggttctgttttctgaaagaaggtctccctctgtggcagtgcagcagaggcattatcatagctcactgcagcctcgacctcctggtctcaaacaatcctcccayctcggcctcccaagtaactgggactacaggcatgcaccaccacacctggctttttttttttaattattttttgtagagatggggtctcaccatgttctcgaggctaatctcgaattagcctcaaactatcctaccatctcagcctcccaaaatgtgggaattataggcatgagctactgcactcagcctggacctctttcttagtagccttttctcctacgattttatttaaaacttacaaagtatggaaataagctgatttatctatcatttcacttttctccctaagctccttttcag

SEQ ID NO: 24917 - DNA, 601 bp, Human
tccatcaccgggtaggtaggcagagagctaagtagcaatagtaaagactcctccctcacttacctgaacaagttttcctgtcttcattcaaggtataaccttcatagcactcacaatgataagagccacttctgtcattcacacagatgtgctcacatccgtgggtgttaagagcacacctatcaagagctatcaaaagatgattgggacaaatgtaaatgcatgcagagcatggcagaaataattgtgggccacgccacttacagttatacacacacacacacacacacacacacacacggagctaatgaaacaagggaggggcagctgggagttgggaaccaaccctccggtcttggctctttcactaagagaccctgtgacataggtaagttttttcccttctgtccatctcaatttcattatctataaaattaagttatctctaagctttcttcctcccaaaaacttttttctaggattaaaaacaaaacaaaaaaatatataattcccattcctcattgactccatgtatgtatctatgtaccagaccagtgagtacccctctaacttctttgctacttctagattccatgagcat

SEQ ID NO: 24918 - DNA, 601 bp, Human
agtgagctcaccaccctctgagcaatgtgtgccttcatctaaaagtgtgatagaatgtctgaaccttgatcttaagttacctttaaaaacctctttgctggtgagttgcaagttggtttcatgtgaaagacccaagtatgaaagaattttttgagtggatcttacctgaacatgtttttttatctgcattcagagtgtagccctcatagcattcacaatgatgggaccctgttctgtcattcacacaaatgtgctgacacccatgggtacccaaagcacatttatcttgagctgtgaaacaaaaagtcaggagaaaagaaatagaaggtggaaaagtattttattacccaggatagaaaccttatttgcagctggaaacatatgaggaaaacttactggaaactattcaaagccattggcactgtttttttctaactagaagttaactgagttaagtgaaatcctgcacatacaataattattctctgaccttccacaattgcttttggaaatcatcagtattgagtttttataacctaagtatctcataaatactttctagcattccttttaggcttattgtacttatcccaactcagcg

SEQ ID NO: 24919 - DNA, 601 bp, Human
cagctcaagccagtcccccgccagtgccactttccacttgtctccattgaaaccttcaccctccttcaaggcccaccaccagcccttcgcagatgcccacctccccagcctctacagccctttgtttccatcagtccctctccctggctcagtctctgctttcataaggagccggctctctgttcacccagatttaacttgctcagaggcagaaacttaggcttctttgtatgctcccaatgcttagttccatactgggaacaaagtaggtgtccggtatttttttactggtttccctttaaaaaaaaaaaaaaaaaaaaaaaagaggggactgggtgacatgccatttccctttgtctatcttgatgaagtctgtatgtcctcaagggagaggaaaatatatgtcaaatctaaaacacattcaatatgccaaagctaaacggcaccttgagagcttggaatttctctcaggagtgtttttacatttataaatgccaccctgtcctgccagtaagtttaaatcaaattaatgaggattaacagcactggcctgggctcattggccaacgtataaggctgagtttcaccaatgattgatcgt

SEQ ID NO: 24920 - DNA, 601 bp, Human
aagacagaaacagatcatggagggtaggctgcctggtataggggtatcattgttttattctgtagaccagtgggagccactggagaattctgacagggagaaagaatcacaactgtgtcttagacagaaagaaaaaagcttgctcctgaaaaattttcctaccaaaggaaatagccttaaagggctgatcctcacctgaacatgttttcttgtcctcatttaaggtgtagccaggatagcaatcacagtggtaggatgcggccccatcactcacacaaatgtgctggcaaccatgagagcytagggcacacttgtcacggactgaccgcacgtggtgcaggaaagaaaatattcacacattaaatagaaaagtaaacacaaatgtttgagaggagaagcttccatttggtccccacaagtgctgagaatgtagtagtcagtagtcagcaacaggccccatgctgcaggagcaagcctgttttctcttcccatacctctcatccctttggcctcacatcacacacactcctttcctttatatctctcacagatatctaagggtacctttcctttttttctacccacagcactgggcagcact

SEQ ID NO: 24921 - DNA, 601 bp, Human
caaggctgcagtgagccatgatcacaccactgcactccagcctgggtaacagagtaagaccctgtctcttaaaaataaataaataaaaataaaactaggacaatagtcctctatttgtatggctaaaatataccaaagatgaaaactagggccaggcgcagtggctcacacctgtaatcccaggactttgggaggccaaggtgggtggaacgcttgaagtcaggagttcaagaccagcctggacaacatagtgaaaccccgtctctaataaagacacaaaaattagctgggcgtggtggcmcatgcctgtaatcccagctactcgggagactgaggcaggaggattgcttgaacccgggaggcagaggttgcagtgagctgagatcgcaccactgcactccagcctgggtgacagattgaaatgtcgtctcaaaaaacaaaacaaaaaaaaaggataaaaaccaggttaagtcctgatttcctctagaggactgttattctatttaatggtttgaagtaagagtcctagttcttaccaataaatactttggaactgaaaattcacgtttgtattgacatttaaccaaatatgagaggtgat

SEQ ID NO: 24922 - DNA, 601 bp, Human
aaagggatagatgaacaaacaaaaagacgagaaaatacttatcacagaaaaattcatcttaggatacattggggaaaatgtttataattgtcaaagctgagtgatgcttaagtgagggttccttattttattctctgtacttttgtgattgccagaaattattcatgatataaagtaaatttagaaaaacatggttggtatagggggaggccagggatatagaaataagacaatgtttatgtaatactgtgtaattaagaaaggaaaatgggcctggtgcagtgccttattcctataatgycagcacttttggaggctgaggcagaaggatcacttgaggccaggagttcaagaccaccctgggcaacgaagcaaggccctgtctctacaaaaaagtaaaatagttagccaggcatagtggcacacacctgtaatcctagctactcgagaggctgaggcaggaggatcacttgagcccaggagttcaaggctgcagtgagccatgatcacaccactgcactccagcctgggtaacagagtaagaccctgtctcttaaaaataaataaataaaaataaaactaggacaatagtcctctattt

SEQ ID NO: 24923 - DNA, 601 bp, Human
tctgaactaagaaagccatattaaggagtcattagcataaatgttccatctgttatgtaagagcatcattaggagcatatacagttatggaaaagcactaggggacaaaataggcagcttttacatgtaaatattgaatgggtgaaacagtctattaaaccattagaaaagaactctaaattttttaaagttgtatattaccactgctcatattaaaacctaacaaataagtcacttgcctgtggaatgtcttaaagtgtttggctcgatcgtagtaccttggttggctccaggcagaagsagaaaaccttccagaaaggatatgtttagtgttcagtctttgaagatacgagctgaccttgtcctggaatgccagtgtagcttcacatccacaagcatcttcagtggaaacaagtcttcgtgcttcctcagtggctgaagacaatgacagtacacaaatatactatctaggaatagctatataggaatcataacaaatcaggaaatccacagttgaatatttccaccgttaagacttacctaagtgcattttccaagaggtaaagggatagatgaacaaacaaaaagacgagaaaatact

SEQ ID NO: 24924 - DNA, 601 bp, Human
cagtcataacttagagacactaaagtttgctcttaataagtatctgcatatgtatttccttggaagaatcatgctgattctgcagaagatcttcatacaatttatccagtaatattcaagcattaatacagataatggcaaattattagcaggaacattggcaataacaggtgtgcaaaagaatgcatgagtattaagtacaccaagctgtccacattttcaggtgagaaattggagcaatttaacgatgtatttgtccatattcatttattttcaacttctccaaaatgtcatcaagtgrcaagttgttaaggccaacaccatttatttttacacattagaaaatataaacacactttcaaacacttcacaagataaaataattatgtcctatgagaagtgaaaaaaaagagcaaaactgttttctcaccaaaagttgaattcagtctaaaagtcaaaaatcctgttcttcagagagcacaataaaagtagacccctgcagtggtcttcagatgtttttgttcatataaaatgtaattggagtagcatcttagtgtgagggatgggggaagcagtgtttatgaagtattgattaaaggga

SEQ ID NO: 24925 - DNA, 601 bp, Human
acagttcaaaattacattcatctcagttatatgaagttgtatgtgtaaataccttgtacaatttgcactctcagtaataagattgatttatattataaatactatcaaaagaaactagacctaaagtttccattgtgaatatggttatctaatataaacatttaaaaattaaatggctcaattagtagataaagaaacactaaacttttcattctatttcctaccaatcatttcacagtcataacttagagacactaaagtttgctcttaataagtatctgcatatgtatttccttggaaraatcatgctgattctgcagaagatcttcatacaatttatccagtaatattcaagcattaatacagataatggcaaattattagcaggaacattggcaataacaggtgtgcaaaagaatgcatgagtattaagtacaccaagctgtccacattttcaggtgagaaattggagcaatttaacgatgtatttgtccatattcatttattttcaacttctccaaaatgtcatcaagtggcaagttgttaaggccaacaccatttatttttacacattagaaaatataaacacactttcaaacac

SEQ ID NO: 24926 - DNA, 601 bp, Human
agttgaacatagcactttatgctttgacttatagcaatttaataaaagtaatggcagtttagaagcaaaggtactagggacagaaacagttctaaaaattaagattttataggattattttgtgttctctagatagtcaaaaatgtattctcaaatttctctgtatattttttatccatgtgccctggtgtttcatttattatgggaatcctattggtatttaggactatgtcttaattttggggcagggcagagtatggaagtagagaggatgggaaggggattgataagataaagtatygtttgtgaagactttgtaaataccatctgggcaatagaataatagaaatttatttatgactcactctacagatcacttttggaggaaaaaatacaaattaaatgtctaccaaaataagaaatgacagaatgactgttgaactaaaccaactctcatgggataatacttttcaaaaatcattttcctttactatagtgaattctaattactctaataactttaccgctaaataacctgatgtggtagctatagagaaaaacagtgaaaaatgaggttcccattaagagtttcacaagtgga

SEQ ID NO: 24927 - DNA, 601 bp, Human
tgtggtagctatagagaaaaacagtgaaaaatgaggttcccattaagagtttcacaagtggaacccttaacctggaaactggttagaagggttctatgatcaaaatgacctggatgccctagcagtcatgctaaaactatataaaaaatttttttttcctctgtagtcttgtattagtccattctcaatgctgttgtaaggaacagtctgagaccgggtaatttataaaggaaagagatttaactgactcagttctgcagggctgaggaggccccaggaaacttataatcatggaggaagsggaagcaaacacattcttcttcacatgatggcaggaaggagaagtatgagaaccaagtgaaggaggaagccgcttataaaaccatcagatctcgtgagaacttactatcatgagaatagcatgggggaaactgcctccatgattcaattacctctcatggggtccctcccacaacacgtggggattatgggaattgcgattcaagatgagatttgggtggggacacagccaaaccatatcaagtgtttagatgatctgattgaaataaatgctatctggagatccatgtgttcaacatct

SEQ ID NO: 24928 - DNA, 601 bp, Human
accaagtgaaggaggaagccgcttataaaaccatcagatctcgtgagaacttactatcatgagaatagcatgggggaaactgcctccatgattcaattacctctcatggggtccctcccacaacacgtggggattatgggaattgcgattcaagatgagatttgggtggggacacagccaaaccatatcaagtgtttagatgatctgattgaaataaatgctatctggagatccatgtgttcaacatcttggaactgttttctttctcagatgtttgggtcattgctgtgattgttattgycataggtaagtatcacaaattttgacaccacttaagtcaaaaaattattgtgaagacatgcattttaaaaatagtttttcagtttctatagttttttcagcttgtaaattggttaaaccgatttaggaaaacctgactttttatttgatatacttaactacctaccttgtgttagtgattttatactctgttatattctgtatatctacttagtaacaaagcctaagtaatacatattttctcaagatgatcagtaatattagttggcttcccaaatgtgcttttgatagttttctaaat

SEQ ID NO: 24929 - DNA, 601 bp, Human
tataaatgtgtaggtgcttaaataacatttgaccactgaaatgtaaccaacatttatttcttctgctagatgttgaatcttggtgattagttttcagaattatatgtcatttgtttcctggtttcttatagttgttggagttgcagtaatttgtgttgtcccgtacagatatcttcaaaggaggaagaagaaagggtaaattaaagcatgtttcttttaacttcttggtccttcttatacttaacatgcttttgtgcagcttcagtttgtaatctgtattgcatgctatcttttttttttwaaaaaaaaatgcctgcattagtttgtcctaccaattgcatttctttgctaaaaatattttcagctacttctaacatcactgcaacataaaaacatctgtgcagagttcctacagctattatgactttaagaaaaatttcttttggatttgaggtttaagttatttagcaaatcatggaccactcactatgaggccttctctaccctattccctatttccaaaattgcactaatggccaaaattaaatttaaagtatttcactgtggagactttgacagttgtattcactggaatttttat

SEQ ID NO: 24930 - DNA, 601 bp, Human
aatggccaaaattaaatttaaagtatttcactgtggagactttgacagttgtattcactggaatttttataatgaaagtttccacttgtctatatagcttagctagttgcaagaagctatgtaggcatatcatttaaatacccaatttggtgtcttttcatttaaagttgttatttatacatgttaaactgggggattcaaaacaacactatccgatttccctcttatgttctctgaatttaccagattgcagtaaaactgatagggttaaagttaaaattgctgagaggggttagatctrtaaggtacctcaattaactgtgtcttttaatatataaaaatgtaaaaagtgagtgggtttagaatagaagaaaaatgtacaagtacatatcttctaaagaaaatagggttttaaaacatcaaactcaaattttagttaaagagcttacagtttaacaaaagacttagaatgaatcctggaacacagactaagattaggtgctttgaaatttctgaaagataatatacattcatttttactgatttttaaaaactgttttcccctatagttttagaaatagctttgaaatcaaacctaata

SEQ ID NO: 24931 - DNA, 601 bp, Human
tcttataaagactataaaatgtctggaggcacttctccacttccgggggtaactggaagcaggctagcaggcacaaataatctcaaattgttgttaaagcctggcacaaaatgtatttcttgtaaactggtatttatggtgatttgggaacgtaattactcttctgcagccttcatctcaaaatacaaaaatagtgtaaggagtcattttaagatcatccaacatcatttacattacttgataaaaagtgggcaaaaggttaaagtattctgccacttttctgtttcatagctctcagctragaacagtataggataccagtgggtccgaaacaggtcccatccacatgctccctccttttcccttcccatttcctttctttactaattcttctaccatactttttagtcttggaagccacagccctgtctttgctactgcttcagtcctgtattgcatggcatgactgtgcttctgaacaacagatgccttttgtttacataaatatttaagtaatggttttttttaaatgcatgattattttttaactctagttaagcatccctggataagtgacagtttggctaagttagtgaaagtt

SEQ ID NO: 24932 - DNA, 601 bp, Human
caatagccatgcgtgactgctaaggacttccaaagtggctagtccaatgtcaggtatgctgcaagtgtcaaacacacactggatttcaaagactaagccaaaaaaatgtaaaatacatctcaatattttggttatactcggttaaagaaaataaaattatttttgcctttttatgtttttaaaagtggcttctggaaaattttaaattacatgtatgactggcatcatctgtctttggccagcactagactagaataataggttttataaagatgtctattgttatactaaaagtgtgacrtaaactttagttatttaggagactcttagtggaatacatgattttcttgacagtgaggggtagatgaggcatcacatacttgaacagttagaaccactatctttttaaaggttctgtgccagagctacagctttaaaatggagggatcaggaaagcatgcgtttgtctccagtctttcccattggccctacatcaaaatgaggacatagttactaagtactttgtgtgctactgctctatttcttgttttggaggggatcaaaaatataagacagggataaaggaaggttttttttacag

SEQ ID NO: 24933 - DNA, 601 bp, Human
tagctacttgggagcctgaggcgggatatcacttgagcccaggagttcaaagctgcagtgaattatgatcacaaccagtgcaccccaggctgggcaagagagtgagaccttgtctcttttttaaaaaaagtaggggaggtgggggttgtgctgggcgaggtgggtcatgcctataatcccagcacttcgggaggcggaggtaggcaggtctcttgagcccaggggtttgagaacagccagggaaacatggtgaaaccccctctctacaaaaaaatacaaaaattacctggatatggtggcrtgcacctgtagtcccagctactctggaggctgaagtgggaggatcagttgagtctgggaggttgaggctgcagtgacctgtgatcacaccactgcactccagccaaggcgacagagcaagaccttgcctcaaaaaacaaaagcggggggagctgtttaaagaggttctcttgttccatagtttcagaaacctacttgaaatgtaaatagcacatttattttatgtttatatcaggtacgaccaaaactgccgcttttgaagattttgcatgcagcaggtgcgcaaggtgaaatgttcact

SEQ ID NO: 24934 - DNA, 601 bp, Human
ccagcactttgcgaggctgaggtgggcagatcacctgaggtcaggagttcgagaccagcctgaccaacatggagaaaccccatctctactaaaaatacaaaactagcttggcatggttgtaatcccagctacttgggaggctgaggcaggagaatttcttgaacctgggaggcggaggttgcggtgagccaagattgtgccattgaactccatcctgggcaacaagagtgaaactccatctcaaaaaaaaaaaaaaaagtgtcagacactcttctgagcactgtgagttattttaaacacttgcatttaaataacttatttagcttctgaagttttttaaaaaacaatttgtattctttaagtggaaaagactcagtattaaaatgttaatgttgggaactgctttcatttggtggggtagatatctaacccttcctaaagagaagaaacaaaattatcaggcttttttttttttcgaacttaaaaccttcacacctatcaacactgccacactccagaaccattacacttctcaaggagacaaatctggaggcatttctgattttttagaatacctatattacttttacgattttaaatt

SEQ ID NO: 24935 - DNA, 601 bp, Human
cagatcacctgaggtcaggagttcgagaccagcctgaccaacatggagaaaccccatctctactaaaaatacaaaactagcttggcatggttgtaatcccagctacttgggaggctgaggcaggagaatttcttgaacctgggaggcggaggttgcggtgagccaagattgtgccattgaactccatcctgggcaacaagagtgaaactccatctcaaaaaaaaaaaaaaaagtgtcagacactcttctgagcactgtgagttattttaaacacatgcatttaaataacttatttagcttmtgaagttttttaaaaaacaatttgtattctttaagtggaaaagactcagtattaaaatgttaatgttgggaactgctttcatttggtggggtagatatctaacccttcctaaagagaagaaacaaaattatcaggcttttttttttttcgaacttaaaaccttcacacctatcaacactgccacactccagaaccattacacttctcaaggagacaaatctggaggcatttctgattttttagaatacctatattacttttacgattttaaattaagcacatcgttttggagtataaaat

SEQ ID NO: 24936 - DNA, 601 bp, Human
aacatggagaaaccccatctctactaaaaatacaaaactagcttggcatggttgtaatcccagctacttgggaggctgaggcaggagaatttcttgaacctgggaggcggaggttgcggtgagccaagattgtgccattgaactccatcctgggcaacaagagtgaaactccatctcaaaaaaaaaaaaaaaagtgtcagacactcttctgagcactgtgagttattttaaacacatgcatttaaataacttatttagcttctgaagttttttaaaaaacaatttgtattctttaagtggraaagactcagtattaaaatgttaatgttgggaactgctttcatttggtggggtagatatctaacccttcctaaagagaagaaacaaaattatcaggcttttttttttttcgaacttaaaaccttcacacctatcaacactgccacactccagaaccattacacttctcaaggagacaaatctggaggcatttctgattttttagaatacctatattacttttacgattttaaattaagcacatcgttttggagtataaaatttgacacgtaagacctttttttccccaaacttattaaag

SEQ ID NO: 24937 - DNA, 601 bp, Human
cctgggaggcggaggttgcggtgagccaagattgtgccattgaactccatcctgggcaacaagagtgaaactccatctcaaaaaaaaaaaaaaaagtgtcagacactcttctgagcactgtgagttattttaaacacatgcatttaaataacttatttagcttctgaagttttttaaaaaacaatttgtattctttaagtggaaaagactcagtattaaaatgttaatgttgggaactgctttcatttggtggggtagatatctaacccttcctaaagagaagaaacaaaattatcaggcttttttttttttcgaacttaaaaccttcacacctatcaacactgccacactccagaaccattacacttctcaaggagacaaatctggaggcatttctgattttttagaatacctatattacttttacgattttaaattaagcacatcgttttggagtataaaatttgacacgtaagacctttttttccccaaacttattaaagtctggaattttttttttttttttttagttttatccttttattgaagcttacaatttcactgaacttttggccccaaatgaaaaaaatgcaaattaaaa

SEQ ID NO: 24938 - DNA, 601 bp, Human
cagtattaaaatgttaatgttgggaactgctttcatttggtggggtagatatctaacccttcctaaagagaagaaacaaaattatcaggcttttttttttttcgaacttaaaaccttcacacctatcaacactgccacactccagaaccattacacttctcaaggagacaaatctggaggcatttctgattttttagaatacctatattacttttacgattttaaattaagcacatcgttttggagtataaaatttgacacgtaagacctttttttccccaaacttattaaagtctggaattttttttttttttttttagttttatccttttattgaagcttacaatttcactgaacttttggccccaaatgaaaaaaatgcaaattaaaaaaagtattggcaaggagaggtgaccactgtcccctggagatggaagccgagcagagcgtggcaggcaagtgagggatcccagctgcggaggcagtagcctggccaaagatgcccagggaacagatttgtctgagcagggccagccccaggcagctagaagttaatacccaaggatttatgggtgtgatggaatccaagccactggtccca

SEQ ID NO: 24939 - DNA, 601 bp, Human
gtcggcatctgcagctgggtgcacacctggatgaagcaatcaagctgtctggcaggattgacagagcgtgggcagtagctggagaccagtagctgggtgaactgggggctcaggttgtagcccatttgggacagagcttgctgcagctctgtgtagctaatggagcctgagttgtcccagtcataactgctggaagagctgcttccactgctggatgaatttccacagggctgagaagccgtagacatttatgtggcctgattaggtcttgtcaaacatgtttatcatcatgaggcaggtytcatcattgaacaaggaccagttgcagttgaccagagcctgcttcacctccttcatggagataaagccactgtgatcagagtcaccgactggaaccaggagtaggcctcatccatattgggaggggagccaccctgtccatgaggcctgggctgctgggcaccgtaggaatttggaggtggctgaccataggggccccctggagctgtaccatcatttggtcctcctggagttccagaggggaacatcccaggattgaggtgtccatagggccctctaccagctggtggtccataaggcc

SEQ ID NO: 24940 - DNA, 601 bp, Human
aaaatgtaaattaatcagttttttaatgggggcagagtaacacaggggcctgggcattaacatcttaatatttaaataattaaaaactgttctgggaaaaagattctgcctttgtatgccttacagagagacttgggagataacatcagaaatacatttaatatttaacggcaaaccactgatatcttcatagtggcatttggggttgttaattttttatcttctctctttaacagccctctctatgatatgctaagaaagaatcttgtcactttagccactgctactacaggtatgtcayatcatatttcttcagtctgtatcacagctttgagttcaagggggcaaatgatgggaaaacaaagaagatgaaggtggaaatggaatgctatctttggcatgactgggagaaatacatactacctgtcacacagaatgttatgttattaactttttactgaaaaatcaaacatagagtagaaggatttccactttctagacgtactgttaacgttttgtcatattgcttcatctagacacacttttaaaaatctctagcagataaggacttttttctccaaacattcaatatcattattac

SEQ ID NO: 24941 - DNA, 601 bp, Human
agtagctgggattataggcacatgccaccatgcctggctaattttttgtatttttagtagagacagggttttgctgtgttgctcaggctgatcttgagctcctggactcaagcagtccacccactttggcctcccagagtcctgggattatgcgtgtgaaccactgcacttggccactgccactgtcttttgatagtttactgaactgtcttttgcactgtcttttgatagtttactgaaataagtaggttgagaagaatccattcctttttatctttttctttctttcttttctttttctttttttttttttttaaatgtagagcgtcttgctctgtcactcaggctggaatgcagtggtgcaatcatagttcactgcagcctttacctcctgggcttaactcatcttcctgtctcagcctcccaaatagctaggactataggtgcatggcactgcactgcacctggctaattttgtttttttgtagaaatggggtcttgctttgttgctcaggttggtcttgaactcctggcctcaagtgattcttccacttcagcctcccgaggtgttgggattacaggcatgagccaccgcccccag

SEQ ID NO: 24942 - DNA, 601 bp, Human
caaatgagagaagtgcttttcatataattttatacctttgcaaatgggttaaacttttcattttggtcaagaagatgccattgtttaaaatggtagttcttttttttttttttttttgagatggagtctcgctctgtcgcctaggctggagtgcagtggcatgattttggctcactgcagcctccacctcccgggttcacgcagttctcctgcctcagcctcctgagtagctgggactacaggcgcccgccatcatgcctggctaattttttatatttttagtagagacggggtttcaccrtgttagccaggatggtctcgatctcctgacctcgtgatctgcccgccttggcctcctaaagtactgggattacaggcgtgagccactgcacccagcctaaaatggtagttctttctaaattgtctctccaaattttcccatgtatacaaatgaaataaatatgactaactttgtgtgtgtttattaatttttgagactgagtctcgctttgtcgactaggctggagtgcagtggtgcgatctcggctcactgcaacctctgcctcctgggttcaggtgatctcctgcctcagcctcccga

SEQ ID NO: 24943 - DNA, 601 bp, Human
caaatgggttaaacttttcattttggtcaagaagatgccattgtttaaaatggtagttcttttttttttttttttttgagatggagtctcgctctgtcgcctaggctggagtgcagtggcatgattttggctcactgcagcctccacctcccgggttcacgcagttctcctgcctcagcctcctgagtagctgggactacaggcgcccgccatcatgcctggctaattttttatatttttagtagagacggggtttcaccgtgttagccaggatggtctcgatctcctgacctcgtgatcygcccgccttggcctcctaaagtactgggattacaggcgtgagccactgcacccagcctaaaatggtagttctttctaaattgtctctccaaattttcccatgtatacaaatgaaataaatatgactaactttgtgtgtgtttattaatttttgagactgagtctcgctttgtcgactaggctggagtgcagtggtgcgatctcggctcactgcaacctctgcctcctgggttcaggtgatctcctgcctcagcctcccgagtagctgggattacaggtgcgcaccaccaagcccggctaa

SEQ ID NO: 24944 - DNA, 601 bp, Human
agaccagcctggccaagatgataaaatcctgtctctactaaaaatacaaaaattagtcaggcgtgcgcctataatcctagctacttgggaggctgaggcaggagaatcacttgagccagggaggtagaggttttagtgagccgagattgcgccactgctctccagccagggtgacagagcaagactccgtctcaaacaaacaaaaaaattgctccatctgcattatatgttagtccaacttcgctttgaagaccactgtggtcagaaaatgctgtctctcaaactttttgttgtctccgtytgtccacaaaaatgtttctggaaataatgttttttataattagaattttgaaaatgtttgcttttttcaatagaaccgcattgacagatcagttgtaggatctgtatccttcctctagcagcctttatcagatggtgatgatattttccatattttatctctgaacctggtagtggttggtgaacctgacccacagtagacttattttgggtctatctcattcacatagcctcaaataatgaatagtccagattattaaattgtttgcagcttgatcttttcgtgtagccaagtttttgt

SEQ ID NO: 24945 - DNA, 601 bp, Human
cccacagtagacttattttgggtctatctcattcacatagcctcaaataatgaatagtccagattattaaattgtttgcagcttgatcttttcgtgtagccaagtttttgtcttttgttctacttgaaaaatttctttgtaagtccttggaatgcatttctcttttagattaatgtaatatctaagaatttctctgtactgtgttgttttccttggttctttttattggccttgagaaaaactttatttgctgctgcttcttaggaaatgtttatagtaactgggaaaaataagacaatgaaaaaaattaatttatatacaggtgatggtaatgggaatttaaaccataaaattatccttgacacttagaatgtcgctttagatgaagatgctattgttttatgaagcaaacggggaaaaatccagatttcaagatcccataaccctgtatgacttaacacttgaaagttgaaattaaatgtaaaaagccatacactcttttccttttgtttgtgagttaggcgaatttggtaatatataggaagagatgacaaaaatagactccattatgtcctgcttggaaccagttttcatataaaaa

SEQ ID NO: 24946 - DNA, 601 bp, Human
atttctttgtaagtccttggaatgcatttctcttttagattaatgtaatatctaagaatttctctgtactgtgttgttttccttggttctttttattggccttgagaaaaactttatttgctgctgcttcttaggaaatgtttatagtaactgggaaaaataagacaatgaaaaaaattaatttatatacaggtgatggtaatgggaatttaaaccataaaattatccttgacacttagaatgtcgctttagatgaagatgctattgttttatgaagcaaacggggaaaaatccagatttyaagatcccataaccctgtatgacttaacacttgaaagttgaaattaaatgtaaaaagccatacactcttttccttttgtttgtgagttaggcgaatttggtaatatataggaagagatgacaaaaatagactccattatgtcctgcttggaaccagttttcatataaaaatttaaaagcttgatatggaagaacatttttagctatttttcactgttttttttcccgattatattttggtaatatattttggatatggcctgtcttggtctttgtcatttttatcaattttgatttttcc

SEQ ID NO: 24947 - DNA, 601 bp, Human
gcacaggatcacagtatggatattccaagtcaagaccaactgaaggtaaaatcaccacacggtgacttcttttgttgtacagagtggccccttctctgtacctatggatcttggactcccaagacctttccctgaatgtggtaagaatttaataagaaaggttcttgggagttcacagaccagggacagagtgaaccttctctgttctgcccataacagagttccagtctctgaacctttctttgggatgtagcacttctgatcttcagttcttccagttgcatttttctttgggtttgtrtgtacctgtgtgtgtgtgtttgaggatattgctttattagattttaataggcgtgttgcagttaagttcatgtcaggccatttcctaaagcttccccaaacctggggaaactttatagtcatcttggtacgtggcgagggtttcatatgttttctgaattatgcctaattttgtagtagactggagggtttatacagatagcctgtttttaacagtagattttggcctttgtgcagaggttttttttccccccaggtttgggattcttctagctttgctcacagtgggttgaggagaggt

SEQ ID NO: 24948 - DNA, 601 bp, Human
tgttctgcccataacagagttccagtctctgaacctttctttgggatgtagcacttctgatcttcagttcttccagttgcatttttctttgggtttgtgtgtacctgtgtgtgtgtgtttgaggatattgctttattagattttaataggcgtgttgcagttaagttcatgtcaggccatttcctaaagcttccccaaacctggggaaactttatagtcatcttggtacgtggcgagggtttcatatgttttctgaattatgcctaattttgtagtagactggagggtttatacagatagsctgtttttaacagtagattttggcctttgtgcagaggttttttttccccccaggtttgggattcttctagctttgctcacagtgggttgaggagaggtgttgcctttatttgatgactgttgtgaacttgagttctctttcttgtgtgtaacccattgtgttgcacactaactggtgagccagaatggaactgctacatcccctggtctcagttatttctactgcactgatggacacctttcccttctttcagcaaagtgcagaggaaagttccacttccagaaaaagaactacagaaga

SEQ ID NO: 24949 - DNA, 601 bp, Human
ttgctaccaggtgaattttctacatacatgaattcagctgccttagacttttcaatcttagtattcttgtatgtatatgatttggttagaatttttattttgatttatctacttgaggcaaaggccaattttcatacttttttttttttttttggagtcagagtttccctgggtcacccaggttggagtgcagcagtgcgatctcagctcactgcgacctccacctccttggttcaagtgattcttgtgcctcagcctcctgagtagctgagattacaggtgtgtgccaccacgcctggcttttttttttttttttttgagacggagtctcattcttgttacctgggctgagtgcaatggtgtgatctcagctcaccgcagcctccgcctcccaggttcaagccattctcctgcctcagcctctggagtagctgggattacaggcgcacgccaccacacccggctaattttgtatttttagtagagatggggtttccccacgttggttaggctggtctccaactcccgacctcaggtgatctgcctaccttggcctcccaaagtgctgggattacaggtgcatgccactacgcctggctaa

SEQ ID NO: 24950 - DNA, 601 bp, Human
agtttccctgggtcacccaggttggagtgcagcagtgcgatctcagctcactgcgacctccacctccttggttcaagtgattcttgtgcctcagcctcctgagtagctgagattacaggtgtgtgccaccacgcctggcttttttttttttttttttgagacggagtctcattcttgttacctgggctgagtgcaatggtgtgatctcagctcaccgcagcctccgcctcccaggttcaagccattctcctgcctcagcctctggagtagctgggattacaggcgcacgccaccacacccrgctaattttgtatttttagtagagatggggtttccccacgttggttaggctggtctccaactcccgacctcaggtgatctgcctaccttggcctcccaaagtgctgggattacaggtgcatgccactacgcctggctaattttggggttttgccatgttggccaggctggtctcgaactactggcctcaaatggtctacccgcctcagcctcctaaagtgctgggattacaggcgtgagccactgcacctggcccaatttttacacattttgaagtttgcaaagatgacataatatactt

SEQ ID NO: 24951 - DNA, 601 bp, Human
acccgcctcagcctcctaaagtgctgggattacaggcgtgagccactgcacctggcccaatttttacacattttgaagtttgcaaagatgacataatatacttaatcacaaagccaagaatgagatataagaagcctggtataagttgagcactctaaatttgaaatgttgagcattctcaatttgaaagatggtaatgctcttttagcaactcatgagtactaggatggtgcaagaccctttcaaaggatcttagaataagttgagcatccaaaatctgaaaacttgttttttttttttkttttgttttgtttttttttttttgagacagggtcttgctctgtcaccaggctggagtgcagtggcacagtctcagctcactgcaacaacctccacctcccgtgttcaagcgattctcctgcctcagcctcctaagtagctgggattacaggcgtgcaccactacgcccagctaatttttgtattcttagtagagacggggttttaccatgttgaccaggatgggttgatgtcatgacctcgtgatccacccgccttggcctcccaaagtgctgggattataggcatgagccaccacaccc

SEQ ID NO: 24952 - DNA, 601 bp, Human
acctgacctcatatgacaggttgcagtgaaaacttagtttcatgcacggaattatttaaaatattacaaaaaactgtcttcaggctatgtgtacaaggtgtacatgaaaacttgggtcccattagccgggcgcggtggctcacgcctgtaatcccagcactttgggaggctgaggtgggcggatcacgaggtcaggagattgagaccatcctggccaacacggtgaaatcctgtctctacttaaaaaaaatacaaaaaattagctgggtgtggtggcgggcgcccgtagtcccagctaccygggaggctgaggcaggagaattgcgtgaacccaggaggtggagctagcagtgagccgagattgtgccactgcactccagcctgggcgacagagcgagactctgtctcaaaaaaaaaacaaaagggaaacttgggtcccatccccaggatatctcattatgtatatgcaaatattccaaatccagaaaaattgtttttgcccttggatggtagtcaccagatctttgccattccattagatatgttgtggtcaggctaatgagttcatccatattttccccaaaactctaaaaaacacttt

SEQ ID NO: 24953 - DNA, 601 bp, Human
aacttgggtcccattagccgggcgcggtggctcacgcctgtaatcccagcactttgggaggctgaggtgggcggatcacgaggtcaggagattgagaccatcctggccaacacggtgaaatcctgtctctacttaaaaaaaatacaaaaaattagctgggtgtggtggcgggcgcccgtagtcccagctacccgggaggctgaggcaggagaattgcgtgaacccaggaggtggagctagcagtgagccgagattgtgccactgcactccagcctgggcgacagagcgagactctgtctcaaaaaaaaaacaaaagggaaacttgggtcccatccccaggatatctcattatgtatatgcaaatattccaaatccagaaaaattgtttttgcccttggatggtagtcaccagatctttgccattccattagatatgttgtggtcaggctaatgagttcatccatattttccccaaaactctaaaaaacactttctaggctgggcatggtggctcatgcttgtaatcctagcactttgggaggctgaggcaggcggatcacctgaggtcaggagttcgagaccagcctggtcaacatggtga

SEQ ID NO: 24954 - DNA, 601 bp, Human
tagttactttgtaactattccagtctatatgatattaaatgtgtaattttattccttaatgcaaatccttgcttattttgtactcaaaaggcaattttaagatatataagaacatggctgggcactgttagaaaatcaaggctgggcatggtagctcgtgcctgtaatcccagcactttgggaggctgaggcaggggcattacttgagctcaagagttcgagaccagcttgggtaacatagcgagacctcgtctctacaaaaaatcagcccagtagaaaattagctgggcatgatggtgcrcaccagtcgtcccagctactcaggaggctgagatggaaggatcacttgagcccaagaggtggagattgcagtgagcggaggttgcagtgaatcaatatcatgtcactgcactccagcctgggcaacaaagtggtgccctgtctcaaaaaaaagttgggggcaagggcaggtatttaagaatagccaactcaaggggggatatgtagtttgtgatgaaaatttgggaataaataatagtattttcaggaagacctataggtagaagggacagaatttttatttgtggaaagaatgacctat

SEQ ID NO: 24955 - DNA, 601 bp, Human
aaatccttgcttattttgtactcaaaaggcaattttaagatatataagaacatggctgggcactgttagaaaatcaaggctgggcatggtagctcgtgcctgtaatcccagcactttgggaggctgaggcaggggcattacttgagctcaagagttcgagaccagcttgggtaacatagcgagacctcgtctctacaaaaaatcagcccagtagaaaattagctgggcatgatggtgcgcaccagtcgtcccagctactcaggaggctgagatggaaggatcacttgagcccaagaggtgragattgcagtgagcggaggttgcagtgaatcaatatcatgtcactgcactccagcctgggcaacaaagtggtgccctgtctcaaaaaaaagttgggggcaagggcaggtatttaagaatagccaactcaaggggggatatgtagtttgtgatgaaaatttgggaataaataatagtattttcaggaagacctataggtagaagggacagaatttttatttgtggaaagaatgacctattttcatttccttcataagttgtagagctcgagtagggaagaataactttaatatggcaccat

SEQ ID NO: 24956 - DNA, 601 bp, Human
tggacaacctagagtttagtgttttatagtggttgttacctactaaaacatacgaattattgagaattgacccagaatatgtggtaccagtgagattgcctggacaaccttgtgatcacctattatggtttgtattgccttgctttgatcttaagggttagaccactatgttaccatcatttgcaatgctgttaatcaaactattatcaggcactatgtactagagcaagtaattctatagtttatacatggtaggagtgtttaaaataccagtaaatgcccatttagaaattcttttagmacaaggtcattgttcagatgcttttagagtcttttttttttcctgtcttctcatagaagacaatgcttttagagtttaaacttgataaacgatgatctgtttgtagtgtcattacttgctaatgaagtctaaacaagggaggagatttgagctctgccactaagacagatacttgatttctggttctttctttcttagaacaggaatttctttttacctattttataaagaagttttaagtattctaaagatagtcttagttattacgtattgtgcatagttatcattcttttcatttga

SEQ ID NO: 24957 - DNA, 601 bp, Human
gaacaggaatttctttttacctattttataaagaagttttaagtattctaaagatagtcttagttattacgtattgtgcatagttatcattcttttcatttgacttctatagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggtaaatttcacatttgaagggaagtggytttttttcttttgaaagggtaacattcttggttactcttgaccacacattatattctctaagaattcttatttactcctatggcgttaaataccatctgtatgcatgtgatacccaaatctgtatctctagtccttacctcttccctaaatgcccaacttcagtttccagatgcctatttaactaacaactctacttagaggatttgacattgaacaatttcaaaatggagcctttggctgtgcgtagtggctcatgcctgtaatctctgggagtcccagcctataacactgggaggccg

SEQ ID NO: 24958 - DNA, 601 bp, Human
gttgtctgtttaccactgaaatgtaaggccagggcttttgtattattcactactttttccattacctggtacctagaacagtatgtggcacataataggtattcagtgagtatttgtttaataaatggatgagtatttaatagtgtgcaaaataataaattgtctctcatgaatgttgtagaaaagcatgtcatgaaatattcatagatgaatgcagaaggttagttctatatggagttcagaaagtgtcaggacaaaaggtttgggtgaccatcagtatttctcatatttctttaataarcatccttgaccattttaagggaaagaatatgtcagaactaatggaatgttttgtagcttcttagagtgtcacctgtagaagggaatttagggaatagattctatttacttgagcaactacaagtccttaccttttaaactcttcagtactgtttcttaggtgttatacctgatttagtgttaaaagagaaaagtccatgcctgacaccattatatccatccattagtttatccacagtaggtgtcaagtagatatatgttgaatgaatacatgtccactgaataaaggcaagatgttctt

SEQ ID NO: 24959 - DNA, 601 bp, Human
gcaaaataataaattgtctctcatgaatgttgtagaaaagcatgtcatgaaatattcatagatgaatgcagaaggttagttctatatggagttcagaaagtgtcaggacaaaaggtttgggtgaccatcagtatttctcatatttctttaataaacatccttgaccattttaagggaaagaatatgtcagaactaatggaatgttttgtagcttcttagagtgtcacctgtagaagggaatttagggaatagattctatttacttgagcaactacaagtccttaccttttaaactcttcartactgtttcttaggtgttatacctgatttagtgttaaaagagaaaagtccatgcctgacaccattatatccatccattagtttatccacagtaggtgtcaagtagatatatgttgaatgaatacatgtccactgaataaaggcaagatgttctttggcgatgtagtgtgacgacattgagttttgggttcatttgtgttgtttcaacatctctgataaacctctgaatacagaaactcatgtttgttttttttctgttaggatgtgggtactgccattgtttcagatactacagatgact

SEQ ID NO: 24960 - DNA, 601 bp, Human
atttgtgagaaggttgctgtacagaggttcataattgtttcataattggttttattctttttattggaccacaaaactagggctttaaatttttaaattctaaattttaaaatttagaacactccttacttttgaaacggactttttttgtttgtttctgtttctgtgggcatgtttttataggacagccagagtatcacataactagtttcacttttgaaagtgaaaagtaaatttttaagatactttgtttcattcttcctgtctgcttagataaaaaattgcacgtttaacaatttgsagcttttctactctgaaattatttatttatttatttttaaattgttttagagacaagctcttattctgtcacccaggctggagtgcagtggtgagatcatagcttactgcaagccggaactcttgggctcaagcgattctcttgtctcagcccccaagtaactgggactacaggcgtgcaccaccacacctggctaattttttttattttttgcagagacagggtcttgctctgttgcctaggccagtttcaaactcctgggctcaaggtatcctcctgccttggcctcccaaagtgctg

SEQ ID NO: 24961 - DNA, 601 bp, Human
tcaaggtatcctcctgccttggcctcccaaagtgctgaaattataggcacctggctgtaaaatagccaccatgcccagctattttctttaaagtcataaatatgggcatcttctctcttctgaatgcaaaatttatttggtaactcttctgggtgcttttctgtcgtttgtgctactactgaaatgccaactagaagtacagaatcatgtgtttggtcttgcatttaagctgtctccttaagtgctagagatgggagaagaatgtgagttttaaattgaagcagttgtcttttttgctttyagttaattagcctcatctaaaacaagtaaacattactaatgagatgtttttgccttcacaggtgattgaagtgggaaaaaatgatgacctggaggactctaagtccttaagtgatgataccgatgtagaggttacctctgaggtatgaatctttagcaagaactattttgcaccagccccatcttcagatgatgtaatcccagcagttcacttgtgttgaagagtgctgtttacccctcatttctgtctcccttgcctagttgctaagtgatgttggtttctttacatttttttaagaga

SEQ ID NO: 24962 - DNA, 601 bp, Human
gtcgtttgtgctactactgaaatgccaactagaagtacagaatcatgtgtttggtcttgcatttaagctgtctccttaagtgctagagatgggagaagaatgtgagttttaaattgaagcagttgtcttttttgcttttagttaattagcctcatctaaaacaagtaaacattactaatgagatgtttttgccttcacaggtgattgaagtgggaaaaaatgatgacctggaggactctaagtccttaagtgatgataccgatgtagaggttacctctgaggtatgaatctttagcaagarctattttgcaccagccccatcttcagatgatgtaatcccagcagttcacttgtgttgaagagtgctgtttacccctcatttctgtctcccttgcctagttgctaagtgatgttggtttctttacatttttttaagagatttttattggaacttaagaagggaaggggataatttgatcttatcctctccctaccttgaaaaggatgagataaatgcctctgtgtgcctttctccctgccatcaaatctctctggagacacaaagttattcaaaatagtcttgcactgctttccctgactc

SEQ ID NO: 24963 - DNA, 601 bp, Human
tggagacacaaagttattcaaaatagtcttgcactgctttccctgactcaacacctctctgcaatcccaaagacagacccataggctatctaaaattatttgttgaatataaaaataatattgtcattgttttcttaaaaagaagcaaatggaaaacagcttaatttccacacagattagtattaatggaggactattaaagaagacttgatattccactcttaggttaatagggatggatttgtcactagttgacaactcaagtctagacccaaatgtataccttgcttttttgttgctrtttccccatgtttcttttagtcttgccacaggtaacacactatgggaaaaaggttggtggaggaaggataagaaggggattttacattttgctgcttggaaagagaaacatttttaggttgtttctggtgttgatccttcccccattcccaccacaccactgttgagcattatggtagttcattgccaatgatctgtgtgtagcttagtaataaagtaaaatatattggtccagtaagtgttcttgactgtaatacaaataacagagataaatgtttccatctgtttttttgagatggag

SEQ ID NO: 24964 - DNA, 601 bp, Human
aatatattggtccagtaagtgttcttgactgtaatacaaataacagagataaatgtttccatctgtttttttgagatggagtttcactcttgttgccaaggttggaatgcaatggcataatctcggctcactgcaacttccgcctcccggcttcgagcgattctcctgcctcagtctcccaagtagctgagattacagacatgtgccaccatgcccagctaattttgtatttttagtagagacgaggatctccatgttggtcaggctggtcttgaacttctgatctcaggtgatccgcccrcctcagcctcccacagtgctgggattacaggcgtgagccaccactcccggccatgtttccatcttaatcagacttctgtggctacttgggtgcagaaaacctattaagcaaatggactgtatttcatcatatcaaagatgccattgaatttaataagccctattattttatgtcctactaagaaaaagtgatgccaattaaactgtggcacaccatcactcatgaattccaaatctttatgaagttcctttgattatttgtatagcattttaaatgagattggaagatcttagactggca

SEQ ID NO: 24965 - DNA, 601 bp, Human
aaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattcmgttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgag

SEQ ID NO: 24966 - DNA, 601 bp, Human
agggggctcctctggatcccagaaaggcagcactgaaggggccgtgacatcacccaggctgggggttctgcaccccctgacactgtaggcaagtgtgtgtgtcatttggagggagagggcatggggtccgtggctttcatcaggctcctgacattcaagagcccagcctccagtcctggctacacggtgggacttgggggagcctccggttccccacatccagccccagctcagtggagggccacctcaggtccgtcagccttctgtagggagggctgcgagggcggggtccatccaggasggcccctcccggctgcaacccaggaagtcctttcagagagctagctggaaaccccaactttggtctattttccccactgggagtccagggagaggggagggaaaggggagaaagcaggaggtctttccctccttcctctcaatcctgaggcctcctgaccccctggctcctctcatgcattaggcacctcactaaggtggagtgggagccgggagacgaagctcaggaccaagctgccccagaggcgagggatagctggctccccacaccccattctgaaaacccttgacctcctcatgg

SEQ ID NO: 24967 - DNA, 601 bp, Human
tcctgagccagggaccaacccccagagttcccatcagcgtgtccagtgcggtccctggctgagccaggcacatctgagcagccaggcctcggtgacccggcaaggcccttaccgatctggtcgctatagtgggtgtactggacgtggtcagggaacggcggcagcgggtccaggtcatactggccctgagccagcaagcctgctgtggggaggcaaagcatgtagggtaccccatcgggaggggcaacgggggcccgaggcgcttctggagagtggaggcgggggtcacaaggtcaggccyataagagcctaggaccccacaagcagattcctagaggatccagactcttcttcgatggtaaagacccttccccaccctggtcatgggtcacctccctgaccttaccctgccccttcctgttgctggcctcctggctgctcctaggactccacatgctcctgcctccctcagagcctttgcacctgacactccctgggcctgtgaggcctgctcagctccttcaggtcttccctggaatttcagctgtgccaagatgccgccccacctccagcccaccagccctcctgctgatttctgtcc

SEQ ID NO: 24968 - DNA, 601 bp, Human
tctgcagccaggggaggataagggggtctgctccctctacccctcccagggggtctccccaccccagctgccggcccgtcctatcctacccctagcccgttaccttgataatcatagtagtctgggttgtctgcaaacaaagatgaaagtggaattggtgggagtaaggctaatcccccagcccctggggcaaacaagttccctcctgagccagggaccaacccccagagttcccatcagcgtgtccagtgcggtccctggctgagccaggcacatctgagcagccaggcctcggtgaccyggcaaggcccttaccgatctggtcgctatagtgggtgtactggacgtggtcagggaacggcggcagcgggtccaggtcatactggccctgagccagcaagcctgctgtggggaggcaaagcatgtagggtaccccatcgggaggggcaacgggggcccgaggcgcttctggagagtggaggcgggggtcacaaggtcaggcccataagagcctaggaccccacaagcagattcctagaggatccagactcttcttcgatggtaaagacccttccccaccctggtcatgggtcacctccct

SEQ ID NO: 24969 - DNA, 601 bp, Human
tcacgccacatttggagaacttgtcccgacagaggtcagctattgggggcaggaaggaggcagggtcagggtggagctgggtgatgggaaccgctgcccctcccccaactctggtgatgggagtgttttgaggatgaaaagtagcaaggaggggagctcagggtgtcctggaagtgggcctggtggataatacgtgttgaataaacatcaggtgggtggctaggtggccagataatgatgcgggtgtggggacaggggaggtcttggggaggtggccttcctacctcggaggagctcctcrtgggcacacactgtacgaacacagatctccttgttaatgacgtacacacggcggaggctgcggggacagggcacgggaggtctcagccccacttccacccaatcccactgggatagcccagacagaacctggcacgggagcccggacagaacctggcacgggagcccggacagaacctggcactggagcccaggagtggaggaggtccctggcccaggctcaaccacagaactgagctcaacttaaggactcactatctttcctccaactcccaccttggcgggccagagctgtcccctg

SEQ ID NO: 24970 - DNA, 601 bp, Human
cccagatcccaggagggccaggactcaggatgccagcaccaccctagcagctcccacagctcctggcacaggaggccgccacggattggcacaggccgctgctggccatcacgccacatttggagaacttgtcccgacagaggtcagctattgggggcaggaaggaggcagggtcagggtggagctgggtgatgggaaccgctgcccctcccccaactctggtgatgggagtgttttgaggatgaaaagtagcaaggaggggagctcagggtgtcctggaagtgggcctggtggataataygtgttgaataaacatcaggtgggtggctaggtggccagataatgatgcgggtgtggggacaggggaggtcttggggaggtggccttcctacctcggaggagctcctcgtgggcacacactgtacgaacacagatctccttgttaatgacgtacacacggcggaggctgcggggacagggcacgggaggtctcagccccacttccacccaatcccactgggatagcccagacagaacctggcacgggagcccggacagaacctggcacgggagcccggacagaacctggcactggagccca

SEQ ID NO: 24971 - DNA, 601 bp, Human
ctctcaggacagtccgcgttgggggcacttggctggcccctctgtgctctccaccgaaaaagtgactcgatcttttgtaaaaacttgtttttaattttgtataaaataaaggtggtccatgcccacgggggctgtaggaaatccaagcagaccagctggggtggggggatgtagcctacctcgggggactgtctgtcctcaaaacgggctgagaaggcccgtcaggggcccaggtcccacagagaggcctgggatactcccccaacccgaggggcagactgggcagtggggagcccccatygtgccccagaggtggccacaggctgaaggaggggcctgaggcaccgcagcctgcaacccccagggctgcagtccactaactttttacagaataaaaggaacatggggatggggaaaaaagcaccaggtcaggcagggcccgagggccccagatcccaggagggccaggactcaggatgccagcaccaccctagcagctcccacagctcctggcacaggaggccgccacggattggcacaggccgctgctggccatcacgccacatttggagaacttgtcccgacagaggtcagctattgg

SEQ ID NO: 24972 - DNA, 601 bp, Human
tgcccttgttaagataaatgaaccaccctggtggaataattcacagtcctgtgatggtcagaggccgagcaaaaacttgccaggtccttggggaggggtctagaggaggtgagcaaatggaggtccccaggagagaggggcatccagtgctggcatcctccctctcgaaatcggcacccgctgtctccatggggccactccttccttcttctgcagctcttcctgtctcccgctcctcacccagagccctcggtgaagggcatgggaaaaggaattgaaggaattccgtcttatcactctrtcagcttctgggtcttgtcatccctttgtatttgttttccggggctgccataaaaaggtgccaccaactgggggcttaaaccacagggatttatcatcttccagacctggacaacagaagtctgagatcaaggtgtagacagacccatgctccctctaggggctctaggggagggtccttcctgcctcttgcggcttccgggagctccaggtgtccctggacttgtggccgcatcactccagtctctgcctccttctccgtggggcctcctcctctgtgtctgtgtctccttttctttgt

SEQ ID NO: 24973 - DNA, 601 bp, Human
gagaagaaagcaacccttaaaatagaggaaaatgaagctgcttggattaccctgttgaagttcatctctgcctgtgccatgcatgaaaaaatactggcaaagtcttcacttacatgagtgttagactccatgttcccagtgggtctcggggttcagaactgagtgctctcatccaagcaataggagcgtcgacctcaggaaagcccaagtgttttgtgtgtattttgaggagtgggttatctgttgcactgagcctctctgtgtattttcttcttcttttcagcagaacaaggggaggtgracatggagagccaccggaatgccaacgcagagccagctggtaagaaggacggggaacgatggcttgcacacgtggccagtgttcccattttatcttctccatcctctcccatcttgctgtcctgctcacattctcaaatttggttgcatggctttgaatgtcttcctttatgtctcgttgctttggagggatactttcaaaagacaatgaatgtgtaaacttcctagggcctgggccttcagagaagacctatatgtgcctaagtctctgtttaacaaaatattaaggaagttttcccag

SEQ ID NO: 24974 - DNA, 601 bp, Human
gacgcggtggctaatgcctgtagtcccagcactttgggaggctgaggtgggcggatcacctgaggttgggagttcgagaccagcctgaccaacatggagaaaccacgtctctactaaaaattaaaaaaaaaaaaaaaaaaaaaaattagccaggcatcgtggcgcatgcctgtaattccagctactcagaaggctgaggcaggagaatcgcttgaacccgggaggcggaggttgtggtgagccaagattgcgccattgcactccagcctgggcaacaagagcaaaactctgtctcaaaaaaaataataataataaaagaaagttagtgtcttgttgactgctctttcgagtcagggaaagatgtttagaacaagctatatcttaaagagaaaaggaagattccttctgcccactgcaatgaagttgtctggcttcattagccagtacattggtatatatgtgtggagccctcgttacttgaagggcgtggcattccagtgttttctgccaccattgttcttaattccttcttccaaatcccagcttctccctccaaaatagttttaagactgacatgcagaataaagtttccaaaacttaa

SEQ ID NO: 24975 - DNA, 601 bp, Human
ttcctaggacaagatgagtcactggttgaatttttttttttttctttttttgagacagaatttcgctctgttgccaggctggagtacagtggtgcgatctcagcttgctgcaacttccaactcctggattcaagcgattctcctgcctcagcctcccgaatagctgggactacaggcatgcgccaccacgcccagctaatttttgtatttttagtagagacagggttttaccacattggccaggatggtctcaatctcttgacctcatgatctgcccacctcagcctcccaaagtgctggsattacaggtgtgagccactgcacccggccctggttaaattttaaaaattacttacagtagactgtctggaaataatttaaatgttcctttaatttttctgtatagtctgagaataagagtagtcaaggatgacttataaagacaaaatatgcacacatccttcaacctagcaatcctaatctctagaaaggaaagaattacagacacaatactgccacagtaagttttatttcagcagtaaaaatttggaaataatctatatttccaacaataatcctggtcatataaattatggtttat

SEQ ID NO: 24976 - DNA, 601 bp, Human
tatacaagtcaatactgttttgaagtgaaaaattatttgctttgagagtgtatgcatgtatgtatatatatgataaatgattataacgtgtgtgtcagtgacaatatgtagtctttggttgttagttatatactgtctacctgtgagatgcaaggtaagtgggtcacagactctcaaatttatgaaacacttagatttttcagggaagttacatgaaggaactagggagtttcatgattagataagacgttcgggtgggatctccaccggacagcactctaaatcatcagcagtgtgagcrgtgattcaatttgggaaagtgagtataggtttaaattctggccacagacaacctctcctacacaattcactgaacctcccctggaaggaggtttccacatcctgcagaggctaactgggcaccaatcatgcttccactaaccgacttggctgcttcctctagcgcttagtacttcaccgttccctttcttcatgggagatggtgtggtaattgataatcacaatacaaactctgaaacaagtaaacggacaataaaactcatatttgcctaaaatgagtttcgataaggatctcggtggc

SEQ ID NO: 24977 - DNA, 601 bp, Human
actacctgcactgcgaggccctggtgcccgtcatccaccgtgatctcaagtccaacaacagtgagtttctgggggcatggttgggggtggcatggctctggtacacacctgctcccaaccttccactgagcctagcttagggtctactgcaggtaggagctcccaccctagggggtcccagctgaccaggggtgcccatgggctcaagctagcccccaaacagagccccaggcacccagcagagtcttcctgcgccagcttcagaagtccttgaccccagcctgcagctgcggtttggacragttaagaaattggtatctctcaggtgggccataagcatcctgcccagccatggctcccacctcaaggaagtcctctggaagctcgtgctcctcatcttctcctcccctaaattcatgttcgtggagttggtgctctgtcctcccctcccgtcgtcatgggcagctcctccagaacagatatctcagagagggaagccctccttggcagtcaaggctaaggccagggctggaattctggcctagccctccctggcttcatgacctctagctggttactccaactcggagcctcaatttca

SEQ ID NO: 24978 - DNA, 601 bp, Human
actgagcctagcttagggtctactgcaggtaggagctcccaccctagggggtcccagctgaccaggggtgcccatgggctcaagctagcccccaaacagagccccaggcacccagcagagtcttcctgcgccagcttcagaagtccttgaccccagcctgcagctgcggtttggacgagttaagaaattggtatctctcaggtgggccataagcatcctgcccagccatggctcccacctcaaggaagtcctctggaagctcgtgctcctcatcttctcctcccctaaattcatgttcgtrgagttggtgctctgtcctcccctcccgtcgtcatgggcagctcctccagaacagatatctcagagagggaagccctccttggcagtcaaggctaaggccagggctggaattctggcctagccctccctggcttcatgacctctagctggttactccaactcggagcctcaatttcagaatctgtaaaaagggagagtgaaacagctcaacagcttgggcaagcccgacctgcgatccccaacccacagcgggtcctcagccatggagatggacatttgagggctggatcgccaagagggc

SEQ ID NO: 24979 - DNA, 601 bp, Human
ctctggaagctcgtgctcctcatcttctcctcccctaaattcatgttcgtggagttggtgctctgtcctcccctcccgtcgtcatgggcagctcctccagaacagatatctcagagagggaagccctccttggcagtcaaggctaaggccagggctggaattctggcctagccctccctggcttcatgacctctagctggttactccaactcggagcctcaatttcagaatctgtaaaaagggagagtgaaacagctcaacagcttgggcaagcccgacctgcgatccccaacccacagcrggtcctcagccatggagatggacatttgagggctggatcgccaagagggcctagcctgaaatcagtgcttgggatgggagtgctgggctaagggagactccatctcccatcatttcaagcccccgacacgctgcccatcatggcccaagagaagtgagtgacagcttcagagggtttcctggtgcacgcagcatttagagagagaaggcatggaagcaggacccagcacacagcagggaccaggagcaggggcctcctagagcccagagtgcaggctggagagcagcagtaggaaatgca

SEQ ID NO: 24980 - DNA, 601 bp, Human
gaggtagcagaaagaccacaagtacaaagaagtcctgaaactttgggtgagttgttgcccctctctgggcctcagattccccacctgaaaaaggtggagagtggccacccggcctgagatactggaacagcactttgccagtctggggtgccacaagtggctagagacaggccaagaagcagcaagtgttggtcttcaaaggggaaggtgggccctggcaccaggggaggtgcccatttccactccacccactgccccagcctgctgtgtttcccctttggaatgagcttgtcgtcggggrcttgctaaatgctcaggtccccgcctccagcagccagaccagaggctgttttgaagttggcagtaaggagtgacagaggagggagaggagggcggagatacgataagtgctttaggacaactggcctttaggatgcttctgccaggtggcagcccccatgcaaaaactttaaaagtgtggtcttgtttcatgctcgtgacagccatctgaggagggttttgttgtcatcctcagcttgatgaagtgttcaggactcagctccaaggtctggctcagaggagtgggtagattttgagacca

SEQ ID NO: 24981 - DNA, 601 bp, Human
tccttatccagacccaggggctcaagaaagcagtgaggctggtcacagtctcacagccatcgtgccgctccctatgtggcctgggagctggccttgggcccctgcaggttggggtcctggctctacttcatcacaaacctgaaccctgctccccccaacccaaatcccagacttcaagcaccgcatcaccgtgcaggcctcacccggccttgaccggaggagaaacgtcttcgaggtcgggcctggggattcgcccacctttccccggttccgagccatccagtgtaagaaacttcacctstcatgcccctctccgccccccagctccttattctctgtcagaccttattcttggaggcggagcccactcactatcccctcttcctccccgcccccaggctccctgccttaggtctagcctgttacctctgaactccccaagcagcattaattttacttatttttttttagtcaaataattgtatgacactatgtactactaattttctaaatgctttgctaatattaatttcttgcaataattctatttggtagttatttttgttgttaatttaagttttatggatgagaaaagtgaaaa

SEQ ID NO: 24982 - DNA, 601 bp, Human
cttattctctgtcagaccttattcttggaggcggagcccactcactatcccctcttcctccccgcccccaggctccctgccttaggtctagcctgttacctctgaactccccaagcagcattaattttacttatttttttttagtcaaataattgtatgacactatgtactactaattttctaaatgctttgctaatattaatttcttgcaataattctatttggtagttatttttgttgttaatttaagttttatggatgagaaaagtgaaaaaagtaacttgttacacagttaataagyggaagagccagaatcaaactcaggcagttggtgtcagtgtctgtactaattactaagcagcaaacttcagcccaagggctagatgagatgccccaccccactgttggccccaagacccaaacccatctatcttgcccaaagctcaccctgggaatggtacagggcccagcctgctccccatactctaaagtttatccctgaagcctgactgtgatgatggagggagaataaagattatctccgatttcatcggtttcccctgcagtggagcctgcagagccaggccaggcatggggccgc

SEQ ID NO: 24983 - DNA, 601 bp, Human
acccaagggaagctggacccagatgggggaaggaatcagcctgtgtggggtggagccaaacaagtgtcagccacactgtgcttctcagagccccttctgggagcctgtaggtgaagaagagaatgagaaggccgagcaggcaggatccaggacccattctcaccacatccaggatagctcggggcctttctgttctccatgacggtaactgccctactgtgccaggcattccctccaagcattgatgaagaggggctactattaccccattttgcagataaggaaactgaggctctgagargtgaagtaacctacctcaaacccccagctgaggatttgaacccagagaggcttcagctccaatgctctcgtagtgagctcagaagctttcacttgaagaaagggcttctcacgtatagactgcttaggaagccagagggtcaggcagaaggcagggctccagcattgcagggaggagggctcactcagctcaacactgcccagctctgagtgaggccagagagttatggcctcccttgcctgtgggtccctgtgccaacctagggaccatcctcagagcccccacacctgctgctcacag

SEQ ID NO: 24984 - DNA, 601 bp, Human
agtgtcagccacactgtgcttctcagagccccttctgggagcctgtaggtgaagaagagaatgagaaggccgagcaggcaggatccaggacccattctcaccacatccaggatagctcggggcctttctgttctccatgacggtaactgccctactgtgccaggcattccctccaagcattgatgaagaggggctactattaccccattttgcagataaggaaactgaggctctgagaggtgaagtaacctacctcaaacccccagctgaggatttgaacccagagaggcttcagctccartgctctcgtagtgagctcagaagctttcacttgaagaaagggcttctcacgtatagactgcttaggaagccagagggtcaggcagaaggcagggctccagcattgcagggaggagggctcactcagctcaacactgcccagctctgagtgaggccagagagttatggcctcccttgcctgtgggtccctgtgccaacctagggaccatcctcagagcccccacacctgctgctcacagccagaatgtaggacccgcttagctgctctcagaagagtcctgttcagcaagccgtttaaact

SEQ ID NO: 24985 - DNA, 601 bp, Human
ggcatgtgccacaatgcccggctaatgtttgtatttgtagtagagatgaggtttcaccatgttgaccaggctggtcccgaactcctgacctcaagtgagccacctgcttcagcttcccaaagtgctgggattacaagcgtgaaccaccatgcccggcctaatttttgtatttagtagagacagggtttgaccatgttggccaggctagtcatgcactcctgacctcaagtgatctgccctacttggcctcccaaagtgctgggattataggcttgagccaccactcccagcctctcttgctttttttttttttttttttgagatggagtctcactctgtcacccaggctggagcgcagtggcgggatctcggctcactgtaacctccgcctcctgggttcaagcgattctcctgcctcagcctcccaagtagctgagactacaggtgcgtgccaccatgccctgctaatttttgtattttttagtagagacagggtttcaccatgttggccaggatggtctcgatttcttgacctcgtgatccgcccaccttggcctcccaaagtgctgggattacaggtgtgagccaccgcacccggcca

SEQ ID NO: 24986 - DNA, 601 bp, Human
accatgccctgctaatttttgtattttttagtagagacagggtttcaccatgttggccaggatggtctcgatttcttgacctcgtgatccgcccaccttggcctcccaaagtgctgggattacaggtgtgagccaccgcacccggccaactctttcttttttttaaacatgatttcccctcttctgtttaaactcactgtaaatgatcagttcttcacctgcgaagtgggggtgataatgataacctcgtggttggtgcaaggattataaaaatggattcttcatcaaacaagaatttgcttttttttttttttgagacggagtctcgctctgttgcccaggctggagtgcagtggtgtgattttggctcactgcaagctccgcctcctgggttcatgccattctcctgcctcagcctcttgagtatctgggactacaggcgcccaccaccacgcctggctaattttttgtgtttttagtagagacagggtttcaccgtgttagccaggatggtctcgatctcctgacctcgtgatcatcccacctgggcctcccaaagtgctgggattgcagatgtgagccaccgcgcctggcccaggga

SEQ ID NO: 24987 - DNA, 601 bp, Human
aaagccaaggtgggaaaggtcagccacccagagtgaatagtgtgtgcgcaggcatgcagctcaccatacccaaggaaaaggcaacctggctgaactccgagaagagttgagagccgaggagtctcaggactggggctgcggacaggggccaaggcacatgggtcagtagatgttgattgaatgaatgagtgaatgaagctggaagtgatgggtagtttttaagcagagacctgtctttaacaggtttgcattttagaaggattcccttgtcccttcagtggcagtggccggggtgggagtygggtgaggtaagaggcagagagtctgagtaagggttggggctgacagaagggactgtgagctaagtcctggttcatagtagaagctcatttttcccagccttgtatttctccctcccgacatccaacctgctgctgcactccaggcaggaggggaaaggcagagggacaaggccagggagggcttcagaggaccagccaaggaggccagactttctcctagtgacagtggagagccacagcagtttctagagccaaggagggatctgacaaaatcagggcttgtgagagcccatcctaga

SEQ ID NO: 24988 - DNA, 601 bp, Human
agccgaggagtctcaggactggggctgcggacaggggccaaggcacatgggtcagtagatgttgattgaatgaatgagtgaatgaagctggaagtgatgggtagtttttaagcagagacctgtctttaacaggtttgcattttagaaggattcccttgtcccttcagtggcagtggccggggtgggagttgggtgaggtaagaggcagagagtctgagtaagggttggggctgacagaagggactgtgagctaagtcctggttcatagtagaagctcatttttcccagccttgtatttctycctcccgacatccaacctgctgctgcactccaggcaggaggggaaaggcagagggacaaggccagggagggcttcagaggaccagccaaggaggccagactttctcctagtgacagtggagagccacagcagtttctagagccaaggagggatctgacaaaatcagggcttgtgagagcccatcctagagtcccttgtccttaatgaggggttccccatccctgcccaagtggtctagaatggagtcaggccaaccctagactggaaggtaggacactagtgtcttgaaatctagggcag

SEQ ID NO: 24989 - DNA, 601 bp, Human
ctggggctgcggacaggggccaaggcacatgggtcagtagatgttgattgaatgaatgagtgaatgaagctggaagtgatgggtagtttttaagcagagacctgtctttaacaggtttgcattttagaaggattcccttgtcccttcagtggcagtggccggggtgggagttgggtgaggtaagaggcagagagtctgagtaagggttggggctgacagaagggactgtgagctaagtcctggttcatagtagaagctcatttttcccagccttgtatttctccctcccgacatccaaccygctgctgcactccaggcaggaggggaaaggcagagggacaaggccagggagggcttcagaggaccagccaaggaggccagactttctcctagtgacagtggagagccacagcagtttctagagccaaggagggatctgacaaaatcagggcttgtgagagcccatcctagagtcccttgtccttaatgaggggttccccatccctgcccaagtggtctagaatggagtcaggccaaccctagactggaaggtaggacactagtgtcttgaaatctagggcagagtctggctgggaaatgg

SEQ ID NO: 24990 - DNA, 601 bp, Human
cagaggcccactgtgacctggccccagcctgcctccactgggactgcccatccatctttcgggtctggggtcgctggctgccattgggctttgctgccgcttcctccacctgcactgccctcccctcccagtgcccatcttgtgaaaggccagaatgtgggtatgtgatggggaggccatgggacctgtgggaccagggaagatgctagtagagggcagaactcagtccttgttccaagaccacggagaggtcttgggccctcacccggaatatgcaccagccacaccctcacctgtgccrcctctgcccgcaggtaaccccccgcggcctagcctggagcccgaggagcccaagaggcctgtccccgcagagcgcggtagcagctctgggacgcccaagctgatccagcgggcgctgctgcgcggcaccgccctgctcgcctcgctgggccttggccgcgacctgcagccgccgggaggcccaggacgcgagcgcggggagtccccgacaacaccccccacgccaacgcccgcgccctgcccgaccgagccgcccccttccccgctcatctgcttctcgctcaagacgcccgactccccg

SEQ ID NO: 24991 - DNA, 601 bp, Human
ggccagcggtcagccaagagcccccgacgtgaggaggagccccgcggtgagtggcctgaagccggcctgcttcacatatgggagacgggggttcccagggagggaggagtggctggtggggacatgcaaggaggcaaggccgagaccacagtcatcagctggaccctgaaccaggcattcggggtactgaagacgcatgtagggagcagagttctaagttcagctatcaggtggtccaggcaggtgggggcgatgcctgctgtgaaataaaagaagtaatcgggccaggcagtggtgcackcctgtgatcccagcactctgggaggatcacgtgagccttgaaaggttgaggctgcagtgagcggtgatcatgacactggactccagcctgggcgacacagcatacatgtaatcataatcgtagcaaactcctggctccttacttgtgccaagtactgtttgcaaggctttcccgagatggtctcatttagtcataacaaccagagaactaagcgctcctggatgcccatttttagatgaggaaatttaaggcacagagattaagggacccacagctcccacagctagtaagtggcagggc

SEQ ID NO: 24992 - DNA, 601 bp, Human
gtggggacatgcaaggaggcaaggccgagaccacagtcatcagctggaccctgaaccaggcattcggggtactgaagacgcatgtagggagcagagttctaagttcagctatcaggtggtccaggcaggtgggggcgatgcctgctgtgaaataaaagaagtaatcgggccaggcagtggtgcacgcctgtgatcccagcactctgggaggatcacgtgagccttgaaaggttgaggctgcagtgagcggtgatcatgacactggactccagcctgggcgacacagcatacatgtaatcawaatcgtagcaaactcctggctccttacttgtgccaagtactgtttgcaaggctttcccgagatggtctcatttagtcataacaaccagagaactaagcgctcctggatgcccatttttagatgaggaaatttaaggcacagagattaagggacccacagctcccacagctagtaagtggcagggccgggatccacatccaggccagcctgctgcagaggcctcactcctaactattacaaaaaacagaggcaccacggagcaggaagggcggtggaagttgagtcaagtaggtcactgtg

SEQ ID NO: 24993 - DNA, 601 bp, Human
atgacactggactccagcctgggcgacacagcatacatgtaatcataatcgtagcaaactcctggctccttacttgtgccaagtactgtttgcaaggctttcccgagatggtctcatttagtcataacaaccagagaactaagcgctcctggatgcccatttttagatgaggaaatttaaggcacagagattaagggacccacagctcccacagctagtaagtggcagggccgggatccacatccaggccagcctgctgcagaggcctcactcctaactattacaaaaaacagaggcaccrcggagcaggaagggcggtggaagttgagtcaagtaggtcactgtgcacatggggaaactgaggcccagagcaggacagtgtcttggggacctcagcagttgggggttgcttgaccctgtgcccctcctatatcctcacaggaggcactgtctcacccccaccggggacatcacgctctgctcctggcaccccaggcaccccacgttcaccacccctgggcctcatcagccgacctcggccctcgccccttcgcagccgcattgatccctggagctttgtgtcagctgggccacggccttc

SEQ ID NO: 24994 - DNA, 601 bp, Human
cactggactccagcctgggcgacacagcatacatgtaatcataatcgtagcaaactcctggctccttacttgtgccaagtactgtttgcaaggctttcccgagatggtctcatttagtcataacaaccagagaactaagcgctcctggatgcccatttttagatgaggaaatttaaggcacagagattaagggacccacagctcccacagctagtaagtggcagggccgggatccacatccaggccagcctgctgcagaggcctcactcctaactattacaaaaaacagaggcaccacggggcaggaagggcggtggaagttgagtcaagtaggtcactgtgcacatggggaaactgaggcccagagcaggacagtgtcttggggacctcagcagttgggggttgcttgaccctgtgcccctcctatatcctcacaggaggcactgtctcacccccaccggggacatcacgctctgctcctggcaccccaggcaccccacgttcaccacccctgggcctcatcagccgacctcggccctcgccccttcgcagccgcattgatccctggagctttgtgtcagctgggccacggccttctccc

SEQ ID NO: 24995 - DNA, 601 bp, Human
tcgtagcaaactcctggctccttacttgtgccaagtactgtttgcaaggctttcccgagatggtctcatttagtcataacaaccagagaactaagcgctcctggatgcccatttttagatgaggaaatttaaggcacagagattaagggacccacagctcccacagctagtaagtggcagggccgggatccacatccaggccagcctgctgcagaggcctcactcctaactattacaaaaaacagaggcaccacggagcaggaagggcggtggaagttgagtcaagtaggtcactgtgcasatggggaaactgaggcccagagcaggacagtgtcttggggacctcagcagttgggggttgcttgaccctgtgcccctcctatatcctcacaggaggcactgtctcacccccaccggggacatcacgctctgctcctggcaccccaggcaccccacgttcaccacccctgggcctcatcagccgacctcggccctcgccccttcgcagccgcattgatccctggagctttgtgtcagctgggccacggccttctcccctgccatcaccacagcctgcaccccgccgagcaccctggacctt

SEQ ID NO: 24996 - DNA, 601 bp, Human
cacaggaagccttcacactggaagggggacctgcgcccccacatctgaaacctgtaggtccccccagctcacctgccctactggggcccaacactgtacccagctggttgggaggaccagagcctgtctcagggaattgcctgctggggtgatgcagggaggaggggaggtgcagggaagaggggccggcctcagctgtcaccagcacttttgaccaagtcctgctactgcggcccctgccctagggcttagagcatggacctcctgccctgggggtcatctggggccagggctctctggrtgccttcctgctgccccagccagggttggagtcttagcctcgggatccagtgaagccagaagccaaataaactcaaaagctgtctccccacatgtagcctgtcacctttcttggaggtaaccaggtgacccaacctatcatacaaccctggtgtcctgatgccccaacaataggcagttggatgccttgtactgcatgcctctcctgggaccaaatccaccagccttggtcagtcattcaaggctcttctcggccaggtgcagtggctcactcctgtcatcacagcagtttgggaggccg

SEQ ID NO: 24997 - DNA, 601 bp, Human
aatgtccctactattagttattgtgaagtaagaacttcatagtagagcaatttttgtagagcaagatttgcatactgttacaagtctacaatttgtggagacaagtttggatgttgttcctttagttcactctcacctccaactggaaaaagagagcgtatgcatggctagatacattttgggtggagggtgctgtttctagcaaaaaaaaaaaaatctctttataagaaacctatccttaaaaaactctattacattactgcagaaaaatacaaactaaaaatttacattattgtcacaygcaatgcagcatttacctggactaagtccacatcttgctcttgtgtttctagagtcgctgggaagctgtgagacaccacaccccagaacagcagcagcagcagtggaggaaagctgtgcatactggcctttgtcttctttctcagtgcaaggtaagtgatggcttcccagcctcttgctgctccaatatcccagctaggaagctccctctgtatatatagagtccttgcccttccagaaagccagaggctgtctgactcatgctttataacatcctcttgattagctatgaatagactag

SEQ ID NO: 24998 - DNA, 601 bp, Human
cctctgcctcctgggttcaggcggttctcctgcctcagcctcctgagtagctgagattacagacgtgtgccaccatgcctgtctaatttttatatttttagaagagacagggtttcaccatattggtcaggctggtgtcaaactcctgacgttgtgatctgcctgccttggcctcccaaagtgctgggattacaggcatgagccactgcgcccagcctaatatttaatatttttcttatttacaaaactgataaatgttgactgctggaaattttggaaaacacaaaaagccttccttttytttaatttccacataagtttatgaccgctgttaaatttcactgttttcttctaatgaaaaagtttcaatgttgatgcccacaattaaaacatcaaagttttcaacaattttcttaataaaaattttagagtggcctagttgtcactgctaagatgttgttagctagcagaaaagaccgctctttcacttttctaagtgtatcactaattttctgagtggtaatagaaaaatatatacttctatgaatgcattctttcaactaaatcaaccaatattacaatgaaacatgaaggggtggga

SEQ ID NO: 24999 - DNA, 601 bp, Human
taacatttaatatttttctttttctttttttctttcttgagacggagtcttgctctgtcacccaggctggagggcagtggcatgatcttggctcactgcaacctctgcctcctgggttcaggcggttctcctgcctcagcctcctgagtagctgagattacagacgtgtgccaccatgcctgtctaatttttatatttttagaagagacagggtttcaccatattggtcaggctggtgtcaaactcctgacgttgtgatctgcctgccttggcctcccaaagtgctgggattacaggcatragccactgcgcccagcctaatatttaatatttttcttatttacaaaactgataaatgttgactgctggaaattttggaaaacacaaaaagccttccttttctttaatttccacataagtttatgaccgctgttaaatttcactgttttcttctaatgaaaaagtttcaatgttgatgcccacaattaaaacatcaaagttttcaacaattttcttaataaaaattttagagtggcctagttgtcactgctaagatgttgttagctagcagaaaagaccgctctttcacttttctaagtgt

SEQ ID NO: 25000 - DNA, 601 bp, Human
atcaatttgtaattatttgaaaggtattcagttttgaggcatttaactaataaataatttacaactacaaggactcatgttactattttatcagtgacttttgaaatatatgcatgtatatcttttttccgaaggcagaaggcatgcatttattaataacgaagagacatgttgaaacctaaactctatgattacattgatacaattaaaagacaaactcagctgactgaaagcgcaccacagattaatcaatattatcaatgattaaatgacacgtactatttcacacagaagcaaaatkttctattaacatttaatatttttctttttctttttttctttcttgagacggagtcttgctctgtcacccaggctggagggcagtggcatgatcttggctcactgcaacctctgcctcctgggttcaggcggttctcctgcctcagcctcctgagtagctgagattacagacgtgtgccaccatgcctgtctaatttttatatttttagaagagacagggtttcaccatattggtcaggctggtgtcaaactcctgacgttgtgatctgcctgccttggcctcccaaagtgctgggattac

SEQ ID NO: 25001 - DNA, 601 bp, Human
atcaaagccccgatatcagtagaatgggagagtccaagagaatggccgagttcatgagccgcaacacgatgtaagttgtactctaaaaaggccaataaatcaatttgtaattatttgaaaggtattcagttttgaggcatttaactaataaataatttacaactacaaggactcatgttactattttatcagtgacttttgaaatatatgcatgtatatcttttttccgaaggcagaaggcatgcatttattaataacgaagagacatgttgaaacctaaactctatgattacattgatamaattaaaagacaaactcagctgactgaaagcgcaccacagattaatcaatattatcaatgattaaatgacacgtactatttcacacagaagcaaaatgttctattaacatttaatatttttctttttctttttttctttcttgagacggagtcttgctctgtcacccaggctggagggcagtggcatgatcttggctcactgcaacctctgcctcctgggttcaggcggttctcctgcctcagcctcctgagtagctgagattacagacgtgtgccaccatgcctgtctaatttttatat

SEQ ID NO: 25002 - DNA, 601 bp, Human
tactgattttctaaatcaactatattttctgagaatcagttgacctaatacatgtagaaaaacaaagttgttacaagtacattatgttgcacaaatgcatgtggttgctaccatgtgattatagatgtaaatcagcatgaaataagtaacatgtgaagcataatagttaatcatagtggtgaatgttgttattattacaaatgcagatcacaaagaagaactgacatcttacctgtctttaaagaacatcacttctccccgaatcgtagttatagcatcaaaggttagcttactgtcacaygcttttggggtttgtgggccgatgggctggacaggattttgggaacgtcctaaggaaaataaaatacctggagttagttttgcctagtattagaaaactacataaacaatgaagacagcttcttcaaggatatcgctaatggctgttttatttgaaatacatataaagaccaccaggcccttgtccgtaatgtttttccccatactcaccatatatggcttggatgccatcaatgtcatcctgagctagctgaacatcaccactgaaggtgtagctagggtacatcaaagccccgatatc

SEQ ID NO: 25003 - DNA, 601 bp, Human
gggggcaacagagacccttcaagttaataggctttgggagggccatttttccaggatggcaggggagataattaaaggatggctatgcaaccctcatcagtgagatgttgctatggaaaggaccactttctcctaagaaagtccaatgatacttatcaccataaagagtggcataatgaaaagagacctgaaatagggaacagaagaccaataactgctctgctaccaatgagctctatgcccccaaaagatctctttccttctctctgacttactttgctaatctgtaaaaaaagatcayacatactgattttctaaatcaactatattttctgagaatcagttgacctaatacatgtagaaaaacaaagttgttacaagtacattatgttgcacaaatgcatgtggttgctaccatgtgattatagatgtaaatcagcatgaaataagtaacatgtgaagcataatagttaatcatagtggtgaatgttgttattattacaaatgcagatcacaaagaagaactgacatcttacctgtctttaaagaacatcacttctccccgaatcgtagttatagcatcaaaggttagcttactgtc

SEQ ID NO: 25004 - DNA, 601 bp, Human
agtgattacttacaacacaccaggcccattccttacatcagaccttatcacaaggacactacaagagagtatttgaggatgagaaattgaggttggggagactaagggaggtgtctaaggccacccagctggtaagaggctaaggttgatttttaaactccgctctggcagccaatccctttgttgtcccttggttagtagtatttacacaaagtggattatagagcttaatagggactagggtaacagcacagcatagactgttatgtgggctgacacagaagagctccagattccaggycacagggaagcctacggccttggctgtcggaaacctgacttctaggtccagtccttcctctgcctggctgtgatgccttaggcaaatcagttactatctctatctctagcctttcatgtctcctcgacatggcgacatttaaatgatctctgtgtcctttcaattctggcaaatcctcaaattggtcctgttccatctagtaatatttggtttgataggtgtgtcctgttgtactgagaggtttcctttaaaaccatgtgttttcttaacttgtcccagcattgaaccacaccctgtata

SEQ ID NO: 25005 - DNA, 601 bp, Human
cattgatttggttggtgagactgagattttcaaaagtccctggagagaatgtagctagtaaccttatatctcagccccaaagggaatgaaaaattgatttattaaagcagtgaaaaataattagaaagattacctttgaaaaaccggacttcatctctgtcggcaaattcgtaagcagcttcaagcccatttggcagttgtggccagaaaacagaaatgaaattgagctcaacttccgggtagaagggatttgtgcgcatgtagaatctgattagaaaaaaagcaagaaaagtttccatcyaatttctggtaatctctggcagatatccagctccagctccttcttgttgctggcactagtggtgtgctggtaaatgtataacattcagctctccaaagaagggttggtttatagcatttgctgatttcactagcttgaaatactcccattatgatgaatttcaagagtctcagtggagcaccattgtatagcatacaaataaaataggcataagtaactttaagaacataaataagtagaaaaatgcagtaaaaattatgacaaactgatgaatttttattatttttattaccttttatt

SEQ ID NO: 25006 - DNA, 601 bp, Human
ttagttaagttgatggactttcattgatttggttggtgagactgagattttcaaaagtccctggagagaatgtagctagtaaccttatatctcagccccaaagggaatgaaaaattgatttattaaagcagtgaaaaataattagaaagattacctttgaaaaaccggacttcatctctgtcggcaaattcgtaagcagcttcaagcccatttggcagttgtggccagaaaacagaaatgaaattgagctcaacttccgggtagaagggatttgtgcgcatgtagaatctgattagaaaawaagcaagaaaagtttccatctaatttctggtaatctctggcagatatccagctccagctccttcttgttgctggcactagtggtgtgctggtaaatgtataacattcagctctccaaagaagggttggtttatagcatttgctgatttcactagcttgaaatactcccattatgatgaatttcaagagtctcagtggagcaccattgtatagcatacaaataaaataggcataagtaactttaagaacataaataagtagaaaaatgcagtaaaaattatgacaaactgatgaattttta

SEQ ID NO: 25007 - DNA, 601 bp, Human
atggggagtggatgggataaggtggaatgttgggtgaactaaaaggcctttaaggcccctctgaaatccagcatcgaattctccagtaggttctacgctatgtcctatcgaggtaacatactatggaagataagtaacttttggccaaagtagctccgttaagatgaatgtcctcaattctacatccttttaaaattcatccccctacattctctggattcccagtgcaggcattgtgtgatgattattggtcaatagactaaatagatgatagattggcaccagccatctgaaggaaagkatgccggccaaggcagtttgagactcactttgaaatgggctattctagaactttttatgtagaaagaactgaggccctaacattctctgcacttaaacttacctccagtatttgttagcaacaaagaagtaggtttttccagtgttttcctcagaaagagcagcatcgatatgcttcacagttctagggaagccaaaggagctgtagatgtccttggggtatccgtgtagcacattctgtccctgaacagcccagtacttattccctgccaatcaagaaagagtgataaaacacttgcct

SEQ ID NO: 25008 - DNA, 601 bp, Human
ttccaactaacaataatgatgttattgctacggcaatgaaatggaggaaatacatgtatattcacttaccatctttcatgaaaactgcatcaactttgtggccaattccaggaaagtcatgtgctatcattttgggataacctggatccatagatcgtttatattcatcatacctggtcagaaaagagttaagagtgtcagaccttttgctaaacatgtgcactctgaaaatcattacagaaaatacacaatgaggaatttaaccagaatatttcattttatagatcatttgtgaaatggrgagtggatgggataaggtggaatgttgggtgaactaaaaggcctttaaggcccctctgaaatccagcatcgaattctccagtaggttctacgctatgtcctatcgaggtaacatactatggaagataagtaacttttggccaaagtagctccgttaagatgaatgtcctcaattctacatccttttaaaattcatccccctacattctctggattcccagtgcaggcattgtgtgatgattattggtcaatagactaaatagatgatagattggcaccagccatctgaaggaaaggatgc

SEQ ID NO: 25009 - DNA, 601 bp, Human
gtctctttctgtcttgaaaggatatgtttgtcactgaagctgctctctgggatcaacgtcagagttgcatactctggaaaagatctttgcaactctggcctatatgaatccataagccacaaacttgactttttgtacccaccatttgtggaactaaattatatcagtacaaaaagggctacattctaaatagtaaaaaaatatgcaaactgaggtataaataagattatattctgtgtatcagtgactctagaggttaaaaatgactgagaaaatagacagttcttcaggaaaacacctyctttggactcacaccatgtgttttccattcaaattagtaatgttcaatttttcctgcagttgaaccagctattagctttctggagagtcaaaattctcttcgttttaggatcaaatttgtattgtcttgttccatgaaagaaatagaaaaatcctagaaacaaaacaaaagagacttactacattatacaagtagtttctaggtttaacttgaattcttgagaaaccaattcatctgtgagcacagatatttttggcatttgctgttccaactaacaataatgatgttattgctacggca

SEQ ID NO: 25010 - DNA, 601 bp, Human
gcaaagactcatgtctcctgtctctttctgtcttgaaaggatatgtttgtcactgaagctgctctctgggatcaacgtcagagttgcatactctggaaaagatctttgcaactctggcctatatgaatccataagccacaaacttgactttttgtacccaccatttgtggaactaaattatatcagtacaaaaagggctacattctaaatagtaaaaaaatatgcaaactgaggtataaataagattatattctgtgtatcagtgactctagaggttaaaaatgactgagaaaatagacarttcttcaggaaaacaccttctttggactcacaccatgtgttttccattcaaattagtaatgttcaatttttcctgcagttgaaccagctattagctttctggagagtcaaaattctcttcgttttaggatcaaatttgtattgtcttgttccatgaaagaaatagaaaaatcctagaaacaaaacaaaagagacttactacattatacaagtagtttctaggtttaacttgaattcttgagaaaccaattcatctgtgagcacagatatttttggcatttgctgttccaactaacaataa

SEQ ID NO: 25011 - DNA, 601 bp, Human
gatctctacttttaagtaaaaaggaggccaatgagaagaaagaaagaaaacctgagggcaaatgttaggattggaactggtttaatggaattcattctatcctaatcatctatcattaaagtgatgaaaaacattattaattatgctgatcctcaaacccccacaagatcctgagttgtggagatgaggttgaatggtttttacaatattgtacttggtgggggcaaacatgaaaatacagacattttataaaattcttcaataatgattgaaacaaacagtacttctgtttaaaactcargtaataaaaaaattcagttactagtatattcgatttattgctcgttctagataatccaattatttttgggtaggattggacattattcctgaaatgttcccgagaggtttacgacccacctgatgcatcttctgtccatttttcatcatcatcaaagtgaatatctccataaagcccaggtccaggtgggtaggcatgagccaaactgtgtcctgggccatcaaaagagtaaaagtctccatgttctgatagggaacaaattaatggaaatataagtgttcagaatttctttttaccctg

SEQ ID NO: 25012 - DNA, 601 bp, Human
caaatcagaaatactttaggtagcactggaaagctttctggaggactgtcattgtagagctgcaatgcctaatttttccagcatcactcaccgtagagagactgaatgccattcacatcatcttgcgaaaggcggaactgggcgagctctgtgaatgagttgtagagtgggtacatcaaagcttcagtgttggctgagtgaaagagccccagggagtggccaagttcatgagcagcaacgaggaataaattggtgcctgtatgaaaatcataaatgttcagaattcaccagctctttcttycataaatacacatacagaacatatgccagctgtacaggccatccttgaaaccacaatgtcttttcagtatttgtggattggttcattgattggcacattccatactttatagaaattaatgtgtttttcaaggttgactttaagtcaatatataagacagtttttcaccgtatccctccctagatccctccttggtcaggaaaactaagacacttttcctatattgacaaatgagaagcattattttcaaaagatttttttttgaaaggacaagactaatagcatgtcagtaaatataac

SEQ ID NO: 25013 - DNA, 601 bp, Human
tcaaagtgcttcaggccaaatcagaaatactttaggtagcactggaaagctttctggaggactgtcattgtagagctgcaatgcctaatttttccagcatcactcaccgtagagagactgaatgccattcacatcatcttgcgaaaggcggaactgggcgagctctgtgaatgagttgtagagtgggtacatcaaagcttcagtgttggctgagtgaaagagccccagggagtggccaagttcatgagcagcaacgaggaataaattggtgcctgtatgaaaatcataaatgttcagaatycaccagctctttcttccataaatacacatacagaacatatgccagctgtacaggccatccttgaaaccacaatgtcttttcagtatttgtggattggttcattgattggcacattccatactttatagaaattaatgtgtttttcaaggttgactttaagtcaatatataagacagtttttcaccgtatccctccctagatccctccttggtcaggaaaactaagacacttttcctatattgacaaatgagaagcattattttcaaaagatttttttttgaaaggacaagactaatagca

SEQ ID NO: 25014 - DNA, 601 bp, Human
acgaaacagatataactccctgccttaatcaaacttacagtctagggaccaagaatcatcccttataagtctgtaaaaaatgatctggacaattctaagaagatgttaaaaattcagcaagaactagatctgaatgattttaaaatgtagaggaaattttatattttaaaaaatctctgtcaagcagaaaaagtaactactgggtactaggattagtactggggtgacaaaattatctgtacaacaaacccctgtgacacgagtttatctatataacaaacctgcacatgtacccctgaasctaaaattaaaaaaaaagctctgtcaagtttctgtttttctttctaagcactgtacatcaaaagaatagataggaaaatataattttctggtctgacctgtctttaaagaacagatattctcccctcagagtgctgatggcatcgaaggacaaagcaggatcacacttggctggcatctcagatcccgaaggaacagattttgtgggcaccaggggttcctcagtagaggcagggggaggtcctaaaggaaacagatttggggatgcaaacattaaaaaaaaatgtgatgcatctgtcaa

SEQ ID NO: 25015 - DNA, 601 bp, Human
cctgcatgtgattccagggtaatgaaatcgatggcaggacttgtgactggttccagtaaaattatttagcttggttccattctaaaagtccataaacagtgtgcatattatgtcctaatattttaaaaaatattatgtgtatattgatgcttgtatatgagtagaacatttttgtaaagagtcaaaggaaattggtagcagtggttgcacatatgaagggagctggaggacggtaggccaaagactggagagagattttttaactccgtatcttttggtagtgtttaaatattgtgccacragcacatatcacttttttccaaaagtaattaatttaaatagtagcatatattagtaaatggaaagataccaccctgcttctaaggatccaccagtgctttctgaagaagttccatgatatatgatattttaaaaaaatgaacgaaacagatataactccctgccttaatcaaacttacagtctagggaccaagaatcatcccttataagtctgtaaaaaatgatctggacaattctaagaagatgttaaaaattcagcaagaactagatctgaatgattttaaaatgtagaggaaatttt

SEQ ID NO: 25016 - DNA, 601 bp, Human
acttagattaagtacaagttaataatggagggcatttattaagtgattactctatgccaagcactgagctaagtgctttacatgctttatctcaattacccttacaaaaaactgtgatgtgttattaatgagaacaaaactaaaaattaagacggttttgtaattttaacaaggtagcatctgtaaggaaggaaggagggaggactccatctcatctgactccaaaggaagtgctctaaaacattacgtcatactggttctaaagagataaaattctataatattttaaaaccttgttttmctttctttccaacctcccctcttctgctaggttctaaattacagtttgggagacaactagacccaagagaatcagacaaatgataaatgagccagaggtccatttcctgctttgcatccatcatggttaagtcattttagtaacaagatcatcagcctcatgaccattggattgtcaagcactggcagctccctccaaaattccttcagagtaatcaagaacaagttttgctttcctatttgcccattaccaggaatcacatttgacctattttgagcatatgggaggactagtatttta

SEQ ID NO: 25017 - DNA, 601 bp, Human
gccacatgactaatttatagagtgtgtgttcctaccacacctactggcagactatctgtcaaataatcagtccccagtatgatcagggtattgaacatgaattgttctagaaagtaaggaacaggcccaaaataaaactttttattgaggaagtaataacacatctatgaaaatacattctctcacctattgcacatgagtatttcttaattctgttcagtgcaattcaaaagcaagtgaagaattccagaaacattcttcatgacacatgcagatatctgcaaggctcatcttcttcagycacagaacatgcaggaaaaattaaccattttggctcataatacattagatgaataattattagatttattaaaaacacccatatctgtcttccccctatctcgcctagcaatgtaaccagctgttactctttaatatgtgtgtcaccatcctggcattggggtcaaactcaaactgtgatgatccactgaagaagtagaaaaatcctgtaaatatagataaggaaaatgatgagacatcttcaaatatgtcattttgcaacacatataacttagattaagtacaagttaataatggaggg

SEQ ID NO: 25018 - DNA, 601 bp, Human
cctgtaccaggcagcctctgctccattgctctgggggggtggggaaggcaaaccctggtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcragaccctctctgcccagctgcctctgctccttcctcctcctcctcctcctccaagtgtcttccagctatgcaggtaagacatgttttttttcctgccctggggagaccctgaaaacagaaaggctagtttcctggggcttagctccttcaaacatcctcaagttgctatattatctttctaaaacatagacctactgacatgcctcccttcctcagaaaccttccgtgggtggttcttacagccttcaagatggagtccagactcttttttttttttgagacagagtctccctctgttgc

SEQ ID NO: 25019 - DNA, 601 bp, Human
tagctccttcaaacatcctcaagttgctatattatctttctaaaacatagacctactgacatgcctcccttcctcagaaaccttccgtgggtggttcttacagccttcaagatggagtccagactcttttttttttttgagacagagtctccctctgttgctcaggctggagtgcagtggcatgatctcggctcactgcaacctcagcctccctggttcaagcgattctcctgacttggcctcccaagtagcggagactacaggcgcctgccaccacacccagctaaattttttcttttcttttttttttttttttttttgtattttagtacagacggggtttcacatgttggccaggatggtctcgatctcttgacctgctgatccgcccgcctcggcttcccaaagtactgggattatgggcgtgagccactgcactaggcctaatttttttatttttagtagagatggggtttcaccatgttggccaggctggtctggaacccctgacctcaagtggtctgccctcctcagcctcccaaagtgctgagattacaggcatgagccattgcgtctgacccagactccttaatgtgactaa

SEQ ID NO: 25020 - DNA, 601 bp, Human
cttacagccttcaagatggagtccagactcttttttttttttgagacagagtctccctctgttgctcaggctggagtgcagtggcatgatctcggctcactgcaacctcagcctccctggttcaagcgattctcctgacttggcctcccaagtagcggagactacaggcgcctgccaccacacccagctaaattttttcttttcttttttttttttttttttttgtattttagtacagacggggtttcacatgttggccaggatggtctcgatctcttgacctgctgatccgcccgcctcrgcttcccaaagtactgggattatgggcgtgagccactgcactaggcctaatttttttatttttagtagagatggggtttcaccatgttggccaggctggtctggaacccctgacctcaagtggtctgccctcctcagcctcccaaagtgctgagattacaggcatgagccattgcgtctgacccagactccttaatgtgactaactcaaggctttccttgaactacttcttacttgtctttccagctttgtcttttcacctctcaaattgagataaaataataacaacctcttggagttc

SEQ ID NO: 25021 - DNA, 601 bp, Human
taggccagatggtttggaggccttctataaggtattattgagtgataagagcaagctgctgtaggatacaaaaacaaaaacaaaaccctagggcatggtggtttgcctcgcagctactcaggaggctgagacgggaggctggcttgagcccaggggtttgcagttacagtgagctatgattgcaccactgcactccaacccgggtgacagagcaaagaccttcacccccactccctacccgtctctaaaaaaaacaaaaacaaaaacaaaaaaacccttgggcccagcgccgtggctcacrcctgtaatcccagcactgtgggaggccgaggtgggcagatcacaaggtcaggagatcgagaccatcctggctaaaacggtgaaaccccgtctctactaaaaatacaaaaaaaaaaaaaaaattagccaggcatggtagcaggcgcctgtagtcccagctactcgggaggctgaggcaggagaatggcgtgaacccggaagcggaggttgcagtgagccaaaatccttccactgcactccagcatgggggacacagcgagactccgtctcaaaaaaaaaaaaaaaaccctgtatttgtgag

SEQ ID NO: 25022 - DNA, 601 bp, Human
gctgtaggatacaaaaacaaaaacaaaaccctagggcatggtggtttgcctcgcagctactcaggaggctgagacgggaggctggcttgagcccaggggtttgcagttacagtgagctatgattgcaccactgcactccaacccgggtgacagagcaaagaccttcacccccactccctacccgtctctaaaaaaaacaaaaacaaaaacaaaaaaacccttgggcccagcgccgtggctcacgcctgtaatcccagcactgtgggaggccgaggtgggcagatcacaaggtcaggagatygagaccatcctggctaaaacggtgaaaccccgtctctactaaaaatacaaaaaaaaaaaaaaaattagccaggcatggtagcaggcgcctgtagtcccagctactcgggaggctgaggcaggagaatggcgtgaacccggaagcggaggttgcagtgagccaaaatccttccactgcactccagcatgggggacacagcgagactccgtctcaaaaaaaaaaaaaaaaccctgtatttgtgagcgcacacacacacacacacacacacacacctgtgcttggtcctagtgaataagcaag

SEQ ID NO: 25023 - DNA, 601 bp, Human
aatcccagcactgtgggaggccgaggtgggcagatcacaaggtcaggagatcgagaccatcctggctaaaacggtgaaaccccgtctctactaaaaatacaaaaaaaaaaaaaaaattagccaggcatggtagcaggcgcctgtagtcccagctactcgggaggctgaggcaggagaatggcgtgaacccggaagcggaggttgcagtgagccaaaatccttccactgcactccagcatgggggacacagcgagactccgtctcaaaaaaaaaaaaaaaaccctgtatttgtgagcgcacrcacacacacacacacacacacacctgtgcttggtcctagtgaataagcaagtaaatcaaatgtctaaatataattatagaaaggagatgtcaccttttggctgtacctccactatttcattctgcagaattgcagaatttcttttttttttcctttctttcttttctttttttttttgacacagagtctcgctctgtcacccaggctggagtgcaatggcgccctccgcctcctgggttcaagtgattctcctgcctcagcctcccgagtagctgggattacaggtgcccaccaccacac

SEQ ID NO: 25024 - DNA, 601 bp, Human
aaatacaaaaaaaaaaaaaaaattagccaggcatggtagcaggcgcctgtagtcccagctactcgggaggctgaggcaggagaatggcgtgaacccggaagcggaggttgcagtgagccaaaatccttccactgcactccagcatgggggacacagcgagactccgtctcaaaaaaaaaaaaaaaaccctgtatttgtgagcgcacacacacacacacacacacacacacctgtgcttggtcctagtgaataagcaagtaaatcaaatgtctaaatataattatagaaaggagatgtcacyttttggctgtacctccactatttcattctgcagaattgcagaatttcttttttttttcctttctttcttttctttttttttttgacacagagtctcgctctgtcacccaggctggagtgcaatggcgccctccgcctcctgggttcaagtgattctcctgcctcagcctcccgagtagctgggattacaggtgcccaccaccacacccagctaatttttgtatttttagtagagacagggtttcaccaggttgtcaaggttggtctcaaactcctgacctcaggtgatccactcgcctca

SEQ ID NO: 25025 - DNA, 601 bp, Human
gcagtgctgggaccagaagatggcattgtatgtggaacaacaaagcactatttctagagactgcctgcagggatatggaaatagctttatgtgtctcagaatgttcttcatacagctgtttttattggggaaattctacttgccgaaaagtttgatagtgagaccctctccagtttgcagatttttctccttcctgctcaacaacttcctagctcagtaactgcctctcccaacaaactccctcagtttcaccacaccaaaaaaggaagacaagccggttgcggtggctcacacctataaycccaaaactttgggaggccgaggcgggtggatcacctgaggtcgggagttcgagactagcctgaccaacatggagaaaccctgtctctactaaaaacacaaaattagcctggcgtggtggcgcattcctgtaatcccagctgggaggctgaggcaggagaatcgcttgaaccccggaggcggaggttgcagtgagccaagatcgtgccattacactccagtctgggcaagaaaagtggaactccatctcaaaaaaaaaaaaaaaaaaaaaacaaggaagacaaaaagaaaagcagctaaa

SEQ ID NO: 25026 - DNA, 601 bp, Human
atccggaggctgataatgtctgcttttctctcttttctaattatttgtgaaaggaaaaatgtggggggttgggagaaaaaaacccttaagtacatactcgctaaatcacattgctacaggtaacttccattaagaacttgaaagtaaaggtagctgcattttcccctagggaacacaatgatagacaggagccttagtctacagcttgaaggattgtaattatacctaagcaaccctcctggaccagtttaatgttattagctgtgatgtatccctacctttgatgtcattatccttactyagctcccttaaagcagagatcaagatgaaaagggcttcagctgcagcatggcacatggagattagagtggggcttttggatgctgaggagcagacctagaatgggaaatagatgggagccacagaagtgaaggtccccctccctcattgctcaacctactccacatctccaggtctgcacatctgttcagttactgaatcctgtgtaagctaccttctttttcttttttcttttatttatttatttattttttttttgagatggagttttgctcttgttacccaggctggagtgcaatgg

SEQ ID NO: 25027 - DNA, 601 bp, Human
tttaatgttattagctgtgatgtatccctacctttgatgtcattatccttacttagctcccttaaagcagagatcaagatgaaaagggcttcagctgcagcatggcacatggagattagagtggggcttttggatgctgaggagcagacctagaatgggaaatagatgggagccacagaagtgaaggtccccctccctcattgctcaacctactccacatctccaggtctgcacatctgttcagttactgaatcctgtgtaagctaccttctttttcttttttcttttatttatttatttwttttttttttgagatggagttttgctcttgttacccaggctggagtgcaatggtgcaatctcggctcactgcaccctccaactcccaggttcatgcaattctcctccctcagccttccaagtagctgggattacaggctgcaccaccatgtctggctaatttttgtattatcagtagagagagggtttcaccatgttggccaagccggtctcgaactcctgacctcaagtgatccacccaccttggcctcccaaaatgctgggattacaggtgtgagccaccatgcccgctgtaaactac

SEQ ID NO: 25028 - DNA, 601 bp, Human
cttgttacccaggctggagtgcaatggtgcaatctcggctcactgcaccctccaactcccaggttcatgcaattctcctccctcagccttccaagtagctgggattacaggctgcaccaccatgtctggctaatttttgtattatcagtagagagagggtttcaccatgttggccaagccggtctcgaactcctgacctcaagtgatccacccaccttggcctcccaaaatgctgggattacaggtgtgagccaccatgcccgctgtaaactaccttcttaaaagctctagaagagggctyttaaccttttgttgtgtgtcatgcaccttccgcaagctgatgaagttgatagacccatctcagaattttttttttttttttgagacagtgtctcactctgtcacccaggattggttgcagtggcacgatcatggctcattgcagcctccacctcccaggctcaagtgatcctcctgactcagcctcttgaatagctgagaccacaggcttgtgtcaccatgcccaggtaatttttaattttttttcgtagaggcagggtctcacattatgttgcccagtctggcctcgagaactcctggg

SEQ ID NO: 25029 - DNA, 601 bp, Human
atttataccaaaatacagttatcaaaatattaaattaacaagagttagggtgaccctattaattagtgtaatttcaaaatagtaatgaacataagtgatagtttgagatttctgtgacttttctaatgtgacgtgaaaatatttgtgatttttctttttcttttttttttttgagatggagtttcgctcttgttgcccaggctggagtgcaatggcaagatctcggctcacctcaacctccgcctcctgggttcaagcgattctcctgcctcagcctcttgagtagctgggattacaggamtgtgccaccacgtccagctaattttgtatttttagtagaaacagggtttctccatgttggtcaggctggtcttgaactcccaacctcaggcgatccgcccgcctcggcctcccaaagtgctgggattacaggtgtgagccaccgcacctggccaatatttgtgatttttattgacgacaaagtcaaaggttctcttcatattattgtggtgtatcgcctacaagcataattaaaataaacactaaatttcagtttaaagtttactgaaaataaatatgtattttttattccctatttaag

SEQ ID NO: 25030 - DNA, 601 bp, Human
actttaaaccacttgtcattctaaatcactagcatttcctggaaaaaaaagccatttttccttcagggctaagctcagggaccaattctgtgtcaccttctttgaatcctgatgatattcacttctttatttgacctgatttattgggccccagacaccatgctgagtgttggggattcagctctggacaatgtcaaatgtcagtcctgcctttcagatcctttctactgggtgagccctggagtgctggttctcctcgcggtgctgcctgtgctcctcctgcagatcactgttggcctcrtcttcctctgcctgcagtacagactgagaggtacagggcagagggtgggtggatcaggatcctttctttaaatgagctggcttcttggagctacaccacttaacatgtatttgtgagtgacttctgggttcagaagttcttctcactattgagtgataaagaaaaaaaataactccatgatgaaagagttttacatcttacggaatgctttcatatgaataatcggacctagcatttccctatgagctaactatgccatatagtaaccccattttacagaggatacaactgaggccagga

SEQ ID NO: 25031 - DNA, 601 bp, Human
ttccacacaaaaaaaggccttcagccctcatggctgagcagaaagaatctgaatgttagagtcaggcagcctgggtttgaattccatctcaggtactgaactctatagcaaaattcttagattctccaagcttcagttgccttgtctgtcaaatagagaaaacatccttcgtcctaaattgtagggaggattaaagtcatgcaaagtgcctactacaaatccagtcacaaagtagctagctactcactaaatgttcagctcctccctcctcattcagatgggaagtggctttagataaacaaagtggcaacgcagtgggctggagcagctctgtgaactgagaatccaagaaaaggggcgaagagcagctgggatgtattggatgcttgtgctggcttggagcattgctcacattctttattcgctattgtatctagactatagctagagaaagagccgcaaccattggctttaaatccagtgctcttcctactctcctgaggttgtttccaggctgcagagaaatagcctgcacaaggggcccaggcgctgggtgtgggagggtccccaccgagagccagaacatgcaggaactaaaatg

SEQ ID NO: 25032 - DNA, 601 bp, Human
tcacattctttattcgctattgtatctagactatagctagagaaagagccgcaaccattggctttaaatccagtgctcttcctactctcctgaggttgtttccaggctgcagagaaatagcctgcacaaggggcccaggcgctgggtgtgggagggtccccaccgagagccagaacatgcaggaactaaaatgttgcctttttctattttaggaaaacttcgagcagagataggtgagttccagtcatcgtttctcccaattcttgccttttggttttttggcataacggaaatggtcccrttcttggaccgtctctccctctcaataccctgttttcccctcagtttccctttctctacagtgggtgtgtcgtgcctagaacaagttttaagtaattaaataacaaagactcaggataaaagatcctttttgagtgccctactaaatccatttccatttgtttctctttcagagaatctccaccggacttttggtaagttccggcatgtctaggccctcccaggtcaacttggtatttcactctagttccagtcacctgggggaacaaggacccctggctcctggttgagtcccttcctc

SEQ ID NO: 25033 - DNA, 601 bp, Human
tccatgagtacagaacatgactaatcagagaagacctcatagaggaatagaaaagccaccaagccccactaggaattgacccctcaaggacatggtttctagcctttttgttcactgcagattgcccaatgcctaaagataatggcaacagaagagcacccaaatatttgttagataaatgttgcagacactagaaggtgtcattagggcacagatggtaccttctctgagcaaacttccttcacagctcctcctcccgaggctgtaggtgactctactcttgtcacctggcacacagagktctatcgtacgatttaggaaattagaccagtgtgtggaccacacacacacacatctttacacacccaaagaggaggaatagtatctttgttttggaggacttgactatgaaaggtcttaactcctttttgtaccatgaatctctctggcactccagtgaagtctaaaggacccctttgcagaatgtttttaaatatacacataaaatagaacacataggattgcaaaaacaatcattgtactaaaatacagttatcaaccgataatcacatttgtgatatagtaacataaatgtttcttt

SEQ ID NO: 25034 - DNA, 601 bp, Human
ggtcttaactcctttttgtaccatgaatctctctggcactccagtgaagtctaaaggacccctttgcagaatgtttttaaatatacacataaaatagaacacataggattgcaaaaacaatcattgtactaaaatacagttatcaaccgataatcacatttgtgatatagtaacataaatgtttctttttttttttttttgaggcagagttttgctcttgtcacccaggctggagtgcaatggcgcgatctaggctcactgaaacctctgcctcccgggttcaagcgattctcagcctccygagtagctgggattacaggtgcccgccaccacacccagctaatttttgtatttttagtagagactaggtttcaccaggttggccaggctggcctcgaactcctgacctcaggtgatccacctgccttggcctcccaaagtgctgggattacgggcatgagccaccgtgcccggccataaatatttctttagccaaagtaatacattaagtaatgtagcagcaagtctaataacctgtaatttctttctttctttctttctttctttttttttgagatgaagtttttttgagatggagtgc

SEQ ID NO: 25035 - DNA, 601 bp, Human
tttcaagatttctgcaataactctaatgggaatgaaaacatctgtggcttccattggtaattaagtcacaggtactgctcatattgtggttagttgtaaaatgttttggtttgttttgttttttccaagacttgggggaatgggtgttggtgggatcaacaagagtcttgctctgtggcccaggctggagtgcaggggcaggatcttggctcactgcaacctccgcctcccaggttcaagcgattctcctgcctcagcctcctgagtagctggcattacaggcatgtgccaccacgcccasctaatttttacatttttagtagagatggggtttcaccatgttggcctggctggtcttgaactcttggcctcatgatccacccgtctcggactcccagagtgttgggattacaggcatgagccaccacacctggcagttgttacatttttaatgaaagaaaatgttaaatccagttattgaaaataaggaggcagtacttttctcatccaagttcatggactttctgaattttgtccccagagtcctttggtgttctaggaccccaggttaaggaaccaaaaaagacaggtgggtggggca

SEQ ID NO: 25036 - DNA, 601 bp, Human
acccttggttgccttgatcatctgctacaactggctacatcgaagactagcaggtgcagtggctgggcagcaggcaagaccaccaaatagtgggggaccaagtcagctctgaatgggaagccaaaagagaatagaaccaggactcaagattaggggagctgggatttccttattcctctgtccccatgcccaaccccaggctcttctgagaaactgtgaagagaaccacttactggatctgtgggatcccccagtggaaagggcagtgtgggtcactccaaatgtccatagggaggatgtrgggaaggtgctattcatcttccactaatcacatatttgtttctttttgttttcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatc

SEQ ID NO: 25037 - DNA, 601 bp, Human
tactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgygccactgcactctagccggagtgacagagtaagactctgtctcaaaaataaataaataaataaataaataaataaataaataaataaataaataaaaaataataatacaagttttcataagcacacttctaaccccttgtcttttatgtatttccttccttatccacgcacctgtctccctctactccagcctcattaccccagaggtcagtcctcaggaaaactaaacacaaagaaagagctcagtcagaaaggccatttatttatgtttcaagatgctcactgcctcctttgttttgt

SEQ ID NO: 25038 - DNA, 601 bp, Human
cctgagcacgcggtggtcaccccggtgctcatccctccctgtgtgtccgaccttggccctgctaagatcctgtgttttgaattctggcaagggttggatgaaagggcagggctccagaaaccagctcagacgtttgcttgggacctgcatgatgagtgggaatcggagggcaccagccctgctgtcccaggctcaggcccccatctgctccccaggtcatgcagcctgggcccccatgccgtgcagctcgcacatatgtggggcagagcagccaccctgcccccagcagcagccgtccatygtcagacgtgatcatttcctgaggcctcgagtgtgtcagggtgtttgtgcctcataacaacccacaggatggtcacccccgctttgcagatgaagaaaccaaagcaggtggtcagatccagtccttgcacttcctgagcctgaccttaccacacagctgtctcctattcggatgcttatttattttttttcccattacagttttgccgacggatggggcaaaagaagcagcgaccagctagagcagggcagccacacagctcgtccgacgcagcccaggcacctgcagagcagccacaca

SEQ ID NO: 25039 - DNA, 601 bp, Human
ggccctgctaagatcctgtgttttgaattctggcaagggttggatgaaagggcagggctccagaaaccagctcagacgtttgcttgggacctgcatgatgagtgggaatcggagggcaccagccctgctgtcccaggctcaggcccccatctgctccccaggtcatgcagcctgggcccccatgccgtgcagctcgcacatatgtggggcagagcagccaccctgcccccagcagcagccgtccatcgtcagacgtgatcatttcctgaggcctcgagtgtgtcagggtgtttgtgcctcrtaacaacccacaggatggtcacccccgctttgcagatgaagaaaccaaagcaggtggtcagatccagtccttgcacttcctgagcctgaccttaccacacagctgtctcctattcggatgcttatttattttttttcccattacagttttgccgacggatggggcaaaagaagcagcgaccagctagagcagggcagccacacagctcgtccgacgcagcccaggcacctgcagagcagccacacagctcgtccgatgcagcccaggcaccttgccccagggagcgctgcttgggaccgc

SEQ ID NO: 25040 - DNA, 601 bp, Human
aaaataaaaaaaaaatacaatgggcatttgtgatacaacaaaacagcacgtgtggcaggtgcgtcgtaggaacagggcaagggcccagcatggcatcagggaccacaatacgtttgtctctattcagcatccttgtcaggccacagtcatgcccacttgagcccattggtggacaagatgatgtccagcagagaagagggtgtctcaccctgtgtcccttggatcagggacagccctctgccctctccataacctcctagtggatgcccttgcagacccctcagccaggcttgggtcatgyactcatccctaaaagggtcactgcagtgagttgccatgaaatcccaggccactctctgggctgaggagggtgtggtctcccccaggaggctctgccaacaaggaagaggggtgtgtgttggccatgggggtggggaggggtgagaggccccagtatctgccactggtggaaatggtatcagtgaaatcctgatcagaaatttgggatggaaaaggaaacaatgagaaaagggctgtgggaacctcctctccagagtggtagttgggcccccccagtgtgcccccatggaggcacaggagt

SEQ ID NO: 25041 - DNA, 601 bp, Human
gctgaggagggtgtggtctcccccaggaggctctgccaacaaggaagaggggtgtgtgttggccatgggggtggggaggggtgagaggccccagtatctgccactggtggaaatggtatcagtgaaatcctgatcagaaatttgggatggaaaaggaaacaatgagaaaagggctgtgggaacctcctctccagagtggtagttgggcccccccagtgtgcccccatggaggcacaggagtgtgcagagtgaagcccctggaggggcattccctctaagctccagggaagatggaacaggrccaccctttctcccctggacatggcctggccaagcctggcctgttcacttctgtcctcatggctctggatgcctaaggatttcgggcttcccgcacaggcactgaccccttcttcccaccaccctatctccaggaaggcctcctgaatgctccccacactgaccccttcttcccaccaccctatctccgggaaggcctcctgaatgctccccacactgaccccttcttcccaccaccctatctccgggaaggcctcctgaatgctccccacgctgaccccttcttcccaccaccctatct

SEQ ID NO: 25042 - DNA, 601 bp, Human
tcctgaatgctccccgcgctgaccccttcttcccaccaccctacctccaggaagccctcctgaatgctccccgcgctgaccccttcttcccaccaccctatctccgggaagccctcctgaatgctccccacgctggccccttcttcccaccaccctacctccgggaaggcctcctgaatgctccccacgctggccccttcttcccaccaccctacctccgggaagccctcctgaatgctccccacgctggccccttcttcccaccaccctacctccaggaagccctcctgaatgctccccrcgctgaccccttcttcccaccaccctatctccgggaaggcctcctgaatgctccccacactgaccccttcttcccaccaccctacctccgggaaggcctcctgaatgctccccgcgctgaccccttcttcccaccaccctacctccgggaaggcctcctgaatactcccccggcgagcatctaagctccagtgcccctcctccccagcccgtgatactgaccatggcctttggcaccacagggcttcgtgggctgaggtgaaggtagcctggctgtccagctgacctatctggcctaaaa

SEQ ID NO: 25043 - DNA, 601 bp, Human
ttcccaccaccctacctccgggaaggcctcctgaatactcccccggcgagcatctaagctccagtgcccctcctccccagcccgtgatactgaccatggcctttggcaccacagggcttcgtgggctgaggtgaaggtagcctggctgtccagctgacctatctggcctaaaaacgagaggtgcaggggatgtggttggtccccagtgctctgctgttaactctggggctccgagcagtgacacaactgttggccgttaccaggaccatggtccaggctggggcaccgtggggcagctggrcctactgctcagaaagccggagggtgggagctgagtatgagggtcccttgtggccacctcagcagcccaggtttaggggacttcacgggctctgggattgcccaggtagctggtgtggggacatccttggggtcctgtgccttccgtgatgcctggcctcgtgctaaatgctgatggttttctcaagggcacttgggaaaggaggaatctggggaatggagggtcctgctgagaggacttgacctgcaaggtgaatccatgactgccggttcccagcccagcctggctgtggcctgaggt

SEQ ID NO: 25044 - DNA, 601 bp, Human
gccaggggaccactaggaggactgaggtggggccagcatttgagcgaggaggtgccacttccaggccaggccagggtttcgggagctctggctacgctgacggggcagggctggttaggttaaaggggtagaaagggccgggtggggccgggcgcggtggctcacgcctgtcatcccagcacttcgggaggccgaggcgggcggatcacctgaggtcaggagttcgacaccagcctggccaacacggtgaaactctgtctctaccaaaaatacaaaaattagctgggtgtggtagtgggcwcctgtaatcccagctactagggaggcggaggcaggagaatcgcttgaacccgggaggcggaggttgcagggagccaagatcgcgccattgcactccagcctgggtgacagagcgagactccatctcaaaaaaaaaaaaaaaggaaaggaaaagaaagggttggttggagtggaggcagaaagaaggccgaggacacagtgtcgcctgcccttgacggaggcagcacatgaggatgagaagctgattggagaagaggatgactgcagtgctaagagcagcgtggtcaggttgccaaggatg

SEQ ID NO: 25045 - DNA, 601 bp, Human
gtttcgggagctctggctacgctgacggggcagggctggttaggttaaaggggtagaaagggccgggtggggccgggcgcggtggctcacgcctgtcatcccagcacttcgggaggccgaggcgggcggatcacctgaggtcaggagttcgacaccagcctggccaacacggtgaaactctgtctctaccaaaaatacaaaaattagctgggtgtggtagtgggcacctgtaatcccagctactagggaggcggaggcaggagaatcgcttgaacccgggaggcggaggttgcagggagcsaagatcgcgccattgcactccagcctgggtgacagagcgagactccatctcaaaaaaaaaaaaaaaggaaaggaaaagaaagggttggttggagtggaggcagaaagaaggccgaggacacagtgtcgcctgcccttgacggaggcagcacatgaggatgagaagctgattggagaagaggatgactgcagtgctaagagcagcgtggtcaggttgccaaggatggagcagtgggcacagcagggggacttagggtcagcggaggagtcggtgaggaaagggaggtttggcaggaagtga

SEQ ID NO: 25046 - DNA, 601 bp, Human
tggatactccatttggcaaggttaatatccaacttgtggagacatgttttttagttttttcatttctccttgctggcttgatttttgaattaaaaaaaaaaaaaaaagaattgcttttgttttggcagcccagggctgtctgctcccagcagagagggccagaagttctgctgttgggttccatcagctgagaaggtgtctgatgggcgcctcacactttgatgttttgagaaaatggctacttagtatgtaaatcacttctcattctgttgctggaaatcagatactcatttcagaccayagactcatttcagactgtacttttcaaatctacattcaaatcttctaatttgtggccaataggtcacaccacactaattaggggacaggctgatgactaataggatgaattattgttacgaagcggcatttgagtggaaagaattgttttggggaattagaacatacctgatgttagttgaatgtgtaactgagctagaaataaaatgctcctccttttataggagaggttgcttgttctccaagcccatgtcactcagcctaggccggggtgagggtgtctgcattctcctaattccat

SEQ ID NO: 25047 - DNA, 601 bp, Human
gctcccagcagagagggccagaagttctgctgttgggttccatcagctgagaaggtgtctgatgggcgcctcacactttgatgttttgagaaaatggctacttagtatgtaaatcacttctcattctgttgctggaaatcagatactcatttcagaccacagactcatttcagactgtacttttcaaatctacattcaaatcttctaatttgtggccaataggtcacaccacactaattaggggacaggctgatgactaataggatgaattattgttacgaagcggcatttgagtggaaakaattgttttggggaattagaacatacctgatgttagttgaatgtgtaactgagctagaaataaaatgctcctccttttataggagaggttgcttgttctccaagcccatgtcactcagcctaggccggggtgagggtgtctgcattctcctaattccatattgctacgtcctctggtccatctgtaagatctctctatctggctgtcccaaccaaaccctccttttcagctaaattcttaggttgaccttgtgtgctcccagtcctgcagtcatcctggttcattttcttaaacccctcg

SEQ ID NO: 25048 - DNA, 601 bp, Human
tgttcaagctcgtgtagttgtaggagaattcactccctagaagttacagggcggaggcctttggctcctagaggtggttcacattccctgccgtgtggcctgctccacaggctgttcacttgactgcagcttgcttcttgctattaggatatggcaaaggtgctagaagtcacctccatggttaagctgtaccttgcaagcatgcaggagtccggcaggagaatctcctatgcatgcttgcaaggtagagcctaatcgtgggagtgacttatagcacgtttaccatttttctattggctgratgcaagtcccaggttcactgaccctttatacagagcatgacagtggggtcctcactagggtctgtctgccactctacatatttgaaacaggagtggcttctcagaatccagtgaacctaaattttagttttagttgctcactggactgggttctaggagaccccctgtgttagtctgtggtcattgctagagaatcacttaattttttctagactctaggagaaaacagttggtggtgtactcatcacgggttaacaatttcttctctccttccataggcatggaaggcagcacaccat

SEQ ID NO: 25049 - DNA, 601 bp, Human
gagaattcactccctagaagttacagggcggaggcctttggctcctagaggtggttcacattccctgccgtgtggcctgctccacaggctgttcacttgactgcagcttgcttcttgctattaggatatggcaaaggtgctagaagtcacctccatggttaagctgtaccttgcaagcatgcaggagtccggcaggagaatctcctatgcatgcttgcaaggtagagcctaatcgtgggagtgacttatagcacgtttaccatttttctattggctggatgcaagtcccaggttcactgaycctttatacagagcatgacagtggggtcctcactagggtctgtctgccactctacatatttgaaacaggagtggcttctcagaatccagtgaacctaaattttagttttagttgctcactggactgggttctaggagaccccctgtgttagtctgtggtcattgctagagaatcacttaattttttctagactctaggagaaaacagttggtggtgtactcatcacgggttaacaatttcttctctccttccataggcatggaaggcagcacaccatcatgccttcaaaggtcaactacc

SEQ ID NO: 25050 - DNA, 601 bp, Human
cgcacctggggggcggatgttatcaacatgaccacagttccagaggtggttcttgctaaggaggctggaatttgttacgcaagtatcgccatggcgacagattatgactgctggaaggagcacgaggaagcagtaggtggaattcttttctaagcacatatagcatgggtttctgggtgccaatagggtgtcttaactgtttgtttctattacgttagtttcagaaagtgcctttctacaaggttttgaagttgttaatattttctgtagttccattggaaggtaagaacaaagatcaaargaaagaaagagacacttttacccaaggatcagtagtgaaaatagtacattgtaggcaggtagatgtgttgagaatcatactaagacttgggccttattttcaggataaaggtgtattttgattgccaatttctgctgctatgctactgttttttgttttcaagaaggaaaaaaatctattaaccctttcctcatgagagggctgtatgttcacatccatctatttaacgtaccgtggctggatactctgttcagcatagaaatgtgacaacaaacagagaagtccttaaggagccgacat

SEQ ID NO: 25051 - DNA, 601 bp, Human
aggaggctggaatttgttacgcaagtatcgccatggcgacagattatgactgctggaaggagcacgaggaagcagtaggtggaattcttttctaagcacatatagcatgggtttctgggtgccaatagggtgtcttaactgtttgtttctattacgttagtttcagaaagtgcctttctacaaggttttgaagttgttaatattttctgtagttccattggaaggtaagaacaaagatcaaaggaaagaaagagacacttttacccaaggatcagtagtgaaaatagtacattgtaggcakgtagatgtgttgagaatcatactaagacttgggccttattttcaggataaaggtgtattttgattgccaatttctgctgctatgctactgttttttgttttcaagaaggaaaaaaatctattaaccctttcctcatgagagggctgtatgttcacatccatctatttaacgtaccgtggctggatactctgttcagcatagaaatgtgacaacaaacagagaagtccttaaggagccgacattctgtcggatggagatagaagttaagcaaaccaatataagaaagctaacggttataaa

SEQ ID NO: 25052 - DNA, 601 bp, Human
aggccccacctcccacaattcgacatgagatttggtgaggacacaaatccaaaccataccagaattcatcagtgcttttcagagatgtcactgagtttctctaggacctccgtgctaggactaagaccatcttgataaatgccgagcttgaactcaggggtttaaacgtagaataaacagacttcacaagtcaggtttttcttagtctgtctggactgttgtaacaaaataccatagcatgggtggcttctgaataacaagtttatttttcacatttctgtaagttgagaagtccaagatmaagggactggcacatttggtgtctagtgagagcccactttctggtagacagccatcttctcactggaacctcacacggtggaaggggccctcgaagaatagcactggggcctcttttgtaagatcactaatcctatccacgaggactctgccttcatgacctaattgcctcccaaatgcccaacctccaaataccctacattgaggattcggtttcagcagataaatttgaggggacacaaacatttaggctgtagcaaggctggagctcagaaaaatgttttatgacaagcagtggaat

SEQ ID NO: 25053 - DNA, 601 bp, Human
acattttaagggggaaaaaaaaacccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtactttgtgctgggaactctacatctagcaatttctctttaaaaccatatcagagatgcatacaaagaattatatataaagaarggtgtttaataatgatagttataataataaataattgaaacaatctgaatcccttgcaattggaggtaaattatgtcttagttataattagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttt

SEQ ID NO: 25054 - DNA, 601 bp, Human
aatcccttgcaattggaggtaaattatgtcttagttataattagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttttattttctttgaatctttctgtgtcttcacatttttctacagtgaatwtaatcaaatagtaaagttgttgtaaaaataaaagtggatttagaaagatccagttcttgaaaacactgtttctggtaatgaagcagaatttaagttggtaatattaaggtgaatgtcatttaagggagttacatctttattctgctaaagaagaggatcattgatttctgtacagtcagaacagtacttgggtttgcaacagctttctgagaaaagctaggtgtttaatagtttaactgaaagtttaactatttaaaagactaaatgcacattttatggtatctgatattttaaaaagta

SEQ ID NO: 25055 - DNA, 601 bp, Human
ggctcgtcagtcacttggttcctctgtctgttcagtggagctgatgatcgctttcatctcacactcgctgtgcacaaagcctcactgcatcctcaacacagccagcttcacctaggaaggaactgaagcccagagaggttgagccgtttacccaagatcacacagtcctccagacgcccctcaaccctcacagggtaaatgagatcatctgtgtaaacatcgctgcacagacgttagcccccgttcgtgtttttgttctgagaaaggtaggccagcttgcctggagaggagaactacagastaaagagggtcctggcacggaggaaagccaggacgctgcagcctagtggctttccaattttttcatcacaacctgcagtaagaaatacgttttgtactctgatagagtgtacacactcaggtgtgcaggtacagctaaagtaagttgcagtagccgcccttattacataaaagggggctctacttttccgattcatttctctttttttctccagaggtgggatctcacccatggcacactcttggctcactgcagcctcaaactcttgggctcaaacgatcctcctgcctcagcctcacg

SEQ ID NO: 25056 - DNA, 601 bp, Human
acacagtcctccagacgcccctcaaccctcacagggtaaatgagatcatctgtgtaaacatcgctgcacagacgttagcccccgttcgtgtttttgttctgagaaaggtaggccagcttgcctggagaggagaactacagagtaaagagggtcctggcacggaggaaagccaggacgctgcagcctagtggctttccaattttttcatcacaacctgcagtaagaaatacgttttgtactctgatagagtgtacacactcaggtgtgcaggtacagctaaagtaagttgcagtagccgccyttattacataaaagggggctctacttttccgattcatttctctttttttctccagaggtgggatctcacccatggcacactcttggctcactgcagcctcaaactcttgggctcaaacgatcctcctgcctcagcctcacgaacagctgggaccacaggcacatgccaccacgctcagttcgttttttaattctttgtagagatggtgtctcattaactcccaggctcaagcgatcctccctcccgggcctcccagagtgctgagattgcaggtgtgggccactggcttgaccctttttt

SEQ ID NO: 25057 - DNA, 601 bp, Human
aggagggaggaaggagacatttgcagaagcacagagggctggaggagcgccagctgtgcagagaagtggtgggtgtgagtggagcaggcagcggtgctgaggaggctggatggaggaactccaggtggctggatttccgcttctcgtcctgctggtgacaagcaaagcacaggccccctcggcagccctgctttattttcttctgaactttgtcacggtcgaaggaactttcctcctaccctctgtaaatattacacaaacagagggaccatcactccagaccctcaaagctgaatacagyggtggcttgctgtcagaccagggtttgagggggggaactgaggcacagagccggaagcctgtgacttccatcctcgggtgtaacctggagacgggggtttcaccatgttggccaggctggtcttgaacacctgacctcacgggatccacccgcctcggcttcccaaagtgctgtgattacaggcgtgagccaccgtgcccagccgagaccctgtcttaaagaaagaaagaaaaaaatccttcgttggggagcatctgcaagcatgaggaatgggggacactggagccagacaggctggtg

SEQ ID NO: 25058 - DNA, 601 bp, Human
ttctcgtcctgctggtgacaagcaaagcacaggccccctcggcagccctgctttattttcttctgaactttgtcacggtcgaaggaactttcctcctaccctctgtaaatattacacaaacagagggaccatcactccagaccctcaaagctgaatacagcggtggcttgctgtcagaccagggtttgagggggggaactgaggcacagagccggaagcctgtgacttccatcctcgggtgtaacctggagacgggggtttcaccatgttggccaggctggtcttgaacacctgacctcamgggatccacccgcctcggcttcccaaagtgctgtgattacaggcgtgagccaccgtgcccagccgagaccctgtcttaaagaaagaaagaaaaaaatccttcgttggggagcatctgcaagcatgaggaatgggggacactggagccagacaggctggtgcttaggggtcccagggccccgggaacccagcagcaaacagcctcgccctcaggggatgacgtaccatcagccacaggccaccagcacggccctgggcttcagtacctgcgagtctgaatggatttgctcctggggcaacc

SEQ ID NO: 25059 - DNA, 601 bp, Human
attgcatctaactggggagccatttgtacccaagtagaagcacacgttcactttgtagctcaagcccaactttaattagccatctgtatgaataaatgctgattccaggtccgtttcctctccagtccctgcagtttaagctgaggaggcatcgcttaaatcagaccatttagaccaggcatggtggctcacacctgaaatcccagcactttgggaggccaaagcagaaggatcgcttgagcccaggagttcaggaccagcctgggcaacatagcaagaccctgtctctacagaaaaacayacacacagaaaaattagccgtgcatggtaagaggaggagactgaggtgcccagcggctgcagcccgtgcatccccagggtcccagcacagagtgggtgttcagaagtgtctgctgagggactgagcaagaacccgactgagcacagcaagcaaacgctcagaacgggaggtcagcagcaccgctgtgcccaacacgggtttccaccataacccgaagttggaacgttttattcttccataccaaacaggagttgagaaggcggctgggttccttgaggtgtggaatgtcatgcactcctc

SEQ ID NO: 25060 - DNA, 601 bp, Human
gcccagcggctgcagcccgtgcatccccagggtcccagcacagagtgggtgttcagaagtgtctgctgagggactgagcaagaacccgactgagcacagcaagcaaacgctcagaacgggaggtcagcagcaccgctgtgcccaacacgggtttccaccataacccgaagttggaacgttttattcttccataccaaacaggagttgagaaggcggctgggttccttgaggtgtggaatgtcatgcactcctcctttcttgcgtggaaagcccgaggtataaagtgtgtatgatgtttgcttttttttttttttttttttttaagacagggtctagctcggttgcccaggctggagtgcagtggagtaatcccagctcactgcagcctccaactcctgggctcaagcattcctcccatctcagtctcctgaggagctgggactacaggcgagtgccaccatgcccagctaatttctgtcctttttgtagaaacagggttttgccatattgcccaagctggtctcaaactccggagctcaagcaatcaatcctcccaccttggcctccaaaaatgctgggattacaggcatgagccaccctg

SEQ ID NO: 25061 - DNA, 601 bp, Human
gtggagtaatcccagctcactgcagcctccaactcctgggctcaagcattcctcccatctcagtctcctgaggagctgggactacaggcgagtgccaccatgcccagctaatttctgtcctttttgtagaaacagggttttgccatattgcccaagctggtctcaaactccggagctcaagcaatcaatcctcccaccttggcctccaaaaatgctgggattacaggcatgagccaccctgcacccaacctgtttgcatttttattttttaactttaagctattaagggttaatgtttgcrtttcttaagggaaaaacagaggagaaagagccaaaggaaaaacactgaaatggtagcattcctgggtgatgagtttatggcgttttgtttcctggttgtctataacaaatatgtaatttttaaattagcaacagcgttagactacttcggggaaacctggctctgtgtgccacgaagcagggaagggcttgttcccaggcgcagcagcacttgggcatcccgtggtgaagtcagccccttacacctcctccaggcacagctgtggggagcatgtcccgagaaggcgcaggaagaggccca

SEQ ID NO: 25062 - DNA, 601 bp, Human
tagaaacagggttttgccatattgcccaagctggtctcaaactccggagctcaagcaatcaatcctcccaccttggcctccaaaaatgctgggattacaggcatgagccaccctgcacccaacctgtttgcatttttattttttaactttaagctattaagggttaatgtttgcatttcttaagggaaaaacagaggagaaagagccaaaggaaaaacactgaaatggtagcattcctgggtgatgagtttatggcgttttgtttcctggttgtctataacaaatatgtaatttttaaatyagcaacagcgttagactacttcggggaaacctggctctgtgtgccacgaagcagggaagggcttgttcccaggcgcagcagcacttgggcatcccgtggtgaagtcagccccttacacctcctccaggcacagctgtggggagcatgtcccgagaaggcgcaggaagaggcccaggccacgtgtcccgtgtggtcagcctggggaccagagttaaaaccagagctcctccttcaggaaacagatcatagaagcctgtggtttcatcctgtgttctcagagaagaggcaccaggctggaaa

SEQ ID NO: 25063 - DNA, 601 bp, Human
agctattaagggttaatgtttgcatttcttaagggaaaaacagaggagaaagagccaaaggaaaaacactgaaatggtagcattcctgggtgatgagtttatggcgttttgtttcctggttgtctataacaaatatgtaatttttaaattagcaacagcgttagactacttcggggaaacctggctctgtgtgccacgaagcagggaagggcttgttcccaggcgcagcagcacttgggcatcccgtggtgaagtcagccccttacacctcctccaggcacagctgtggggagcatgtccmgagaaggcgcaggaagaggcccaggccacgtgtcccgtgtggtcagcctggggaccagagttaaaaccagagctcctccttcaggaaacagatcatagaagcctgtggtttcatcctgtgttctcagagaagaggcaccaggctggaaagacatttctttgggcagacaggcccagagtatagggcccaggttcccagagcaagcgtcccagggccccggcggtcgtaactaccgctgcatgggctctgatgctcagccgcggaaaagcaagtaaccgggaatgaaggaagtggggtcag

SEQ ID NO: 25064 - DNA, 601 bp, Human
ttctttgggcagacaggcccagagtatagggcccaggttcccagagcaagcgtcccagggccccggcggtcgtaactaccgctgcatgggctctgatgctcagccgcggaaaagcaagtaaccgggaatgaaggaagtggggtcagtcccaaccctgccacgtgcgggtctcgagacggtggacaagtggctggactccactgggcctgggctgtcactggtacacagagggcactgggctagaactgcgttcctcccaccagaggctccacaccatctccgggcccctccccagagcctytcaaccaaaatcagtgtcttcaaagttcaagttgattctgaagctcagccaggtcgggaccagataatgcattctaggggacatcctcctgggtctcccatccaccctggtggctccctgggctgtgtgtagatgcccagctcctcctccctgccatcgtgtgggcatggcaccatgccctgacggcctccctcccctgcccacctctgcccgcagggagctgcaggaggagagcggtctgacagtggacgccctgcacaaggtgggccagatcgtgtttgagttcgtgggcgagcctga

SEQ ID NO: 25065 - DNA, 601 bp, Human
gcatgtcttctgcacagacagcatccaggggacccccgtggagagcgacggtgagtctcacagggcctgctccccctccccactatgcgggtcccatctcctggctgggagaaaggccatccgcccaaaccatctctgagtgccagggaccgggcagcctgcgtccccctccaccccacagtgccagcgtggggcccatgagccgtggtctctgcaccgaggctccagtagcgtacctgcccctgctctgcgcccaccctaaaatgagaaacacggtcatgaggatgaaatataaacgatygtcaggttcctcacaatcactcagtgaactcctcagagagtcagtgtacgtttgggctggccagacgcagtggctcacccctgtaatcccagcactgtggactgtgggaggccgaggcaggaggatcgttgagcccaggagttcaagaccagtctgggcaacacagtgagaccccatctctacaaaaaaacatggttttgttgttgttgctgttgttgttttgagacgaagtctcgctctgtcgcccaggctggagtgcagtggcgcaatctcggctcactgcaagctccacctcccagg

SEQ ID NO: 25066 - DNA, 601 bp, Human
gcccaggctggagtgcagtggcgcaatctcggctcactgcaagctccacctcccaggttcacaccattctcctgcctcagcctcccaagtagctgggactacaggcgcccgccaccacgcccggctaatttttttgtatttttagtagagacggggtttcaccgtgttagccaggatggtcttgagctctgaccttgtgatccgcccgcctcggcctcccaaagtgctgggattacaggtgtgagccaccgcgcccggccaaaaaaaacatgttttttaagcatgaagtttgggttgcacytcagtgcctcctcttcccccattggtacagaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttc

SEQ ID NO: 25067 - DNA, 601 bp, Human
ttgcacctcagtgcctcctcttcccccattggtacagaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccrggtttcatctggaattaactggatggaagggaaaataaagctatctagcggtggttttttttttttttttttggagatggagtctctctctgttgcccaggctggagtgcaatggcacgatctcggctcacgtcaacctccgcctcccaggttcaagcgatcctcccatctcagcctcccgaagaggtgggattacaggcgcacattgccacacccaactaatatttgtctgtttagtagagatggggtttcaccatgttgaccaggctggtcttgaactcctgacctcaggtgatccac

SEQ ID NO: 25068 - DNA, 601 bp, Human
tttcccaccaggcttgggcactgtttaaaggaaagttccgagaaggcatcgacaagccggaccctcccacctggaagacgcgcctgcggtgcgctttgaacaagagcaatgactttgaggaactggttgagcggagccagctggacatctcagacccgtacaaagtgtacaggattgttcctgagggagccaaaaaaggtaggggctctcctgaatttgggtcacctaacagaggcagccagatccttgaggcaccttaacttcattctgagcatcactttctagctttccttttgtattgcctgcctgcctgccttctgcctcacagtgaagcccagcctccttgcctgagttatgtgggtcacaagttgaaattcctgtggggttcagcataggagaattaatcacactgtatgcctcaatgtatatgggggggggtgcattgaatatgtgttttccagttagtctttcaaaaaaaaaaagaaaaaagaaaactggataacttgttaaaatttacttatctaatagtctttagtgagtgactattttgcagaaaaggagtaatgagaggaatatctcatcactatgcatggtaataaaa

SEQ ID NO: 25069 - DNA, 601 bp, Human
agcggagccagctggacatctcagacccgtacaaagtgtacaggattgttcctgagggagccaaaaaaggtaggggctctcctgaatttgggtcacctaacagaggcagccagatccttgaggcaccttaacttcattctgagcatcactttctagctttccttttgtattgcctgcctgcctgccttctgcctcacagtgaagcccagcctccttgcctgagttatgtgggtcacaagttgaaattcctgtggggttcagcataggagaattaatcacactgtatgcctcaatgtatatgggggggggtgcattgaatatgtgttttccagttagtctttcaaaaaaaaaaagaaaaaagaaaactggataacttgttaaaatttacttatctaatagtctttagtgagtgactattttgcagaaaaggagtaatgagaggaatatctcatcactatgcatggtaataaaactgtcaacttttaaagtgtaacatggtcagctgaggtgtttattaaaagtcagattcctggacccctcttttcaagattctgaccagtgtgtctggaagagagctcaggaatctgcatctggaacaaat

SEQ ID NO: 25070 - DNA, 601 bp, Human
atagtctttagtgagtgactattttgcagaaaaggagtaatgagaggaatatctcatcactatgcatggtaataaaactgtcaacttttaaagtgtaacatggtcagctgaggtgtttattaaaagtcagattcctggacccctcttttcaagattctgaccagtgtgtctggaagagagctcaggaatctgcatctggaacaaatccttcaggtgacctcacttgggaaacatctggctggcggggtcctttatgtcacaaggcacattcgcatgccatctgtcatgtatttctttaccygtcctgtacaactcagaccttgtagaaaaaaatcagtttaatagcatgaaaaaataacttcccaagggagttgctgaaaaataccttatttgtcaacaccgtgttatgcattctaagaattaaatgctcaggtatttttacaagatttgacatttagttaggtcagttcctgtttttacgttgtgccatttcccttttccccaaacatgtaggagccaagcagctcaccctggaggacccgcagatgtccatgagccacccctacaccatgacaacgccttacccttcgctcccagccca

SEQ ID NO: 25071 - DNA, 601 bp, Human
taggaatatttgttcctttgcaatttggcctttttttccccagtcatgttcaggttatccttggctgcaggtagtgaagaggtgtaccactctttaatgtttgtactgagtggcatgttcacaaaaaagctcagaattcagttgcattggcttttcaagagggatttgcagcaagggctggtttccaatatggtagtggaggaattggctaacataaaactagctcctgaaattcagacttgcgtttactgctctggctctatggaattagtaaccatgggaaagaggcaatgcttagaaytgtgtaaagtgatggagtaggtagagacctgtcttgaagcatcggtaacagtaaatgaagcagcagcaagatcaggtgttctgtgccacattctttttccattcatgtttcatacaacattgtcttcaggaacatggttcagtgttctcccaacccacaagagacaagcaaaataaaaatggactaaataatttgctagtttttaattgggctctttggcacagactcaagtagacctgaactctcagctctgttgtgaacccgctttgtgaacaaggacaaagcatgtcatctgtctct

SEQ ID NO: 25072 - DNA, 601 bp, Human
aagagacaagcaaaataaaaatggactaaataatttgctagtttttaattgggctctttggcacagactcaagtagacctgaactctcagctctgttgtgaacccgctttgtgaacaaggacaaagcatgtcatctgtctctgagcctcagtctccctgttagtcagttacagagagagcgctccaagtttccttccaaagctgtgcactggctcgtttctccatcagctttggttttccagttggtctccagctcatctttgcctcacaagagcgtgccctgctagttgctggtgctggsagtgggtgggaaggtgattgggcgccagccccttccttcccaggcttcacacacacaccccaggaagccccgcggtgcgtcggactctctgtctagacatcatctgatttttatttgcaaatgcaggttgccaggtgacaggaaccttttatgcttgtgccccacctgagtcccaggctcccggagtccccacagagccaagcataaggtctgccgaagccttggcgttctcaggtgagtgcagggtttgctcctggaggcaccgcaggaggccagcctctgctgccagctctgtcatct

SEQ ID NO: 25073 - DNA, 601 bp, Human
agacctgaactctcagctctgttgtgaacccgctttgtgaacaaggacaaagcatgtcatctgtctctgagcctcagtctccctgttagtcagttacagagagagcgctccaagtttccttccaaagctgtgcactggctcgtttctccatcagctttggttttccagttggtctccagctcatctttgcctcacaagagcgtgccctgctagttgctggtgctgggagtgggtgggaaggtgattgggcgccagccccttccttcccaggcttcacacacacaccccaggaagccccgcrgtgcgtcggactctctgtctagacatcatctgatttttatttgcaaatgcaggttgccaggtgacaggaaccttttatgcttgtgccccacctgagtcccaggctcccggagtccccacagagccaagcataaggtctgccgaagccttggcgttctcaggtgagtgcagggtttgctcctggaggcaccgcaggaggccagcctctgctgccagctctgtcatctttgggcagattcgatgggactttagacacttgctttgctccctctggggtctggagtagatgtagacacatcct

SEQ ID NO: 25074 - DNA, 601 bp, Human
actctcagctctgttgtgaacccgctttgtgaacaaggacaaagcatgtcatctgtctctgagcctcagtctccctgttagtcagttacagagagagcgctccaagtttccttccaaagctgtgcactggctcgtttctccatcagctttggttttccagttggtctccagctcatctttgcctcacaagagcgtgccctgctagttgctggtgctgggagtgggtgggaaggtgattgggcgccagccccttccttcccaggcttcacacacacaccccaggaagccccgcggtgcgtcrgactctctgtctagacatcatctgatttttatttgcaaatgcaggttgccaggtgacaggaaccttttatgcttgtgccccacctgagtcccaggctcccggagtccccacagagccaagcataaggtctgccgaagccttggcgttctcaggtgagtgcagggtttgctcctggaggcaccgcaggaggccagcctctgctgccagctctgtcatctttgggcagattcgatgggactttagacacttgctttgctccctctggggtctggagtagatgtagacacatcctgtgtgtga

SEQ ID NO: 25075 - DNA, 601 bp, Human
cgtcggactctctgtctagacatcatctgatttttatttgcaaatgcaggttgccaggtgacaggaaccttttatgcttgtgccccacctgagtcccaggctcccggagtccccacagagccaagcataaggtctgccgaagccttggcgttctcaggtgagtgcagggtttgctcctggaggcaccgcaggaggccagcctctgctgccagctctgtcatctttgggcagattcgatgggactttagacacttgctttgctccctctggggtctggagtagatgtagacacatcctgtgwgtgaggtgaccagggtgatttaggagcaccattagaaaacctgacatcactgcttgtggttctgctgaccgtttcagccactggcttgaatggagtcattttggcttcttcactggcacctctctgaatttctaggaatgtgcctttacctttaccgagggcccctcttcagccaacattctcacgatgtggaataattgcttggaagtgtagaagggcttctcattttgagaagctgatcatccttccaggttgagccacaaataagtcctcctcctctactccctggggacattagtt

SEQ ID NO: 25076 - DNA, 601 bp, Human
ctgaactttaatatagcttgcaaacaaatatggattcaatctgatttttaaagttttatttctaaaaaaaaaaaaaaaaatccctgcaccatggagatcttacctactataaagaaggcacctctaggcttggcaagcacacgtgctatatgtatatttatttttcagataatattttggattgtttttaaatgggatttgtttttatattaaaaccaaatagcttaaggtttggaattctcatcttgccctctggcatctttaaaaatcagtgatgaaaaatactaactaaattctgaakgtttcagggaggcgagagttgtggcacttttgctgctcagaggggagctggagtttgacctaccagctctttctagttgtgaatgaggcttgcacctttttttctgaggtgctcgtgagtaactgaggatgccctttgggaggaggtgcttctgagcaggaaggcttgtgtttgtttttagaaactttcaaacccttgtcttgaacacctaagacttgtgtgggtgcctgaagagtaggaaataaacagctatttatatctcggcaacctcgtgatttctgatgacattaaatgaaatga

SEQ ID NO: 25077 - DNA, 601 bp, Human
cgccaactcttcctctgccttttcccagtcctgtcccttcctgagccccttcagaaactcctgtgtctttgatttctcatgtgcctccccttttcttgaatgtgcttcttcattcaacttatttaaaataaaaatatgacacgtctgtgtgctctggcactgttgacatgtgctcgtacttctgggtgtaagtgacccaagtttttgtaagctcatccagattttcttttggtgcccaaagcaaatatgtccccagataactaagcttcaggccaggtgtggtggcccatgcctgtaatcscagcactttaggaggctgaggtgggcagatcacttgaggccaggagttcaagaccagcctggccaacatggcaaaaccccgtctctactaaagatacaaaaattagctgggcgtgatggtgggcgcctgtaatcccagctactcaggaggatgaggcacaagaatcgcttgaacctgtgggaggcggaggttgcagtgagctgagatcgcaccacggtgctgcagtttgcaggacagagcgagactccattgccccccgcaccacaaaaaaataactaagctcacacagaggctgaccat

SEQ ID NO: 25078 - DNA, 601 bp, Human
ccatccccaagccctggccagggcggtcccatccttcttggggttgggcatggtgttcatgggggaccaaggaaattgaagggcaactggggggaccccccctcccctgtcagcatctcctgtgtctgccttgggatctggaagagctcacatgggccaggaaggctaaggcccactgggcctggatttctgaagactctggaccttggtgccagtggattcagaagataccacaaggtgagggctttctaatgaaagtgtcacaaggaactggcactggcttttctgagtgcctcttgcwgggcgtttttagggaggtagagcccccgtggtgactaagctggaaggtgcacattgagtcacaggtgcactgcgtgagagacagcacaggcagggggtggacgcctgtgagtgtcctggggctgtagacttgcacgactagaacttactattaatctgtgagcaagagctggtcttggctttcattccttcctctgtaaccaagggctgtgctctttgcccactgcagcctctcacctcaaagtgttcactgaggttcaaggaggatgctgtgaacgtaaaaactgcagctgtgccaacc

SEQ ID NO: 25079 - DNA, 601 bp, Human
tgtatatccacaagcgggaggccaggggggctgccccactcctgttctcaagtcaagttactgttccatccctggagacaggcaagaagtctactcagagttacacagttcaggcatagtgacagtgggactcagctgccgatggctggtgctcagtcaccacgttgacgttacatattttctgtggtgcctgagttacgtggatgtccgcagtagcacagatactggattatgtgggctctgtagtgaggggatgaggttttaaaatgatcctgggatgtcgaaacattctgattttttmaatgaaaacttgtccatggcataaattggtcttttgccattgcgtgactacgtttcttgttctttatctcccgacttcactgtggtctactaccttttgaatcttcgtgggtccaatgctgcaaagcagtgttctttagctgtcgactagttcctcttgaagaatcgagggagaccgagggccctggggggaaagcacccaaaggaatgcatacatgctattttgtatctgagatgttcacatcaagagccccactcagcggagtaagagtgctcattcctcttgcagtgttcagaatca

SEQ ID NO: 25080 - DNA, 601 bp, Human
taccatagtggcttcctgttctttgtaaaggccagagtttcatttagaaaagtcccaaatgaaaagtaaatgtcaaatgacctggaaaaataagcgtaacccttaaactagtgagggaggaagcatggtccaacgagcagcacagtctgaggactcacgtgctcctcccagacttgagatctgctcatcaaagaaccagggaggacagcctcaaaggagggtgcctctttccccatcttttttatttttcaggaaagttgtcgtatttccattttatagggattgaaaaagattgatggtwaaagttgccctttaaaattctccaggttaagattgctgtaagaatgctatctagctagtggatcttcattcaatggaaaagcttttcccaaatgagaaactatccattccctggaggcattttgtaggtctctgcagctgtgtcctagcacctcttttatttctggaattttagaaattatttaattattgggcatatgatatttgaaagaggctgaatctttcaaggaattcaagcaaatcagaccctctcgtaatgttctctagcatagctcaagatgggttcaactgtggcaagtaa

SEQ ID NO: 25081 - DNA, 601 bp, Human
tagtggcttcctgttctttgtaaaggccagagtttcatttagaaaagtcccaaatgaaaagtaaatgtcaaatgacctggaaaaataagcgtaacccttaaactagtgagggaggaagcatggtccaacgagcagcacagtctgaggactcacgtgctcctcccagacttgagatctgctcatcaaagaaccagggaggacagcctcaaaggagggtgcctctttccccatcttttttatttttcaggaaagttgtcgtatttccattttatagggattgaaaaagattgatggttaaagytgccctttaaaattctccaggttaagattgctgtaagaatgctatctagctagtggatcttcattcaatggaaaagcttttcccaaatgagaaactatccattccctggaggcattttgtaggtctctgcagctgtgtcctagcacctcttttatttctggaattttagaaattatttaattattgggcatatgatatttgaaagaggctgaatctttcaaggaattcaagcaaatcagaccctctcgtaatgttctctagcatagctcaagatgggttcaactgtggcaagtaacacta

SEQ ID NO: 25082 - DNA, 601 bp, Human
gcacctcttttatttctggaattttagaaattatttaattattgggcatatgatatttgaaagaggctgaatctttcaaggaattcaagcaaatcagaccctctcgtaatgttctctagcatagctcaagatgggttcaactgtggcaagtaacactaaaagggtagggttaggattagggttagagttttcttttttatgagaaaaggtttccatagataacatgaagcattaatttgccatgggaaacagaatcttgaacccttaagacttttgaatttgaaaacttcacattgctacrtacttgcaagcattattaacgggcttgcatgctgagcaataccaggtaaaagttacaccccctaacatcaaagttctcatcatgttctagctctgatgctatttctcattgagaactgaaatgaaacatggtttaatcttgaacatacaaccccccttcttgattttaaaaacaaagaccagccaaccaaccagtatataatcccatagactcaggagttttctcatgagttctctccagtgattgacttaataattgatatgattgttgaaataataactgatacattgttaacaacag

SEQ ID NO: 25083 - DNA, 601 bp, Human
gggctttacgttactgtctccttagaatctgagtgctgtttaatagtgagccagttgcaggatatctcagtaatgtctttttaaaatctcttattaaaggtagaacctctgctagccagacaactatattattttgctcaacaaaacagtggacatttcctgaggggctacgatttaccagaacacatcagcaatccagaagattaccacagatctatccgccattcctctattcaagaatgaaaaatgtcaagatgagtggttttctttttcctttttttttttttttttttgatacggrgatacggggtcttgctctgtctcccaggctggagtgcagtgacacaatctcagctcactgtgacctccgcctcctgggttcaagagactctcctgcctcagcctccctggtagctgggattacaggtgtgagccactgcacccacccaagacaagtgattttcattgtaaatatttgactttagtgaaagcgtccaattgactgccctcttactgttttgaggaactcagaagtggagatttcagttcagcggttgaggagaattgcggcgagacaagcatggaaaatcagtgacatctg

SEQ ID NO: 25084 - DNA, 601 bp, Human
agtgacatctgattggcagatgagcttatttcaaaaggaagggtggctttgcatttcttgtgttctatagactgccatcattgatgatcactgtgaaaattgaccaagtgatgtgtttacatttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaaygtatgtaggagctgcagttcttgtggaagacacttgctgagtgaaggaaatgaatctttgactgaagccgtgcctgtagccttggggaggcccatcccccacctgccagcggtttcctggtgtgggtccctctgccccaccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtt

SEQ ID NO: 25085 - DNA, 601 bp, Human
cttgttaaagagcactgggtcatatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtgraatgagcagcccttacagtattgttaccaccaagggcaggtaggtattagtgtttgaaaaagctggtctttgagcgagggcataaatacagctagccccaggggtggaacaactctgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaaagtgttgggattg

SEQ ID NO: 25086 - DNA, 601 bp, Human
catatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtgaaatgagcagcccttacagtrttgttaccaccaagggcaggtaggtattagtgtttgaaaaagctggtctttgagcgagggcataaatacagctagccccaggggtggaacaactctgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaaagtgttgggattggttaaggtctttatttgtat

SEQ ID NO: 25087 - DNA, 601 bp, Human
taatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtgaaatgagcagcccttacagtattgttaccaccaagggcaggtaggtattagtgtttgaaaaagctggtctttgagcgagggcataaatacagctagccccaggggtggaacaactstgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaaagtgttgggattggttaaggtctttatttgtattacgtatctcccgaagtcctctgtggccagctgcatctgtctgaatggtgcgtgaaggctctcagaccttacacaccattttgtaagttatgttt

SEQ ID NO: 25088 - DNA, 601 bp, Human
ctcctgagtcagcacatgcatctgtcagagagagaagagcaagacggagcacgaggctgcagctgaatttagaaagttagaggtgttctcatcagccacatgagatgggcaggagattccttccagtaggcgagagagcagagtgcagacaacagatgtgagaaaggtccccatagctgtcaagttcctgcatccttgtgctgaagaaagggaggtgccatcatgattgatgttcagaggcagtataaaagcactgggtttctccccaactgcttgtcacaccgacctgcaccatctctckcctgcctgtggggtttctgtcaactagtcgtggagggaaggagactctttaaagaataacatcttattgtggccatgccagaacccactaagaaagagggtaagacttatctagaaatctttttgttgtactcctgaataaagtgtttattttggtatttatcttcaaacaaataacaaatatcttaactagatgagaaaataaaatcactatgatttaaggaaacgatcttttagattaaacagaccagaggaaaaatacagcgagagtatattgaattgaaaaatttctgataacgat

SEQ ID NO: 25089 - DNA, 601 bp, Human
ttagacaaagaaaagctacagcgttggtgagaacaacaaatccaggtaagactgcctaagaagagcctggccctgaaataatccttttcctcctttctgctcatcagactggacccttgtcgaaactcctcctggggaggaacaagccaagcagaatgccaactcccagctgtccatcttgttcattgaaaaacctcaaggaggaacagtgaaagttggtgagtgcctagcattcaatccttccttttttaaaaaattaaggtgagccgagcacggtgcctcacgcctgtaatcccagcaytctgggaggtccagacaggcagatcatttgagctcaggagttcgagaccagcctggccaacatggtgaaacccagtccctactaaaaatacaaaaattagcagggcatggtggcagacacctgtaatctcagctactcaggaggcagaggcaggagaatcgcttgaacccacgaggcggaggttgcagtgaaccgagatcgcgccactgcattccaggttgggcaacagagcaagcctctgtctccaaaaaaaaaaaaattttgaggtgaaattcacttataacattaaccattttaaag

SEQ ID NO: 25090 - DNA, 601 bp, Human
ataatccttttcctcctttctgctcatcagactggacccttgtcgaaactcctcctggggaggaacaagccaagcagaatgccaactcccagctgtccatcttgttcattgaaaaacctcaaggaggaacagtgaaagttggtgagtgcctagcattcaatccttccttttttaaaaaattaaggtgagccgagcacggtgcctcacgcctgtaatcccagcactctgggaggtccagacaggcagatcatttgagctcaggagttcgagaccagcctggccaacatggtgaaacccagtycctactaaaaatacaaaaattagcagggcatggtggcagacacctgtaatctcagctactcaggaggcagaggcaggagaatcgcttgaacccacgaggcggaggttgcagtgaaccgagatcgcgccactgcattccaggttgggcaacagagcaagcctctgtctccaaaaaaaaaaaaattttgaggtgaaattcacttataacattaaccattttaaagtgaacaattcagtggctattagtacgttcgcaatgttgtacagccactacttctatctatttctaaaacattttcat

SEQ ID NO: 25091 - DNA, 601 bp, Human
tgtgagcactcagaatttatagtctgagaggagcagagaaaaaaataaacaaataatcacaaatgccaagtgctatgaagggatggtgagctggaggaggacctgagggttgaagaattttaaccaaataaatctttataagggatatattatgatctgaactagtctttgacacttatcaatattatgcaaatgagtacatagccaactgtattccagaattacttctttccaggctagaatgtcaaaatacactgcatgtgaacagaaatgttggttccccttatgttcctgtacgacrttgaaatgctgggctggaagctggactacaatgtcacgtcctcagggtctaaatcactcaatacaaacagattgcaggtttacttcaagcagatcagtttgatttagtcacattcctataattccaggcttctcatcaccttgcctaataaaaagagtgaaaaaaattcaattttttcatttttatttcatacatatccatatatatgaaataaaattttatacatatccatatatgcaataaaagttcacatatatcatacatatccatatatgtccatatatatgaaataaaaaatta

SEQ ID NO: 25092 - DNA, 601 bp, Human
agaaatattaatgggtgtgatttattaattcctgagggctattagcccatcaatagactacttcaaataaccattagtctcaatagtattgattaattccccaaatgcatttaaagcaatagtatatgaagtgcccttaagtgagcctcacgtttcctcattctacagataagaaaccaaggtacagagacaacaagtgacttatcccaagtcacacaggagttagaggcagggccaggacccaaacccaagtttcccttttatgagtcagctcatttcctgtgactccatattaaagatrccactctgaatttgccttggaagctggcgcttcagtttataacacaaattgacactttaggaagacaagagagctttgtattctccctgcaatcatttactcagtcaggaaaatactaaacactgtctttgcgtagaatataatgctactgatgtgaggaaaagaaatccagtgcctggcacatagaaaaggatagatacacttttgtgggaggaaaaatagtggtaaaaacatggactggagtctcagctctaccatttactaattatgtgactttggtcaaatatttgacccctctga

SEQ ID NO: 25093 - DNA, 601 bp, Human
cataattagattgttgttaatataaggctatgttatgttcatttagtatactatactaatccactaatataactttagaaatcattgtgttttcctactagtgagttgcatgcgttttcattgcggtaatgacatatggttaccatttctactcctccaagtgtgtgtgccaaaatccccacaagaaaaaaaaatatgattaaaaccaacatctctgtacaacgaaagatcttcctgctctgaacaaagccagcttacttcaaatagacattagctaaatcagattaaatcttttgggcakcatcctgttataggaattgacctgtataaatacttgtaagttgtactctacataaaatttctataactgttatactcttcactaggatcaccaagttattgaaattttgatgtagatgaaaatacagtgagtattatacaggtctatcccgaggcttggaaaagaatcagaagtgcctacagaaatttggctttttctcctcactgtaacttaacatagccatgcagacagggtcatgtgcagccaccatggtaagtaactaaagatatgttccaggtgcattaaggaaatgctggaggt

SEQ ID NO: 25094 - DNA, 601 bp, Human
cccatcattccctaacatgatagcatgaattcattttcacactgatatataagatgtttgaccagttttccagaaaatcatatccaaatcagcattacggtaagcagtcgttgtaacatttctaaattaacctgataaaaatagtcatgtaaatgtaaacaaaatcaggattatttattcaatgaaggaaaccaatttgtttatactaagcctgttttccaaaagagtgtttatttctgaattttatttttattttatgcttttaaaagaaaggaagacaagtgtaaatcttaaatcttamttaaatcttaaatcttatttttaacacatatatgttctttatgtgttctgtagtcaatgatcaaaagttggggtcataattttggtatgcaccctaagaagttactttcccttgttcatggtgccctaaaccatttgcttcacagtttaacatttgtatttttataactcatacccaatttgcttccaaaaaacattcaagacagtactttaagatgaaatgtaagaaaatttttaaaacctagtctcctttccccctgccgatttagaaaaaaaattttaaaaccatcagtatccataa

SEQ ID NO: 25095 - DNA, 601 bp, Human
attattgtttattattttgttaatgttccaatagaatttaaagatttttaccaccctttaaaaaaaatctgacctttatttctgaacttcctggaaactggttgagaaatggccccagagaaatgtagtagggttttttttagtttatgtagttcagccattcccactatcccagaactcctgaagttatatttttgagaggtgtattaatactacaggggagagccagctgacatctcttttccccaagctgaactttgttattgttatcacttagctctgaattcatctcctaaggtgygtggtagatggcttttttaaaagctagggtttattttatcttgttaaaatatgagacagtgagcttacctaaacaatagtataataaggttggaatgatggaaatacaagcatgacaacatgaagcatttcacatttgtattttccaaactgctaaatgagaattattatcttttaaaaagcaggaaaaaaacttattaaattaaaaaaagaagttaactatctttatttaggacccttcaaagacaactttttttttaattgctgtgttctatgttatttaaaatatttggaaatcctg

SEQ ID NO: 25096 - DNA, 601 bp, Human
aatcatttattcacccaaggaaatctactataccactgggataggtaatgaatagatcttattcatacatcaatggataagatcaagtctctacccacctataaagtacatgaattggttagttaaagaatgtacagagttaaaaatctgacaccctcagccaactctatcttccaacagtgggttaaaaaaattaaatagcaaatatgtgagtactgatttttatttgaaataaaaaccttatgtaaaagaaaattataatggaaattaaatagtatatataaatatgcttatacattawgtattataaagataaaaattggtttttttttttggtttgacgttaaactgtgtaagatatgatacctaaagagcagatcaaaattatatccctgctgggcacgatggctcacgcctgtaatcccaacactttgggaggctgaggcaggaacgcttgaaccgaggagtctgagacaaacctgggcaagatggtgagactcagtcttacaaaaaataaattagctgggcctgatgccccacacctgtggtcccggccacacgggaggctgaggcaggaggatcacttgagcccaggaggtcg

SEQ ID NO: 25097 - DNA, 601 bp, Human
cagtgggttaaaaaaattaaatagcaaatatgtgagtactgatttttatttgaaataaaaaccttatgtaaaagaaaattataatggaaattaaatagtatatataaatatgcttatacattaagtattataaagataaaaattggtttttttttttggtttgacgttaaactgtgtaagatatgatacctaaagagcagatcaaaattatatccctgctgggcacgatggctcacgcctgtaatcccaacactttgggaggctgaggcaggaacgcttgaaccgaggagtctgagacaarcctgggcaagatggtgagactcagtcttacaaaaaataaattagctgggcctgatgccccacacctgtggtcccggccacacgggaggctgaggcaggaggatcacttgagcccaggaggtcgaggctccaattagctatgtttgcaccactgcactcctgcctgtgcaacagagcaagaccctgtctcaaaaaaaaacaacagatccttgactttcaaacactaccaaattataagccaaatttgctggcaataaagaaaagaataaaatcacattcacagactctgtttattttcatc

SEQ ID NO: 25098 - DNA, 601 bp, Human
ttaagtattataaagataaaaattggtttttttttttggtttgacgttaaactgtgtaagatatgatacctaaagagcagatcaaaattatatccctgctgggcacgatggctcacgcctgtaatcccaacactttgggaggctgaggcaggaacgcttgaaccgaggagtctgagacaaacctgggcaagatggtgagactcagtcttacaaaaaataaattagctgggcctgatgccccacacctgtggtcccggccacacgggaggctgaggcaggaggatcacttgagcccaggagrtcgaggctccaattagctatgtttgcaccactgcactcctgcctgtgcaacagagcaagaccctgtctcaaaaaaaaacaacagatccttgactttcaaacactaccaaattataagccaaatttgctggcaataaagaaaagaataaaatcacattcacagactctgtttattttcatcctattcaaaacagatacatctttgaacacaaaggatgccagagaatcctgtttatcaataactgtcagatgacagatgattcagagtattatgtgacagccggtgatgagaaatgttcca

SEQ ID NO: 25099 - DNA, 601 bp, Human
gtaagaggtaaaaatgaaatctcttattgtggtcaccaggagctgttggcttcttctcccagggataatgatcaaagtgaaagtaactgaggctcctctacactggcagctattatggatcctaatgagtcttctggtttgttgaagactagaacagcagaggggagaaagagaacctgttgagtacaaatgcctcatgttttgactcaagccaagcactatcttgcaaaaataattattctagttatagctttgaaacccaacagattttactggataatccttgtttcacacactcaaytgatcacaaataggtttctcttgaaaccagcttcattaataagtggttggtaccaagcacactgaaaattatcatttactaagacattgtgaaaagagctggagggtgtgaatacagccatgtcttccttattttctttatgagggcttctgatgacagacaaccctgagatctctgtcatccatctggaactaggatcaaagatttgagttttatatattctccttcatcagaaatgtctagcatttagtatcttctttgctaaaagaataatatttgatatatgttttgtttgttctt

SEQ ID NO: 25100 - DNA, 601 bp, Human
ttttgtatactagagcctccaattatggtgaccaaacagctggaagatacaactgcttattgtggggagagagtggaattagaatgtgaggtgtctgaagatgatgccaatgtaaaatggtaaatagccttaatgaagtctgtccatgtttaatagacaaaaaaattggaccttcatagttgatagaacaggaagtacaaatagcttttaaacctttgaaaacaatctccacctcatttgtgttagtagagatgataaataaaagtatactaatatactggggtttttccactcatgagaytgaaaaaagaaccagagatctatgtgggtaagcacgtagggaagtgggtacttaatactaagtggatgactcaagtttacccaagtctatttgaccccaaagcctatggatgctcttaacctttatagcaggcttcctctcactatgccatattggcaacttacatgaaaaaacatatttagtgtttagtaagtttagtaagacttctttagatgtcttctaagtgggcttactaatgatagttgtgttaattcggttttagaaaagtttctatttgatttctatttgcaatgattttta

SEQ ID NO: 25101 - DNA, 601 bp, Human
cacgtagggaagtgggtacttaatactaagtggatgactcaagtttacccaagtctatttgaccccaaagcctatggatgctcttaacctttatagcaggcttcctctcactatgccatattggcaacttacatgaaaaaacatatttagtgtttagtaagtttagtaagacttctttagatgtcttctaagtgggcttactaatgatagttgtgttaattcggttttagaaaagtttctatttgatttctatttgcaatgatttttaagtacatatttacatgtgtttttcatgtaaccsctagtcactttattttcatagtacctcaggggaaaaaaatttagactgagaatcaccaattgcttttagaaataagagtttatttgttttgctcaggtggggaatgttttctcaggttccttgtgagtaatcttaaaattaaaaactagaaattttaaatcttaaaatgaaatgttatgttgaaaggtacagtaaattacacagcaggatttgtagtaattggtacagtgtagattgttcattctaatagagaatcatagttatctttaaaatgcattaaatgatattcttactaatgtg

SEQ ID NO: 25102 - DNA, 601 bp, Human
caatcccaatacattccttatgctttatggatctgtggccattttagtttaacatcaagaagtctttcagccatagacagatccttatctgatatttgtatccatttaaagcaattataatccattctgctatgatgtaacatgtgcatttctaaaaataattatgctatgcaaagtcatgcagtaaaaaccatagggtttgtaggggaaatgggattatgggtatgacactcaagaattttgctggtttattagtccgttctcatgctgctaataaagacatacccaagactgggtaatytataaaggaaaaagcttcagttgactcacagttccgcatggctggggagacctcaggaaacttacaatcatggcagaagggaaagcaaatatgtccttcttcacatggtggcagcaaggagaagtaccaagcaaaatggcaaaagtcccttataaaactgtcagatctcatgagaactcagtcactatcatgagaacagcagcaggggggtaaccgcccccatgattcaattacctcccaccacgtccctcccatgacatgtgaggattataggaactacaattcaagatgagatttagg

SEQ ID NO: 25103 - DNA, 601 bp, Human
ccttatgctttatggatctgtggccattttagtttaacatcaagaagtctttcagccatagacagatccttatctgatatttgtatccatttaaagcaattataatccattctgctatgatgtaacatgtgcatttctaaaaataattatgctatgcaaagtcatgcagtaaaaaccatagggtttgtaggggaaatgggattatgggtatgacactcaagaattttgctggtttattagtccgttctcatgctgctaataaagacatacccaagactgggtaatctataaaggaaaaagsttcagttgactcacagttccgcatggctggggagacctcaggaaacttacaatcatggcagaagggaaagcaaatatgtccttcttcacatggtggcagcaaggagaagtaccaagcaaaatggcaaaagtcccttataaaactgtcagatctcatgagaactcagtcactatcatgagaacagcagcaggggggtaaccgcccccatgattcaattacctcccaccacgtccctcccatgacatgtgaggattataggaactacaattcaagatgagatttaggtgagggcacagccaa

SEQ ID NO: 25104 - DNA, 601 bp, Human
tggccattttagtttaacatcaagaagtctttcagccatagacagatccttatctgatatttgtatccatttaaagcaattataatccattctgctatgatgtaacatgtgcatttctaaaaataattatgctatgcaaagtcatgcagtaaaaaccatagggtttgtaggggaaatgggattatgggtatgacactcaagaattttgctggtttattagtccgttctcatgctgctaataaagacatacccaagactgggtaatctataaaggaaaaagcttcagttgactcacagttcygcatggctggggagacctcaggaaacttacaatcatggcagaagggaaagcaaatatgtccttcttcacatggtggcagcaaggagaagtaccaagcaaaatggcaaaagtcccttataaaactgtcagatctcatgagaactcagtcactatcatgagaacagcagcaggggggtaaccgcccccatgattcaattacctcccaccacgtccctcccatgacatgtgaggattataggaactacaattcaagatgagatttaggtgagggcacagccaaaccacatcagtcagcgacat

SEQ ID NO: 25105 - DNA, 601 bp, Human
atttaaagcaattataatccattctgctatgatgtaacatgtgcatttctaaaaataattatgctatgcaaagtcatgcagtaaaaaccatagggtttgtaggggaaatgggattatgggtatgacactcaagaattttgctggtttattagtccgttctcatgctgctaataaagacatacccaagactgggtaatctataaaggaaaaagcttcagttgactcacagttccgcatggctggggagacctcaggaaacttacaatcatggcagaagggaaagcaaatatgtccttcttcacatggtggcagcaaggagaagtaccaagcaaaatggcaaaagtcccttataaaactgtcagatctcatgagaactcagtcactatcatgagaacagcagcaggggggtaaccgcccccatgattcaattacctcccaccacgtccctcccatgacatgtgaggattataggaactacaattcaagatgagatttaggtgagggcacagccaaaccacatcagtcagcgacatattttttaaaatataagaacccagtaaaaagtagtagcacagttttacacatgctaaatggttaataa

SEQ ID NO: 25106 - DNA, 601 bp, Human
gagggtgaaatggtagagtagtgccagctcaagtgtgactccgtggctttctacaaaaataaaagcaaaaaaaaaaaattacatttaaaaagaagacatgaggctgggcatggtggctcatgcctgtaatcccagcactttgggagctggggcaggcagaacacctgaagccaggagttccagaccagcctgagcctgcatggagaaaccccatctctactaaaaatacaaaaaaattagccaaatatggtggcagcatgcctctaattccagctactcaggaggctgaggcacaagaatygctggaacccgggaggcagaggttgcagtgagccaagatcacgccactgcactccagctgggtgacagagtgagactctatctcaaaacaaatttttttaatgttaaaaataaaattaaataataaaaagcagaatgagacttctactttcaaccagaattgaataacaggaaccagatttacctactcacttgaaataacccccaaaatagacaaaatatgtgaacaatgggtttcaagacattggacatcagatcgtgaaagacaatgactatgaaatatgataaacaaatgaaataa

SEQ ID NO: 25107 - DNA, 601 bp, Human
tgactccgtggctttctacaaaaataaaagcaaaaaaaaaaaattacatttaaaaagaagacatgaggctgggcatggtggctcatgcctgtaatcccagcactttgggagctggggcaggcagaacacctgaagccaggagttccagaccagcctgagcctgcatggagaaaccccatctctactaaaaatacaaaaaaattagccaaatatggtggcagcatgcctctaattccagctactcaggaggctgaggcacaagaatcgctggaacccgggaggcagaggttgcagtgagccragatcacgccactgcactccagctgggtgacagagtgagactctatctcaaaacaaatttttttaatgttaaaaataaaattaaataataaaaagcagaatgagacttctactttcaaccagaattgaataacaggaaccagatttacctactcacttgaaataacccccaaaatagacaaaatatgtgaacaatgggtttcaagacattggacatcagatcgtgaaagacaatgactatgaaatatgataaacaaatgaaataagccctataattgcctcaagcttattgccataaaag

SEQ ID NO: 25108 - DNA, 601 bp, Human
agttgggttaattgtaaatatatattgtaaactagggaaaccactttaaaaagtttaaaaaagaggaagtaaaattaatatgctaataaaggagagaaaatgaaatcacatagaatgcttaattaaaaccacaaaaggcagaaaaaaatgtagaagacaataataggaacaaagaagaagggcaaccaatagaaaataataacaaatatgacagatattgatcgagctataccaatatttactttaaatgtcaatggtccaaatatacaaattagaagcccaaaattgtcagagtagagcraaaacatgacccaaagatatgttgactataagaaacccagtttaaatataaagttgcatccattaaagtatagggagagagagagacatgctgtgctaagactaaacaaaagaaagtatgagtaaccatattagcttcagacaatgcagactacaaagcgaagaaatttatctggaatagaaatgagcgttacataatgatgaatgggtcaatactccaagaaagcctaataatccttaacatgtatacacctaacaacagagcctcaaaatatatgagacaaaaactgatagaacggca

SEQ ID NO: 25109 - DNA, 601 bp, Human
agcagataaaagacatgatacaaattagtgcagaaataaatgaaattgaaaactggaaattaatagagaaattaacaaaagctggttctttgtaaatatcaataaaacgtataaccctctagccgggctaagtaggataagaagagtcaaggctaattaacagaaatgaaagagggacattactacaaatcccatggacattaaaaggatagttaaggaatattatgaacaactctatgcccataaatttcacaacctagttgaaatggaccaactccttgaaagatacaatcttctaaarctcacacaagaagaaataggcaatcagaaaaggattatctctattaaacaaattgaatcaataattaataaccttacaaaacagaaagcaacaggccccaatgggtttgttggtaaattctaccaaacatttaaggaagaaattgtgccttaatctctttcagaatgcttcctaattcaatctatgaggtcagttttatcctaatatcaaaaccagaaaatttcagaccaatatctctcataaatgtagatgcaaaaattctaatgaaacattagccacgaggtcaggagatcgagacca

SEQ ID NO: 25110 - DNA, 601 bp, Human
atcctaatatcaaaaccagaaaatttcagaccaatatctctcataaatgtagatgcaaaaattctaatgaaacattagccacgaggtcaggagatcgagaccatcctggctaatacggtgaaaccccgtctctactaaaaatacaaaaaaaattagccgggcgtggtggctgcgcctgtagtcccagctagtcgggaggctgaggcaggagaatggcgtgaacccgggaggcggagcttgcagtgagccgagatcgcgccaacacactccagcctgggcgacagagcgagactccgtctcaaaaaaaaaaaaaaaaaagagcaaataaaacccaacaatgtatgaaaagaattatacaccaagaccaagtgaaactcactctaggtatgcaatgctggctcaaaatttgaaaatcaattaatgtaatccactacatcaacaggctaaaggagaaaagtaacatgattatatcaaccgatgcagaaagaatctttgacaaaatgcatgaagaaaactctcagcaaaatagaaatagagggaaatgtattcaatctgataaaaaaaaaatctaccataaaaagaaaaacccaacagctaaagt

SEQ ID NO: 25111 - DNA, 601 bp, Human
caaccatattcaacatttagacaataatttcttggttaacattttcaaggtaaggaatgagagtcttgggtttcatatggggcttattctgtaatgttgggacacgggtttaagggatttggagacatcattatttttatttcgggcaaggggtgggctcatcttcccttatcccatattgagcacaaatttttgcccaaattagttactaacttgtatgagtctgttttcacgttgctgataaaggcctactagagactgggtaatttataaagaaaaagaggtttaatggactcacagttccttgtagctggggaggcctcacaatcatggtggaaggtgaaagccatgtcttccatggcagcagacaagagagagagaatgagaaccaagccagaggggtttccccttacaaaaccatcagatcccttgagacttactcactaccacgagaacagtatgtgggaaactgcccctgtgattcaattctctcccaccaggtccctcccacaacatgtgggaattatgggagctacaattcaagatgagatttggatggggacacagccaaaccatatcataagcataattcagtaaatat

SEQ ID NO: 25112 - DNA, 601 bp, Human
gtaggtaaacaatctcccaggaaacttgttcaaattccacaaacagtggcccaagacttcacctccaggaaaactctttggacaccaaactttaacacagatcctcgaagtgaaggaaggaggttacgaagcacatttgggaaatcaggaatgtgaacgcaaatgcacctcccctggaggaaactcactatggagatgaaacttcctatgaagagaaaactgctgaaaaagaaatcccaggtgcctggattggggcacctgtggaaatgctcacctctgttctggagggaggaagaggagrgggacaatgaagtatcctgatacccctcaatccctcttgcacctactccacacacagagtcctataattggtttctccaggatttaaaaagccactaaccaaaagcagtggaaacgtcagaaatttcccagggttaacccagtaagggaaggggatagtgtcactaatgcaacaagtaaattcttgagcacttcagtttattcctcttccatcctcctgcccccatttaaaaaagtcatgagcactccattctgtttttttgtattgtccagccagcagaatatcccaatcttatgtgtg

SEQ ID NO: 25113 - DNA, 601 bp, Human
tcattattatgtatatattttgccgagtaacgttctggaattagctttctatgggagttctctcacaacgtgtatctctttcttcttgcagtcttttcttattttctttatgtggctgccgactcttcattctcttttaatggctgttgtcctccagactaattttctatagtgtttaatgcttttagagacatcaggttttattctgtaagagaattctttgttttgtaagatcgtgtgttgttttggactctgcctttctctcgtttttgttttgttattatttttttaatgcctgcarcattttactcttctttgttttctttctgcactctagttttttctttcctttcttaaaaattctcctcacatgttaaataacttacatgttccttcctcatcccctgggacaccatcttctttgtctgtgtttccccaattaaagtggttccaatgtgaagagatgggctatttttgttccccctctggtcttgtttcgtcctgttttctcttgaaattgtctcttttactagttcttcactcttttgtacatgttttctgagtctcttattttcactttctcatccactgtctcttgact

SEQ ID NO: 25114 - DNA, 601 bp, Human
ctaagagaaaatgtatttttctataaagttgctttaggcttattacaacaataaaaatacaaagttgcaataaagccaaggatgtcagggataaattttgctgagtcaaactgttaaaacatctctgtgtggaaaccacacacacacacacacacacacacacacacacacacacattttgaaccagttactatatatcgtctgttagtggcacatctcagagtttattgcagagatatgccacaagggtacgctggtgagcatcatgccattttgcttttgtaaggctattttcagacaycagactgattgcaaaattgtgctattttaccctctctcagaacctccaaagattcgcatcccaagacacctgaagcaaacctatatccgcagagttggagaagctgtcaatctggttatacctttccaggtaagagttcaagggtcgctctttttctctttagagggctggattagtttaggaagtgggaagaggtactctagcatttaagttcatcatgattcaggatttcctcagagggagaggaggtaaataaagaatgaaagagtattggagaatgattaagcaatctcctgctgt

SEQ ID NO: 25115 - DNA, 601 bp, Human
agaacctccaaagattcgcatcccaagacacctgaagcaaacctatatccgcagagttggagaagctgtcaatctggttatacctttccaggtaagagttcaagggtcgctctttttctctttagagggctggattagtttaggaagtgggaagaggtactctagcatttaagttcatcatgattcaggatttcctcagagggagaggaggtaaataaagaatgaaagagtattggagaatgattaagcaatctcctgctgtcaaaatagagaaatctatagaaaccgtcacagattttcyttctgcatgagacaaatgagatatagtcttgcctgaagctcagcgactatggtgggcagggaagaaacatcaaggagataccaaatgaagaaatgcttgaagactcttttggtcctatacatttgtaaaacccatcattttaagtgaagctctcagtgtaacattcaggaaaacagtgtgtgcttagttcccacaatgaccccaaaccaaaataatttcaataagggggacaactgaaatttgaaataacgatgacactaactgaaatatatgaacaatattaaatcattgttccagcaa

SEQ ID NO: 25116 - DNA, 601 bp, Human
aacccttactctccaactccctattcatatgacacctccagacagtgctgttcaatagaactttcttcaatgttagaaatgttctatatcaatgctgtccaatatggtagccactagccacatgtggctgttgagcacttgaaacgtgtaactaggaactagtgtgactggagaaataaatttttaattttcttcaattttaattaattttaatttaaatagccacgtgtaccttgtggctatcgtatcagccagcctggccttagaatgtaggtctctacacacatttgacactcatatacacacacacacacacacacacacacacacacacacacacactcacacatgcacacatgcacacacagagagaactctgttcaaacccaggctcccatgaaaccaaactaaagggatggccaattcaggccatcctcattgcactccgggtgcaaacctaaggagagacattgtgtactacataccccccgcatgaaatcagaatgaaagccaaggaggaagtgaagcagaacacagcccaggaggaagtgggtggcttggcaaggttcttctcactttccttctcttgcagcatcaaata

SEQ ID NO: 25117 - DNA, 601 bp, Human
tccctattcatatgacacctccagacagtgctgttcaatagaactttcttcaatgttagaaatgttctatatcaatgctgtccaatatggtagccactagccacatgtggctgttgagcacttgaaacgtgtaactaggaactagtgtgactggagaaataaatttttaattttcttcaattttaattaattttaatttaaatagccacgtgtaccttgtggctatcgtatcagccagcctggccttagaatgtaggtctctacacacatttgacactcatatacacacacacacacacatacacacacacacacacacacacactcacacatgcacacatgcacacacagagagaactctgttcaaacccaggctcccatgaaaccaaactaaagggatggccaattcaggccatcctcattgcactccgggtgcaaacctaaggagagacattgtgtactacataccccccgcatgaaatcagaatgaaagccaaggaggaagtgaagcagaacacagcccaggaggaagtgggtggcttggcaaggttcttctcactttccttctcttgcagcatcaaataaaaccagaagtggcaac

SEQ ID NO: 25118 - DNA, 601 bp, Human
cctattcatatgacacctccagacagtgctgttcaatagaactttcttcaatgttagaaatgttctatatcaatgctgtccaatatggtagccactagccacatgtggctgttgagcacttgaaacgtgtaactaggaactagtgtgactggagaaataaatttttaattttcttcaattttaattaattttaatttaaatagccacgtgtaccttgtggctatcgtatcagccagcctggccttagaatgtaggtctctacacacatttgacactcatatacacacacacacacacacatacacacacacacacacacacactcacacatgcacacatgcacacacagagagaactctgttcaaacccaggctcccatgaaaccaaactaaagggatggccaattcaggccatcctcattgcactccgggtgcaaacctaaggagagacattgtgtactacataccccccgcatgaaatcagaatgaaagccaaggaggaagtgaagcagaacacagcccaggaggaagtgggtggcttggcaaggttcttctcactttccttctcttgcagcatcaaataaaaccagaagtggcaacaa

SEQ ID NO: 25119 - DNA, 601 bp, Human
ctattcatatgacacctccagacagtgctgttcaatagaactttcttcaatgttagaaatgttctatatcaatgctgtccaatatggtagccactagccacatgtggctgttgagcacttgaaacgtgtaactaggaactagtgtgactggagaaataaatttttaattttcttcaattttaattaattttaatttaaatagccacgtgtaccttgtggctatcgtatcagccagcctggccttagaatgtaggtctctacacacatttgacactcatatacacacacacacacacacacwcacacacacacacacacacactcacacatgcacacatgcacacacagagagaactctgttcaaacccaggctcccatgaaaccaaactaaagggatggccaattcaggccatcctcattgcactccgggtgcaaacctaaggagagacattgtgtactacataccccccgcatgaaatcagaatgaaagccaaggaggaagtgaagcagaacacagcccaggaggaagtgggtggcttggcaaggttcttctcactttccttctcttgcagcatcaaataaaaccagaagtggcaacaag

SEQ ID NO: 25120 - DNA, 601 bp, Human
ttcttcaattttaattaattttaatttaaatagccacgtgtaccttgtggctatcgtatcagccagcctggccttagaatgtaggtctctacacacatttgacactcatatacacacacacacacacacacacacacacacacacacacacactcacacatgcacacatgcacacacagagagaactctgttcaaacccaggctcccatgaaaccaaactaaagggatggccaattcaggccatcctcattgcactccgggtgcaaacctaaggagagacattgtgtactacatacccccsgcatgaaatcagaatgaaagccaaggaggaagtgaagcagaacacagcccaggaggaagtgggtggcttggcaaggttcttctcactttccttctcttgcagcatcaaataaaaccagaagtggcaacaaggcaggtatgggggacccagccccaaccctgcactggggctgctgagtcagccctcaagcctccacatcgttcctgccaccacaactaatcccagttcccagatctgggggtctgcgtgttcagcttctgtcactgagtctgagagagaaaaaatcatgagaacagggac

SEQ ID NO: 25121 - DNA, 601 bp, Human
cacacacacacactcacacatgcacacatgcacacacagagagaactctgttcaaacccaggctcccatgaaaccaaactaaagggatggccaattcaggccatcctcattgcactccgggtgcaaacctaaggagagacattgtgtactacataccccccgcatgaaatcagaatgaaagccaaggaggaagtgaagcagaacacagcccaggaggaagtgggtggcttggcaaggttcttctcactttccttctcttgcagcatcaaataaaaccagaagtggcaacaaggcaggtatkggggacccagccccaaccctgcactggggctgctgagtcagccctcaagcctccacatcgttcctgccaccacaactaatcccagttcccagatctgggggtctgcgtgttcagcttctgtcactgagtctgagagagaaaaaatcatgagaacagggaccgcatagatctggcatcccagagactgttcagcccccaggaagggagatgagaccaaagtgtgatgtttgtatatttgtgtaatctctagagttcgcaaacattttctcatttgatcctcagaaacaccctgtgaggcag

SEQ ID NO: 25122 - DNA, 601 bp, Human
agatctggcatcccagagactgttcagcccccaggaagggagatgagaccaaagtgtgatgtttgtatatttgtgtaatctctagagttcgcaaacattttctcatttgatcctcagaaacaccctgtgaggcaggaaggccagatttccttaccttgcttgagaagggaagaaactgaaagggaagttaagtgacttgcccaatgtcacacagaaagtcaatggtagggccaagaacagagtccatggcccggtcacttaattcagtggttttttccactctgtatattattagagaacmcacatttttccctagtggctaacagcaagttgtacatttaaggaaataagcttgaactgtttttccctatcttcaacaacgtcgttctctgcttcccatgtgtgagtctgagcatccccaaccactcttcaggctctgaagcaggggtttggtgtgtagctctacatctcttattataacctagccatgttcagagcccacaggaaagctgtgccttacctgacagaattcatgcttggttcctgtctgccagggtacgcctggatgcttggggattctaggaaattcctttgtaataga

SEQ ID NO: 25123 - DNA, 601 bp, Human
accctgtgaggcaggaaggccagatttccttaccttgcttgagaagggaagaaactgaaagggaagttaagtgacttgcccaatgtcacacagaaagtcaatggtagggccaagaacagagtccatggcccggtcacttaattcagtggttttttccactctgtatattattagagaacacacatttttccctagtggctaacagcaagttgtacatttaaggaaataagcttgaactgtttttccctatcttcaacaacgtcgttctctgcttcccatgtgtgagtctgagcatccccarccactcttcaggctctgaagcaggggtttggtgtgtagctctacatctcttattataacctagccatgttcagagcccacaggaaagctgtgccttacctgacagaattcatgcttggttcctgtctgccagggtacgcctggatgcttggggattctaggaaattcctttgtaatagaaatggaaactcaggttcatgaatgggattatgatttcttaaattctgctcttaaagaatagtttcaacagcgagagggaacagagagagaattctagacaagtctaaaatgagcagcacag

SEQ ID NO: 25124 - DNA, 601 bp, Human
tgcaacgtcaagaaataaatttaaggccgggtgtggtggctcacacctgtaataccagcactttgggaggtgggcagatcacttggggccaggagtttgagacaagcctggacaatatggtaaaaacctgtctgtactaaaaatgcaaaaattagccagacattgtggcacacacttgtggtcccagctacttgggaggctgaggcatgaaaatcgcttgaacctgggaggaggagactgctgtgagccaagatttcaccactgcactcagcctgggtgacagaccatgactctgtctccaaaaaaaaaaaaaaaaaaaaaaggaaagaaagaaatttaagagcagagctagaaaaacgttgtttccaatcattgttatcattgtatttcagtaaatttgctgaaagttgctctaaccaaaggggcaacttcctgtaacagcctcccttaaagggtcattccctttaaactaagcactctttccccactggctaatccgttttgagttttgttaagttgcagggagtgttgaggctgctctgtgccctttgatctggcctggctccatactactggaaggcaaagggtctcagaagccccc

SEQ ID NO: 25125 - DNA, 601 bp, Human
tgcctcctgtaacagaggaaagggtcttttaaaatatcctcatgaaacaaaatgtagactgggaaagaaagtgaccttgcagtgacaccatgaattcatcctgtagaccgtccaggtccaccccaaattgtgaagattgaggatgtctggggagaaaatgtcgctctcacatggactccaccaaaggatgatggaaatgctgctatcacaggctataccattcagaaggctgacaagaagagcatggtaaggtctggctttctctggttcatcagtagcaaaaggcacatttcatcagagstaaaggagatggcacaagggcctcactggtaaggagccaactggggctatggagaagtgatgtggcagagcagaaaggaaaagacctgtggagccacagagctggtcttaaaccccagcattgctacttaagaccacatgtataaggaccacacgtgaccacaatcacttgagctctttgatctctattttcctcatctatgtaatgggggcacaaatatcccttgcttgattattacaaagctaaaatgatataaagcaactggttcaatgttcagtagaattcaataaactcattcat

SEQ ID NO: 25126 - DNA, 601 bp, Human
aagctaaaatgatataaagcaactggttcaatgttcagtagaattcaataaactcattcattcaacaaatatttgctcaagactttgactcagatttacacccatgcaactctttctccttgtgaaataaatgttggatactgtgcacttatgtctacaaaaaagtaaaaagacagacaccagttagaacagaaagattctacaaggttacagcatgtgcaaatgcggaaaggtctggagaaaaagagcttaatgcaaacttgtccaacccgtggcccacaggcctcatgcaacccaggayggctttgaatgcagcccaacacatatttgtaaactttcttaaaacgttatgagtttttttatgattttttttcagctcatcagctatcgttagcgttagtctattttatgtgtggcccaagacaattctttttccagggaagccaaaagattgaaaacccctggcttaatgtgtttaaaaagcaacctagttggagtatgacttattataaacttattttatagatgaggaaactgaggcttgcagaggataaatgacttgctaaagatcaccagattttctcacgcctgaaatcccagc

SEQ ID NO: 25127 - DNA, 601 bp, Human
ggctaataccccagaggctggaagaagtagacattttcttctagagtttctacttttattcttggacacctttattgtagctacacatgggacccactctgtgataaaaggagaaactaaattctatccttatcttttcttttcatcataaaccactcttcttaaaaccttccttgtgtattttcacattagaacaaatttctattcaaaatactcagaaagacaccaaagtcttctcaatatctggttcagtttcagatgacccctctggctttctatcccacgtgtgattggctatacrtttatacccctcagaatgtttgccacatggcatttgctcatctttgtccatgtttttctaagttcagggaagttttaatcatgtgtaaagtatgccaccaataatatattctcaggccaatttacataattttaacatatttgtaatgcttgtttttaaggtaaaatctacaaaaatccagtgtatgaagactttgatttctcagaggcacccatgtttactcagcctttggttaacacctatgccatagctggttacaatgccaccctaaactgcagtgtgagaggaaatcctaaggta

SEQ ID NO: 25128 - DNA, 601 bp, Human
agtgaagaaaatcaaatgatcgtgacactttatggggtttctctgaaaaaaatgctcagcaaatatgcactctctacaatgagttaacaacatggacctatggatgacattgttttttaatttgaaagtatttaattggcaaataaaggtcatatacattcaagctgaacaatatgatgatttgatatatgtacacattgtgtaatgattatcacaatcaaattaatacattcatcagtaccgatgctgtacattcgatgcccagaacttgttcatcctgtaactgaaagtttgcacccawgtagatcaaattgaaatgcaactgaatccatttgagaagattgccctagagttacctctgaacacatctggctttctttgttagaactgttagtttgcttatttgccaagcactaagtagagtttaatgtgagaaatagtgtcaagtaaaagtctatccttctcagatgcactttctttttaagccatgctttaaaattctgtcactggctttgatggtctattaatatgccaattacagatatgttttgacctaagtttcttcaatttgaacttcagcctaaaataacctggatgaaaa

SEQ ID NO: 25129 - DNA, 601 bp, Human
tttttatcttttctaatgtgcttgaatcgaaactctctgtgcctaattaaaaagaacattaacaaactggaagcagatcttcccactgatccataatgtggtatgcatttattctgctgttcagtcagaacatttaaatcatctatgaggaatcacaaaacctctcaaagagcaataaatactttccaaccacttgggaatttaaatgaagattgaacaatagtaggggaaaaactgctgtggttctactgggaacttgcttttccttctagatgccaagtgctttaaattctaaatgtastaaatccaggagaagattttccaagtagagactgaatgaatctttgtaactaatgggaacatgattagtcacatttccaggcagctagtcaagaagtattgtttcagcgatttttcaggtagatggttttgatttgtctgttttccttttggtcctctctaggtgggctctccttctgcagactcctcttgcaaggcgtacctccaaacataattgattcatatctgcgagacttacactcaagcaatcctgaggaatactgagggagggcctggctactgtctctctgcactctgctgc

SEQ ID NO: 25130 - DNA, 601 bp, Human
ctttgtaactagctcctctcacaccccagaggccctgcttccaggccttcctggcttccatcctgggtggtggttctgctctcacaggacaccagcttaaaggggtccctggttctcctgactctggcgataagggtgatggagacagattttgtggcccagtgaaggtcgctctgtgcaggcctgctggagttccaatgagactgagtgggttttctctctgctcagccacacccaggatgggggcaaagcagtcttctctggtgaacttggcctggccttttaggctctgactcaggcrctgggattaatcctcaccctcacctgggctgactgtggccttgctcctgatctttcttcagtcctatgttccccaccccaaccccttctgcacttcctccccactgcctttatcttgtctggaaagaacacaggacacaggaggtcagctggatagcccagctctgaccagggaagggctcctgcagcccctcgaccctgtctggcacctgcaccaaccctctgagcccctcttggggtcttgaggctgtccaggtgcctccctctggccccgtccccttggggcagggggatgggatgg

SEQ ID NO: 25131 - DNA, 601 bp, Human
ccagcccaggccatccccaaccccagaatctttgtaactagctcctctcacaccccagaggccctgcttccaggccttcctggcttccatcctgggtggtggttctgctctcacaggacaccagcttaaaggggtccctggttctcctgactctggcgataagggtgatggagacagattttgtggcccagtgaaggtcgctctgtgcaggcctgctggagttccaatgagactgagtgggttttctctctgctcagccacacccaggatgggggcaaagcagtcttctctggtgaacttkgcctggccttttaggctctgactcaggcactgggattaatcctcaccctcacctgggctgactgtggccttgctcctgatctttcttcagtcctatgttccccaccccaaccccttctgcacttcctccccactgcctttatcttgtctggaaagaacacaggacacaggaggtcagctggatagcccagctctgaccagggaagggctcctgcagcccctcgaccctgtctggcacctgcaccaaccctctgagcccctcttggggtcttgaggctgtccaggtgcctccctctggccc

SEQ ID NO: 25132 - DNA, 601 bp, Human
gagggtgggccacaggctgtggccttccagcccaggccatccccaaccccagaatctttgtaactagctcctctcacaccccagaggccctgcttccaggccttcctggcttccatcctgggtggtggttctgctctcacaggacaccagcttaaaggggtccctggttctcctgactctggcgataagggtgatggagacagattttgtggcccagtgaaggtcgctctgtgcaggcctgctggagttccaatgagactgagtgggttttctctctgctcagccacacccaggatggggkcaaagcagtcttctctggtgaacttggcctggccttttaggctctgactcaggcactgggattaatcctcaccctcacctgggctgactgtggccttgctcctgatctttcttcagtcctatgttccccaccccaaccccttctgcacttcctccccactgcctttatcttgtctggaaagaacacaggacacaggaggtcagctggatagcccagctctgaccagggaagggctcctgcagcccctcgaccctgtctggcacctgcaccaaccctctgagcccctcttggggtcttgag

SEQ ID NO: 25133 - DNA, 601 bp, Human
tgcgcctcttttctgaactcccctagtaggtagggtttggaagcagccactcaagttggagcaggatggagctccccagagactggacctgccctttgctcggcccagttttgcagcactgactcagcacttcacagggacccctggggcagggacattgtcctctctgtggagaaggtcaaccaccaggcatcagctggggagctgcaggagctactatcactcctttgctggtcaagactgcaggggcacacagaacctcccagcccaccctttgggccttggagtcagcaggtccctrgagagacccaagggaagaggaccggagcaaggaataaggtaagaggggagaacctggcccagggagggactgagggattggagccaaggttaccagtcaggcctcacttaccccctgggttggcgctgaactccagtgcactgccccactctggactgcaggaggcgctgtgagagctgcattcgctgggcacctgcaagacagggcgaaggcccaaggtcggggcacagccattctttgatgtctctctctgcctagtcccagtgggcagaagtacctgtggtggggttggagggtggg

SEQ ID NO: 25134 - DNA, 601 bp, Human
ttgggaacagagggctgttcctctccccttcttctctctcaattcagggcaggcccagcccagccactggcatcgggaagagaccagaacaggagacgtgcacagcttgtccaggtcagggcactgcgtctctcaaaccgtttcacttggggggtggaattagaggccgcgttatgataaaaaggaagctcctgagtttgccccctgagctggggcatacacgagggggcgctctggtcccctgctttacctccctggaaaggggatgccctctcctctaaggaggcagctgaatgagggygtccagtcccttgctggggggtgggttaaccttacatggatgaggaaggggatagtctggcctatggcaccccagagctggcttcctagcatcagggcagcctggcttaggaggcccctgctacagaagtagtggcatctgtggccagcttggggggctcgcaaggatgcccggcttggaagacaatctcagttgggcatggtttcatctgggaaggccacagacacatcttccactgtgatgctgtccacgatggaggtgagggagtgcaggttgtgggcatctgtagggtcagccgtg

SEQ ID NO: 25135 - DNA, 601 bp, Human
ctcctatgctatccacaaaagaaacccaaatttttaaaatttaaattagaaagcctgcagggggtacttgagtgacacgactcattatgtgtgagtacttatgggcaattatggagggggatgctggtctcaatacacatacacactctcgcaaacgcacacatacagaatatgtaggttcatcagtcttcagttattgcttctattctggggcaaaaaaatgaaagaactgtaattacctttgttgttagtaggtcctgagcagtgatagtctcataaccctggggcctccggacgccgygcctcctgcgtgggcgaattcctcgtgtcgtggccgcgcgggcgctcaggttatatagcccagttagtgatgctaagcgcgggcggggccgctagctgaggggctagcaggtctatgcgcctgacgcctgcgcacgcgtccaggctgtgcgctccccgttctcccctcctccccacttctccccacgccttgctcgtctcccgccctcctccgacaaccgctcccctcaccctccacccctacccccgcccctcctccttcctccccggcatgcgccatatggtcttcccggtccagcca

SEQ ID NO: 25136 - DNA, 601 bp, Human
ttcccccacggccggcgggctcctccgacgcgcgtgttctcacggcttgaagcagcgcagcggatcgcgagggacggagcgggtgtgcccctacccgggctggcggtggctacgtctcggggtgcagagcgccggggcgcactaggcggggacccttcctggccgcgcgcagctctggctacgcaggcgggaggcggcaggcagggggcgctgcggggcgaggcaagtgcagtccgccgctgcctgcctgcgagtctggggctgcgcgccgctccccacctagctgcgcgacccgagcgcmgcgcccaccgcgctccgtgggctcccgcgcctcgaagggtcgggatccggtctgagcctctcctggctctcggtgcaagccgctgggcacctaacgagacgggggcgcccggacgcctcggattctgtagcgcggtatcccgggccaccgactcggcaaaggtcggcgggtcctccgggtggtccgacgagattgtcagatgtggcctgctttatggccatgaaccgaatgccctggaaggtctggcaacggaggaggcgtcttcactctccccgccagcatctttcatcagagcactgc

SEQ ID NO: 25137 - DNA, 601 bp, Human
ttatttatttatttattttgagacggactgtcactctgccacccaggctggagtgcagtggcacgatctcgactcactgcaacctctgcctcctgggttcaagcgattctcctgcctcagcctcctgagtagctgagactacaggcgcccgccaccacgcctggctaatattttgtatttttagtagagatggggtttcaccatgttaggcaggatggtctcgatctcctgacctcgtgatctgcctgcctcggcctcccaaagtgctgggattacaggcgtaagccaccacgcccggccsgcacatgcctttctaccaaggcgagttccacagtttctgaagattcaattagaccttaaatagattagcgtggtgggggaagggttgcttcaggtcacactctggtagcagcaagaagtgacaactgataccttgacaggaagggaggaaacagaaaagctatattaaaaaaaaaaaaaaggctgacaggagaactcaaaaagacaaaagtgtggtaatttgggaaaagaacaaaagagtttccctgtattgcagcccagagtaatcgctggtgtaaatacagagtccctgagtcatggg

SEQ ID NO: 25138 - DNA, 601 bp, Human
caagcgattctcctgcctcagcctcctgagtagctgagactacaggcgcccgccaccacgcctggctaatattttgtatttttagtagagatggggtttcaccatgttaggcaggatggtctcgatctcctgacctcgtgatctgcctgcctcggcctcccaaagtgctgggattacaggcgtaagccaccacgcccggccggcacatgcctttctaccaaggcgagttccacagtttctgaagattcaattagaccttaaatagattagcgtggtgggggaagggttgcttcaggtcacrctctggtagcagcaagaagtgacaactgataccttgacaggaagggaggaaacagaaaagctatattaaaaaaaaaaaaaaggctgacaggagaactcaaaaagacaaaagtgtggtaatttgggaaaagaacaaaagagtttccctgtattgcagcccagagtaatcgctggtgtaaatacagagtccctgagtcatgggaagccatgaagctttgctccagagacagggaagggtgcagccaccatggtgaaaagcaaaaatgatgagagcagcaaagcctggcagtctggaatctcg

SEQ ID NO: 25139 - DNA, 601 bp, Human
ggctaatattttgtatttttagtagagatggggtttcaccatgttaggcaggatggtctcgatctcctgacctcgtgatctgcctgcctcggcctcccaaagtgctgggattacaggcgtaagccaccacgcccggccggcacatgcctttctaccaaggcgagttccacagtttctgaagattcaattagaccttaaatagattagcgtggtgggggaagggttgcttcaggtcacactctggtagcagcaagaagtgacaactgataccttgacaggaagggaggaaacagaaaagctrtattaaaaaaaaaaaaaaggctgacaggagaactcaaaaagacaaaagtgtggtaatttgggaaaagaacaaaagagtttccctgtattgcagcccagagtaatcgctggtgtaaatacagagtccctgagtcatgggaagccatgaagctttgctccagagacagggaagggtgcagccaccatggtgaaaagcaaaaatgatgagagcagcaaagcctggcagtctggaatctcggctaaccaacagtcgctctcccagagttctggttaattgaggtcatacagtattttcatgtat

SEQ ID NO: 25140 - DNA, 601 bp, Human
cgtgatctgcctgcctcggcctcccaaagtgctgggattacaggcgtaagccaccacgcccggccggcacatgcctttctaccaaggcgagttccacagtttctgaagattcaattagaccttaaatagattagcgtggtgggggaagggttgcttcaggtcacactctggtagcagcaagaagtgacaactgataccttgacaggaagggaggaaacagaaaagctatattaaaaaaaaaaaaaaggctgacaggagaactcaaaaagacaaaagtgtggtaatttgggaaaagaacaaragagtttccctgtattgcagcccagagtaatcgctggtgtaaatacagagtccctgagtcatgggaagccatgaagctttgctccagagacagggaagggtgcagccaccatggtgaaaagcaaaaatgatgagagcagcaaagcctggcagtctggaatctcggctaaccaacagtcgctctcccagagttctggttaattgaggtcatacagtattttcatgtatttcaactccacgcgtgtatgcattgtgtccctactgcatgccagataccgcatcaggccctggggcaatccag

SEQ ID NO: 25141 - DNA, 601 bp, Human
ttagcgtggtgggggaagggttgcttcaggtcacactctggtagcagcaagaagtgacaactgataccttgacaggaagggaggaaacagaaaagctatattaaaaaaaaaaaaaaggctgacaggagaactcaaaaagacaaaagtgtggtaatttgggaaaagaacaaaagagtttccctgtattgcagcccagagtaatcgctggtgtaaatacagagtccctgagtcatgggaagccatgaagctttgctccagagacagggaagggtgcagccaccatggtgaaaagcaaaaatgrtgagagcagcaaagcctggcagtctggaatctcggctaaccaacagtcgctctcccagagttctggttaattgaggtcatacagtattttcatgtatttcaactccacgcgtgtatgcattgtgtccctactgcatgccagataccgcatcaggccctggggcaatccagctccctcagggagctgacagtccaatgagggagtctataaagttcaggccagacaaaagcagagagaaccggagaacaggctggatgcgtaacatggcagccccacctaatctgtgagcggtgggtgcaa

SEQ ID NO: 25142 - DNA, 601 bp, Human
gtggtgggggaagggttgcttcaggtcacactctggtagcagcaagaagtgacaactgataccttgacaggaagggaggaaacagaaaagctatattaaaaaaaaaaaaaaggctgacaggagaactcaaaaagacaaaagtgtggtaatttgggaaaagaacaaaagagtttccctgtattgcagcccagagtaatcgctggtgtaaatacagagtccctgagtcatgggaagccatgaagctttgctccagagacagggaagggtgcagccaccatggtgaaaagcaaaaatgatgagrgcagcaaagcctggcagtctggaatctcggctaaccaacagtcgctctcccagagttctggttaattgaggtcatacagtattttcatgtatttcaactccacgcgtgtatgcattgtgtccctactgcatgccagataccgcatcaggccctggggcaatccagctccctcagggagctgacagtccaatgagggagtctataaagttcaggccagacaaaagcagagagaaccggagaacaggctggatgcgtaacatggcagccccacctaatctgtgagcggtgggtgcaacagga

SEQ ID NO: 25143 - DNA, 601 bp, Human
tgagtcatgggaagccatgaagctttgctccagagacagggaagggtgcagccaccatggtgaaaagcaaaaatgatgagagcagcaaagcctggcagtctggaatctcggctaaccaacagtcgctctcccagagttctggttaattgaggtcatacagtattttcatgtatttcaactccacgcgtgtatgcattgtgtccctactgcatgccagataccgcatcaggccctggggcaatccagctccctcagggagctgacagtccaatgagggagtctataaagttcaggccagacraaagcagagagaaccggagaacaggctggatgcgtaacatggcagccccacctaatctgtgagcggtgggtgcaacaggaccacttccttgaggaagtgacatttaagcagagccctaaaggatgaaaagaaatcagaacaggcccttctggaatcttgcctcttgagggaaagcctgcatctgggaccctgaggctcctggtctgcagatgttcccagcactgagtgtgttgctgccctggaggaggtgcggcaacaccaaggttccacctcctctgttgcctgtgcctgtcctgctgg

SEQ ID NO: 25144 - DNA, 601 bp, Human
agacagggaagggtgcagccaccatggtgaaaagcaaaaatgatgagagcagcaaagcctggcagtctggaatctcggctaaccaacagtcgctctcccagagttctggttaattgaggtcatacagtattttcatgtatttcaactccacgcgtgtatgcattgtgtccctactgcatgccagataccgcatcaggccctggggcaatccagctccctcagggagctgacagtccaatgagggagtctataaagttcaggccagacaaaagcagagagaaccggagaacaggctggatgygtaacatggcagccccacctaatctgtgagcggtgggtgcaacaggaccacttccttgaggaagtgacatttaagcagagccctaaaggatgaaaagaaatcagaacaggcccttctggaatcttgcctcttgagggaaagcctgcatctgggaccctgaggctcctggtctgcagatgttcccagcactgagtgtgttgctgccctggaggaggtgcggcaacaccaaggttccacctcctctgttgcctgtgcctgtcctgctggtctcatgaggaccacagactccctcctgggttg

SEQ ID NO: 25145 - DNA, 601 bp, Human
ggtctcatgaggaccacagactccctcctgggttgatccaacctgtctatccccctgactcctctgtttccttccccaccaaaccctgatgaggccgcaggatattttaaaaggctggagggaaaggagtgtcttggccatgatctggccaatgtagaagaagcagaatgcccaaaacaagcttgtaaagcttccctctggtcccacgaccccaaagcccatacttctcagcatcaaatgagggctgcatggtctggagctagcaaagcaggctttggagttttattagacattaagtttyttttaaaggaacagaaatataaagcaagcctccaccagccccttcccctggggaatctggtgttaaattgttacatccacgagcaaagatgcttcagtggcaggaacctgactcccctttcccttggttccagccctgttcccagtggccacatgggggagggggaggactggtggctggaaatcaaaccgtggcagggcagggctgctgggtggtgagagcagccactgtcccatcattgataacagttctccctttctctccatcttggtgcgaggcttttgccaaatggctggcctt

SEQ ID NO: 25146 - DNA, 601 bp, Human
ccagtgtagagtcaggattcaaacccaagaccctggccctctcctttctgctcttgggcatggacatcttccatttattatttaatatgtggaattaaggacctggagtaaggccctgctggcctttgttagaaaaaggccctcctctgggtagatacaacccagcaggtgcaaagcttagcaaatggagtttgggataggtttcagctctacttgccccgttggctgggagccctgtgcaagctacaacctgtccaaccattcatgacatccctgttggtaggccctccgctgggcctcyggccaccttccccatgtggtatatccttgggattccaggagttgctgtaaccccaggatgaactttgcagaaggtcagcagctgaagctctgacctcacacccccagcagcctgcacgggcacactgtccctcacttgcctttcccctgtcagctttgatgttcctaacgcctccctggtgagctcatcccagcccaggtggttctaatagaaggcagtgggaggagggtgtttgattccccggaagaaccccccccaacccaccccagctttctcttgccagtctgaccctccgatctc

SEQ ID NO: 25147 - DNA, 601 bp, Human
caccttccccatgtggtatatccttgggattccaggagttgctgtaaccccaggatgaactttgcagaaggtcagcagctgaagctctgacctcacacccccagcagcctgcacgggcacactgtccctcacttgcctttcccctgtcagctttgatgttcctaacgcctccctggtgagctcatcccagcccaggtggttctaatagaaggcagtgggaggagggtgtttgattccccggaagaaccccccccaacccaccccagctttctcttgccagtctgaccctccgatctccctycatccaggtgtcccttggaggtgccaaggaggcatgccccacaggcctgtacacacacagcggtgagtgctgcaaagcctgcaacctgggcgagggtgtggcccagccttgtggagccaaccagaccgtgtgtgagccctgcctggacagtgagtagagggtggcgggcaggaggaggggagaagaatgggagggaggagaggggtgaaagggaggggcgctggggagaagcatgcccagtagaggccttataagaccaccactgtaaggtcatcagaagtgggtctgacccagtgtagg

SEQ ID NO: 25148 - DNA, 601 bp, Human
gcactggtgcagtcttggctcactgtaacctctgcctcccatgctcaagcaatcctcccacctcagcttcccgagtagctgggattacagacgtgcaccactacacccagctaatttttgtattttttatagagatggggttttgccatgttggccaggctggtcttgaactcctggcctcaagtgatctgctcgccttggcctcccaaagtgctgggattacaggagtgagccaccacgcccagcctttgtccccagttctgcccctttcacttctctctggcttttccttctttgcctyctcatccccccaccacacccccgaagccagtgaccccttgctccatcttgtctctgatgcctttgaataatgttgagacccccctacaggcctcagtttccccctaatggcgctttagcctttctgcttctgcttccacattctgaacaatctgtccttccctggttctcaggttcctaaatctatgctcttcctgtccttggagcaaggataggtcctgccagatccagggtggcacagagttccccacccaaagctggaaggggtgaagaagatctggccctgttccttcccctccct

SEQ ID NO: 25149 - DNA, 601 bp, Human
aggctttctgaactggaagagcagcttgaggaccctcaggagctgggaccctttgactctgagccctggtctaggtccatggtgggttttggctctgggacctgagatggaacccaccctgtccttgactgacgttagggagtccactcctgtctctgggcctcggtttcctcactggtcatatggctgccagggttgttgcgggttagggaatacagtggggctggcccacttcagcttgccctgtctaggggaggggtcaaccgtgttccgcagtttagtgaaggatgaggggcatgcmgggaacactaaggaggggctctgtggaagaagaaggaggggaggggcagacctggggctcaaaagcccggggacaaggcagtgcatgctcgtggctgtcagctccagggatggatgggagctgggcgtgcccaccttagccaagcacaggccccaaggagatggggtggttcttgggatgggagaaggaagccccgtgggagccagggcagagctgttttggtctctggttggtgacgtccgtctcaggggagactggtgggcttttccacttcggggagaggctggcagtgcctttaca

SEQ ID NO: 25150 - DNA, 601 bp, Human
gggttaaatgtcagctctgggacaagagaccatttcaggaaatggaatttgattcttggttttgttgccccctcccctccagcgtaccatactttccccgcatttacttacgtttcaggtgtcaacatggtgactcacccaccctcagggcagaagggctacccgctgccccagtgaaattcggtttgaatagggataacctggtccctccatgcagcccggaaatggctgtcaggacctgccaagggcttagtaggttggaatgctagtggacgtggccacatctggatctcatcccccmgcccccgtcagaggggattggagagatgagggcagctccccaagagtcagtgccgcctctggtctggccacgccttgctaccctcccagccttcccctaccatgctctgatctcggtgatggtctcattcattgggcacccggacatgtacactccttcaccctctggcttggggtcagtctgagctgagctgtgtctccagcctctggacttgggctgccccccagcttgcccagtcccctggcagagcaagagaagaccctccccagtccaatgctccacctggggctgccagaagac

SEQ ID NO: 25151 - DNA, 601 bp, Human
cccgcatttacttacgtttcaggtgtcaacatggtgactcacccaccctcagggcagaagggctacccgctgccccagtgaaattcggtttgaatagggataacctggtccctccatgcagcccggaaatggctgtcaggacctgccaagggcttagtaggttggaatgctagtggacgtggccacatctggatctcatccccccgcccccgtcagaggggattggagagatgagggcagctccccaagagtcagtgccgcctctggtctggccacgccttgctaccctcccagccttccsctaccatgctctgatctcggtgatggtctcattcattgggcacccggacatgtacactccttcaccctctggcttggggtcagtctgagctgagctgtgtctccagcctctggacttgggctgccccccagcttgcccagtcccctggcagagcaagagaagaccctccccagtccaatgctccacctggggctgccagaagacagggctctgtctccttcactacctctggcccctcccaggacggagacggggaagggtggtttgggtgacagatggcagcccctcactgctggcagc

SEQ ID NO: 25152 - DNA, 601 bp, Human
aagagtcagtgccgcctctggtctggccacgccttgctaccctcccagccttcccctaccatgctctgatctcggtgatggtctcattcattgggcacccggacatgtacactccttcaccctctggcttggggtcagtctgagctgagctgtgtctccagcctctggacttgggctgccccccagcttgcccagtcccctggcagagcaagagaagaccctccccagtccaatgctccacctggggctgccagaagacagggctctgtctccttcactacctctggcccctcccaggacrgagacggggaagggtggtttgggtgacagatggcagcccctcactgctggcagccagatggattctagattcacatctgggggctttgcccctcagaaggtgctgaaaacgggcctttgaagcatttcatcttgagtggaagaggccagaagatgggtggcagcttctactcctgcttgggtgggcaaagtgggggctgggagggcagagctgggagccagttaccctccccttcaccccattggcatgtcctgcctgctttccctccctgccccaggcgtgggaagtgaggagggacgg

SEQ ID NO: 25153 - DNA, 601 bp, Human
cattttccattctttctaaaaaaaaaaaaaaaaaatcatcaaagtaacacatccgtgtttaggaaaatgcaaacaagaccaatatctttcaaagcaaaaagtaaaagcccccttttatctccccaaatcctacttctctccttattggaatctgtttgaaatggatccttcccaactattttctgtgtgtctttttttataaacatgtatataaaccttttataattacatgtaaacatggagggctttttaggcatcagtgagatcacattgtacatattctacagcttacttttttcaytcaatctccctcaggagacctttcctcaggaatgtagattagctgatcatttgtaaccactcattcaatagtatggatggatggtaatttatttagccagtccccattgatggacatttgttttttttttttttccagttttttgttattgcttataattgcagaggaaatccttttatatgtcactgcccacatgtgggagtattttagaagggtagattgggagaagaggagttcctgagcagtcacttttgctgcactgctcattccaggaacatttactgaacacttacagagggc

SEQ ID NO: 25154 - DNA, 601 bp, Human
accagggatggtactagggggaagtgacaaggccccagagactcagagggaggaatcgaggaaccagagccatggactctacactgtgaacttggggaacaagggtggcatcccagtggcctcaaccctccctcagcccctcttgccccccaccccagcctaagatgaagaggatcggaggcttgtcagagctgggaggggttttcgaagctcagcccacccccctcattttggatataggtcagtgaggcccagggagaggccatgattcgcccaaagccagacagcaacggggaggccragtgcaggctggcaccgccttctctaaatgaggggcctcaggtttgcctgagggcgaggggagggtggcaggtgaccttctgggaaatggcttgaagccaagtcagctttgccttccacgctgtctccagacccccaccccttccccactgcctgcccacccgtggagatgggatgcttgcctagggcctggtccatgatggagtcaggtttggggttcgtggaaagggtgctgcttccctctgcctgtccctctcaggcatgcctgtgtgacatcagtggcatggctccagtctgctgc

SEQ ID NO: 25155 - DNA, 601 bp, Human
cccctcaccttgcaacacacagacacacgcacacacacacacaggaggagaaatctcacttttctccatgagttttttctcttgggctgagactggatactgcccggggcagctgccagagaagcatcggagggaattgaggtctgctcggccgtcttcactcgcccccgggtttggcgggccaaggactgccgaccgaggctggagctggcgtctgtcttcaagggcttacacgtggaggaatgctcccccatcctccccttccctgcaaacatggggttggctgggcccagaaggttgygatgaagaaaagtgggccagtgtgggaatgcggcaagaaggaattgacttcgactgtgacctgtggggatttctcccagctctagacaaccctgcaaaggactgttttttcctgagcttggccagaagggggccatgaggcctcagtggactttccaccccctccctggcctgttctgttttgcctgaagttggaatgagtgtggctcccctctatttagcatgacaagccccaggcaggctgtgcgctgacaaccaccgctccccagcccagggttcccccagccctgtggaagggact

SEQ ID NO: 25156 - DNA, 601 bp, Human
aacacacagacacacgcacacacacacacaggaggagaaatctcacttttctccatgagttttttctcttgggctgagactggatactgcccggggcagctgccagagaagcatcggagggaattgaggtctgctcggccgtcttcactcgcccccgggtttggcgggccaaggactgccgaccgaggctggagctggcgtctgtcttcaagggcttacacgtggaggaatgctcccccatcctccccttccctgcaaacatggggttggctgggcccagaaggttgtgatgaagaaaagygggccagtgtgggaatgcggcaagaaggaattgacttcgactgtgacctgtggggatttctcccagctctagacaaccctgcaaaggactgttttttcctgagcttggccagaagggggccatgaggcctcagtggactttccaccccctccctggcctgttctgttttgcctgaagttggaatgagtgtggctcccctctatttagcatgacaagccccaggcaggctgtgcgctgacaaccaccgctccccagcccagggttcccccagccctgtggaagggactaggagcactgtag

SEQ ID NO: 25157 - DNA, 601 bp, Human
cgaggctggagctggcgtctgtcttcaagggcttacacgtggaggaatgctcccccatcctccccttccctgcaaacatggggttggctgggcccagaaggttgtgatgaagaaaagtgggccagtgtgggaatgcggcaagaaggaattgacttcgactgtgacctgtggggatttctcccagctctagacaaccctgcaaaggactgttttttcctgagcttggccagaagggggccatgaggcctcagtggactttccaccccctccctggcctgttctgttttgcctgaagttggartgagtgtggctcccctctatttagcatgacaagccccaggcaggctgtgcgctgacaaccaccgctccccagcccagggttcccccagccctgtggaagggactaggagcactgtagtaaatggcaattctttgacctcaacctgtgatgaggggaggaaactcacctgctggcccctcacctgggcacctggggagtgggacagagtctgggtgtatttattttcctccccagcaggtggggagggggtttgggggcttgcaagtatgttttagcatgtgtttggttctggggcccctt

SEQ ID NO: 25158 - DNA, 601 bp, Human
ccccgctagagcatctctgggtccctgctatggaggggcaaagccagttccaaggccagctggtggaggagtccagatcacatcatcgggcagggccaggccccatggctcgttctccgccatctcccgtacccaccccaggaggcatccgggaaggtccagctctccctgctctcccagtacaggtgagggggctcctaccacttctcctggtcttcaccctcctcctccctcagtcccacctggcaaacactttccttggggccccatcaacatctgaggccaccatagccctgtctcmgcatgcaacatgagctggggccctggggcctcgccctgccgccctgtgagcccgggggctgctctaccttgtcattgatgaggatctccatggggttgttgccccactcaatgaggaccagctcgttggcctggccgggcacagcgtaggagaagggcgtgcccacacctggcgtggcgctggacttgagccacatgcagacagtgaaggcgtacatctctggcaggctcttcttcaccttggcatacatatagttggtccgcagtgggaatgtgagctggaacttgtctccagggcggt

SEQ ID NO: 25159 - DNA, 601 bp, Human
cctgtcctcctcccgagagttagggggctgagtgggatagacttggactcaggaaaaatctctaaggacccctcaccccgctagagcatctctgggtccctgctatggaggggcaaagccagttccaaggccagctggtggaggagtccagatcacatcatcgggcagggccaggccccatggctcgttctccgccatctcccgtacccaccccaggaggcatccgggaaggtccagctctccctgctctcccagtacaggtgagggggctcctaccacttctcctggtcttcaccctccycctccctcagtcccacctggcaaacactttccttggggccccatcaacatctgaggccaccatagccctgtctcagcatgcaacatgagctggggccctggggcctcgccctgccgccctgtgagcccgggggctgctctaccttgtcattgatgaggatctccatggggttgttgccccactcaatgaggaccagctcgttggcctggccgggcacagcgtaggagaagggcgtgcccacacctggcgtggcgctggacttgagccacatgcagacagtgaaggcgtacatctctggca

SEQ ID NO: 25160 - DNA, 601 bp, Human
ggtgctgcaggtggccaggttgtacacctccccgggggtcagcttgcggtcccagatgttgaagtgggccagctcacccacaaatgcctgggtggcatcaaacccaccacccagagtgtccttcagagaaaaacagaggatgagagtggaggggtcgccaggtggtctgggggcccatccctaggccggggatctgagtgcctctgtgcctgcccgatcacggactctcacggccactcctaggtgccgtttcgtctccctgtccctgactctccagccctacatccatccctcctctggrggagcccaagaaaagggatggcaccgaccacctctgccctggagcttctcctggggggacctggactctgcccctcctgcagctggtccctcagccatggacaaccacagcagctgggcctggggcccctgcccagacatcactccatgccacctaaagctgcccaacagggacagatgtccccgattctccatcccttcgtcttcctcccaggtgcccaacaggagacaaaccacttcacgggaactagattatgcatcactaaaagcagaactggccttcccatgccaaagaaagtgt

SEQ ID NO: 25161 - DNA, 601 bp, Human
aaatgcacatacacttctctcccctccttggaaggactagaaggaaatgtccatgttgcttttcacggggaacaaaaaaaggcaaaaaggttctggacactgctcaggtgtcagtgtcgccggccagtggcagcttgtgggctgctgtaggccgtgagccccatgagatggaggagtgggtttcaggcccctgccctggccaggcctggctccacacgtgaggtctctggagtacccctggaggggtctgaaccagctcacctggcgcctggtgtgctgggagggatatggctgtcaaagkcccccaaaaaggaccttcccaccgatgggctgggttgaagtcccagtggccccatgtggccaggtcttcatcgaaacacggcttctttccttaaaaggtcccctctggtctgcactgccggaggccaaaggagaggggtgctggggcccggcttcccgggctgtgggtggcacgctcctctctcagggccctctgggctgaagcagtgcagcacagctccagaggtgagaagggaggggcagaccccagccttgcaggatctgaggaggtgggaaggtcgagggcagggccgtcctgggg

SEQ ID NO: 25162 - DNA, 601 bp, Human
caagtttccactcaattactttcaaaaaggctctcagtgtacttggccttacatgttcctaactcaccaataaaccatgtttggaattcagtcttgaaaatgactactgcctttcagtagcactgttccaaatgcatctctgagtgggtttgcacatgagtgtgcatgtactcactctctatctctttatctaggtttatctgtcagtactataatcagtgcactaacagggccttggtagaagagtgcaagtaggaaagctctttccctcacactgggcaacattataattatacagackctacagacaagctacggcccaggcatctgcatagaaacaagtactgatgctctttccagcaacttcccttcaacaaacaggaattagaaatgtccattcctcagatttctgccccattacaccaatttttaggtcctttccaataatagagatagcaaatgaaagggacctggcaagggtttatgtcctaacatttttcacttggtggcaaatattcaagaaaaagggtaaaagccaacccccagaaatgatggccactaaagccacaaaccacaaggtcccttgctagataagtgtgat

SEQ ID NO: 25163 - DNA, 601 bp, Human
gaactcctatgatagagaaaggaatttccctgacctctgagtctcctgtgacctttgcaagtcacttatcccctctgaacttcagttcctttatttgttgagttagaacacatattatcctcccttctcctggcatgtgatatgcatcaaatgaaataatgaatgtgaaagtgctttgcattggacaaacataaaggactaagaatgaaggttcaggtgggtaagactgaaataatgatttggtctgcaggaatgaatccatctacagacactaaggtagcctcttggcatctgttataayatcagaaagcatgttcctggtttccttaaaggcccgagaggtgtcagagttagaaggttccaaccttctcattttagaaactgggaaactgaggctcagagaagtaaatgtactttcccaaaatgtcacagcctaggattcttaataaatttgattcaaaggcaatctgtaaaagcgcgccatagtttggctaggagaaaaagaaatgaaagaggaaggttacttaaaatcacacaaaaccttggaattgaaagtcactaaatttaagggtcaggcagtgatagagtaatgaactgaggc

SEQ ID NO: 25164 - DNA, 601 bp, Human
cattggacaaacataaaggactaagaatgaaggttcaggtgggtaagactgaaataatgatttggtctgcaggaatgaatccatctacagacactaaggtagcctcttggcatctgttataacatcagaaagcatgttcctggtttccttaaaggcccgagaggtgtcagagttagaaggttccaaccttctcattttagaaactgggaaactgaggctcagagaagtaaatgtactttcccaaaatgtcacagcctaggattcttaataaatttgattcaaaggcaatctgtaaaagcgygccatagtttggctaggagaaaaagaaatgaaagaggaaggttacttaaaatcacacaaaaccttggaattgaaagtcactaaatttaagggtcaggcagtgatagagtaatgaactgaggcgtagaagtgagttcccacccttctgatctacatgttattccagtcctcaaaatatcagatcccgtaatgaaggcttatgtggaacaagattttgtaatcagggatggggactgcatacctgtagcctcaactttcatctccaggaagtctgccttgagaactgtggataaagaaagac

SEQ ID NO: 25165 - DNA, 601 bp, Human
tgtcctcaaccttctgtttttctcttctctccagtctgtttacacttactccctggaggatcttattcccatccatggcttcaattgccaccaaatactagggacctccccacaacaggctactattcacattgtagcatatgtgactagccccactccccagacttatatagtggctatactcatatttctaacccccaaatctatgtatacatacatccagctccaactgctagcctaagttgcagttacccactgaacatctatctctacctaagtctcaaagtgtctttaaaaaatktgtataaatttaacaactgtgtcttcaaaatcactgtgtccaaaattgagctcagcatctttcccataaaacctgcttctccatgattaattattgtaccatctacttaagtgcccaagttagacttttctctttctcggttcatcaatgttccatgtttgaaaatgtagcaaggtcttattgagtctttctcaaatctgtcccttctgttccattcccactgggaatgccataggccagggcttccccaactcttgccaggacaattagtctccttaactggtctccagtctttactct

SEQ ID NO: 25166 - DNA, 601 bp, Human
ccccctttctatgactcatccgcatatggactgcagtataaagaccaagcaccttagtatgttatacaatgccttcacgatctggctccaatccatctttctggtctcacccccagctaagtttccctcttttcactcccacattctagccaaagtggaacactaataacttctgaaaccataagctgtcgggcctctttgaaatgttctcacctcctttatgttcttgatgagccactactcattttcttcttagttatttatgtttaaattgtgtaagggaaatgaataagggggtgaygtcattcaaacgctaggccgtagtcaggtatacaaatggggaccaaaaaggggcaagacaaagtttaaaaagatcatcattttcattagagatgagagaagaacttagcaacaatgaccatagacgggactgactatgtgactggtctgaggatcttgatcagaggccaacctgtggaagcactgatgcaagtggtggttacaaggtggaggcctagatggaagggatgctttccctatgtggatgctgagtgggaggagcctgtgggtactcaggatggtagttcatgacatactggag

SEQ ID NO: 25167 - DNA, 601 bp, Human
cacacaggaaaagaacatgatcagagaacaggactaagaaaaaagctctgggaccttctaacatgtaaagttgggaagagaaggaaaaccaggagagaagactgagatggattatctggtgagattaaaggaaaatctggtatcctgagagccaggtgaataaagtgtttcaagaaggaggagttagtcaactgtgtcagatgctactcacaaactgagtatgatgagaacaatgttgtagctatttggtttggcctcatggagattattggcaaacctgacaaaaatggtcttagtggartaggagggcagaggcacatttagaatgggtgtagtctccacactagcaattattccactgaaggcatttatttcttcacttatctatgtctccatttcttctgtgagggcaagcaatgtatcttaatttcacctagcacagtacctggcacatagtagttatccaatccgtgtttgctatatttgaatttaaaatttcacaacattcaccttgctcacccatttcaatatattgggggcataaatctaagaacaccttggatcctgcactggccttatagggatcctccacgtggtaact

SEQ ID NO: 25168 - DNA, 601 bp, Human
catttagtcaaaaaacattctcagtaaactatcgcaaggacaaaaaaccaaacaccgcatgttctcactcatagatgggaattgaacaatgagaacacatggacacaggaaggggaacatcacactctggggactgttgcggggtggggggaggggggagggatagcattaggagatatacctaatgttaaatgacgagttaatgggtgcagcacaccagcatggcacaagtatacatatgtaactaacctgcacattgtgcacatgtaccctaaaacttaaagtataataataataaaaraaaaaagaaaaaaaaaaacattggctgagcatttacttgtacctggcattgtgccaggtactggggatccagagatgaatagaaatagtccaaacctccaacgagctaatagtttagtagaaaagagcaccatacacaaaatttgcaatgcagtgggacaagtacgatgacaaaataaaggtatatggtaggtggctcagaggaagtaagtaatcaactaataattataagaatagcaaactctgtactgctctaagtgatttacatgtattaacccatttaaacctcataacaactctg

SEQ ID NO: 25169 - DNA, 601 bp, Human
atggaaagagtcattttttcaggggaggtttaacattttaactcttataacacaaaatacttatatttagccctttgaattgtctgctttcagcatgagcaaagtcatatgtgaaatgttagcctaaaaatacaatttctatcatgcttccagaacaggaaggatatgtttctctacccacgatgtaagctaacaccaagtgtctaccttagttcaattaccagacacatttaaaaaatatatggctgaattttatttcacacaaaggcatccatattcagacttgcgttagtagtacacrtcattaatgatggtatttactatgaatcggacagctggcagtttataatgctagtagaccaaaaacttaagtgactcactttcttgctgttttgttatagggctgtggtagatctacaaaagaagataaacagaaagatccatggctattgtcaatcaatataggaaaacagagaacataatattaaatatctttccccagataggcattaaaaatgattagaaactccaggatgttaaaaagatagccaagtgggctaaacataattgctttgccaagattgctagaaaatacttgaac

SEQ ID NO: 25170 - DNA, 601 bp, Human
cacgatgtaagctaacaccaagtgtctaccttagttcaattaccagacacatttaaaaaatatatggctgaattttatttcacacaaaggcatccatattcagacttgcgttagtagtacacatcattaatgatggtatttactatgaatcggacagctggcagtttataatgctagtagaccaaaaacttaagtgactcactttcttgctgttttgttatagggctgtggtagatctacaaaagaagataaacagaaagatccatggctattgtcaatcaatataggaaaacagagaacrtaatattaaatatctttccccagataggcattaaaaatgattagaaactccaggatgttaaaaagatagccaagtgggctaaacataattgctttgccaagattgctagaaaatacttgaacaggccaggcgtggtggctcatgcctgtaatcccagcaatttgggaggccaaggcaggcagatcacttgaggtcaggagtttaagaccagcctggcaaacatcatgaaaccccatctctacaaaaatccaaaaattagccaggcatggtggcgtgcacctgtaatcccagctgtttggg

SEQ ID NO: 25171 - DNA, 601 bp, Human
ctgttccatgtcattggtcattgggttatgccccttctaacctgtacatgactctacacatctctcttttaactgtctcctcctctccattcctttttaacaccgaattagttaagaaccctatcagtgttgtttttgttttaattttttttttttttttgacagagtctcgttctgtcacccaggctggagtgcagtggcgcaatctcagctcactgcaagctccacctccccagttcacaccattctcctgcctcagcctcccaagtagctgggactacaggcacccaccaccacgccyggctaactttttgtattttttttagtagagatggggtttcaccatgttagccaggatggtcttgatctcctgacctcgtgatctgcatgcctcagcctcccaaagtgctgggattacaggcatgagccacagcgctgggcccagtgtcttattttgtatttatattttatgaaacatatttttaaaaaacaaaaatttactatctcaccaattaattatttcattggccttctctgatttccctattgtccccatctctgatcactccactccaattcattctccactcttttcctagat

SEQ ID NO: 25172 - DNA, 601 bp, Human
gtcattggtcattgggttatgccccttctaacctgtacatgactctacacatctctcttttaactgtctcctcctctccattcctttttaacaccgaattagttaagaaccctatcagtgttgtttttgttttaattttttttttttttttgacagagtctcgttctgtcacccaggctggagtgcagtggcgcaatctcagctcactgcaagctccacctccccagttcacaccattctcctgcctcagcctcccaagtagctgggactacaggcacccaccaccacgcccggctaactytttgtattttttttagtagagatggggtttcaccatgttagccaggatggtcttgatctcctgacctcgtgatctgcatgcctcagcctcccaaagtgctgggattacaggcatgagccacagcgctgggcccagtgtcttattttgtatttatattttatgaaacatatttttaaaaaacaaaaatttactatctcaccaattaattatttcattggccttctctgatttccctattgtccccatctctgatcactccactccaattcattctccactcttttcctagattatttttaa

SEQ ID NO: 25173 - DNA, 601 bp, Human
gtcatgaccacgaaggagttgtccccctagaagtgaggggcagggggagggtggggtgggctgggagctgggagaagagccccaagggccccaccgctgccccagcagaggcccctagagcccacaggacacgcagcagccaccacaccccctgccaccaacatggggtgatatcaccaggctgcttctgcccggcattcacagaggtccagagagaaagaggagctgggctggtcccacagggacgtgggacagagtcccacccaactctgagacaggccctgtgaggggaaggtgcaamcctgagccagctcacctgggctgggaagacgtagtcagccacatcccagacctgggggccgaggccagggagctgggtcacggccaggcccttgagtttcacagagacactgctgatgaggccgctcgaggtctggtagcccttctcatagagaaacacccacctgtgcgggtggggacagagggggagttgtggttgtggcaccagctggacctgtcacacgctttcccacgccctccccagatgtgcctctgagccaccatctgctcctaaagctcctgtcttgggctagaggcagga

SEQ ID NO: 25174 - DNA, 601 bp, Human
ggtcatgaccacgaaggagttgtccccctagaagtgaggggcagggggagggtggggtgggctgggagctgggagaagagccccaagggccccaccgctgccccagcagaggcccctagagcccacaggacacgcagcagccaccacaccccctgccaccaacatggggtgatatcaccaggctgcttctgcccggcattcacagaggtccagagagaaagaggagctgggctggtcccacagggacgtgggacagagtcccacccaactctgagacaggccctgtgaggggaaggtgcaracctgagccagctcacctgggctgggaagacgtagtcagccacatcccagacctgggggccgaggccagggagctgggtcacggccaggcccttgagtttcacagagacactgctgatgaggccgctcgaggtctggtagcccttctcatagagaaacacccacctgtgcgggtggggacagagggggagttgtggttgtggcaccagctggacctgtcacacgctttcccacgccctccccagatgtgcctctgagccaccatctgctcctaaagctcctgtcttgggctagaggcagg

SEQ ID NO: 25175 - DNA, 601 bp, Human
accttctcagccagggtgctgaagttctggcctgactcttgcaccacgtagccaagctggaagactgggcacagggggtgcagggtcttgtgaaagaggcaggtcttcatgtgggcagcattcacctcctccaccaggttgcgcctgtgggggtggaaggtgttgacagctgctgtgtgtcatccgggagggtgcccaccacgccccaaagcctggggacccctcacaggctccacattgcccctttgattccttccacgccagcaggaatggagggagacagagacagctgagagctgcsggagcggccccggccagctgcctgcatttctgcccgaatttcccacgcacctgttgaccttgaagcgtggaaagctgatgctgttcttgatgaaaagagtgaagttctcggcctctcggagaagggcagggctggaggacaccacacgcactcaccgcccctccccaggaggccccctgtgtgtcccacacagagcttggcacagcagggggtgggccgagcctccgggacccgcctgcagccctgggctggtggaggggtgggtgtgctctagcgtggccaggacccaggggaatcttc

SEQ ID NO: 25176 - DNA, 601 bp, Human
tagctgggattacaggtgcccgccaccacacccagataatttttgtatttttttttttttgacagagtcttgctctgtccccgagtctggagtgcagtggcgtgatctcagctcactgcaacctctgtctcccaggttcaagcgattctccggtctcagcctcccaagtagctgggattacaggcgcatgccacgatgcctgcctaatttttttgtatttttagtagacacggggtttcaccatactggtcaggctggtctcgaactcctgacctcaggtgatccgcccaccgtggcctcycaaagtgctgggattacaggcgtgaaccactgtgcccggccaatttttgtttttgttttttttttgtttttgagatggaatcttgctccattgcccaggctggagtgcagtggcgcaatcttagctcactgcaacctctgcctcccgggttcaagtgattctcctgcctcagcctccctagtagctgggattacaggtgcgcgtcaccatgcctggctaatttttgtatttttagtagagaaggagatttcaccatgttggccagactagtctcaaactcctgacctcaagtgatccacc

SEQ ID NO: 25177 - DNA, 601 bp, Human
tgggaggcaagcagacaattactgcattaattaaagaaggaatctgtgaagacctggattgggaagaaaacattggagaaagcgaagctcctctgggcgaggcgagtaatgggacaggtggagataggctgagcaacaggagaagagctggaaggtggtcagagaaggggacagggagctgggaaacttgccaggagcctagttactgagaagttcccagttgaagatggcagggagattttttttttcttttttgtgagacggagtcttgctctgtcacccagactggagtgcagtggcrcgatctcggctcactgcaacctctgcctcccaggttcaagcgattctcctgcctcagcctcctgagtagctgagattacaggtgcccgccaccatgcccggctaattttttatatttttagtagagacggggtttcaccgtgttagccaggatggtctcgatctcctgacctcgtgatccgcccgccttggcctcccaaagtgctgggattacaggcgtgagccaccgcacccagccctgatgacagggagatttttaggaacagggaggtctaacattcagcatgtgtgttgctccggc

SEQ ID NO: 25178 - DNA, 601 bp, Human
ctggacattttttatttaagaaaagatactgagaaactgttttggggtagaggtcctgtcaccctcactggccttccctcccattaccctccacactccagctctctgaccatttcttgtttatttatttatttattttcgccctgctcttgtaacccagatacgtccttgttattcccttctgtttcactcgtgtgttttctttgggagcatttctcgctttataatcataagtttatttagtgtgattatgtattaacccatctcctccaagactgtaagctccaggaggacgaagctrtctgtctcattcatcaccaactcctgagttcctggcacaggtcacagtgtgggaggcaagcagacaattactgcattaattaaagaaggaatctgtgaagacctggattgggaagaaaacattggagaaagcgaagctcctctgggcgaggcgagtaatgggacaggtggagataggctgagcaacaggagaagagctggaaggtggtcagagaaggggacagggagctgggaaacttgccaggagcctagttactgagaagttcccagttgaagatggcagggagattttttttttctt

SEQ ID NO: 25179 - DNA, 601 bp, Human
ctagcctgggtgcagagccagactctgtctcaaaaacaaacaaacaaaaaaagcccatctcacagctggtacacgcactctctcaagaacagaccattttggagccgggcgtggtggctcgcacctgtaatcccagcattttgggaggctgaggtgggcagatcacttgagatcaggagttcgagaccagccagaccaacgcaatgaaaccccgtctctactaaaaaatacaaaaattagctgggcatggtggcgggtgcctgtaatcccagctgcttgggaggctgaggcaggagaatcrtttgaacccgagagacagaggttgcagtgagccgagatcacaccactgcactccagcctgggcaacagagcaagcctctgtctcaaaaaatcaacaacaacaaaaaaaactggacattttttatttaagaaaagatactgagaaactgttttggggtagaggtcctgtcaccctcactggccttccctcccattaccctccacactccagctctctgaccatttcttgtttatttatttatttattttcgccctgctcttgtaacccagatacgtccttgttattcccttctgtttcact

SEQ ID NO: 25180 - DNA, 601 bp, Human
ggtcggagccggagctcagatttgcacaggtctctcctactatgcaccctgagcttctggcaaactgctctctgcctggctgagagggtaggagacttcctggggaggcccctctgccctggctgggacccaccagggctccaggctgaagcctcacgctgcacccagtcaggagttggggcccgagcatcaggatgtcctcatgttctcctgcaggcccagggtggagctggtagctgcgaggtcacgctcagcctgtgtacgtggtgcaagggttgggggatacaagtcagtgctgggkaagcagctgcccacgccccccaccccaacacagacacaagcgccggaggccttcgaagggcctggctcggggggttctcttaccgcccctggccccatgtcctcagcgtatttgaacttcttctgcttgtagtagtgcctcttaggcaggatgtgaagcagcagcaggtcacagagaactgtggcctggggtcagggaagggcacggagacagcgtgggaatccgggggtgggtacggagccctccacatcccacctcagtccctggtggtgaggccctggctggatctgacctcactgg

SEQ ID NO: 25181 - DNA, 601 bp, Human
ggcagcgggttggataatgagagtccggagagagaagcacgaagctagggtgcaggtgtgtgggagggtcctgcccagccccagccattccccaccaggagcggctgaggctagggtagggctccctcagggtgtgtggggtcggagccggagctcagatttgcacaggtctctcctactatgcaccctgagcttctggcaaactgctctctgcctggctgagagggtaggagacttcctggggaggcccctctgccctggctgggacccaccagggctccaggctgaagcctcacgctgyacccagtcaggagttggggcccgagcatcaggatgtcctcatgttctcctgcaggcccagggtggagctggtagctgcgaggtcacgctcagcctgtgtacgtggtgcaagggttgggggatacaagtcagtgctggggaagcagctgcccacgccccccaccccaacacagacacaagcgccggaggccttcgaagggcctggctcggggggttctcttaccgcccctggccccatgtcctcagcgtatttgaacttcttctgcttgtagtagtgcctcttaggcaggatgtgaagcag

SEQ ID NO: 25182 - DNA, 601 bp, Human
gtttcattctattttattttagtttaatttagtcacctatggttactgactgccacatcggagagcacagatctagagaaatggaggcagcgggttggataatgagagtccggagagagaagcacgaagctagggtgcaggtgtgtgggagggtcctgcccagccccagccattccccaccaggagcggctgaggctagggtagggctccctcagggtgtgtggggtcggagccggagctcagatttgcacaggtctctcctactatgcaccctgagcttctggcaaactgctctctgccyggctgagagggtaggagacttcctggggaggcccctctgccctggctgggacccaccagggctccaggctgaagcctcacgctgcacccagtcaggagttggggcccgagcatcaggatgtcctcatgttctcctgcaggcccagggtggagctggtagctgcgaggtcacgctcagcctgtgtacgtggtgcaagggttgggggatacaagtcagtgctggggaagcagctgcccacgccccccaccccaacacagacacaagcgccggaggccttcgaagggcctggctcggggggtt

SEQ ID NO: 25183 - DNA, 601 bp, Human
ccgacttcttcacctatgagaccaccaagtcggtggttgtgaagagctggaccatcgggatcatcaaccgagtagttcagcttctgatcatctcctactttgtagggtgagtctgtggcctttcaggttcctggcggggtgggctgcctggtatcccgtcttcaccctcctgcctcggtgctaccatccagcttcctgagctcctctgctcctgggggaaacagtttcttctgtggagccgagtcttaaagactggcctctgccacccccacctagggcctaaattcacccaggtgaattmttttcccagttcgtcctccagggttgagattggtttcaagacacacgctcggagtagtagggtccctgccccggcactgccctccaccgagggagggctcaggagctccatctccaccctccctgctctcatctccccaacaagagaacaggcagaccccctcccacatcttcgaattcccctcagtcaagtcttcggggtctcaaaaagacaagacagcacaggaatagggaagggaaggcactgagacaagggggtggtggcaggttgatcaagttggtggccgggagggaaagagag

SEQ ID NO: 25184 - DNA, 601 bp, Human
ccatcgggatcatcaaccgagtagttcagcttctgatcatctcctactttgtagggtgagtctgtggcctttcaggttcctggcggggtgggctgcctggtatcccgtcttcaccctcctgcctcggtgctaccatccagcttcctgagctcctctgctcctgggggaaacagtttcttctgtggagccgagtcttaaagactggcctctgccacccccacctagggcctaaattcacccaggtgaattcttttcccagttcgtcctccagggttgagattggtttcaagacacacgctcrgagtagtagggtccctgccccggcactgccctccaccgagggagggctcaggagctccatctccaccctccctgctctcatctccccaacaagagaacaggcagaccccctcccacatcttcgaattcccctcagtcaagtcttcggggtctcaaaaagacaagacagcacaggaatagggaagggaaggcactgagacaagggggtggtggcaggttgatcaagttggtggccgggagggaaagagagaactggatctgttttagaatgaggaatttccttctggcatggatgggtgag

SEQ ID NO: 25185 - DNA, 601 bp, Human
ttcaggttcctggcggggtgggctgcctggtatcccgtcttcaccctcctgcctcggtgctaccatccagcttcctgagctcctctgctcctgggggaaacagtttcttctgtggagccgagtcttaaagactggcctctgccacccccacctagggcctaaattcacccaggtgaattcttttcccagttcgtcctccagggttgagattggtttcaagacacacgctcggagtagtagggtccctgccccggcactgccctccaccgagggagggctcaggagctccatctccaccctscctgctctcatctccccaacaagagaacaggcagaccccctcccacatcttcgaattcccctcagtcaagtcttcggggtctcaaaaagacaagacagcacaggaatagggaagggaaggcactgagacaagggggtggtggcaggttgatcaagttggtggccgggagggaaagagagaactggatctgttttagaatgaggaatttccttctggcatggatgggtgagatggtgagagagagaagggcaagggagaagccctctgctcttgaaggggaggacaaagagggaactgccc

SEQ ID NO: 25186 - DNA, 601 bp, Human
cttcctgagctcctctgctcctgggggaaacagtttcttctgtggagccgagtcttaaagactggcctctgccacccccacctagggcctaaattcacccaggtgaattcttttcccagttcgtcctccagggttgagattggtttcaagacacacgctcggagtagtagggtccctgccccggcactgccctccaccgagggagggctcaggagctccatctccaccctccctgctctcatctccccaacaagagaacaggcagaccccctcccacatcttcgaattcccctcagtcaastcttcggggtctcaaaaagacaagacagcacaggaatagggaagggaaggcactgagacaagggggtggtggcaggttgatcaagttggtggccgggagggaaagagagaactggatctgttttagaatgaggaatttccttctggcatggatgggtgagatggtgagagagagaagggcaagggagaagccctctgctcttgaaggggaggacaaagagggaactgccccttgatgaggaaacaaacagaggcccaagggaagagtggccaaggagaaaaggagcttttctgaacatag

SEQ ID NO: 25187 - DNA, 601 bp, Human
tgtccttcttgtggtcatttccacacactggtgggcaccaggaaatacaggcagaaacctcgaaggttttctttcctggcatgcgggtctccaatcttatgctgttctttcagacaatgggtctttgcatttgaggcagcaatccactgactgtcaggagttagttcaagcaggtcaaaggagaatcctgtgtgcctgtgggctgaagctgcatgcaaacctgcttgcttgaaatgttgaagtttatgcgagggtgtggagggaaaggtggctagatgtgactttttaggtgattttttgstctgtgtgctgggcaagccctggtaggcttcagtgggcaggtattgtaaaaaggctgtaccatccagtgctcctttgggagattttagaaaagggattcaagctttggaatagcattaaatggccacaaagttcccttccaatgttgaggttttgtgagatacgaggtttgcaaatgttcgctgtctgcatctctagagcttggctcaaagttggttcctaaatgttctgtgttcacgtgtatattcaatgctgtggttgtttatagccacaagatggtatgttggcccaggtgagtgca

SEQ ID NO: 25188 - DNA, 601 bp, Human
ccaaccccatccatctcctagcctgacagctccccacgggacactgccttccagttacatcagcgccctctgcagcccagccccctgacctgagtcccatctccgtgtatgtgaacccatgcacgttgtgacttcatgagtccaccgtcattaatttagcaaaaatgtaccagcatctctgcatgccaggcactgtggattgaggacggaatggtgggcaaaagcagacagggtcctcgccctcctggggcttacagcggaaggcaagagatggcattcatctgatgatctccacaaacgkgaaatgtcaactgtggcttagaggtgcacagttatagagagccgcttctgtgaaggtgtttggcccagtcagggagtaagggaaggttttctggagatgtgacattttagccaagacccgaaggatgagtaagagcagcccaggtgaaagagggaaggaagagagttcagggcagagaaacccacctctgcaaagggaaggaggctggcaaacaggggaaagaaaagaaggtcattgtggctggagccgagggagcagagatgagtgagggtggtgtacggtggatgggaacacacacag

SEQ ID NO: 25189 - DNA, 601 bp, Human
tggttgattgttccttggagtcctcggccctttcctcctgagactttcctaagccaggagatgctttcactggtgatggagcaggagctggtaggaaaagcacagggtccggttcagggggccagcatggcctggctttgagctgggacacagctagagaccttcgagtgaagaggctgtgagtggtctggagcacgttgtctggttagagctgacataccagctttgcaatcctgggcaagttagcaccctctctgtgcctcagtttcctcattcatgacatgaaggtaataacgaagcygtctcagtaagaatgtagtgaaagattcggcttagcaagtgccgcattggttatataatactagtctgaactctgcatctccaaatgttcctggactttaaggacgcagggcaggggcctcagaaaaccatttccttaggtcgacactgagaaatatgtctattctgtggctaggcacattgaagctcggttccagaagggtgtgtttagaccacagtttgcactctgcgaatgtacagccaacagccatcttagctggaagcagagagcctaggccccagacctcactcccttcactct

SEQ ID NO: 25190 - DNA, 601 bp, Human
ccttaggtcgacactgagaaatatgtctattctgtggctaggcacattgaagctcggttccagaagggtgtgtttagaccacagtttgcactctgcgaatgtacagccaacagccatcttagctggaagcagagagcctaggccccagacctcactcccttcactctgcagggccccaggctgtgagctaataatgctcatttgggtttcctgtgacagggaggctcccttctcttcttcaaggacgtaatttggcagatgggatttctacgtgaggcatacttccttgtgaaatctgaaygaaacccctccccttccaaaaaaagaagaaaagaaaagtgctgggagataaagcagcaccacaaagccccatagaaggcggtatgcatgagagcattttacaagcacgcaagtcactctaagtggtgcgttaatcaggatgccgcctgcctgctctaaaggagcaataggaaagcaggtaacgggtttgaagccatatgctggtgctgtgactacaccctttctctcctgctcaagaaatcattcagaattcaagccagtaatactactgaaaaaatgataaatatgtgaggtagtaaat

SEQ ID NO: 25191 - DNA, 601 bp, Human
gggagggaggagggttgcatggcattttctaaacgtatttgatgaggttttctcatctgtcgaatgggaatggtggcagcatctacctcccagtgtgccatcaggaataaaggcaatcttgccaaaggctggaagtgtgggattaagtgaggctgagcggggacttcagccttgagggctgtgattggcgatttcaaatggaaaggcaggcactttataggaaagcagaggcacgagttgccagcaggtatttgcaggcccttttgctcgaggccaggaaagtctgagaaggaagataggsatggaaaaagggaaggcctcatccacgtggtcccattatggcttaaagctgtaggaaggcgccagtacaggtaaatgaccactgggtggcagcacaatccagggaataagatcagactcttccctccctcctcccccagcccccccaccttcaaccgagctcctttacctgccaggtaaaagctcagccgctgtcccccgcttcctcctctgttctcatctgacacctgggcagatagattctgccaagcaccgagctcccaaggacctttattgatttgtttactgagctactttgtgt

SEQ ID NO: 25192 - DNA, 601 bp, Human
attaagtgaggctgagcggggacttcagccttgagggctgtgattggcgatttcaaatggaaaggcaggcactttataggaaagcagaggcacgagttgccagcaggtatttgcaggcccttttgctcgaggccaggaaagtctgagaaggaagatagggatggaaaaagggaaggcctcatccacgtggtcccattatggcttaaagctgtaggaaggcgccagtacaggtaaatgaccactgggtggcagcacaatccagggaataagatcagactcttccctccctcctcccccagcmcccccaccttcaaccgagctcctttacctgccaggtaaaagctcagccgctgtcccccgcttcctcctctgttctcatctgacacctgggcagatagattctgccaagcaccgagctcccaaggacctttattgatttgtttactgagctactttgtgttggacacttagggtacagccgtgggccaaggctggaatgcatgggagcagaggcctgggatcctctgtccttctgtctcctgggtgcctgccagagaagtggcccccatcagcagcatggaatgactttgagccatgcatt

SEQ ID NO: 25193 - DNA, 601 bp, Human
gcaggcccttttgctcgaggccaggaaagtctgagaaggaagatagggatggaaaaagggaaggcctcatccacgtggtcccattatggcttaaagctgtaggaaggcgccagtacaggtaaatgaccactgggtggcagcacaatccagggaataagatcagactcttccctccctcctcccccagcccccccaccttcaaccgagctcctttacctgccaggtaaaagctcagccgctgtcccccgcttcctcctctgttctcatctgacacctgggcagatagattctgccaagcacygagctcccaaggacctttattgatttgtttactgagctactttgtgttggacacttagggtacagccgtgggccaaggctggaatgcatgggagcagaggcctgggatcctctgtccttctgtctcctgggtgcctgccagagaagtggcccccatcagcagcatggaatgactttgagccatgcattctcaatggggccatatggcccccaaggaggtgaaaattggttctcactctttttatgcataaagcacaaatttgcatacagtacataaacagatatctgtgatatcaaagtt

SEQ ID NO: 25194 - DNA, 601 bp, Human
aggaggtgaaaattggttctcactctttttatgcataaagcacaaatttgcatacagtacataaacagatatctgtgatatcaaagtttcatggagggggggaccactaggggagaaaatgtctagaaaggcacctgaggggcagtaatgggacaaaaggtggagaaacgctattctaagtcaaccaagggctcactctaggtctcacgcctctggaaggaaccatccgcacaccctgccaggcatggccaagtgttggcaggaaggtgacctctcccagcttctgtctgctgggtctatrgactcctctctttctcttcatttatgctctcctgccccaggtgggttttcttgcacgagaaggcttaccaggtacgggacacagccattgagtcctcggtggtaaccaaggtgaagggctccggactctacgccaacagagtcatggatgtgtctgattacgtgacgccacctcaggtatggtacccctacccagagaggcatgtggatgtccagacactgggcaggttggaagggagaaagcgagcaaagagtgccaatgggattcccaaactagaatccatgatgtcactgatccaga

SEQ ID NO: 25195 - DNA, 601 bp, Human
acctgaggggcagtaatgggacaaaaggtggagaaacgctattctaagtcaaccaagggctcactctaggtctcacgcctctggaaggaaccatccgcacaccctgccaggcatggccaagtgttggcaggaaggtgacctctcccagcttctgtctgctgggtctatggactcctctctttctcttcatttatgctctcctgccccaggtgggttttcttgcacgagaaggcttaccaggtacgggacacagccattgagtcctcggtggtaaccaaggtgaagggctccggactctacrccaacagagtcatggatgtgtctgattacgtgacgccacctcaggtatggtacccctacccagagaggcatgtggatgtccagacactgggcaggttggaagggagaaagcgagcaaagagtgccaatgggattcccaaactagaatccatgatgtcactgatccagaggacctctcccccagcagctgagagctgtgtgagagcttgggcctgcggtgctgggcatcaggaaagctgggttcctctccaggctctgccacaacttgtaatgcaatcaaggacaacacacatgggagaag

SEQ ID NO: 25196 - DNA, 601 bp, Human
caggaaggtgacctctcccagcttctgtctgctgggtctatggactcctctctttctcttcatttatgctctcctgccccaggtgggttttcttgcacgagaaggcttaccaggtacgggacacagccattgagtcctcggtggtaaccaaggtgaagggctccggactctacgccaacagagtcatggatgtgtctgattacgtgacgccacctcaggtatggtacccctacccagagaggcatgtggatgtccagacactgggcaggttggaagggagaaagcgagcaaagagtgccartgggattcccaaactagaatccatgatgtcactgatccagaggacctctcccccagcagctgagagctgtgtgagagcttgggcctgcggtgctgggcatcaggaaagctgggttcctctccaggctctgccacaacttgtaatgcaatcaaggacaacacacatgggagaagggggccatgtgggtggctgcaaagagccagctctgcccctcaccagccctgtgaccttggccaagtcactagacacaagccttgctttcctcatctgtagagtggggataatcagttatagtccctg

SEQ ID NO: 25197 - DNA, 601 bp, Human
ggcaaaactctgcctctgcctggaatgtaaaacccctacccccacttgctaggtgcttcagtctccttggccaccaccctgctgcgtcagccctggctggaacgtctccagtcatggagagctcattacctccggaagcagccttcccgttttcaggagactccacctgttacagagttcctgtttctcaccgtatagctgggggaggaggctctgggtttctgcagacctgagatgccttaatgaggaacagagcccacgtggcatggtgggcacatagcctgccttcagggacttccasccttccaccccacgcagtcctctctctgtgcagctgtggtctgggtcacccctaggagctgggaaggcagccctgaaacatcctgcaaagtccctgggcatttttctaagagggaacatcattcagtcctccctggaggactggtccccaccctggcctgcaatctgctaacatgctagctcggatctctcttcctcatcttataaagccaccagctcccctcccatgatagcccattaatccattaatccatgcatccatgaacggattaatccatccatgagggcagagcccgcaggg

SEQ ID NO: 25198 - DNA, 601 bp, Human
gacgggcaggcctggctgagcaacagcacagcgcctacgaggccgctcaggtgggaggcggccaggggcctggggatgcagctcagagaacgcggactgctggacctccgagggagagccaggcgtcagggctgccctcccaggaggaagcaggaggaactccaccgcatttactgaacgagtggaatgaggcgcatccccattgtccagcgctgcttctcccctccacctgctcaccccccacccaccccggggtcagggctctgaaggcgcctggcagagcagcctccacaagttgccyctttggctttgtggcgccagctcctgccaggtggcatgaggatgggggaaggggatggccgagctgggtgcagagatagaggcctctgggcaggacccccagctggacaccagagaggctggccgcgggtggggcaagttgaccggaagggagctcaggaacatgccgggctgatgagtttctccagctctgagtaggcagtgacaccctgtgattataaataacctgccggcgcctgggtcagctgccaggccaaggcccagggaggctcctggggcgacagctgccacccagccccct

SEQ ID NO: 25199 - DNA, 601 bp, Human
agtagagacggggttttaccacgttggtcaggctagccttgaactcctgacctcaagtgatccagccaccgcggtctcctctcccaaagtgctggggttacaggcatgagccactacactcagcggtgtgaaaaccacccaaatgtccatcagctgatgaatgcatgaccacaatgtggcagccccacacggcaggatagtatcagccacagagaggaatggagggctgatagatgccacaacatgggtgaaccttgaaaacatgacaccaagtgaaagaagccagaaaaaaaaaaaaaaaggccgcatactatacaatttcatttatacgaaatacccagaataggcaaatccatagagacagattctcctgcctcagcctcccgattagctgggattacaggcgccactatcatgcccagctaattgttttgtatttttagtagaaacagggtttctccatgttggccaggctggtctcgaactcctgacctcaggtgatccacccacctcggcttcccaaagggctgggattataggcatgagccacagcgcccggccgccaatttcctaattttcatacttgtacttagttaaatat

SEQ ID NO: 25200 - DNA, 601 bp, Human
caataaaagaaaaaataggtaagttggacttcataaaaatttaaaatgttcatgcatcaaaagacactctcaagaaagtgaaaagacaacccacagaatgggagaaaacatttgaaataatgtagctggtaagggtttagtatccagaagatacaaaaaactcttataatttaacaataaaaagccaaataatccaatttaaaaatgagcaaaggatttgaatagacatttctcaaaaaaaaaaaaaaaaaaaagagagagagagatacacaaatgcccaattaagcatatgaaaagatgmcaaacaccattggtcattagggaaatacaaatcaaaaccacaataaaacaccacttcacttccactaggatggctatcattttttaaaaaccctacagataacaggtgttgatgaggttgtgaagaaattagaacccccgtatatcactgatagggatgtaaaatgaggtagttatggtagaaaacagtttagcagttcctcaaaaggttaaggatcgagttaccagataagccagaaaattcccaagagattgagaacatggccaggcacagtggctcccgcctgtcatcccagcactt

SEQ ID NO: 25201 - DNA, 601 bp, Human
tgaaataagagtacaaatcccatacttgttgacactaaaaacgcaagcaataaaagaaaaaataggtaagttggacttcataaaaatttaaaatgttcatgcatcaaaagacactctcaagaaagtgaaaagacaacccacagaatgggagaaaacatttgaaataatgtagctggtaagggtttagtatccagaagatacaaaaaactcttataatttaacaataaaaagccaaataatccaatttaaaaatgagcaaaggatttgaatagacatttctcaaaaaaaaaaaaaaaaaaaagagagagagagatacacaaatgcccaattaagcatatgaaaagatgacaaacaccattggtcattagggaaatacaaatcaaaaccacaataaaacaccacttcacttccactaggatggctatcattttttaaaaaccctacagataacaggtgttgatgaggttgtgaagaaattagaacccccgtatatcactgatagggatgtaaaatgaggtagttatggtagaaaacagtttagcagttcctcaaaaggttaaggatcgagttaccagataagccagaaaattcccaagagatt

SEQ ID NO: 25202 - DNA, 601 bp, Human
acagcctgcctgtgtgccacagccagttctgaaaacactgagtccctgggggcaggtgactttgcagggccaccctcgcccgctgccacggcctgcctgtgtgccacagccagttctgaaaacactgagtccctgggggcaggtgactttgcagggccaccctcgcccgctgccacggcctgcctgtgtgccacagccagttctgaaaacactgagtccctgggggcaggtgactttgcagggccaccctcgccccacgagtccccgtccacaccctcctcgtcacagagccaggcccagygcccccaggccctcagggagggctccctgcgtgcaccccacccacctccagggctatatcctggaagtcgctcccggcccagcggatcacggagcccagtcggaagatggggcagtagtggttcttggggccaaagtggcatgatttcaggaaagatctgtccttgacgtccatcacattgcttctgggtggaggccatgggcagccgagaaatgaagtaagacttgatgtttcccggcctggccaggagtcactcggtccctcaccaacctgagtgctgacagctccccgcagcaacac

SEQ ID NO: 25203 - DNA, 601 bp, Human
cgcccagcctcagaacaggagaacgcacagcggggcccccagggaccctcccaacgtccccctcccagcctgagaacaggagaacacacagcggggcccccagggaccctcccaacgtcccccgcccccccgcccagcctcagaacaggagaacgcacagcgggacccccagggaccctcccaacgtcccccgccccccgcccagcctcagaacaggagaacacacagctgggcccccagggaccctcccaacgtcccccgccccccgcccagcctcagaacaggagaacgcacagctggrcccccagggaccctcccaacgtccccctcccagcctgagaacaggagaacacacagctgggcccccagggaccctcccaacgtcccccgccccccgcccagcctcagaacaggagaacacacagctgggcccccagggaccctcccaacgtcccccgccccccgcccagcctcagaacaggagaacacacagctgggcccccagggaccctcccaacgtccccctcccagcctgagaacaggagaacacacagctgggcccccagggaccctcccaacgtcccccgccccccgcccagcc

SEQ ID NO: 25204 - DNA, 601 bp, Human
tcccgcccagcctcagaacaggagaacgcacagcggggcccccagggaccctcccaacgtccccctcccagcctgagaacaggagaacacacagcggggcccccagggaccctcccaacgtcccccgcccccccgcccagcctcagaacaggagaacgcacagcgggacccccagggaccctcccaacgtcccccgccccccgcccagcctcagaacaggagaacacacagctgggcccccagggaccctcccaacgtcccccgccccccgcccagcctcagaacaggagaacgcacagckgggcccccagggaccctcccaacgtccccctcccagcctgagaacaggagaacacacagctgggcccccagggaccctcccaacgtcccccgccccccgcccagcctcagaacaggagaacacacagctgggcccccagggaccctcccaacgtcccccgccccccgcccagcctcagaacaggagaacacacagctgggcccccagggaccctcccaacgtccccctcccagcctgagaacaggagaacacacagctgggcccccagggaccctcccaacgtcccccgccccccgccca

SEQ ID NO: 25205 - DNA, 601 bp, Human
agtggctcacgcctgtgatcccagcactgggaggccgaggtgggcggatcacctgaggtcaggagttggagaccagcctggccaacatggtgaaaccctgtctctacaaaaatacgaaaattaaccgggcgcggtggcgcacgcctgtaatcccagctactcaggaggctgaggcagaagaattgcttgagcctgggaggcagaggctgcagtgagccaagatcatgccattgcactccagcctgggcgacagagtgagactccatctcaaaaaaaaaaaaaaaaaaagaaaagtgatagmtgaaggtgggccttctgtaagaaagtaacaggcgcaaacatccaggaccctcccagtgactgtctgcaggtagggatccatgtggagctcacttttcttgaccccctcccaggaacgtggtcctggtatgggacacaattttccaggttttaacaaaagtcacccctgggtcccaatggactcctccagtggggctgtcttgtgtgcacagggagaggaatgagggaagaggctgccagaaacctgggaaagggacctgccgggatgggcactgaccactcccatggctctcaaaaactc

SEQ ID NO: 25206 - DNA, 601 bp, Human
gctcccccgatcccacaggccaggcactccccgaccccgcaccacccggaccccatccaatcgttccttcaacacatttgctgggcacccagcacgtgccagtgtctgcaccgaagtacggagaggatctggacaagagagacctcctggggactctccctctggtgcaggagacaggcgtgtcgatgacgacccacataggacttcactcagcctggggagggtccctattcagtccttaaggactaaagaggagtttatacaagacaaagaggcggaaggacattacggagggaggaasaagcctgtcacatctgggaaatgccgcagggcctgtgcgggaagagggagatgcgcttctggagaaggggatggggactggcctgttaggcttcttagaatgtttccgaggcattggtcctcatcctttaggtgaggcggaggcaccacagcccgaattttggcatttagaaagatccctgtggtagtcagtgtgagataggttggaagggttctaaccaacaaggacgctatggtgctagtcaaagaaagatgatgggtgccaggtgcagtggctcacgcctgtaatcccagcactttg

SEQ ID NO: 25207 - DNA, 601 bp, Human
ggccagggtcagggcgcagggctataacccagggctggggttcaggccgtagctggagtgcagtaaggcgaatgacccaggcagaccctgcacccactgtcccaggctgtgggggtgctgagggagtactaaggtgtctgtcccaattcccattctgatccctgcttctccagaaggccttccccaaaggccgaagccacagccccttccccttcccgccctcccacagtcatcagggttccccacccacgctgtgctctgccgctgtgaacacgcacaccccaccgaacccagggcccargaaactccggaaacagcctctgcatggaagaaaatatccgcttttctttcctttactactccagcttccctcagccccggcgcaccaggaccaccaagtccaagaatcccaaaacagaagtgctgcagacaccactcgattggtaaaccaactctctcatctcccagatagagaaaccgaggcccggggaggcctgggacttgtccagaatcaggcggagcctgtgaactccgtctcccgccctgtggcccacagcgccctctcctcccactgctgccgaggccgaatccggttctgtag

SEQ ID NO: 25208 - DNA, 601 bp, Human
acggccagcaccctcctgaggccggggcagccccagaatcgcacacagaagaggggctgagggggggtcatctgagcacagagacgttcggcaaaggcagagtaactcaggagaacctcatcctacagacactgccgggattcaaatctcagcgctgccattcaccggctgtgtgacttgagcaaattaccgagcctttctgtgcctcagcttcctcatttgtaaaatggggaagatcggtgtctatctgattcagttgcttacatgagttaacaaatacggagagtacagaggggttccrggcagagagtcagtgctgtggagcagcgcgctgttatcatctgagcgccggcatggcacagcaggcacccatggccatccagggtctcgggagctaagggggaccttgcggggtaaagcaccagccccttcccacagaggctctcccagttcctagatgtcctgccttgtggccagctcacaccagagcagaggggtccgctggagctgccaggcatgagaagccccaactggggacccctctctgcaggacccagctgtcgggctctctgcctagcagtggcctcacctgtggggctcc

SEQ ID NO: 25209 - DNA, 601 bp, Human
aggcccagctcccagctgaacgctgccaattcctgagtcagcaaggaatgaaagctgggccaggagaaaggccaccaaggtcagtgagtacctggggtgtggtttgcaagagagtcacagaaccccagtctgacagcaggaggtgtccagcccccactgggaggggaaaaaagggaaaacaaggcacagaaagggccaggcacctgctcaccgcacaggtactctgcaaggcagacgcagagcaggcccgagacaggtcccccacccagccagacgccctccccacgcaggctgagcctcrtctgcagagaagccagcgcccccaggaatcgcggcccaaggacccccctggcagcacggccagcaccctcctgaggccggggcagccccagaatcgcacacagaagaggggctgagggggggtcatctgagcacagagacgttcggcaaaggcagagtaactcaggagaacctcatcctacagacactgccgggattcaaatctcagcgctgccattcaccggctgtgtgacttgagcaaattaccgagcctttctgtgcctcagcttcctcatttgtaaaatggggaagatcggtgtct

SEQ ID NO: 25210 - DNA, 601 bp, Human
aaatgtccccttgggtgttgtccaagagctttctctgagcaaccatcattctcggcagggatttcggaaaccctgctagaggctagaggaaggccagctggagtggctgggcctggctgtgatgtctctgttggctttggaggaattacacgcgggcccctctccctgaggttaggtcagcatctcatttaagcacctcttggtgggcccagcacacagcatgcgtcaatacatgtttacagctcatatgaatgagtgaaggtgcagccaggttgagggaaaatccaaacactccacttcygctcagcaccctggcctgtccctttccctggacacctgctccagggactcctcttctaggtccgagcccctctgaccattgggaggctcccctcctcactcagcaaaaagcttgcagcaagatcccaaagttcaggagagatggctgtgcctggaagcccctgtctcatgcaggcacagactcctctacccagttcagagctgcgggttgttctggccccaaagttttcagcgacactgctggtagccagcagccctggctacatctccactgtctgcagctgctccaaattcacctgtg

SEQ ID NO: 25211 - DNA, 601 bp, Human
ctagactccccaggagctggcttccccactaagagccagctgcctcctgactgctccagtcctttcctggttgcctccatggccacctttaaattttatccttggggcaagcccaaatgtccccttgggtgttgtccaagagctttctctgagcaaccatcattctcggcagggatttcggaaaccctgctagaggctagaggaaggccagctggagtggctgggcctggctgtgatgtctctgttggctttggaggaattacacgcgggcccctctccctgaggttaggtcagcatctcrtttaagcacctcttggtgggcccagcacacagcatgcgtcaatacatgtttacagctcatatgaatgagtgaaggtgcagccaggttgagggaaaatccaaacactccacttctgctcagcaccctggcctgtccctttccctggacacctgctccagggactcctcttctaggtccgagcccctctgaccattgggaggctcccctcctcactcagcaaaaagcttgcagcaagatcccaaagttcaggagagatggctgtgcctggaagcccctgtctcatgcaggcacagactcctc

SEQ ID NO: 25212 - DNA, 601 bp, Human
ccagtcaaaatattgtaacttaaatcagctgagcatactgctgctttcagggtgggggaggaagcctcttggtctctaggcagcatgcgtgtaagtctgacctagaaattggctccatccaccaaagctggcctttttcccctgagaaccagggcttcttaaatgtcactgtgcacacagatcaccttggaatcttgttgaaacacaggttctgatttgggtggggggcgggggagctgggacctgcatttctagcaggctccggtccctggaccccactttaaatagcaaggcttggccrggtttggtggctcacgcatgtaatcccagcactttgggaggccaaggctggcggatcacctgaagtcaggagttggagaccagcctggccaacatggtgaaaccccatctctgctaaaactacaaaaattagccgggcatggtggtgggcacctgtaatcccagctacttaggaggctgagacaggagaatcgattgaacctgggaggcggaggttccagtaagccaagatcacgccactgcactccagcctgggtgacagagcgagactctatttcaaaaaaataaataaataaaaagc

SEQ ID NO: 25213 - DNA, 601 bp, Human
gggaggacggaggttgcttttcactgactatccttttgcaccttctaaactttgaatcatttaagtattacccagtcaaaatattgtaacttaaatcagctgagcatactgctgctttcagggtgggggaggaagcctcttggtctctaggcagcatgcgtgtaagtctgacctagaaattggctccatccaccaaagctggcctttttcccctgagaaccagggcttcttaaatgtcactgtgcacacagatcaccttggaatcttgttgaaacacaggttctgatttgggtggggggcrggggagctgggacctgcatttctagcaggctccggtccctggaccccactttaaatagcaaggcttggccgggtttggtggctcacgcatgtaatcccagcactttgggaggccaaggctggcggatcacctgaagtcaggagttggagaccagcctggccaacatggtgaaaccccatctctgctaaaactacaaaaattagccgggcatggtggtgggcacctgtaatcccagctacttaggaggctgagacaggagaatcgattgaacctgggaggcggaggttccagtaagccaag

SEQ ID NO: 25214 - DNA, 601 bp, Human
ccgggaggacggaggttgcttttcactgactatccttttgcaccttctaaactttgaatcatttaagtattacccagtcaaaatattgtaacttaaatcagctgagcatactgctgctttcagggtgggggaggaagcctcttggtctctaggcagcatgcgtgtaagtctgacctagaaattggctccatccaccaaagctggcctttttcccctgagaaccagggcttcttaaatgtcactgtgcacacagatcaccttggaatcttgttgaaacacaggttctgatttgggtggggggcgggggagctgggacctgcatttctagcaggctccggtccctggaccccactttaaatagcaaggcttggccgggtttggtggctcacgcatgtaatcccagcactttgggaggccaaggctggcggatcacctgaagtcaggagttggagaccagcctggccaacatggtgaaaccccatctctgctaaaactacaaaaattagccgggcatggtggtgggcacctgtaatcccagctacttaggaggctgagacaggagaatcgattgaacctgggaggcggaggttccagtaagcca

SEQ ID NO: 25215 - DNA, 601 bp, Human
catgtccatttttgacaggggagactgggtcttaagcgccagcgtcaggagaagttcattacctgagtgaatgtgtaagaaaccacacgagttctcggcaaaatcagggagcctcctgcattagtaacactggctgcctctggggaaccgggaggacggaggttgcttttcactgactatccttttgcaccttctaaactttgaatcatttaagtattacccagtcaaaatattgtaacttaaatcagctgagcatactgctgctttcagggtgggggaggaagcctcttggtctctaggyagcatgcgtgtaagtctgacctagaaattggctccatccaccaaagctggcctttttcccctgagaaccagggcttcttaaatgtcactgtgcacacagatcaccttggaatcttgttgaaacacaggttctgatttgggtggggggcgggggagctgggacctgcatttctagcaggctccggtccctggaccccactttaaatagcaaggcttggccgggtttggtggctcacgcatgtaatcccagcactttgggaggccaaggctggcggatcacctgaagtcaggagttggagac

SEQ ID NO: 25216 - DNA, 601 bp, Human
ctcaccttgggtttacggggagacaactcacatacaacggggtaggagaagagagctagtcagctcccaagcccaacatcgaaacgtacttcatgtccatttttgacaggggagactgggtcttaagcgccagcgtcaggagaagttcattacctgagtgaatgtgtaagaaaccacacgagttctcggcaaaatcagggagcctcctgcattagtaacactggctgcctctggggaaccgggaggacggaggttgcttttcactgactatccttttgcaccttctaaactttgaatcatktaagtattacccagtcaaaatattgtaacttaaatcagctgagcatactgctgctttcagggtgggggaggaagcctcttggtctctaggcagcatgcgtgtaagtctgacctagaaattggctccatccaccaaagctggcctttttcccctgagaaccagggcttcttaaatgtcactgtgcacacagatcaccttggaatcttgttgaaacacaggttctgatttgggtggggggcgggggagctgggacctgcatttctagcaggctccggtccctggaccccactttaaatagca

SEQ ID NO: 25217 - DNA, 601 bp, Human
gctgagctccaggtttctcaccttgggtttacggggagacaactcacatacaacggggtaggagaagagagctagtcagctcccaagcccaacatcgaaacgtacttcatgtccatttttgacaggggagactgggtcttaagcgccagcgtcaggagaagttcattacctgagtgaatgtgtaagaaaccacacgagttctcggcaaaatcagggagcctcctgcattagtaacactggctgcctctggggaaccgggaggacggaggttgcttttcactgactatccttttgcaccttytaaactttgaatcatttaagtattacccagtcaaaatattgtaacttaaatcagctgagcatactgctgctttcagggtgggggaggaagcctcttggtctctaggcagcatgcgtgtaagtctgacctagaaattggctccatccaccaaagctggcctttttcccctgagaaccagggcttcttaaatgtcactgtgcacacagatcaccttggaatcttgttgaaacacaggttctgatttgggtggggggcgggggagctgggacctgcatttctagcaggctccggtccctggac

SEQ ID NO: 25218 - DNA, 601 bp, Human
tggcgagggctgagctccaggtttctcaccttgggtttacggggagacaactcacatacaacggggtaggagaagagagctagtcagctcccaagcccaacatcgaaacgtacttcatgtccatttttgacaggggagactgggtcttaagcgccagcgtcaggagaagttcattacctgagtgaatgtgtaagaaaccacacgagttctcggcaaaatcagggagcctcctgcattagtaacactggctgcctctggggaaccgggaggacggaggttgcttttcactgactatccttttgcaccttctaaactttgaatcatttaagtattacccagtcaaaatattgtaacttaaatcagctgagcatactgctgctttcagggtgggggaggaagcctcttggtctctaggcagcatgcgtgtaagtctgacctagaaattggctccatccaccaaagctggcctttttcccctgagaaccagggcttcttaaatgtcactgtgcacacagatcaccttggaatcttgttgaaacacaggttctgatttgggtggggggcgggggagctgggacctgcatttctagcaggctccggt

SEQ ID NO: 25219 - DNA, 601 bp, Human
agaggatgcttccagggagccgcccagacagcactgggactggttgtgtgagggcggcgctggaggacttttctgccaggtggctcgggcaatggcgagggctgagctccaggtttctcaccttgggtttacggggagacaactcacatacaacggggtaggagaagagagctagtcagctcccaagcccaacatcgaaacgtacttcatgtccatttttgacaggggagactgggtcttaagcgccagcgtcaggagaagttcattacctgagtgaatgtgtaagaaaccacacgagttytcggcaaaatcagggagcctcctgcattagtaacactggctgcctctggggaaccgggaggacggaggttgcttttcactgactatccttttgcaccttctaaactttgaatcatttaagtattacccagtcaaaatattgtaacttaaatcagctgagcatactgctgctttcagggtgggggaggaagcctcttggtctctaggcagcatgcgtgtaagtctgacctagaaattggctccatccaccaaagctggcctttttcccctgagaaccagggcttcttaaatgtcactgtgc

SEQ ID NO: 25220 - DNA, 601 bp, Human
gcctcccaaagtgctgggattacaggtgtgagccactgcgcccagcctggatctttactttctaatcagagagcagtataggcttgttgcaggttcccttcccagaaaacccaaagcgaggaagttgctttgctctaggagggttcctgttctggagaccatgtccctgggcccctgacatccctctccaaagcctcagtggagggatgctctcaccacccccgcctttctgtgtgcagagagaacccctccaaagaggatgcttccagggagccgcccagacagcactgggactggttgwgtgagggcggcgctggaggacttttctgccaggtggctcgggcaatggcgagggctgagctccaggtttctcaccttgggtttacggggagacaactcacatacaacggggtaggagaagagagctagtcagctcccaagcccaacatcgaaacgtacttcatgtccatttttgacaggggagactgggtcttaagcgccagcgtcaggagaagttcattacctgagtgaatgtgtaagaaaccacacgagttctcggcaaaatcagggagcctcctgcattagtaacactggctgcctc

SEQ ID NO: 25221 - DNA, 601 bp, Human
ttctggagacggagtctcgctccgtcgcccaggctggagtgcagtggcacgatcttggatcactgcaacctccgtctcccgggttcaagcaattctcctgcctcagcctcctgagtagctgggactacaagtgcacgccgccacgcccagctatttttttgtattttagtagagacagggtttcaccatgttgcccaggctgttctcaaactcctgaactcaggcaatctgcccgcctcggcctcccaaagtgctaggattacaggcgtgagccaccgtgcccggctaggaagacattttygttgcaatatgaaacaaatagtatgactatcctcaggttctgtggcttctgccagccatttcgaagtctggttaaaatcagcagccatgacccctgccttttttgcttcctcccaaacctaaaagtcaccaagttataaaaatgcaaggctttgcgtcagtgaagaagtgacacacctaagtggatcacctggatcttcactttctttttttttttttgagactgagtctcactgtcgcccaggccagagtgcagtggtatgatctcagctcactgcaacctctgcctcccaggttcaag

SEQ ID NO: 25222 - DNA, 601 bp, Human
tccaacacctgacatgtcacagggactccataaatatttcctggctgaaggaatgactaactgtaggaagacattttcctttttctggagacggagtctcgctccgtcgcccaggctggagtgcagtggcacgatcttggatcactgcaacctccgtctcccgggttcaagcaattctcctgcctcagcctcctgagtagctgggactacaagtgcacgccgccacgcccagctatttttttgtattttagtagagacagggtttcaccatgttgcccaggctgttctcaaactcctgaamtcaggcaatctgcccgcctcggcctcccaaagtgctaggattacaggcgtgagccaccgtgcccggctaggaagacatttttgttgcaatatgaaacaaatagtatgactatcctcaggttctgtggcttctgccagccatttcgaagtctggttaaaatcagcagccatgacccctgccttttttgcttcctcccaaacctaaaagtcaccaagttataaaaatgcaaggctttgcgtcagtgaagaagtgacacacctaagtggatcacctggatcttcactttcttttttttttttt

SEQ ID NO: 25223 - DNA, 601 bp, Human
gactggaaaccctcgggggcagggatcgtgtctgtgttgctcatctctgtctcagcagcatctggtccaacacctgacatgtcacagggactccataaatatttcctggctgaaggaatgactaactgtaggaagacattttcctttttctggagacggagtctcgctccgtcgcccaggctggagtgcagtggcacgatcttggatcactgcaacctccgtctcccgggttcaagcaattctcctgcctcagcctcctgagtagctgggactacaagtgcacgccgccacgcccagctawttttttgtattttagtagagacagggtttcaccatgttgcccaggctgttctcaaactcctgaactcaggcaatctgcccgcctcggcctcccaaagtgctaggattacaggcgtgagccaccgtgcccggctaggaagacatttttgttgcaatatgaaacaaatagtatgactatcctcaggttctgtggcttctgccagccatttcgaagtctggttaaaatcagcagccatgacccctgccttttttgcttcctcccaaacctaaaagtcaccaagttataaaaatgcaaggcttt

SEQ ID NO: 25224 - DNA, 601 bp, Human
taagggttcaatgccccattagactggaaaccctcgggggcagggatcgtgtctgtgttgctcatctctgtctcagcagcatctggtccaacacctgacatgtcacagggactccataaatatttcctggctgaaggaatgactaactgtaggaagacattttcctttttctggagacggagtctcgctccgtcgcccaggctggagtgcagtggcacgatcttggatcactgcaacctccgtctcccgggttcaagcaattctcctgcctcagcctcctgagtagctgggactacaagtrcacgccgccacgcccagctatttttttgtattttagtagagacagggtttcaccatgttgcccaggctgttctcaaactcctgaactcaggcaatctgcccgcctcggcctcccaaagtgctaggattacaggcgtgagccaccgtgcccggctaggaagacatttttgttgcaatatgaaacaaatagtatgactatcctcaggttctgtggcttctgccagccatttcgaagtctggttaaaatcagcagccatgacccctgccttttttgcttcctcccaaacctaaaagtcaccaa

SEQ ID NO: 25225 - DNA, 601 bp, Human
atgacgggtgtgatcatttgataagggttcaatgccccattagactggaaaccctcgggggcagggatcgtgtctgtgttgctcatctctgtctcagcagcatctggtccaacacctgacatgtcacagggactccataaatatttcctggctgaaggaatgactaactgtaggaagacattttcctttttctggagacggagtctcgctccgtcgcccaggctggagtgcagtggcacgatcttggatcactgcaacctccgtctcccgggttcaagcaattctcctgcctcagcctccygagtagctgggactacaagtgcacgccgccacgcccagctatttttttgtattttagtagagacagggtttcaccatgttgcccaggctgttctcaaactcctgaactcaggcaatctgcccgcctcggcctcccaaagtgctaggattacaggcgtgagccaccgtgcccggctaggaagacatttttgttgcaatatgaaacaaatagtatgactatcctcaggttctgtggcttctgccagccatttcgaagtctggttaaaatcagcagccatgacccctgccttttttgcttcct

SEQ ID NO: 25226 - DNA, 601 bp, Human
aaagtctaaaggggcaaccttgcagctaaagaccgtcaacttcattaaacaaaagcctcaccaaacctggctcctgtctgccgccttcacccaggttctccgttgctccttcccatatcaaagcgtctcttcacacctgtgcttctcttacctggaatgcttccccctcacctagttaggctgctataacctttcagatttcaactcataggtcacttccttggggaaaccttctctggctactcctcgctgacctctccgacaccccattccgtctgtgatgacgggtgtgatcatttgrtaagggttcaatgccccattagactggaaaccctcgggggcagggatcgtgtctgtgttgctcatctctgtctcagcagcatctggtccaacacctgacatgtcacagggactccataaatatttcctggctgaaggaatgactaactgtaggaagacattttcctttttctggagacggagtctcgctccgtcgcccaggctggagtgcagtggcacgatcttggatcactgcaacctccgtctcccgggttcaagcaattctcctgcctcagcctcctgagtagctgggactacaagt

SEQ ID NO: 25227 - DNA, 601 bp, Human
actggaaggcttggccggccttgaagaaacaatgaggttaaatcctctaaggaagcaaagtctaaaggggcaaccttgcagctaaagaccgtcaacttcattaaacaaaagcctcaccaaacctggctcctgtctgccgccttcacccaggttctccgttgctccttcccatatcaaagcgtctcttcacacctgtgcttctcttacctggaatgcttccccctcacctagttaggctgctataacctttcagatttcaactcataggtcacttccttggggaaaccttctctggctactmctcgctgacctctccgacaccccattccgtctgtgatgacgggtgtgatcatttgataagggttcaatgccccattagactggaaaccctcgggggcagggatcgtgtctgtgttgctcatctctgtctcagcagcatctggtccaacacctgacatgtcacagggactccataaatatttcctggctgaaggaatgactaactgtaggaagacattttcctttttctggagacggagtctcgctccgtcgcccaggctggagtgcagtggcacgatcttggatcactgcaacctccgtc

SEQ ID NO: 25228 - DNA, 601 bp, Human
cccatgcctgtaatcgcagcactttgggaggccgaggtgggcggatcacgaggtcaggagatcgagaccatcctgattaacacagtgaaaccccgtctctactaaaaatacaaaaaattagccgggcgaggcgagcgcctgtagtcccagctactcgggaggctcaggcaggggaatggcgtgaacccgggaggcggagcttgcagtgagccgagatcgcgccacggcactcccatccagcctgggcgataaagcgagactccgtctcaaaaaattaaaaaaaaaaaatacaaaaaaaaaagccagtttccatcagagtaatgagctcccactcttgcaccaagattatgcagaaaaatggtgggagctgggggctgtgcaaaaagcaaggaaactggaagagtgtgacactgtctggaagctgtcaggcgatccctggctcttctgagcacggggcccctgatgggcagtcaagaggtcactggaaggcttggccggccttgaagaaacaatgaggttaaatcctctaaggaagcaaagtctaaaggggcaaccttgcagctaaagaccgtcaacttcattaaacaaaagcctcaccaaa

SEQ ID NO: 25229 - DNA, 601 bp, Human
cctgatgaccccagcatcagacgtggaggtcactttgctctgtgatggctggtccctgtgatgtggcattgatagcacccaatgtacaaatttcccgttgggcagcatcctgggattcccaaaggcatgggatcactgggtgctagacggctgggtttaggacagggcctgaacgtaagcagaggcaattcacgtgctcctggaatatcagaacagaaaggagctcttgagaggctggcactctcatcttcccagtgaggcaaccagtgcccagggagaagggccttcccaagtctgaaargagctacagttcatgcttcacttctccccatttaaaagccagtttccggccaggcgcggtggctcatgcccatgcctgtaatcgcagcactttgggaggccgaggtgggcggatcacgaggtcaggagatcgagaccatcctgattaacacagtgaaaccccgtctctactaaaaatacaaaaaattagccgggcgaggcgagcgcctgtagtcccagctactcgggaggctcaggcaggggaatggcgtgaacccgggaggcggagcttgcagtgagccgagatcgcgccacggcactc

SEQ ID NO: 25230 - DNA, 601 bp, Human
tcaaggactccggaaggaagtcatgttccccatttacaacccgttccctagtgcgggaagccagccacggagaaaggaagaactgacggcagggggtggggcaaaaagacagccatgatgggtccgtcctgatgaccccagcatcagacgtggaggtcactttgctctgtgatggctggtccctgtgatgtggcattgatagcacccaatgtacaaatttcccgttgggcagcatcctgggattcccaaaggcatgggatcactgggtgctagacggctgggtttaggacagggcctgaaygtaagcagaggcaattcacgtgctcctggaatatcagaacagaaaggagctcttgagaggctggcactctcatcttcccagtgaggcaaccagtgcccagggagaagggccttcccaagtctgaaaagagctacagttcatgcttcacttctccccatttaaaagccagtttccggccaggcgcggtggctcatgcccatgcctgtaatcgcagcactttgggaggccgaggtgggcggatcacgaggtcaggagatcgagaccatcctgattaacacagtgaaaccccgtctctactaa

SEQ ID NO: 25231 - DNA, 601 bp, Human
agaagctgcaatgagccgaggtcgtgccactgcactccagcctgggctacagagcgagactccatctcaaaaaaaaagatgggtaaacatgaagagaaaaaaatcaggacacgtttgaaattgacaccatttattgttttatgaccaaataagagtgtcagagaatacatatcttgggcaggtcccagaaagcgtctgccatctcccccactttaattctgtgtactggcctaagggcaaacagctggcaggaaggtggtgtctttaggagagagagtacttggatccactggagagtatrctctgagggaagctgcggcacttgcagaggggagtgggctggaaccaaatggagcccttttccggacacgcacaatgctattcccagtgaggtaatctaggaactctacagggcactgcggtccttagctgaggtgctcaaggactccggaaggaagtcatgttccccatttacaacccgttccctagtgcgggaagccagccacggagaaaggaagaactgacggcagggggtggggcaaaaagacagccatgatgggtccgtcctgatgaccccagcatcagacgtggaggtcacttt

SEQ ID NO: 25232 - DNA, 601 bp, Human
ctgcctcagtctgactgctggagtattgttctcccaactgtggctggcgctacccagtgtggcccctacaagtcttagttccttggcggaggggaagtccccactttgggacaaggccaactggacttatcttcccgctcaactttgaggacccagcattgttcctccagtttccagttcttgcagtgtttgtaaaggtgcccgaatcgtacctgatcccattcactaaatattatctccattttatagaggggtaaattgaggaagtccctgagaaattaacttgtctaaggtgtcccarcaaaaaatagtgccccagggatttgaaccggtttgctgattgatttttcaccagttgccttaagaattatcatgatttaacctctctgggcctcagtttcctcctctataaaatgcagacagtgatacatcaaaggtacttaaaggaaaatgtactgtacccacctcatggggcatgtggtgaggataaaacgggttgacacaggaaaagagctctcaatggtgcctggctcatagaaaacactcagtggattttttttttcccattacccgggaacctgtgttaaggaggccacaggct

SEQ ID NO: 25233 - DNA, 601 bp, Human
ctggaacagagtcccatgtgaaacaagaccatgagaaatacagcaagcctccaggtttgagacaaactgggactagagggtgagtcagagtctgggatgggggtggggagaaacccattcattcattgttttcagttcttactcttttcggggatcctcccttgtcccacatgctgtggcagagccgtctgtgggggtctcattttctggaagccatccccacccctcaccatggctggggttgttggatagagggaggctggccctctttctttggggggactgttcagttgcgcctgamgcctgctttctttccgagtgctgcaaggtaattaaatagttggttaatcacttttaacgccaaacagctgcggctccatctacagtgtgctggaatctgggctagacccagatgaacccagcctcgatttgggggctccagcaggactcacagcacggtggttggtggtggtgggggcaggggggtggttgcatgacatctggacccaagaggcagctgttgtggcagcaagagagaggagagagatgaggccccgttcctatatggctctgctcccagggtcccacatcctctgttaaa

SEQ ID NO: 25234 - DNA, 601 bp, Human
gccctggctgcctgggctcggattacgcaaggctggtgggcgtggagcaagcaagggggcagctgggggcctccaggcccaggcagggcagggcttggcggccccagcgttccccaggaaactgtaaaaacgagtctggggccctgactttgctgatagcggccatctcagccatagagggaggtgaagcctctgtgatctccacccccgcaccccctcaggacatggcccctaaaagcaccatcccatttagggtcacccattttcttcctaggagctgtggggctttgcgaataactcsctatggctgaatctgctttgctgaactaggaaaccctagtgagttgtatagatgccattcatttaagaaccttgaaaagccaacatcttattcccatgtaaaacatacctaggtgatttggagaatacagtgacacaaagaagaaaataacaattacttgtaattctcaccatcttgagagaaccaccgttaacattttttagcgtgtgtatccttccagatttcgctttagtttgtataaatatacatgtataaatagtttttaaaaaataaaatgggattatgtgtacatactgcttt

SEQ ID NO: 25235 - DNA, 601 bp, Human
tatacatgtataaatagtttttaaaaaataaaatgggattatgtgtacatactgctttataatgcatcttctttaccttgatcatggtgaacatttattcatttgttgtttctgattttgagtgactcagggcttgatagtcttcatcctgcttcttctgttacacttttttttttttttttttttttgagagggagtatcgttctgtcgcacagactgggaatgcagtggcgcgatcttggctcactgcaacctccacctcctgggctcaagcaattcttgtgcctcagcctcccaagtygctggcactacaagcacccgccaccacacttggctcatgtttgtatttttagtagagacgaggttgcaccatgttggccaggctggcctcgaactcctgacctcaggtgatccacccgcctcagcctcccaaagtgctggatgacagaagtgagccaccatgcctggcccttctgttacatttcttatattcttgcatggagaaaggattgggggggattgtgagggcatccatctgtccatctatgtggctggccttgggggctagatttcttctggggaggactaatttttttaccct

SEQ ID NO: 25236 - DNA, 601 bp, Human
tatgtgaggaagtcggggagggaggccgtgatccctgctgaggtgtgtctagaggctgtcttgttctatcagtgaggtcagccttctcctgatggtggccaaatccttcttaggatcctggggccagttttgatgtcaatgaccaggaccctgacccccagcctcggtacacacagatgaatgacaacaggtaagaagtggcaggccccggtctctgcctcccttctcctttcttccactaaggaacagggctgagcctgggtgagatgtgccttgcctaaaaggctgaggcttttcccayagtcctggcccacctggggctctgagggagggctcggtcagagtggagatggccacaggcccagtggagtgtgggagatgggggctgggtactcaggggatgatgggtgtcggatgtgcggatccctcgtgctcctcaggccacatctgccgggccctgttcaccccatttgttctactcatgctacgtgcttggccctggcaggcacggcacacggtgtgcgggggaagtggctgcggtggccaacaacggtgtctgtggtgtaggtgtggcctacaacgcccgcattggaggtgagtg

SEQ ID NO: 25237 - DNA, 601 bp, Human
ggtactcaggggatgatgggtgtcggatgtgcggatccctcgtgctcctcaggccacatctgccgggccctgttcaccccatttgttctactcatgctacgtgcttggccctggcaggcacggcacacggtgtgcgggggaagtggctgcggtggccaacaacggtgtctgtggtgtaggtgtggcctacaacgcccgcattggaggtgagtgtgggcctgggccaccctgtcttcaggagggcccttcagtggaatttttcccgcccacttcccatctggccaatgcctgccactttccsactgtggatcctttgatcacgtggctgttccatggagggttcccaaagggtcaaagactgaaagagctggacccctgtggagtgagggtttcctagcaggagtctcctgaaatcctcacgacccactgtgagtcctcacgtggcagatccttgatcaccaggctcttttgggaaccagagactctttctagtcctgaatgtgtggttgggggcaggaggtgttctctttttccttctctgggtcttgtctttgaaaggcagaggcaaacaggtagttgggggttcagggtttctcagcat

SEQ ID NO: 25238 - DNA, 601 bp, Human
gatccctcgtgctcctcaggccacatctgccgggccctgttcaccccatttgttctactcatgctacgtgcttggccctggcaggcacggcacacggtgtgcgggggaagtggctgcggtggccaacaacggtgtctgtggtgtaggtgtggcctacaacgcccgcattggaggtgagtgtgggcctgggccaccctgtcttcaggagggcccttcagtggaatttttcccgcccacttcccatctggccaatgcctgccactttcccactgtggatcctttgatcacgtggctgttccayggagggttcccaaagggtcaaagactgaaagagctggacccctgtggagtgagggtttcctagcaggagtctcctgaaatcctcacgacccactgtgagtcctcacgtggcagatccttgatcaccaggctcttttgggaaccagagactctttctagtcctgaatgtgtggttgggggcaggaggtgttctctttttccttctctgggtcttgtctttgaaaggcagaggcaaacaggtagttgggggttcagggtttctcagcatcagcctccacccttcccttactcatcccctggg

SEQ ID NO: 25239 - DNA, 601 bp, Human
ggctgctggctggctctgtccagcaccctcttttggaggctgtctgcctccacccccatgtggctgggtgatagtggctcaggcatcatgcaacatgaactctggggctctgtaggttcttggaggccatggagccatctctgaagactttgaaaagcctagactctctctaaaaacatactttgttcttattcatctccaccctctagttgaacccccttattcctttggaaaatgaggcccaggaggggctcgtcattagcatgtccacggcaagttagcaaggcagcagctgggaccyggggttcttggccctggctccccataccatctgtggtgcccagggcctgtatgcagagggagggtaggcaggtggctcctctagccccctccacccatcacaggccccaatatgattctcttcctggcaggtgacgactgacttgcggcagaagtgcacggagtctcacacgggcacctcagcctctgcccccttagcagccggcatcattgctctcaccctggaggccaagtaagtgggtgggggccagcggcaaccctgtccctaccagcactctctgtagggcagcccttagggcag

SEQ ID NO: 25240 - DNA, 601 bp, Human
gccagtgggacctgagagtcgcagggggtgcccgctggtccctctgggccaggctgaccatcatggtgctctcctgcacagagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccatgggcacccgctccaccctgctggcagccaggtgcttgctctgtccctgcccgccctgcccagcgccgcckcctctcacagcccgcgtgcttgcctttgctcgctcacacggcccagggggcactgagtgctactcagtggggcactcttggcattttgggagggacaattttgtcctgtgggactgtcccatgttgcaggaatccctggcttgcaaccatttaatgtcagtagtgtgccccaccttgtgcggtgcctgtgtacctttctagaatcccccagttgagcacgtctggctcactgagaaacagccaagccagcaggcacttctggccccatggggttggtctgcgtgggggaagggtgtgtgg

SEQ ID NO: 25241 - DNA, 601 bp, Human
cagctgcgctctggctttagttttcggggggtgaaggtgtacaccatggaccgtggcctcatctcctacaaggggctgccccctgaagcctggcaggaggagtgcccgtctgactcagaagaggacgagggccggggcgagaggaccgcctttatcaaagaccagagcgccctctgatgagcccactgcccaccccctcaagccaatcccctccttgggcactttttaattcaccaaagtatttttttatcttgggactgggtttggaccccagctgggaggcaagaggggtggagactgyttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggagga

SEQ ID NO: 25242 - DNA, 601 bp, Human
cttaggcttgcaagtaaaaaaggagggaacacctatccctgccttacatagcagagctcctctttcccactcggatcgagaatcatgcagacggctcccttgctttttctgcacctgcaatctatattttcccagggcatcgcctcccagcaggagctctgtccatgggctgggctttgccatttagtcatacagcctgcatcaaatcacttcccttctcaaagagcccccatcccagagtgtgctgcacaaagtttcagaaaaaatccacaggaaagccggtactgcacagccttgcggyagtggttttacaccctcaaggtgaagtgtgtctgtctggagatgttgtttgaatttagctttgttgagggaaattaacccatttcagagacctggcagtgcaagtgtcctggggcagacagaggtcctgtcctactcaccaggtaccacatgttggaccaaatggggtcgttgaagtaaagggcctgcgggtcacttcgcacctgtctcttcacccttcgtttcacttcctgttgctggagccatttcacctaccagaagaaatgcaattactgtttatattagaaatgatttcttgatt

SEQ ID NO: 25243 - DNA, 601 bp, Human
tttacagatgaggcacagagaagttaagtaacttactcaagatctcagagctaatcatttgcagacccaggataggaacccaggcactctgggcctagagcccgtgttttcacactgtcaccctgtcactgttcgtgttgctactatctgtacgctgatgatccccctccatgcatttcttagttctttaggctccattcctaaaagtgtatgtgactgtgcaagcatgtggatgaatccctctgcaaaacccttgcccctgacagtagcaagtagcagaatattcatcttcctaattctytccagcatagttttctttactgcctaacttaatgggggctgggggagatcgggaccttactgtttttaaacttgcatttacttaatgaccagcacagttgaatatatttgcatgtcagttccgaggattgacttacataatttggggccaggtcagggtgatttctctctatgccatcatcaaggatggtgaccaccacgttttttcctgtgtagcccctcttccacgctgcctggacattcatttccgaccggcagcgactgttcttgtcgccacaatgctgtaagcacgaaagacaca

SEQ ID NO: 25244 - DNA, 601 bp, Human
tggcatggcctgtgactcctggagaagcctgcctcgcgcccaggcagggaagatacgccggcagccaccgcctctccagctccctcgcacacacattcaatagtgacgctgcagggaggggaagagaagccggggagatgaggcgaggtgacgtacttattttcattgctggcatcatatcgtggagatgggtcataatcattgccgttcacgtcgtagctggcgtaggaatcctaagaaatggaatcgtggtgagtgaggagaaatggcatatgacagctctgtttgaaatggattttaygttccgttggcaaatagagaaaccacacgcggggctcctctcttactatagctataatctcatatacgtttttatcgtggtaaaatatatgtgacgggaaatacacgaccttaaccattctcgagtgtgcggctcagtggcattaattcacagtgctgtgaggccatcgctgctacccatctccagaaccctttcaacctgcaaaaccccacacccactcaacactaactccccactcccctctcccaggccctggcaacccccactccacctttttgtctaagagtttggctactccga

SEQ ID NO: 25245 - DNA, 601 bp, Human
gaagggctgtgcctggcatggcctgtgactcctggagaagcctgcctcgcgcccaggcagggaagatacgccggcagccaccgcctctccagctccctcgcacacacattcaatagtgacgctgcagggaggggaagagaagccggggagatgaggcgaggtgacgtacttattttcattgctggcatcatatcgtggagatgggtcataatcattgccgttcacgtcgtagctggcgtaggaatcctaagaaatggaatcgtggtgagtgaggagaaatggcatatgacagctctgtttkaaatggattttatgttccgttggcaaatagagaaaccacacgcggggctcctctcttactatagctataatctcatatacgtttttatcgtggtaaaatatatgtgacgggaaatacacgaccttaaccattctcgagtgtgcggctcagtggcattaattcacagtgctgtgaggccatcgctgctacccatctccagaaccctttcaacctgcaaaaccccacacccactcaacactaactccccactcccctctcccaggccctggcaacccccactccacctttttgtctaagagt

SEQ ID NO: 25246 - DNA, 601 bp, Human
cactggcagcaggaagggcaccttgggacgtgcatgaggctgggctgctgcaggctcgcgggagctctgcagcctgctgtgtggaactccagtggccgaggcttcctgcacagcattgcctgcgcacccgtttgtgaatctcagaatcaaagcgaccacaaactaaaagactataatcgggagacgcccctcagcaagagtcttgtcaacagtggggaggaagaaaaagcttttattatttccctctaaatatttttagaggaatgataagagctcagggtatggggcatgctgatggagaaggaaagagacagcaaatgaattcccaggactgaccccagggctgccgtttacactgcaaagtcacctgggctctccggaccccactgcctccacttgcaaaatgacagtgacacaaaaacgcccaccatttcggaagaatctgctgggtgcattcctcatgcatcatctcactgacccctcctgtgaccctgtgaggtaggggacatcactggcctggacgagcctctaagacactaagacatgaagtttcaaccagctcacccggcatgcacgcagccagtaagtgggagagctgcga

SEQ ID NO: 25247 - DNA, 601 bp, Human
cactcagcagctgggagactatgaagaaatgaccagaaaaacaaatgcgttttcctcagtaatgaccccattctctgatgtgccacgtcgggtcagttcctccagcgggggccaaaataggagcaacttgaaatagcacatctttgagaagagtccacagaggatgggaatcattgattcaaatttaaagctgcctttaaaaatcgccccaggcagcagccctctggaagagagtcatctgtccttccctggaagccacacagcttcaaggccagggctgttcccggggtcacagagctcratggatggctcgggatgggattgaatcctgcccttcaagggtcactgcgtggtatgtgggtcattcctcctttgccccaggcatcctcactggcagcaggaagggcaccttgggacgtgcatgaggctgggctgctgcaggctcgcgggagctctgcagcctgctgtgtggaactccagtggccgaggcttcctgcacagcattgcctgcgcacccgtttgtgaatctcagaatcaaagcgaccacaaactaaaagactataatcgggagacgcccctcagcaagagtcttgtcaacagt

SEQ ID NO: 25248 - DNA, 601 bp, Human
caaagaccacagagtggctggcgggtggcctcgcaggagcctgccagcctccccttggcccatcggcagagaagcatctttgccctgcttagccccttgtgaggttcccctggagaagttcaaagtgggctgggctgtgcgctggtgggggacaccccgaccactgcttcctgctgcagcggggcctgggtgagcacataccccgcgatgaatgcacagagttccacagctgggtgtttctaagcgcaggtgggccgaggcccctgcagagtccaagtaacaggccaggtgagctgccttrgacccccgtcacccacctgtgtacccccttcagccagggatgggcaaactccaaggcagagagggtcgtgctagcagtggccacctggctgtcactggaacagctgttctggaacgaggcaaaaacacttctgctctcgccggtcaagagccacttctcagactccccgagtgactcctccacactggccctggcacctgtcacagcagagtcttccctgtcttgtttcagggctgtggccagtgtcactctgatacttgttaaaatgtttactgtcacccttgtcccagagcgctcccc

SEQ ID NO: 25249 - DNA, 601 bp, Human
tctgcagccacctcctcccccttcctcagccttcctgacacacaaggatccggaaccaaagaccacagagtggctggcgggtggcctcgcaggagcctgccagcctccccttggcccatcggcagagaagcatctttgccctgcttagccccttgtgaggttcccctggagaagttcaaagtgggctgggctgtgcgctggtgggggacaccccgaccactgcttcctgctgcagcggggcctgggtgagcacataccccgcgatgaatgcacagagttccacagctgggtgtttctaagsgcaggtgggccgaggcccctgcagagtccaagtaacaggccaggtgagctgccttagacccccgtcacccacctgtgtacccccttcagccagggatgggcaaactccaaggcagagagggtcgtgctagcagtggccacctggctgtcactggaacagctgttctggaacgaggcaaaaacacttctgctctcgccggtcaagagccacttctcagactccccgagtgactcctccacactggccctggcacctgtcacagcagagtcttccctgtcttgtttcagggctgtggccagt

SEQ ID NO: 25250 - DNA, 601 bp, Human
gggggtgggggcagtagaggaggaagcttccgcctcacacttgcagagtgacaccaagtccttcggaggaggtgcaggcaggtgcagctggcaggaggcagaggatgcagtgtaggcctgacgcccgggaaaggtaagaagtggaggaaactccagggtttcggcagggcagcagggctaggggtctcctgagagaaaaacgctcattctgataagaggaaattaacagatggtgaccaaactcaacgcacccaggaaagccatcaaatgatattacttagagaaaggaaatcatgaacayggtttgaaaacagattcctcctccgtggggcaggactcgggggtgggcagacagagacagagagaggctgtttgcagtataatctcttcctactatccgactgacttactagctgtttatgagccacactgcaatcactatgcatgggttataatacgatgagaactgtaaaaatattttaaacgatataaatttaatgggcttgactcctgccaccccctcccattctcccatcccccacaggaggagtcagagaagcctggacttcctgctggaactcccccggtccccactccctac

SEQ ID NO: 25251 - DNA, 601 bp, Human
tggaagggtgatttatgtattcggcagttcttggtgggcagcagctgacttggtcatacccgagtgtgccagcactcactcagcccagccttgggcctggcttaggtgctcagcagcctcattgaagctgcctcggtgttttcttgggggaatggagataaaggaagctgtccagtgtcccaaggatgcccgcaagaccccatgctgtgtgcgtgcgtgtgtgtgtctacaccgcccctcttccttaattttccttctcacatttagtgtctgggtgagtactaaactcggagggacaggygggtagataccctgtatttggtcattggtttctcaggcattcaagacctgagtggttggggggtgggggcagtagaggaggaagcttccgcctcacacttgcagagtgacaccaagtccttcggaggaggtgcaggcaggtgcagctggcaggaggcagaggatgcagtgtaggcctgacgcccgggaaaggtaagaagtggaggaaactccagggtttcggcagggcagcagggctaggggtctcctgagagaaaaacgctcattctgataagaggaaattaacagatggtgaccaaac

SEQ ID NO: 25252 - DNA, 601 bp, Human
gttggagctgggagctaagtaatggaagggtgatttatgtattcggcagttcttggtgggcagcagctgacttggtcatacccgagtgtgccagcactcactcagcccagccttgggcctggcttaggtgctcagcagcctcattgaagctgcctcggtgttttcttgggggaatggagataaaggaagctgtccagtgtcccaaggatgcccgcaagaccccatgctgtgtgcgtgcgtgtgtgtgtctacaccgcccctcttccttaattttccttctcacatttagtgtctgggtgartactaaactcggagggacaggcgggtagataccctgtatttggtcattggtttctcaggcattcaagacctgagtggttggggggtgggggcagtagaggaggaagcttccgcctcacacttgcagagtgacaccaagtccttcggaggaggtgcaggcaggtgcagctggcaggaggcagaggatgcagtgtaggcctgacgcccgggaaaggtaagaagtggaggaaactccagggtttcggcagggcagcagggctaggggtctcctgagagaaaaacgctcattctgataagagga

SEQ ID NO: 25253 - DNA, 601 bp, Human
ttcagcttaatttttaggatgtctcgcttgtcatcaagactgagatccaagcgatctagtgggttggagctgggagctaagtaatggaagggtgatttatgtattcggcagttcttggtgggcagcagctgacttggtcatacccgagtgtgccagcactcactcagcccagccttgggcctggcttaggtgctcagcagcctcattgaagctgcctcggtgttttcttgggggaatggagataaaggaagctgtccagtgtcccaaggatgcccgcaagaccccatgctgtgtgcgtgcrtgtgtgtgtctacaccgcccctcttccttaattttccttctcacatttagtgtctgggtgagtactaaactcggagggacaggcgggtagataccctgtatttggtcattggtttctcaggcattcaagacctgagtggttggggggtgggggcagtagaggaggaagcttccgcctcacacttgcagagtgacaccaagtccttcggaggaggtgcaggcaggtgcagctggcaggaggcagaggatgcagtgtaggcctgacgcccgggaaaggtaagaagtggaggaaactccaggg

SEQ ID NO: 25254 - DNA, 601 bp, Human
ggtcccctctgcaacttccccactcccctgacagctggatgaaaccaacactgctcagaattccgaatgcaaagatccctctctgcagctccaacctccccaagcctcccataggctcagtgaaccagagagcccgaacgatcactgccaaacaaccaggacccctcctggacggagggtgcctcatcctaggagctccatctttggaaatcatcccgtagaaatgacagacgctcagcaggaacaccatccaaagcaatatgttctatgcaggaaacccgccctccagcttacccacccyctccgaagcttaaattcagcttaatttttaggatgtctcgcttgtcatcaagactgagatccaagcgatctagtgggttggagctgggagctaagtaatggaagggtgatttatgtattcggcagttcttggtgggcagcagctgacttggtcatacccgagtgtgccagcactcactcagcccagccttgggcctggcttaggtgctcagcagcctcattgaagctgcctcggtgttttcttgggggaatggagataaaggaagctgtccagtgtcccaaggatgcccgcaagacccca

SEQ ID NO: 25255 - DNA, 601 bp, Human
agtcagattttacagaagactgtaggcgacaaatagggccacaaggaggaaaagcagatgggggaatgtggtttggtttgagatcatcaaatttctaggaggattttcagtgacagatcgagacagttgcgatttaaggttctctgtatgacatattttacttccaaatgacgaaaaaaaatcaaatgacctcagtatttcacaaaactgtgacaagaatgaggggaaaccacgtggtcccctctgcaacttccccactcccctgacagctggatgaaaccaacactgctcagaattccgratgcaaagatccctctctgcagctccaacctccccaagcctcccataggctcagtgaaccagagagcccgaacgatcactgccaaacaaccaggacccctcctggacggagggtgcctcatcctaggagctccatctttggaaatcatcccgtagaaatgacagacgctcagcaggaacaccatccaaagcaatatgttctatgcaggaaacccgccctccagcttacccaccctctccgaagcttaaattcagcttaatttttaggatgtctcgcttgtcatcaagactgagatccaag

SEQ ID NO: 25256 - DNA, 601 bp, Human
gccaggcttcctaaggaccaacgttaaacagatctttgtgccaagttacagcttctacagtctctcaccgccgggccacatcatctaccaaagataaagtcagattttacagaagactgtaggcgacaaatagggccacaaggaggaaaagcagatgggggaatgtggtttggtttgagatcatcaaatttctaggaggattttcagtgacagatcgagacagttgcgatttaaggttctctgtatgacatattttacttccaaatgacgaaaaaaaatcaaatgacctcagtatttcacraaactgtgacaagaatgaggggaaaccacgtggtcccctctgcaacttccccactcccctgacagctggatgaaaccaacactgctcagaattccgaatgcaaagatccctctctgcagctccaacctccccaagcctcccataggctcagtgaaccagagagcccgaacgatcactgccaaacaaccaggacccctcctggacggagggtgcctcatcctaggagctccatctttggaaatcatcccgtagaaatgacagacgctcagcaggaacaccatccaaagcaatatgttctat

SEQ ID NO: 25257 - DNA, 601 bp, Human
cgatgtcttccctggggagggagagttcatttcatgagctcagaagcaccgcgactgagggccagcaaacaccggccacctggacgcggccagtgtctttagccacagcaatgtctaatggtcccttctgaatagctaggtgtgagaggagccaggcttcctaaggaccaacgttaaacagatctttgtgccaagttacagcttctacagtctctcaccgccgggccacatcatctaccaaagataaagtcagattttacagaagactgtaggcgacaaatagggccacaaggaggaaaarcagatgggggaatgtggtttggtttgagatcatcaaatttctaggaggattttcagtgacagatcgagacagttgcgatttaaggttctctgtatgacatattttacttccaaatgacgaaaaaaaatcaaatgacctcagtatttcacaaaactgtgacaagaatgaggggaaaccacgtggtcccctctgcaacttccccactcccctgacagctggatgaaaccaacactgctcagaattccgaatgcaaagatccctctctgcagctccaacctccccaagcctcccataggctca

SEQ ID NO: 25258 - DNA, 601 bp, Human
caacttcaacccaatcaaatcgtatttcgatgtcttccctggggagggagagttcatttcatgagctcagaagcaccgcgactgagggccagcaaacaccggccacctggacgcggccagtgtctttagccacagcaatgtctaatggtcccttctgaatagctaggtgtgagaggagccaggcttcctaaggaccaacgttaaacagatctttgtgccaagttacagcttctacagtctctcaccgccgggccacatcatctaccaaagataaagtcagattttacagaagactgtaggygacaaatagggccacaaggaggaaaagcagatgggggaatgtggtttggtttgagatcatcaaatttctaggaggattttcagtgacagatcgagacagttgcgatttaaggttctctgtatgacatattttacttccaaatgacgaaaaaaaatcaaatgacctcagtatttcacaaaactgtgacaagaatgaggggaaaccacgtggtcccctctgcaacttccccactcccctgacagctggatgaaaccaacactgctcagaattccgaatgcaaagatccctctctgcagctcc

SEQ ID NO: 25259 - DNA, 601 bp, Human
gtaggggacatttcaaccctagccatgaacttgcacttcttttcagtaaactcacaacttcaacccaatcaaatcgtatttcgatgtcttccctggggagggagagttcatttcatgagctcagaagcaccgcgactgagggccagcaaacaccggccacctggacgcggccagtgtctttagccacagcaatgtctaatggtcccttctgaatagctaggtgtgagaggagccaggcttcctaaggaccaacgttaaacagatctttgtgccaagttacagcttctacagtctctcaccrccgggccacatcatctaccaaagataaagtcagattttacagaagactgtaggcgacaaatagggccacaaggaggaaaagcagatgggggaatgtggtttggtttgagatcatcaaatttctaggaggattttcagtgacagatcgagacagttgcgatttaaggttctctgtatgacatattttacttccaaatgacgaaaaaaaatcaaatgacctcagtatttcacaaaactgtgacaagaatgaggggaaaccacgtggtcccctctgcaacttccccactcccctgacagctgg

SEQ ID NO: 25260 - DNA, 601 bp, Human
tagagatgttttaactgtctctgacgactttattttcacttcccagatcttccagtggcttcatggaagccatgggacagaagctgtaggggacatttcaaccctagccatgaacttgcacttcttttcagtaaactcacaacttcaacccaatcaaatcgtatttcgatgtcttccctggggagggagagttcatttcatgagctcagaagcaccgcgactgagggccagcaaacaccggccacctggacgcggccagtgtctttagccacagcaatgtctaatggtcccttctgaatarctaggtgtgagaggagccaggcttcctaaggaccaacgttaaacagatctttgtgccaagttacagcttctacagtctctcaccgccgggccacatcatctaccaaagataaagtcagattttacagaagactgtaggcgacaaatagggccacaaggaggaaaagcagatgggggaatgtggtttggtttgagatcatcaaatttctaggaggattttcagtgacagatcgagacagttgcgatttaaggttctctgtatgacatattttacttccaaatgacgaaaaaaaatcaaatg

SEQ ID NO: 25261 - DNA, 601 bp, Human
taaaacggtttctgggaaggagacgtggaaatgaggcgaggaaacagccaggtctgaggagtgtagagatgttttaactgtctctgacgactttattttcacttcccagatcttccagtggcttcatggaagccatgggacagaagctgtaggggacatttcaaccctagccatgaacttgcacttcttttcagtaaactcacaacttcaacccaatcaaatcgtatttcgatgtcttccctggggagggagagttcatttcatgagctcagaagcaccgcgactgagggccagcaaacaycggccacctggacgcggccagtgtctttagccacagcaatgtctaatggtcccttctgaatagctaggtgtgagaggagccaggcttcctaaggaccaacgttaaacagatctttgtgccaagttacagcttctacagtctctcaccgccgggccacatcatctaccaaagataaagtcagattttacagaagactgtaggcgacaaatagggccacaaggaggaaaagcagatgggggaatgtggtttggtttgagatcatcaaatttctaggaggattttcagtgacagatcgagaca

SEQ ID NO: 25262 - DNA, 601 bp, Human
aggggccagaaagactcctctgttcttcacaggaaaatcaagggtcccaacacaagctgctctattccagagccatgcctgtcatttccatcgcaatggcctaggatcaaagagagctagcagtgctgcaaatgacactgagattacagatgatggaggaatttacaactttaatttttctgggttgaaagagctggtctggtggggaaaagaatgatttttctggaaaacatacttgaagaggtacccttcttgcagagcgagctaaatttgcaaagagggataggaccatgaactctgygtgaagacagaataggtggaaagggttacgtccaggaagctggtagcagcttgtgggtgtcctgtcagagctccctgtggtctctgcagtgggtaagtatcagggtggtctgatttacatcactagccaaggccagggcctcatttgtgtgtaggttttctttccttttttttgttttttgttttttttttttttgagacaggggtcttgctacgttacccaggctggtctggaactcccgggctcaggtgatcctcctgccttagccttcagagtagctgtgcctatagaagtgtgccg

SEQ ID NO: 25263 - DNA, 601 bp, Human
tgcctgtggaagcagccttaaaattgcagaatcacaggatcatacgagggaaaggggccagaaagactcctctgttcttcacaggaaaatcaagggtcccaacacaagctgctctattccagagccatgcctgtcatttccatcgcaatggcctaggatcaaagagagctagcagtgctgcaaatgacactgagattacagatgatggaggaatttacaactttaatttttctgggttgaaagagctggtctggtggggaaaagaatgatttttctggaaaacatacttgaagaggtaccyttcttgcagagcgagctaaatttgcaaagagggataggaccatgaactctgcgtgaagacagaataggtggaaagggttacgtccaggaagctggtagcagcttgtgggtgtcctgtcagagctccctgtggtctctgcagtgggtaagtatcagggtggtctgatttacatcactagccaaggccagggcctcatttgtgtgtaggttttctttccttttttttgttttttgttttttttttttttgagacaggggtcttgctacgttacccaggctggtctggaactcccgggctcag

SEQ ID NO: 25264 - DNA, 601 bp, Human
gatggtgtagatgctgttggtgtagccatcgcacgagcagtagtccccctctctcccgccattcccagatgcccagacgaaaatggagcccaggccctgccggccctggagggacaagaggaacaaggcttagccccgcagcagaacctcgtagggtgggtctccccccgaacctagagtcccatctcccaaatgttccttcaaagggataagaaggttgcattcagaccatctggatgctgctgagagcatggttttgggggctctgtttggattttaatggtgtgcctttgcctgtggmagcagccttaaaattgcagaatcacaggatcatacgagggaaaggggccagaaagactcctctgttcttcacaggaaaatcaagggtcccaacacaagctgctctattccagagccatgcctgtcatttccatcgcaatggcctaggatcaaagagagctagcagtgctgcaaatgacactgagattacagatgatggaggaatttacaactttaatttttctgggttgaaagagctggtctggtggggaaaagaatgatttttctggaaaacatacttgaagaggtacccttcttgcag

SEQ ID NO: 25265 - DNA, 601 bp, Human
aaggaaatgggaaactcagtcccagaaccacagggacctgagttttgccaacagcccgagtgggcaaggaaacagattctcccgggagcctccggaaggaaccacggccctgccagcaccttggtcttggccttgtgagactcaaagcagagactcggctgaggctcctggacttctggcctacaggaccatgagatatcaatttgtgctgttttaagctgctaagtttgtgataatttgttatggcaggaatagtaaagtcacacccacccacccaccacaggactccagtagccgattwgcctaacctttgagaatcaatttcacagtgagagcaatccagatcctcttccgaactcagcaccttccttgcacacgtttgagctgggccaactgtctagggaaggtgggggtctggtctgtgtcacacacaggaagatgtgacgggaaggccaacagagaccagtttcctccttgttcgtttcagtggggctggggtacctcaacatggggagggcagctgagggcatgggaaaagggacaaaaatgctccctctctgactccagcatcttcatatgcaaatggacaccatgatataga

SEQ ID NO: 25266 - DNA, 601 bp, Human
ggttcagcctgtgtgggttcaggtgtgctaggtgggattgtcgcccccatcatctttgtcccctggtgttattccaatgagctttgcagatggagttaaggtcggtagccagccgaccttaaagcaggaagattatcctggattatctgagtagacctgctgccaccacagggccctccaccttggaagaggaaggcagcaaggctgtttgagagaggaagcattagaaggactggacccaccgctgctggcattgaagagggagctgaggagtaagccaatgaatgtgggtggcctccaraggctgagaacgggccccagctgacagcccacaaggaaatgggaaactcagtcccagaaccacagggacctgagttttgccaacagcccgagtgggcaaggaaacagattctcccgggagcctccggaaggaaccacggccctgccagcaccttggtcttggccttgtgagactcaaagcagagactcggctgaggctcctggacttctggcctacaggaccatgagatatcaatttgtgctgttttaagctgctaagtttgtgataatttgttatggcaggaatagtaaagtcacaccc

SEQ ID NO: 25267 - DNA, 601 bp, Human
ccaggctgggtgtgggatggattctggacctcactaccactcaggctgacgtgtatctcccgttggactcaaacgggaagtgggtgctgggggttcagcctgtgtgggttcaggtgtgctaggtgggattgtcgcccccatcatctttgtcccctggtgttattccaatgagctttgcagatggagttaaggtcggtagccagccgaccttaaagcaggaagattatcctggattatctgagtagacctgctgccaccacagggccctccaccttggaagaggaaggcagcaaggctgttkgagagaggaagcattagaaggactggacccaccgctgctggcattgaagagggagctgaggagtaagccaatgaatgtgggtggcctccagaggctgagaacgggccccagctgacagcccacaaggaaatgggaaactcagtcccagaaccacagggacctgagttttgccaacagcccgagtgggcaaggaaacagattctcccgggagcctccggaaggaaccacggccctgccagcaccttggtcttggccttgtgagactcaaagcagagactcggctgaggctcctggacttct

SEQ ID NO: 25268 - DNA, 601 bp, Human
aagcagatcaacctggcatgttcttgaccgcccaaggcctactgcacagggcaacaaggcaggtaccgctagctggggctctgcctgccctcctcggaggcactggcccaggctgggtgtgggatggattctggacctcactaccactcaggctgacgtgtatctcccgttggactcaaacgggaagtgggtgctgggggttcagcctgtgtgggttcaggtgtgctaggtgggattgtcgcccccatcatctttgtcccctggtgttattccaatgagctttgcagatggagttaaggtyggtagccagccgaccttaaagcaggaagattatcctggattatctgagtagacctgctgccaccacagggccctccaccttggaagaggaaggcagcaaggctgtttgagagaggaagcattagaaggactggacccaccgctgctggcattgaagagggagctgaggagtaagccaatgaatgtgggtggcctccagaggctgagaacgggccccagctgacagcccacaaggaaatgggaaactcagtcccagaaccacagggacctgagttttgccaacagcccgagtgggcaagga

SEQ ID NO: 25269 - DNA, 601 bp, Human
gaccctgggtctcgggaacaaataaggtgttaggcaaatgcatctcggcaaccacaggtttccacaacatctggtgctccctgctaaatcactttgtaggaagacaggcaggggcaagaaggccagctgggagcacagaccgtacgctttgataataatagatcagctggttccctctctactgcagaagcgcatgtggaaaaaatggtaaaacaacatgaaaccaagacgcaccccacaagccctcatccctgggtctgctggactttgtggcctatcaccaacagccaagagtacccayggcaaaaccatcagagtccacactagctacccctaagtcaccccctgacttcagagcagctagaggtacccaggtggctcagagagagtttctgcctttagccagtaggtcataagctgggttctccaccaggacgtcctcctgaagaagcagatcaacctggcatgttcttgaccgcccaaggcctactgcacagggcaacaaggcaggtaccgctagctggggctctgcctgccctcctcggaggcactggcccaggctgggtgtgggatggattctggacctcactaccactcaggc

SEQ ID NO: 25270 - DNA, 601 bp, Human
gacaccaaccctgctgacaccttgatccaggaattccaggctccagaactttgagaaactaaatttctgttgtttgagctgcccagtccgtgggactctgttacggcagcctgagctgactaacctgggcagctgctgtttaacgggcagagggttccagcctgggaagaagacgaagctctgggagagggatggtggtgcaggtgcacgactcactgaatgtgcttaatgccgctgagctgtccacttcaatagggtgaaaatggccaatgtcatgtgtattttaccacaatctaaacatttttttttttagaaaaaggtaagtgggaacttactttgcttctagagccaaggcgatgatgcccgccaccatgggggcagagactgaggtcccagtgtggccatcggtacagcgctgacgcagatccgtggtgacctgggggagagagaagcacagtgaggcagtgatggcagacaggctaactcactctctggagaaggctgggctacttcaggtgccactaactggcaagcgtgaccctgggtctcgggaacaaataaggtgttaggcaaatgcatctcggcaaccacaggtttccac

SEQ ID NO: 25271 - DNA, 601 bp, Human
cccacaagtgggattgctgatcgtctggggagtctgtttaattttttcaaggacgcgctacactgttttgtatggcggctgctctgcacactcccaccctcggccccctctttgcctgttttcctacgagaagctcacccatggcgttaagtcttgggtatactccttccctgggctcacactctccaggctccagccctggcctcccctgacttctccaatgtgttcttgctgctcctggctggtcactggcttcctcaccgtctctccccgtctgtgtccagtggctcagtctccaggmctttccctgccaggcacacctgttctcctcctgcatccactggccttcctgcggcccacacgccaacctcactgttaggggagattctgaggcctcgagtagcccatggccgtgcaccctggtagagaggtcacaggtgcaggctttggagtttagacaagtgctgacatggccacaccccatgctgcccgtgcaacctggcaagttactgctgtgtgtcagcagggcgtactcgaagacggctacagccagtcctcctggaaatcttgaatttaggtgccgggatgacctttggagtgg

SEQ ID NO: 25272 - DNA, 601 bp, Human
tccctgctttcaatcctggatatcacccacaagtgggattgctgatcgtctggggagtctgtttaattttttcaaggacgcgctacactgttttgtatggcggctgctctgcacactcccaccctcggccccctctttgcctgttttcctacgagaagctcacccatggcgttaagtcttgggtatactccttccctgggctcacactctccaggctccagccctggcctcccctgacttctccaatgtgttcttgctgctcctggctggtcactggcttcctcaccgtctctccccgtcygtgtccagtggctcagtctccaggactttccctgccaggcacacctgttctcctcctgcatccactggccttcctgcggcccacacgccaacctcactgttaggggagattctgaggcctcgagtagcccatggccgtgcaccctggtagagaggtcacaggtgcaggctttggagtttagacaagtgctgacatggccacaccccatgctgcccgtgcaacctggcaagttactgctgtgtgtcagcagggcgtactcgaagacggctacagccagtcctcctggaaatcttgaattta

SEQ ID NO: 25273 - DNA, 601 bp, Human
aggaacgcacgccgcgccacaggtgctgcctcagggaatgtgaccctaggaacacggactaagtaaaatcgggggagctgctgcagctgagggggcctggagacgcagaagagagagagctgaagtacccagctgccccggcctccccagtggcacctgctgggatgtcacaggcgtctctccagtggcccactctgtgtgtgggtgtgcgaagacgtacagaacacaaactttcccatttcaaccatttgtaaaggtacagctcagtagcattaaggacgttcacattgctctggtaccrccacacccacctccagaacttttcaccacctccagactgaaactctgtcccacgggacactcagtccccatcgctccttctgcagcccctggcaggcaccacgctactttctgtctctatgagtttgatggctccaggtcttcgtgtaagtggaaccacacaggatttgtcttatttcccttagcacaacgtccttgagggacctcatcataatctgtatccgaatctccttcctttcaaggctgaatgttccacgtgtgtacagagcacacttcgctgatctcttcgtccatcatggac

SEQ ID NO: 25274 - DNA, 601 bp, Human
aggattacaggtgtgagccaccacacctggcccacctttttcttttttttaacacctctgaaatccagatccatcttatgatctgatacctcttataagcccctctgcccacagcaaccaggaacgggttacattgcctggaggtgctgaacttggtcctgtctattcacagcgtcatttccaggtctaaataactctcagcctaaaagaactcttcaatagttacaaaaattctaagagatatggatgcattgtataatggcagcacttctggtttctgtggtacataaaaaggtgcatsttacaactttatggcatcttggattcgatgaaatatagtatttttcatactatctgtacacagagaatagtataaaataagagcattgttcctttcttctaatcagtattaaatgctatgcaacctggatatttgaacatacaagctttctgcaaggctgctttaaaacatggtaaagataacacctacatgtgaatcagtaatgaaaggaatatatttttgccctatcaaacagctgagtgaaaagaaagatgtatgggctcatggttccggccgccatttgacagataaatatttata

SEQ ID NO: 25275 - DNA, 601 bp, Human
caggtgtgcaccaccacacccggctaatttttacattttttgtagagacgaggtcttgctatattgcccaggctggtcttgaattcctgggttcaagcaatcctcctgcattggcttcccaaagtgttaggattacaggtgtgagccaccacacctggcccacctttttcttttttttaacacctctgaaatccagatccatcttatgatctgatacctcttataagcccctctgcccacagcaaccaggaacgggttacattgcctggaggtgctgaacttggtcctgtctattcacagygtcatttccaggtctaaataactctcagcctaaaagaactcttcaatagttacaaaaattctaagagatatggatgcattgtataatggcagcacttctggtttctgtggtacataaaaaggtgcatcttacaactttatggcatcttggattcgatgaaatatagtatttttcatactatctgtacacagagaatagtataaaataagagcattgttcctttcttctaatcagtattaaatgctatgcaacctggatatttgaacatacaagctttctgcaaggctgctttaaaacatg

SEQ ID NO: 25276 - DNA, 601 bp, Human
ggccccactgtcctatgatttacttttataacacagggactggccaaaagaagttttacagttagaaagtaacttacaaaactatctcaatgtcctcattgtacagatgaggaaactgaaggcaagtttcaaaatcacagagctactcagggctaaggatgcaagctgccctcaggtggcacacaaacaacatttattttaataattatggatttgttttaatgcacattagaaaaaatacgtaactacatatcaaacctatgattaactagatgtagtacagtttccttttaaaatatattttttatgtcaaaaaaaagtagtgggggaagtaattttttttttaagagatggagtcctgctgtgttgtccaggctagactcaaattcctgggctcaagcaatcctcctgcctcaacttccctagtagctgcgactataggcacacgtcattgctcctggcttaaagagaactatgagtaaatattggtataggtggtgtctcggtgtggccaaagttatagagtataggagaccccagactcttgtgacctgagggttcttccgtaatgtcactgtgagcttccgggatacttttctta

SEQ ID NO: 25277 - DNA, 601 bp, Human
gaggccccactgtcctatgatttacttttataacacagggactggccaaaagaagttttacagttagaaagtaacttacaaaactatctcaatgtcctcattgtacagatgaggaaactgaaggcaagtttcaaaatcacagagctactcagggctaaggatgcaagctgccctcaggtggcacacaaacaacatttattttaataattatggatttgttttaatgcacattagaaaaaatacgtaactacatatcaaacctatgattaactagatgtagtacagtttccttttaaaatayattttttatgtcaaaaaaaagtagtgggggaagtaattttttttttaagagatggagtcctgctgtgttgtccaggctagactcaaattcctgggctcaagcaatcctcctgcctcaacttccctagtagctgcgactataggcacacgtcattgctcctggcttaaagagaactatgagtaaatattggtataggtggtgtctcggtgtggccaaagttatagagtataggagaccccagactcttgtgacctgagggttcttccgtaatgtcactgtgagcttccgggatacttttct

SEQ ID NO: 25278 - DNA, 601 bp, Human
gctccctgaatctaagaccagacaagagaaacaaaatctgagacctctcagttcacacaattaccacgtgcccgaaatgcaataacacaaggctgtactcatcttttttgccattttctttccctgctgagttcccagagcattccgggaaaacagcacagcacagagacaggcttgcgaactggcccggtccagtatttaatttggccagggcaggagactttcaaagtttaatttaagaggcaaggtcaagaactgcatacaatctattctcctatttaattaggccagaattaaaatktgggtcagctcttgttacagtacaccactaccaccgacattcctgcaaaacaaagatgaactagcccaatcgatggcctccttattaaaaggaatgtccctcggcacttagggtaactatgcttgacctatattttacagatagtagtatcagacttagtgtcaaattagttagacctgagcttcagaaaaggttaaaaaaaaattcctccctaacataaatactacggccaaatgaaatatttttcagtatacctgataagaagtcaggcaaacaggtcgggcacagtggctcacacct

SEQ ID NO: 25279 - DNA, 601 bp, Human
cctgggtctcttgtccgaggcggccacacacatgtgctgcgatggcactgctgtccacttctttgcctccacaacgagagcttctgcgtccaccaaaccaaatccatagaaatggctaactgaaaagacaggcccttcagagccaggctctcctgcctctcccaggaagggagcaaggctggctcttgcatctgccgggccccatggaggacagagggaccgtaagactcgaggtctcctgggggccccaggctgcaggacgggtccccctgagggctgctcaaaggtcccagctgcctcwctctctctgaacccaactccttctgctaaatttaggagtgtgggtcaggaaacacgtcccgctttggtacagagtagaagtgctgagaaggtctaggagtttctttttttgagacaaagacaggttcctttacattaaaagggcttgtcagcatctatgctccctgaatctaagaccagacaagagaaacaaaatctgagacctctcagttcacacaattaccacgtgcccgaaatgcaataacacaaggctgtactcatcttttttgccattttctttccctgctgagttcccagagca

SEQ ID NO: 25280 - DNA, 601 bp, Human
taccctggcccctcttaagttcccataaacaccttcattctaattacctgtaagtcatatatttgcatcaatgtatttccccttgtttctaagtttgttaaagaaatgactccatagcctcccaaaaaccatgtgcgaagctttggaattaattcccagcccctgagcgcaagagaagttggcagagagcagcctgggagcaccttccccacataccacccgagcctgtctgtattcccgggacaggcccctgctggtgcaggttctgcagggcagcccacgactgggtgggagagctggyggggggacaaacagtgctccctgtggtacacatgctcgattcaaaagccaactgaataggattaaatgacctttaatgcacttctaagcaaagaaggcatagccagaattccacaaatccctccgctaaacaacaaaaaacgaaacaacaactcttttgtcacttctctctgaaaaggaaagttttccaggaccttttggaaggcaaggtttcagggagcaacttttaaggtttttggggcctacatgcaagggtctccaagagaaaggaagctgccagcagaaccagtgggagtcccca

SEQ ID NO: 25281 - DNA, 601 bp, Human
tagctagaaagagacagaaggtaccagaataccctggcccctcttaagttcccataaacaccttcattctaattacctgtaagtcatatatttgcatcaatgtatttccccttgtttctaagtttgttaaagaaatgactccatagcctcccaaaaaccatgtgcgaagctttggaattaattcccagcccctgagcgcaagagaagttggcagagagcagcctgggagcaccttccccacataccacccgagcctgtctgtattcccgggacaggcccctgctggtgcaggttctgcagrgcagcccacgactgggtgggagagctggtggggggacaaacagtgctccctgtggtacacatgctcgattcaaaagccaactgaataggattaaatgacctttaatgcacttctaagcaaagaaggcatagccagaattccacaaatccctccgctaaacaacaaaaaacgaaacaacaactcttttgtcacttctctctgaaaaggaaagttttccaggaccttttggaaggcaaggtttcagggagcaacttttaaggtttttggggcctacatgcaagggtctccaagagaaaggaa

SEQ ID NO: 25282 - DNA, 601 bp, Human
atacaaagtggtggggaggggaagggttaagcaaagggcaacccccaacttctgcctggttccatctgagagccttcgctagcccctgtttctgaatctctgcagctccctatagcctacacaagggccacagcctcaggcaggtcaccaaaggagtcaagtgggcccagagtgggcaaggggaccacaccccagaagacagagcaggcctggtcctggggggcttcctgcagatgatgtgggcacagtgccagtcctggtttttgagagaagctggaaatgctgatttgtccatgaaatytctttactctctctacctcttagctagaaagagacagaaggtaccagaataccctggcccctcttaagttcccataaacaccttcattctaattacctgtaagtcatatatttgcatcaatgtatttccccttgtttctaagtttgttaaagaaatgactccatagcctcccaaaaaccatgtgcgaagctttggaattaattcccagcccctgagcgcaagagaagttggcagagagcagcctgggagcaccttccccacataccacccgagcctgtctgtattcccgggacaggcccc

SEQ ID NO: 25283 - DNA, 601 bp, Human
gattccagtgcaccgaggacaaagctggtgccgggcccgccacctgctgccaccgctccagcttgcctgctgcagagagaccaggctgctgggcagtgctgtggggggcacagcacaggccccaatcctctggacaatggccctgtctaccttgcattgctgctgagtcaattaccctgtctcatacaaagtggtggggaggggaagggttaagcaaagggcaacccccaacttctgcctggttccatctgagagccttcgctagcccctgtttctgaatctctgcagctccctatagccyacacaagggccacagcctcaggcaggtcaccaaaggagtcaagtgggcccagagtgggcaaggggaccacaccccagaagacagagcaggcctggtcctggggggcttcctgcagatgatgtgggcacagtgccagtcctggtttttgagagaagctggaaatgctgatttgtccatgaaatctctttactctctctacctcttagctagaaagagacagaaggtaccagaataccctggcccctcttaagttcccataaacaccttcattctaattacctgtaagtcatatatttgcat

SEQ ID NO: 25284 - DNA, 601 bp, Human
gaactgctcgtgcccgtgtgagacctcccacaggcagaggcacagcacggccgggcctcccggcaggagggagaggtgcccctgtgacactcgtgctatgaaaggagaatgtgggatgggctgagcttggtgccagggtctgcctcagggttgattccagtgcaccgaggacaaagctggtgccgggcccgccacctgctgccaccgctccagcttgcctgctgcagagagaccaggctgctgggcagtgctgtggggggcacagcacaggccccaatcctctggacaatggccctgtctrccttgcattgctgctgagtcaattaccctgtctcatacaaagtggtggggaggggaagggttaagcaaagggcaacccccaacttctgcctggttccatctgagagccttcgctagcccctgtttctgaatctctgcagctccctatagcctacacaagggccacagcctcaggcaggtcaccaaaggagtcaagtgggcccagagtgggcaaggggaccacaccccagaagacagagcaggcctggtcctggggggcttcctgcagatgatgtgggcacagtgccagtcctggtttttg

SEQ ID NO: 25285 - DNA, 601 bp, Human
ctgccagcacggaaaacatggagcacatggacacacactcgcccacctgctcagctccggcccagtgcacgcaggaacacggggctggtgtcagacagcttccaactttccaagaaatgccagaaatgaggacttttaaaatctttaaggttaaaaaaataaaataaaaaacaccacggggagcaacatagcatcaaaagctgcagctcgtccgctgacaccgaactgctcgtgcccgtgtgagacctcccacaggcagaggcacagcacggccgggcctcccggcaggagggagaggtgyccctgtgacactcgtgctatgaaaggagaatgtgggatgggctgagcttggtgccagggtctgcctcagggttgattccagtgcaccgaggacaaagctggtgccgggcccgccacctgctgccaccgctccagcttgcctgctgcagagagaccaggctgctgggcagtgctgtggggggcacagcacaggccccaatcctctggacaatggccctgtctaccttgcattgctgctgagtcaattaccctgtctcatacaaagtggtggggaggggaagggttaagcaaagggcaaccc

SEQ ID NO: 25286 - DNA, 601 bp, Human
cggctggagtgaacggagagcccgttgctggcctcagggctgccagcacggaaaacatggagcacatggacacacactcgcccacctgctcagctccggcccagtgcacgcaggaacacggggctggtgtcagacagcttccaactttccaagaaatgccagaaatgaggacttttaaaatctttaaggttaaaaaaataaaataaaaaacaccacggggagcaacatagcatcaaaagctgcagctcgtccgctgacaccgaactgctcgtgcccgtgtgagacctcccacaggcagagrcacagcacggccgggcctcccggcaggagggagaggtgcccctgtgacactcgtgctatgaaaggagaatgtgggatgggctgagcttggtgccagggtctgcctcagggttgattccagtgcaccgaggacaaagctggtgccgggcccgccacctgctgccaccgctccagcttgcctgctgcagagagaccaggctgctgggcagtgctgtggggggcacagcacaggccccaatcctctggacaatggccctgtctaccttgcattgctgctgagtcaattaccctgtctcataca

SEQ ID NO: 25287 - DNA, 601 bp, Human
agtgcagaggcgtgacctcagctcactgcaacctccgcctcctgggttcaagtgattctcttgcctcagcctcccaagtagctgggatcacaggtgcgtgccaccacgcccagctaatttttgtatttttagtagagacaagagttggccaggttggtctcgaactcctgacctcaggtgatccacccaccttggcccctcaaagtgctgggactacaggtgtgagccacccttcctgggctagggtagtttttaaaatgcctgatggcgcaaggacagcactacccagccaaggggtggytcccaataggcctggcaggacctgccctctattatcccaagggcacaacactgggcagcagcaggaggaggaaagtttccagggaagggaaacagggccccaggggagcgggagaggggaggctggggcagcggaaggttcttgtgggtcaggtagccggacgtaagcaggacacgtagggcaaccaggcccctgtgccagggatacatatattatcacactcaagtcttataacagtcctaatgtttacagataagtgaagtggcattttcagagatgaggaataaagagaggcaaagg

SEQ ID NO: 25288 - DNA, 601 bp, Human
cctcagggtagtttttttttgtttgttttttgtttttgagacagactctctttctgtcacccaggctggagtgcagaggcgtgacctcagctcactgcaacctccgcctcctgggttcaagtgattctcttgcctcagcctcccaagtagctgggatcacaggtgcgtgccaccacgcccagctaatttttgtatttttagtagagacaagagttggccaggttggtctcgaactcctgacctcaggtgatccacccaccttggcccctcaaagtgctgggactacaggtgtgagccaccyttcctgggctagggtagtttttaaaatgcctgatggcgcaaggacagcactacccagccaaggggtggctcccaataggcctggcaggacctgccctctattatcccaagggcacaacactgggcagcagcaggaggaggaaagtttccagggaagggaaacagggccccaggggagcgggagaggggaggctggggcagcggaaggttcttgtgggtcaggtagccggacgtaagcaggacacgtagggcaaccaggcccctgtgccagggatacatatattatcacactcaagtctta

SEQ ID NO: 25289 - DNA, 601 bp, Human
ttaagggctgaggtgctgaggcacatcaatggcttcttagtgaagaacctggcaaactgataaagctgctaaattaagtaagatgtgcagtaggataggaggtcactgatcctaaaacacaaattcttgatacaatcacaaaatctgccttggaaaaaaaccaaagtcccaagactcagatgacagctggagtagcctcagggtagtttttttttgtttgttttttgtttttgagacagactctctttctgtcacccaggctggagtgcagaggcgtgacctcagctcactgcaacctccrcctcctgggttcaagtgattctcttgcctcagcctcccaagtagctgggatcacaggtgcgtgccaccacgcccagctaatttttgtatttttagtagagacaagagttggccaggttggtctcgaactcctgacctcaggtgatccacccaccttggcccctcaaagtgctgggactacaggtgtgagccacccttcctgggctagggtagtttttaaaatgcctgatggcgcaaggacagcactacccagccaaggggtggctcccaataggcctggcaggacctgccctctattatc

SEQ ID NO: 25290 - DNA, 601 bp, Human
taagaaatggcaaaggtcaaggctgattttcacactcgatgccaagctgaacccaacacactggggacagaacaaggacaaactgtcttttaagggctgaggtgctgaggcacatcaatggcttcttagtgaagaacctggcaaactgataaagctgctaaattaagtaagatgtgcagtaggataggaggtcactgatcctaaaacacaaattcttgatacaatcacaaaatctgccttggaaaaaaaccaaagtcccaagactcagatgacagctggagtagcctcagggtagtttttktttgtttgttttttgtttttgagacagactctctttctgtcacccaggctggagtgcagaggcgtgacctcagctcactgcaacctccgcctcctgggttcaagtgattctcttgcctcagcctcccaagtagctgggatcacaggtgcgtgccaccacgcccagctaatttttgtatttttagtagagacaagagttggccaggttggtctcgaactcctgacctcaggtgatccacccaccttggcccctcaaagtgctgggactacaggtgtgagccacccttcctgggctagggta

SEQ ID NO: 25291 - DNA, 601 bp, Human
cttcccacccagcaacaatcttacagagaccataactccagtgcccggatgcacgaaagcagacaggggcgggggtccccctggggtaccttcaccgaagcccagagagtgctcactaaggacgccttttgaaagtgcttgtttgtgcaagaatgaaacttccatgtttgatttcaagccagctgtgtgcactgttctctgggagacacaaataaggaaagaggagcagctactcaagcttgtggggaaagttctgtcccttcacctgcagggctgatccagtctcaacaggggcatttgrgggagatgacaatggcagggttggttgcttttcagtgggaatgggaggggcccgtggagagcggggggaggagacagctcccccacccccagcagtaccctccttgcaagtcctgatgagcctccctttacccttcccaactcgaaggtctttcccaactgtacccttgagcccctgggccttctgcctcacacttggttcaggcagaaacaggaagcaactaatcaacatccaatctcttcctgcacccagtgccatcctcagaagtgactctttctgtactggaatcaattccaggtt

SEQ ID NO: 25292 - DNA, 601 bp, Human
cttggatttccaaggtccactgcccttcagccttttctccccagcagtggacagtcatgaattcccagtttgtaaacccttcattggaaagatccagcaacctgcaattggaggtgtggtgtcagaaatgaaggtgctggtactgagtggctgggcggaggggctggcacaagcagggctctcgggggactgtatgacctggctggaccgtacccccagggtagcgggggtctggccccagccaacccgagggcaaagggcacagtgaaatgtgatcgtctttaagctcttacacagactmtctcctccatcacctccttgaacctccttaacattctgagaggaaggcaggcaggcaggcaggtttcatataacccagtgaaagatgtttacaagctctcaccaacagaagcccccagtcccgacaatttcctgcagaaggtggctggctccttcccacccagcaacaatcttacagagaccataactccagtgcccggatgcacgaaagcagacaggggcgggggtccccctggggtaccttcaccgaagcccagagagtgctcactaaggacgccttttgaaagtgcttgtttgtgca

SEQ ID NO: 25293 - DNA, 601 bp, Human
ccatgaagcgttcttaaattaaatccaccttgctgtccacgtggtcccaatcactccaccgcctgagcgtgttctggtccagctgcagctcattctctgggcaaccatgatgttcgtgttgcaatttgtacttaggtctgcttttccctttgcctcaattagcgtgacagttcctccaagccccgctgccttcttgtgtcacttcccgtaactcctagcaggggtctcttcatacaaggggggctccgttcacgtgctgaacagcctggctagcggctgatgcctctctagatgggcttaractgacacgggtttatttgaaaactccaccttcaatcctttgtggaggaaatccaggatttaaaaaaatacacaaacaaataaatgttagaagcaacttgggagttctccatgtgctttgccgttgcgcgctcagaccaactgccgatggacaggagagtttggtatcaccatcttctccaccgttcacgccatccaagaacagcacaccagaacctcactggagcagtatcggacccgagaggcatgcaagacttgggccgattaattgcagacaagaggtgcccacgagaataagagt

SEQ ID NO: 25294 - DNA, 601 bp, Human
gacagccttggggagggtcctgaagcagtgctcccagctgctggtccgggtgtatggacttcacaccccccacccctgttcctgggtctctctgcagtggaaagcttattcataattttgcaaggagcccagtgcaaggttgggggctattcaacagagctgcagggcccccacactgcactgaggtcacccaccggtcaggttaagacgatgcccatccaagggtggagatgcctagatgaatatctgtaaacaaacctccccagtatggctgtccacttgaattgtgtttaaaagccaratatccaggttcctctcgcccatgaagcgttcttaaattaaatccaccttgctgtccacgtggtcccaatcactccaccgcctgagcgtgttctggtccagctgcagctcattctctgggcaaccatgatgttcgtgttgcaatttgtacttaggtctgcttttccctttgcctcaattagcgtgacagttcctccaagccccgctgccttcttgtgtcacttcccgtaactcctagcaggggtctcttcatacaaggggggctccgttcacgtgctgaacagcctggctagcggctgat

SEQ ID NO: 25295 - DNA, 601 bp, Human
caggggtcctccccacgctggtcggcaggagtgacgcctgaagctacagctggggtggactcctgcctactgcccacctgtccctcctacgctgggaaacggcccaggggaccccgacagctctgacacacagggactaagtggggcatgtgaaggcttttgagttactggaagaaaaacctcctcctccgaggtgtgagttatgagaggggatggggagtgagctcaagagtaaagactagtgagttgctggccaccttcatttggtggggacttgaggaaaagacaaaagtcctcattytctgctgcccacagtggggttttgctggggcacgcaaagccctcttcactcgtcttgaagtctccagaccttgccagtgttagacccagtgaggctggcttccctccccgaaggctctctggtgttatttccctagttttcactgggggggctttgcgtgtcccggttcccactgtgaacccctttcagagctgtgtgtatccacgaggacactctagatgctgttcctgggcggtgctggtatcctgggttccagatgccacccaccatttctaaaactcattactaaactcctccccc

SEQ ID NO: 25296 - DNA, 601 bp, Human
ggagtgaaacatccagggtgggtacgccacccggagcagggaggagatgggacttgtgagagcctggaggggtagcggggagggagaggctggaacagctgtttcattcactcacttgcaccagtcatcatgctgggaccagccagcacctttgacttccacgtggaggacagagcaacacaagagggggtgctgagtgtcaggggagctgctggcaagctgatgagccaggaggaattaggtagcccccccgcaactcgctgtggtgggaatggggatggatctccgcatgctcaggacygcctggtggggctgttgctggccaggtctagggtggggcagggacacagctagacagtgctgtcctagggttggggggctgctgttttctgtgctgagggctgagcccctttcagaacatcccctttaggctttccttggagcccttggtgggacggcagctgtgtcttccctcaagttcccaggggtccccagcttctcactccggaggctggtgtgttgttggaaaaacaactgagaactgcaggcgagctgagtagatgccagcaaacctcaccctctaggtccttcccaggtatcc

SEQ ID NO: 25297 - DNA, 601 bp, Human
ctctgagtccgagtcccacctccatcatgactagttgtggcctttgcccctgctcagctttgattccccatctgtaggacgaggaaaacactgcctgtctagtgttcaggggtgcggttgccacctgtgaaatgcccggcaaagacaaacccatcccttccgagcccaactgacgttggtcagcagctccttttcatgtctggaggtctgcaaaccttccgcccacatctgactcccaatttcatctccgcagctctgccgaggagggctctcccccagctctgaccaccaatcccatgtrccctgacccacgcccagcgcacacatcctgtgttacagagaagccgatggcatagtctttcctggaggagaaattacagcacagacagcaggacctcctcttctgatacctgaaatcagactgagttcaagagtggctggccctagccacctctctgcccttgctcagtagtggacgttgactctgttgcaggtgggtgaaattccctggacagccaggatgtctctcagcatcacttggaacttctcctggccaggtctgtggggaagtgctattaactaacaggtctgggtgctttga

SEQ ID NO: 25298 - DNA, 601 bp, Human
aacccaagccctgcttttgtgtctcccagggcgaggcgaattacgaaaacatggcatggggtcttgggcctacaactcctgtccagcccccaccctcctgggacagcaagacacctggccttgcggctctgagtccgagtcccacctccatcatgactagttgtggcctttgcccctgctcagctttgattccccatctgtaggacgaggaaaacactgcctgtctagtgttcaggggtgcggttgccacctgtgaaatgcccggcaaagacaaacccatcccttccgagcccaactgacrttggtcagcagctccttttcatgtctggaggtctgcaaaccttccgcccacatctgactcccaatttcatctccgcagctctgccgaggagggctctcccccagctctgaccaccaatcccatgtgccctgacccacgcccagcgcacacatcctgtgttacagagaagccgatggcatagtctttcctggaggagaaattacagcacagacagcaggacctcctcttctgatacctgaaatcagactgagttcaagagtggctggccctagccacctctctgcccttgctcagtagtgg

SEQ ID NO: 25299 - DNA, 601 bp, Human
acactccaagcagcgccaccgccctgacattcctcaggtttcgagggggttttacctgaatccttctttacagacagtacatttctcaggttcatccacgcactttttacagcttgggtggcatttaaggcaatttttctgacctggagaaaaatagcgagataagaaaagagaagggacgacactgacaggaatgaaatctgggcaagcaggcccccggcatttcaaagcgggggtgcgggtgggctgttccccgagtccacctccggaatgggtggaaataaagcagccagaggccgcytgtacctggtgtggggtcacagaattctcacctcccctttctgaggtaaaaacggtcctcagacaaccaccaggcctctgaggtggttctgcttatttcaacagggatggaggccaattcctggtgggctgagtagagtttaacgaggtggaaatcttcataaacgtggccgggtgtgggcaggtggggggtggagagcctgaggctgccgcttgcccaccacggtgctttctcagggaaacctatgtatgaagatctggctgctctagatggtgagacaggaacctacggcgagtcatc

SEQ ID NO: 25300 - DNA, 601 bp, Human
catccccggcccagacagcgaggggaactggagcaggtggaggtgctggagcgaaaggaggcggatctgggcacagccctgtgctgtacgtgatgtgatcaagtgctgctttgcccaattcgcccatgttgtgtaaaatgtagagattccgcccatcctctccctttccatcctaagtggacacacgatttccaggactcggaatctttaccctcaatggctttgggcctctgacagttcagcttttaggagaaatgcaccaacgtggtaaatccataacacactccaagcagcgccacckccctgacattcctcaggtttcgagggggttttacctgaatccttctttacagacagtacatttctcaggttcatccacgcactttttacagcttgggtggcatttaaggcaatttttctgacctggagaaaaatagcgagataagaaaagagaagggacgacactgacaggaatgaaatctgggcaagcaggcccccggcatttcaaagcgggggtgcgggtgggctgttccccgagtccacctccggaatgggtggaaataaagcagccagaggccgcttgtacctggtgtggggtcac

SEQ ID NO: 25301 - DNA, 601 bp, Human
ccatggtgctagtctccctactatgggagtgtcccccaaaaaattttgaacagaatgttctaagattttagacagcaattcggaggaacaggtaatgtatatttgattgcattaaatgcagtttggttgcactaaatgggctgaagaaacatttcaaaatattccaagaacaatcattaacccagtagaatgattttaaagaaaatgcatgctgagctttatggggctgagcctgatgaacagggagaaccaggaacgtaaagagcaccctcaggaagccgtgaagatgtcaggagctggsagaaaaagagaagaccgagggatgcagaggagagagggtgggtgagccgctacagcccatccccggcccagacagcgaggggaactggagcaggtggaggtgctggagcgaaaggaggcggatctgggcacagccctgtgctgtacgtgatgtgatcaagtgctgctttgcccaattcgcccatgttgtgtaaaatgtagagattccgcccatcctctccctttccatcctaagtggacacacgatttccaggactcggaatctttaccctcaatggctttgggcctctgacagttcagc

SEQ ID NO: 25302 - DNA, 601 bp, Human
tgggggtgtgttgcagccctccaccgcctcaccctgcaaaagcagctccctgcctggaccgcagcatcctcaccactgccagcctgcggaaatgcagagtcgtgggctctgcccagacctgctgcatcagaacctgcatctggacatgaggtgatccttccagtgcggaccatggtgctagtctccctactatgggagtgtcccccaaaaaattttgaacagaatgttctaagattttagacagcaattcggaggaacaggtaatgtatatttgattgcattaaatgcagtttggttgcaytaaatgggctgaagaaacatttcaaaatattccaagaacaatcattaacccagtagaatgattttaaagaaaatgcatgctgagctttatggggctgagcctgatgaacagggagaaccaggaacgtaaagagcaccctcaggaagccgtgaagatgtcaggagctgggagaaaaagagaagaccgagggatgcagaggagagagggtgggtgagccgctacagcccatccccggcccagacagcgaggggaactggagcaggtggaggtgctggagcgaaaggaggcggatctgggcac

SEQ ID NO: 25303 - DNA, 601 bp, Human
tgaaggcagtagcatagtgcctcctggggaaacttcatctcccctgtttgtaaaatgcgagtaagaattatgtctacttcacaggttgctgcaaagattaaatgaggcaacactggtgcaagcccctggaataagagaagatatgctcagtaagttttcttcctttgttctttactccaaaaaagaaacttcttctatggagaattccagtcctcacagcatttgagaagggagacggggctgggggtgtgttgcagccctccaccgcctcaccctgcaaaagcagctccctgcctggacygcagcatcctcaccactgccagcctgcggaaatgcagagtcgtgggctctgcccagacctgctgcatcagaacctgcatctggacatgaggtgatccttccagtgcggaccatggtgctagtctccctactatgggagtgtcccccaaaaaattttgaacagaatgttctaagattttagacagcaattcggaggaacaggtaatgtatatttgattgcattaaatgcagtttggttgcactaaatgggctgaagaaacatttcaaaatattccaagaacaatcattaacccagtagaat

SEQ ID NO: 25304 - DNA, 601 bp, Human
cagtgacggaagcactgcctctatgtggcggggctaccgacaggaggcgttttctctttagcacaccattcctacattgagtatccgatttccctctcctacaggatgggacgggatgcataaatgcattcccggggacccctcagcacttctctgctgggaaacaggcaggttccagggagctgggaacacagagcctcctcttcctgatgcccccagctaccagcctgggttgaggatccactcctgggctgcctgacctgcagagcctgggacatcaaagctggcctctcccaggccrccagcggaatgcctccttcctcttccaactcttttatctttgggggatccctttcctgggccagttcatcctttcactcctaatcctgccttgtccagccaacaggtttaaatgacagcagatgtgatgcatgactttgggagccttgctttgccttccctctcctggactcctagctgcttggggtcctcttctccccagtactctgatctggaagaaagaggcaggctgaaggaaatgaaggcagtagcatagtgcctcctggggaaacttcatctcccctgtttgtaaaatgcgagt

SEQ ID NO: 25305 - DNA, 601 bp, Human
acttgaaataagacgccctctggagccccagcaggcctgtcagatgcagcccctaccttcctctttcgccccatttgtgccctcacttcactccagccagccgagtgctggacagagacacagatgctgagctagaccacccacgtggatggcttctgccaccttcccagtgttcgaccccaagcaagccagccagcccctctacatctgtttcccttcctgttaattggtttctacatcataaagttgcttggaggactcaatgagctaatacccataaacatttcagtgtctggcacayagcagtgtgaatcaatatcacctactattatctctttagttcctgagattatactgtgtacagtctgtgacgtacatgttctagatgggtttgccatactgagcaagggctctggggtgcatctgtcagacccggagactcctgctatgacactgggatttataataagaaatatgtgaagagaaaaagaaaaaaaaaaggaaatatatgttcggtctttgtcctggcacacagctcctaaaacccttggaattatcaaagtgctaaatgtctttaataactgatagctgggggttcctg

SEQ ID NO: 25306 - DNA, 601 bp, Human
gggggcccagcaggaaggggtacaaggccctgggaagcaaagctcccatcaccaggcagcaggcgccaggctccgtccttgacccagtgatagctttttcttactgtcatttctccaactcgaatccaaaccccatgaagagaagtggagctgtgtgggtcatcactggtggcacgctagctcagtctcagtgtcaagtccctcttgaagtgttggcatttatggcgtgtgacggggctgtcggctacaaggctggccctgaaccccaacccgctcttgcctctcttgcttgaaaccttgraaccttctgcagcttcgcaatgaacttgaaataagacgccctctggagccccagcaggcctgtcagatgcagcccctaccttcctctttcgccccatttgtgccctcacttcactccagccagccgagtgctggacagagacacagatgctgagctagaccacccacgtggatggcttctgccaccttcccagtgttcgaccccaagcaagccagccagcccctctacatctgtttcccttcctgttaattggtttctacatcataaagttgcttggaggactcaatgagctaataccca

SEQ ID NO: 25307 - DNA, 601 bp, Human
gagacttaattcttaaagtattactgcagaaaaagctcatatgatgtgagtttcttagaaaggaccaaagtaccaaggacaggaaggagagaggagaaaacttaacccaaaacatatccgagcccacagactgatggtgcacttcaacttactgtgcaaatagctctgcaaaacaaaatccaataaaatgaatgaattctctgctattctgcataaaaactgtgcctgggagacatctgtgccatcatctttgtgggcaattataatacatgtaaaattgtttatagaattcttttcctcyttgaaaaaatgttcaaaataagtgaagataggcacaaagaactaaggctatgtttgaaaacatccccatccccacctggatccattcccgcctctcccaaagccctctcaatgtttatggtgttgtgtttctgtccgcgccgttccacagcaagagctgagctctgagacaagatggcttatgagtggtgagcatctcttatccctttccccatctgaaataagccactgcctggctgggtttctaatgagaacctcaggctgcgtgttcaaagtgggcctttgcattgttttgggattt

SEQ ID NO: 25308 - DNA, 601 bp, Human
ggggcgcaggggagacccccagagctgtggacctgctcaccaatgaatttaatagctgaagtgatggagaagtcactggtttgagatgagaattccaagggactctataaagctttttgccatcaggcaatctggggactcaaagaaagaaaagtgaattattgaaatcaaagagttgcaaaactgtatgcctgaatgttatggattcaagtgactacgaaatttaaataagcaacatcagtgatgctgcctaatccatctgggctaaataagtcaaagaaataataaaaataatagacaraaaggcgacaggcaaactgctggggaaatctgctgagctgccagcgggtggaacccatccagatgctgagcactgtggccttgagggctgccccaggagggaactgaggaggacatgtctcccctgggtggtctgaggtcagcctggcaatcataggaggacactggccttggccacagccttgttcatcaggcctgtctattccaggacatacggcagggagctgcatggggtgctcatggccggccacgtggggaggggtgtgcccattctgcaggatttctgaggcacagtagtatc

SEQ ID NO: 25309 - DNA, 601 bp, Human
gtgggtctcatacaccaggcggggtgccactctgagtggggtttgggagctgttcagggcctgccgttgtacctctcacgcctcacctgctgaacccgtcttccccactatccttcctccagcaccagggtccttaacacctgtggagcctcccaagtgggaaagaaagctcattcttgtttgtacttaagtttcatgctcaatgtattaagcttcaaagttgttaaaacacatttatttggaggtggtggcgatggtggcacacaaatgtaaattcacttaatgccaccgaactgtatgmctaaaaatagtcaagatggtacattttatgtgatgtgtattttaccgcaataaaaaagctgttaaagtgggttgattttctaagcgacctattttctcaactactaaaaaatatgaatttcataactcagtgaaagtcttttaaggattccattaagtcgcaagtctctatagactttgaacactttaaaagcacccacaatcatagcaataagagcagaacgggctgtgcttatacaggacctgctatgttgtttgcggggcccagtataaagtgaaaacatggagcctttgttcagaa

SEQ ID NO: 25310 - DNA, 601 bp, Human
ttgcagaggttccggagcctggagggctcaagcacaaggccctgggctctggggctggcttcacacctcagaaccacagccgtaagcctgggagggaattctgagctcctgcaggagaagctcctccttggagagtcaggaagagtgaagccgagaaggccacagggttttgagcaggaggcagatgtagggacctcaaggggcctcttgaggaccaccgtcttcatggcaggtgtctccctctcttcctgaggtgcggtggaagagctgtgccccgggggcgggactctgtctggtttakgttgttctggagcagaggctgctcgtatgctttggccaatgccgcccctccccatcactggtctctgggagcatctggtgggtgggtctcatacaccaggcggggtgccactctgagtggggtttgggagctgttcagggcctgccgttgtacctctcacgcctcacctgctgaacccgtcttccccactatccttcctccagcaccagggtccttaacacctgtggagcctcccaagtgggaaagaaagctcattcttgtttgtacttaagtttcatgctcaatgtattaagcttcaaa

SEQ ID NO: 25311 - DNA, 601 bp, Human
gcggagagggttacaggcagggaggagattatctcaggggctctatgataatcacaatgcccaggtaaacctcctcacagctgcttcagttcgattgtggtcgcagatcgaggccttgcagtctgctctggactcagatggggcctctcgctgcatcaagggaaaatccctttgcagaggttccggagcctggagggctcaagcacaaggccctgggctctggggctggcttcacacctcagaaccacagccgtaagcctgggagggaattctgagctcctgcaggagaagctcctccttkgagagtcaggaagagtgaagccgagaaggccacagggttttgagcaggaggcagatgtagggacctcaaggggcctcttgaggaccaccgtcttcatggcaggtgtctccctctcttcctgaggtgcggtggaagagctgtgccccgggggcgggactctgtctggtttatgttgttctggagcagaggctgctcgtatgctttggccaatgccgcccctccccatcactggtctctgggagcatctggtgggtgggtctcatacaccaggcggggtgccactctgagtggggtttggga

SEQ ID NO: 25312 - DNA, 601 bp, Human
acgtcagagaggggcagtgaagtagtcactgactgacagcggagagggttacaggcagggaggagattatctcaggggctctatgataatcacaatgcccaggtaaacctcctcacagctgcttcagttcgattgtggtcgcagatcgaggccttgcagtctgctctggactcagatggggcctctcgctgcatcaagggaaaatccctttgcagaggttccggagcctggagggctcaagcacaaggccctgggctctggggctggcttcacacctcagaaccacagccgtaagcctggragggaattctgagctcctgcaggagaagctcctccttggagagtcaggaagagtgaagccgagaaggccacagggttttgagcaggaggcagatgtagggacctcaaggggcctcttgaggaccaccgtcttcatggcaggtgtctccctctcttcctgaggtgcggtggaagagctgtgccccgggggcgggactctgtctggtttatgttgttctggagcagaggctgctcgtatgctttggccaatgccgcccctccccatcactggtctctgggagcatctggtgggtgggtctca

SEQ ID NO: 25313 - DNA, 601 bp, Human
gtccgaggaggacctgtcgacctgggtcagatgttggactagttgactagatagcacctcctctgggccaggtgtctccagggagcaactgatgggacgtcagagaggggcagtgaagtagtcactgactgacagcggagagggttacaggcagggaggagattatctcaggggctctatgataatcacaatgcccaggtaaacctcctcacagctgcttcagttcgattgtggtcgcagatcgaggccttgcagtctgctctggactcagatggggcctctcgctgcatcaagggaaaayccctttgcagaggttccggagcctggagggctcaagcacaaggccctgggctctggggctggcttcacacctcagaaccacagccgtaagcctgggagggaattctgagctcctgcaggagaagctcctccttggagagtcaggaagagtgaagccgagaaggccacagggttttgagcaggaggcagatgtagggacctcaaggggcctcttgaggaccaccgtcttcatggcaggtgtctccctctcttcctgaggtgcggtggaagagctgtgccccgggggcgggactctgtctgg

SEQ ID NO: 25314 - DNA, 601 bp, Human
ggttggctcagggtccgaggaggacctgtcgacctgggtcagatgttggactagttgactagatagcacctcctctgggccaggtgtctccagggagcaactgatgggacgtcagagaggggcagtgaagtagtcactgactgacagcggagagggttacaggcagggaggagattatctcaggggctctatgataatcacaatgcccaggtaaacctcctcacagctgcttcagttcgattgtggtcgcagatcgaggccttgcagtctgctctggactcagatggggcctctcgctgcrtcaagggaaaatccctttgcagaggttccggagcctggagggctcaagcacaaggccctgggctctggggctggcttcacacctcagaaccacagccgtaagcctgggagggaattctgagctcctgcaggagaagctcctccttggagagtcaggaagagtgaagccgagaaggccacagggttttgagcaggaggcagatgtagggacctcaaggggcctcttgaggaccaccgtcttcatggcaggtgtctccctctcttcctgaggtgcggtggaagagctgtgccccgggggcgg

SEQ ID NO: 25315 - DNA, 601 bp, Human
aagagatctttgggaatggtgttgacaggtgtttggtgtgtacagccagggcgttttcaacaacagagaaacaaatgcctaagactaagggtttatagggcagggaggagagactcgaagacacaacagttctgagcaaagggccacgagtcatggaggaaaaccttcaggttggctcagggtccgaggaggacctgtcgacctgggtcagatgttggactagttgactagatagcacctcctctgggccaggtgtctccagggagcaactgatgggacgtcagagaggggcagtgaagtrgtcactgactgacagcggagagggttacaggcagggaggagattatctcaggggctctatgataatcacaatgcccaggtaaacctcctcacagctgcttcagttcgattgtggtcgcagatcgaggccttgcagtctgctctggactcagatggggcctctcgctgcatcaagggaaaatccctttgcagaggttccggagcctggagggctcaagcacaaggccctgggctctggggctggcttcacacctcagaaccacagccgtaagcctgggagggaattctgagctcctgcagg

SEQ ID NO: 25316 - DNA, 601 bp, Human
ggcatgagatgatctcagagggagcacacctgcccactggccgtgccacgatgatgggccctgtttccaacaggcctaggcccacctctgctccctgaacacttggaaatccagtgccaaagtcttcatataaaaaatataaaacagctcatttattttttgtatggatacatgttgaaatggcaatattttagacacattaggttgaataggatatgttactaaaattatttttgcctgtttcatttgactgtttaagatatggttactaggcaacttcaaattgcacccgtggcttgcrtttgtggcccttccattgcacagaacgctgtagaagatgacgggggaagatgaaagaagagatctttgggaatggtgttgacaggtgtttggtgtgtacagccagggcgttttcaacaacagagaaacaaatgcctaagactaagggtttatagggcagggaggagagactcgaagacacaacagttctgagcaaagggccacgagtcatggaggaaaaccttcaggttggctcagggtccgaggaggacctgtcgacctgggtcagatgttggactagttgactagatagcacctcctc

SEQ ID NO: 25317 - DNA, 601 bp, Human
tgtggggcaagcccggcatctcttctgggtagaagccctcaccacaggctggcacacacttccagtcgtggaagtggaagtttttcgcacagtgaatgcactcttctctgcctggccctgagagacacaggaaaagaagcaggtatcagggatggctggcagaagaccatgccccaggcctgcttcagggccttgtgagatcaggggtaccattcaggagcccccaggccaccaccacagctgccatttcccaggttctgtgagctgggccgtcctcacccactcccaggaggtgggcatygccatcaccatttcacagacggggacatcgaggcatgagatgatctcagagggagcacacctgcccactggccgtgccacgatgatgggccctgtttccaacaggcctaggcccacctctgctccctgaacacttggaaatccagtgccaaagtcttcatataaaaaatataaaacagctcatttattttttgtatggatacatgttgaaatggcaatattttagacacattaggttgaataggatatgttactaaaattatttttgcctgtttcatttgactgtttaagatatggttac

SEQ ID NO: 25318 - DNA, 601 bp, Human
tccccgccaggaggaccgtaccttcgacacactttgtggggcaagcccggcatctcttctgggtagaagccctcaccacaggctggcacacacttccagtcgtggaagtggaagtttttcgcacagtgaatgcactcttctctgcctggccctgagagacacaggaaaagaagcaggtatcagggatggctggcagaagaccatgccccaggcctgcttcagggccttgtgagatcaggggtaccattcaggagcccccaggccaccaccacagctgccatttcccaggttctgtgagctrggccgtcctcacccactcccaggaggtgggcatcgccatcaccatttcacagacggggacatcgaggcatgagatgatctcagagggagcacacctgcccactggccgtgccacgatgatgggccctgtttccaacaggcctaggcccacctctgctccctgaacacttggaaatccagtgccaaagtcttcatataaaaaatataaaacagctcatttattttttgtatggatacatgttgaaatggcaatattttagacacattaggttgaataggatatgttactaaaattattttt

SEQ ID NO: 25319 - DNA, 601 bp, Human
ggctggccacagaatgcctcctgttgcctctcctcagaaggctctgcatcaggtcgaggtggtcgttcaggccatgagactcctgaagacacagacagaacacggtaacaaggagagctcggcttgctcaaaggagagcgctgcgggggatagaatcttctggtctggctttggaattggactttctaagccactgctgcagtttcagaagtagctgactatgtagaaatagatactccggccccagtggtcatacattttatgccctcaaacctatcttatttatagtctgaccaaaccrtccccagactgctcagtggcaggcaacgagcaggtagactgctggccctttgtcacatgtgaggatggcccagggttcgccagctgggccggggagatttactacacagccgcagaaaagcacggggagaagagtgatgtgtgatgccaagcgcctttcttttctgctttggtcttgaagattcagtaaacttatggtcccagaagctgctccaaagccagagctgtggattcccagaattcattttgttcctgttagtttgtcggaagactggagccaacaagcagcatttgagaggat

SEQ ID NO: 25320 - DNA, 601 bp, Human
ttacattttgttcagaggaattgcttggccatcggggtaccttttggctggccacagaatgcctcctgttgcctctcctcagaaggctctgcatcaggtcgaggtggtcgttcaggccatgagactcctgaagacacagacagaacacggtaacaaggagagctcggcttgctcaaaggagagcgctgcgggggatagaatcttctggtctggctttggaattggactttctaagccactgctgcagtttcagaagtagctgactatgtagaaatagatactccggccccagtggtcatayattttatgccctcaaacctatcttatttatagtctgaccaaaccgtccccagactgctcagtggcaggcaacgagcaggtagactgctggccctttgtcacatgtgaggatggcccagggttcgccagctgggccggggagatttactacacagccgcagaaaagcacggggagaagagtgatgtgtgatgccaagcgcctttcttttctgctttggtcttgaagattcagtaaacttatggtcccagaagctgctccaaagccagagctgtggattcccagaattcattttgttcctgt

SEQ ID NO: 25321 - DNA, 601 bp, Human
aacccagaaggtgctcccgccgctgccagcctggacccgacccaggcccctcccgcctgaggccctgccaagaactgcccagcccggacacagaggaggttcccgcgtggacgcagggaagagcctcccattgccccagtggaggaagctgcccaggggccaaggatgagtcacaggttcgaggaatcacatggcgaggctgtgggcggggatcttgtctgccctcctcctacataaggccccctgagcccacactgcctcagcatccctctggctccagagctcagagccacccacagcygcagccatgctgtgcctcctgctcaccctgggcgtggccctggtctgtggtgtcccggccatggacatcccccagaccaagcaggacctggagctcccaaaggtttgaggctgggggagcgggcactttactgtgggaggcctggggcgggtgggagctgcgggcaggcgggaagcccaggatctcagaaacctacaggaagcacagaatggacgccatgacgtcaggaagccctcagccctgctctccatctttagggtggcctctctggtttcccagcatcctaggtgactcattatt

SEQ ID NO: 25322 - DNA, 601 bp, Human
atagcccaggatctggtagatagcagacaaccatccaatgctcactgtacccatcccagttagactcagccccgtctgcaccgggtgcaacgagagccatggtggggtgggaccgccgtgcagcccaaggccccctcagttggcagggacctggcactccatggccatggcgaccaacaacatctccctcatggcgacactgaaggcccctctgagggtccacatcacctcactgttgcccacccccgaggacaacctggagatcgttctgcacagatggtgggtttctcatcattgagaygggctgggcgggggctcagtctcccccctcaggggtccaggactgggtgggttgggcggagctggacttagccccaggcattttctgacagccaggggcttcactgtggcccttccatgagggtggggtggaaaaccagggctccagacgttccctgtccccttggatcccctgccccaggctctgggccaacagccaaccacacagtgcagccccaggtcagactgaggagaaggtctgggcggctgcgggctgcggtgctccttggacccggggaagttcccgtggtgacctgatttt

SEQ ID NO: 25323 - DNA, 601 bp, Human
ccatccaatgctcactgtacccatcccagttagactcagccccgtctgcaccgggtgcaacgagagccatggtggggtgggaccgccgtgcagcccaaggccccctcagttggcagggacctggcactccatggccatggcgaccaacaacatctccctcatggcgacactgaaggcccctctgagggtccacatcacctcactgttgcccacccccgaggacaacctggagatcgttctgcacagatggtgggtttctcatcattgagacgggctgggcgggggctcagtctcccccctyaggggtccaggactgggtgggttgggcggagctggacttagccccaggcattttctgacagccaggggcttcactgtggcccttccatgagggtggggtggaaaaccagggctccagacgttccctgtccccttggatcccctgccccaggctctgggccaacagccaaccacacagtgcagccccaggtcagactgaggagaaggtctgggcggctgcgggctgcggtgctccttggacccggggaagttcccgtggtgacctgattttaggagtgacagtgaaggcaactccaattca

SEQ ID NO: 25324 - DNA, 601 bp, Human
cactcatcctattgtcaccacctttcagggagaacaacagctgtgttgagaagaaggtccttggagagaagactgagaatccaaagaagttcaagatcaactgtgagtgtccccaggccccaagggctggctcagtgctggcatgctagccacgctctcccagaggcggctctgctggggcatgagggagtggggcctggcctgtccccactctctctgcttcagggagtcagagtgtttactccggtcaacctgatgctgaccccagaggcatcttttacctggagggcaggggaagcaytaattcttggcatgacatgactggatgtgggtctgcactgtgcccaggcacaggggacaggtgctttgttgcactgttcactctggcctcacaaaaggccagggaggctgcaggcgagcaggtgggcaggtgggcaggtgggtaggtgggtaggtggatatgtatacaggtgggcaggagggtaggtgaacaggtgggtaggtgggcaggtggctaggtgagtaagtggttaggtgaacaggtgggcaggtgagcaggtggttaggtgaacaggtgggcaggtggataggtgaacaggtg

SEQ ID NO: 25325 - DNA, 601 bp, Human
cagctctggtcttaggctgagctcccaggcctctctgggggaagagagaggggcttacagcatgtccttggtccactgaattcttcctaacaatttgcaacattttgttctattttgttaattattatttttttaaaaagacagaggtggtcagggtctggggcctcttatcccctcatgggcacattttcccagcaaatacagtttgcttctcatgcttgggacttgcctcaggcctttctgaccctgcttgccctccccagaatcgagccactctccaaggtccatttcttctccctcytcccgcccctgtgccctgttcctgtgccatctcccgccatcctcacccgtacgtgacttctcagttggagtctctccaggtcacagcctccctgcctgccgtgtctgcctctccacggcacacctggcctctccccctcagccggggctccatggccctccacattgcctctcctcccctttcctccctggcttccctgatcatggtccacagcaggggccacgtcccatggtgtcagtggatgaggaagccacttagtgtggtgggatgtccacacacctgcacaggactctgctgaga

SEQ ID NO: 25326 - DNA, 601 bp, Human
ccacagcaggggccacgtcccatggtgtcagtggatgaggaagccacttagtgtggtgggatgtccacacacctgcacaggactctgctgagacggaggcttcatcttccttttggttcttctcttctttccccagatacggtggcgaacgaggccacgctgctcgatactgactacgacaatttcctgtttctctgcctacaggacaccaccacccccatccagagcatgatgtgccagtacctgggtgggtctcacagcacatgagctcaacgtgggtgagaggcagcagctacgtccrtggctgggaaccctggggagctgacaactggcttcctgtccacctcggtgcctgtgggctgactttttctttcttggttttttttatttgtttgttgtttgctttgtttttttgagaaagggtctcattctgtcactcaggctggagtgtagtgacgtgatctcggctcactgcaacttctgcctcccagattcaagcgattctcgtgcctcagcctccagagtagctgggattacaggcgcacgccaccatgcccagctaatttttgtattttttggtagagacggggtttcaccatgt

SEQ ID NO: 25327 - DNA, 601 bp, Human
gttacatggaagggcatgagaagctggggacctgcaggtctcggtcccacgttcttttttttttttctttttttaagatggagtctcgctctgtcaccaggctggagtgcagtggcacaatctcagctcactgcaacctcgacctcctgggttcaagcgattctcctgcctcaaccccccgagttgctggaaccacaggcgtgtgccaccatgcccagctaatttttgtatttttaatagaaacggggtttcaccatgttggccacgatggtctcaatctcttgacctcatgatccccccsctttagcctcccaaagtgctgggatttcagtgccacattcttaagggggtgtcctcaagcccaccacatccttccagggctcccccgaaacaccctgctcttcctccctctacttaagtgacctgtaaacccaacagctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatgg

SEQ ID NO: 25328 - DNA, 601 bp, Human
catggaagggcatgagaagctggggacctgcaggtctcggtcccacgttcttttttttttttctttttttaagatggagtctcgctctgtcaccaggctggagtgcagtggcacaatctcagctcactgcaacctcgacctcctgggttcaagcgattctcctgcctcaaccccccgagttgctggaaccacaggcgtgtgccaccatgcccagctaatttttgtatttttaatagaaacggggtttcaccatgttggccacgatggtctcaatctcttgacctcatgatccccccgcttyagcctcccaaagtgctgggatttcagtgccacattcttaagggggtgtcctcaagcccaccacatccttccagggctcccccgaaacaccctgctcttcctccctctacttaagtgacctgtaaacccaacagctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggag

SEQ ID NO: 25329 - DNA, 601 bp, Human
tccccccgctttagcctcccaaagtgctgggatttcagtgccacattcttaagggggtgtcctcaagcccaccacatccttccagggctcccccgaaacaccctgctcttcctccctctacttaagtgacctgtaaacccaacagctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccackgccatggggaggctgctccctgggggcagagtctctggcagaggttattaataaacccttggagcatgtcctgtctggatgcgcagccactgctgggtgtgggattcagggacgagggcctggggtcggggcaggcccaggccaccgcctggcagaaccggagctcctacagacccatgggcagcttctggtggagaaaatacctcaagtttcttatctacaaaataaaagggtccactttcacaaacttgtgaaatgtctagaacaataaaaccaggacactcatatcagaattgatga

SEQ ID NO: 25330 - DNA, 601 bp, Human
agaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcsgagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaacta

SEQ ID NO: 25331 - DNA, 601 bp, Human
gctctcctacagtctcttgggatcccctaaccagagcctttttgccatagggctgcacactggtcaaatcagtactgcccgtccagtccaagacacagattcacccaggcagactctcacggtcttgatcaaagacaatggggagccttcgctctccaccactgctaccctcactgtgtcagtaaccgaggactctcctgaagcccgagccgagttcccctctggctctgccccccgggagcagaaaaaaaatctcaccttttatctacttctttctctaatcctggtttctgtggggttygtggtcacagtgttcggagtaatcatattcaaagtttacaagtggaagcagtctagagacctataccgagccccggtgagctcactgtaccgaacaccagggccctccttgcacgcggacgccgtgcggggaggcctgatgtcgccgcacctttaccatcaggtgtatctcaccacggactcccgccgcagcgacccgctgctgaagaaacctggtgcagccagtccactggccagccgccagaacacgctgcggagctgtgatccggtgttctataggcaggtgttgggtgcagagagc

SEQ ID NO: 25332 - DNA, 601 bp, Human
cccagggtcctcagttttgagctgccaagctgaggttctaacctggctcaactcctaagtttatgctctttctactatagggaccatggctgcctttggatccagcctcggcttctctattacctgagcaggatgagaggctgtcctcttcctcgagctctgctttattcttccagatcagggttgccagataaaatacaggatgcccagttacagttgaatgtcagataaacagcaagtactatttcagcataagtcagtctcaaatgttgcatgagacataatgtactaaaaaaaaaaatgctcattgtttacctgaaattcaaatttaactgggagccctgtacttttatttactaaatctggcaactctaccccagatgtctgtgaggttaagtggggccaggcctacagctgacggaaggacagagagagaggtggcagggactgctggcctcctgaggcagagctgtcccaggtctggtggggctatgattccagagaggccagagactgagtatgaaagtggcaggcggctgggtctgaggagatgccaagttggcctcttgagggaaataaacaggtatatttagctgttgtg

SEQ ID NO: 25333 - DNA, 601 bp, Human
tatagatgggaaaacaggcttgagccacgcagagacttgaccaagctcacacagttccttagtggcagagcagagcaaatattctctttcttttacattctggatttccatatcttctctccctcctggtccagcccaacctcagggcaccccccacgaggtgggcgggggatggctttgtcacttgcacccactcggggtgctactcagagatcttgggtgcacataggacgtgggtgggccgagcttctagctactccgtcaggcccttcctgtcattctgtctctgcctcccttctcyctgcttctccgtgttcctcctcattcttttctgtgtgcagggagactacaccccccaccccgctctttctctggcgcctctgaggtcccccctctagcccctaaatcactctggaatcctggctctttgaagccagatctgggcccccctcccctaccccttccattcccaggctgggaaaggctgaagaggctgacggctggaggggagggggcggggcggtggcggatctggcttccttttggagttaattagggaaaacagagaaatgtcagcggaatgaaagggctgggggtgggg

SEQ ID NO: 25334 - DNA, 601 bp, Human
ttgatgatgtattgcacaggatgaagcaccatctcatttagtcctcacagcagccttcacagtgcgtacaaatcagctggcaattccgagaggctgcattctaaacaagttcctgggtgatgctgagccagggccagagtgtggacttctctgggccccagtttcttcttctgtacagtgggacgttggactggaggtgctgtctgatgtcacctagctgtggcactctgagcctgtgcctaaagtgtccctgagatgtctagtccccgagatcatcatctcctcagcttcatagagccgrgctcttctccatcttctctctacctcccattcactcagaacagggataaggtccaagctgctggtggtgatggtgactgactgtcccttccagcatgcgcttaggtacacttgggcctgaatgcccctctaacaaatgctaccgggtatggccttggtccttctaacacttggttccctcatctgtaaaatgagggtcataccacatagctggctgggctgttatgtagaggttaaaagtgattgtgcatgtgaagcatccagcagagtgcctggcacacagtaggtgctcaaatgctgt

SEQ ID NO: 25335 - DNA, 601 bp, Human
gaccctaagtttagctcccacctgatcttcctctgtctctgcagaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcrgcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaat

SEQ ID NO: 25336 - DNA, 601 bp, Human
agcagatgcttttgagaaatactgacacagagttttgattttctgtagcttcgtgactcggtaaaaaggtacgacttacttggtgcttcaaatactagcgccaaggtatccgcgttatcttcggcccttagtgtaatgatatcttcattgccggcgcattttagtattttggacatactagaagacaggagacacatgctttaaaatcaacgccgtctgctgaagggctgtatttcgaacgcggttagaaggggttaccactctcacccatcaggccgtctcagaactggtggagggtaarcggactgctggaggatgccattattaatgcagacgttttgggacgcatctggcagtatttatactaaaataccaccagcagtgtcccttctggatagaaacaatctcctgccactaagtaggatgacaggctgccacatttctcgcaagggcattataaagcatttaaagtcaaccgcgactgagccgggaggatcgcttgagcccagaagttggagaccagcccgggcaacacaccgagaccgtctcagaaacaagaaagccacagctaaagcgtccattcaaggccaacaggatttag

SEQ ID NO: 25337 - DNA, 601 bp, Human
ctgtgtacagcactctctacaatgagaaactgatactcactggaattccaagttgttcaacatctaaatccatcaacttcatttcatagtctgaaactttctcctggtctaccaaaagaaagcagatgcttttgagaaatactgacacagagttttgattttctgtagcttcgtgactcggtaaaaaggtacgacttacttggtgcttcaaatactagcgccaaggtatccgcgttatcttcggcccttagtgtaatgatatcttcattgccggcgcattttagtattttggacatactaraagacaggagacacatgctttaaaatcaacgccgtctgctgaagggctgtatttcgaacgcggttagaaggggttaccactctcacccatcaggccgtctcagaactggtggagggtaaacggactgctggaggatgccattattaatgcagacgttttgggacgcatctggcagtatttatactaaaataccaccagcagtgtcccttctggatagaaacaatctcctgccactaagtaggatgacaggctgccacatttctcgcaagggcattataaagcatttaaagtcaaccgcga

SEQ ID NO: 25338 - DNA, 601 bp, Human
gggctaccaattggacccacaacatgtaagctaatattaggattacataagtgctccaaacaggtagacttttactcctaaccatatccttctattgagctgctgtcctatgctcaattatttggtaagagagtaagtatctccagaaagctaaaggttatacgcctaacttcccaatcctacccttaagagccggtgtggacttgatccataaaccactgttctgtggtatgtacacgtgctgaatttgtattcccttcttgcaaatataattctaaattggatgacacttataaatcaktcgcagatttcaacagtatctcaattttcagaaattacttgggatccaattctgtctacttttaattttagcaattaacctaataagcagtattataattctcttcaaactattttctttttacttaaaaactacttacagcttcctcctctttatcgacattacttgtctgtgacaatttaatgtttccatttccaagttctccacttgcagaaaatttcactccgtcttttgcacaggaaattacaacagcatctccaatatggctgagatctcggcatatacgtgcaaattcaccag

SEQ ID NO: 25339 - DNA, 601 bp, Human
actctcaaagttgcatggagtctgctttctagccttagtgagaagtctccttcctgtttaacctttgattcctacagcctgtgactttggctaaattgtcacttaaggttgctcagcctgcttctccacctttaaaatgggctaccaattggacccacaacatgtaagctaatattaggattacataagtgctccaaacaggtagacttttactcctaaccatatccttctattgagctgctgtcctatgctcaattatttggtaagagagtaagtatctccagaaagctaaaggttatacgcctaacttcccaatcctacccttaagagccggtgtggacttgatccataaaccactgttctgtggtatgtacacgtgctgaatttgtattcccttcttgcaaatataattctaaattggatgacacttataaatcattcgcagatttcaacagtatctcaattttcagaaattacttgggatccaattctgtctacttttaattttagcaattaacctaataagcagtattataattctcttcaaactattttctttttacttaaaaactacttacagcttcctcctctttatcgacat

SEQ ID NO: 25340 - DNA, 601 bp, Human
ctctcacccccgaaacaaaacaccctgaatatcaaggctccagggctatagctaccagtctgtaggacacacagggtagaggaatttatgtatacacaggaatgcaatcagcaaaatccaaactctggaaaacttaataaatgatctaatttcttcaacaaatagattgtaatggaagggggaaaatgaaattaggggaaaccaggctaggtgtgttggcacacacctgtagtcccagctacttgggaaactgaggcaggaggatcacttaagccctggagtttgaggctgtagtgaaccractgcaccaccgcactccagcctgggtggacagagcaagaccctgtctcaaaaacaaagaaaaacagaaaaagaaaaaaacgaggttggcaggagtggaaatgtgattcaggaaacagataaagaatcagctcctagactttattaatttaaaaaaaaacctttcaactgaattttacctttatttaaactaaatgttgactacccattcaagggacaagagagcaatatatagtatttattgtaagcttataatatgccacacacagcatatgctaagctctttaatgctaccgtattt

SEQ ID NO: 25341 - DNA, 601 bp, Human
gcaaacacatccagacaccctgtgcctcctactagaggcacacaccaccacctatattcttgctctctcacccccgaaacaaaacaccctgaatatcaaggctccagggctatagctaccagtctgtaggacacacagggtagaggaatttatgtatacacaggaatgcaatcagcaaaatccaaactctggaaaacttaataaatgatctaatttcttcaacaaatagattgtaatggaagggggaaaatgaaattaggggaaaccaggctaggtgtgttggcacacacctgtagtcccrgctacttgggaaactgaggcaggaggatcacttaagccctggagtttgaggctgtagtgaaccgactgcaccaccgcactccagcctgggtggacagagcaagaccctgtctcaaaaacaaagaaaaacagaaaaagaaaaaaacgaggttggcaggagtggaaatgtgattcaggaaacagataaagaatcagctcctagactttattaatttaaaaaaaaacctttcaactgaattttacctttatttaaactaaatgttgactacccattcaagggacaagagagcaatatatagta

SEQ ID NO: 25342 - DNA, 601 bp, Human
tttgaaatccttttgatctccatcaggctgctctaaactgaaaaaccatttaaacgaaagggtagctgtagctgggaattcagtaggatacttccaacagtcctggtcaaaatgaagacactgccctgtgatgtttgaaattcaagtaactttatttaaattcaaaaacaattcttaaaactgcatttagagtcaagacccttttgtattataaaaatcacaagtatttctaagagacaaaaatacttctaggttaactagaccagatctgactttggactttattctttaaacaaattgsagagaatagagaaaaaaataggttatttacagaaaacaatatctacatatgtacttagaggtacaaatttggtgacagaaaagacttcagtatatgctggcatcttagaagcagttctcaaagagcttagttttattttcttgaattttaagaatgcctaagatccttcttcatcctcgatcttgggagccaagtagtattttaagtgtcccatatccgcaattttatactctacaactgaaagacaggaagatggttaattactgaggagtatgtatcacatatgactacctacaaaac

SEQ ID NO: 25343 - DNA, 601 bp, Human
catttttccagcctcccatctccaggcagggcactttaacccaatgcatgtctattcatcaaagctgagccctattctagtacctcccagacctggcttccaggaagttcttctacatgtctaccctcaacttctcctgctgcatgtattccaaaactcagctggctccaccacgtcctgttatcctaggtgaatccctttcattatctgagacacagcttttccacttaacctctaaggccccttctggctcagccattgcaggattcctatgcaagttcattccttgatgcttagcctmaggcttcctcctccagaaagctgtctcagaacacccatccagacccttcacttccccatgaaagtcctctgggcagggaccctgcctcttccttcctccttggccctgagtgaggtacagcatagagctggtcaaaggatttgggggtggggtgggaagcgtggggcaagggcgggcacctaccactcgggggagcacagctgacagggcctccttgacagcacgttgcaggcctgaaatgtcgatgacagagcccagactcagcaaggcgtcctggaagagaggagagggcagtgagag

SEQ ID NO: 25344 - DNA, 601 bp, Human
gccatttttccagcctcccatctccaggcagggcactttaacccaatgcatgtctattcatcaaagctgagccctattctagtacctcccagacctggcttccaggaagttcttctacatgtctaccctcaacttctcctgctgcatgtattccaaaactcagctggctccaccacgtcctgttatcctaggtgaatccctttcattatctgagacacagcttttccacttaacctctaaggccccttctggctcagccattgcaggattcctatgcaagttcattccttgatgcttagcytaaggcttcctcctccagaaagctgtctcagaacacccatccagacccttcacttccccatgaaagtcctctgggcagggaccctgcctcttccttcctccttggccctgagtgaggtacagcatagagctggtcaaaggatttgggggtggggtgggaagcgtggggcaagggcgggcacctaccactcgggggagcacagctgacagggcctccttgacagcacgttgcaggcctgaaatgtcgatgacagagcccagactcagcaaggcgtcctggaagagaggagagggcagtgag

SEQ ID NO: 25345 - DNA, 601 bp, Human
ccctcctcctgggctctgaacttctaggaggtttggggaaggcagagctgaggagagggaatggggctgcttagataccaagtcccatttatccctgtcatgctgtgtgaccttgggacaagtgccctctctctctgggcctccggtggttcatccatcaagcagattcagggacaatgggctctggagggatgggaaggtcacattctgagttggccatatttcctggagcagaggctgcccttggccgggtttagagtagggaagaggacattcaaggctatcaggactcagttagggmatctcctcctccaggaagtcttccatgccccttaggctggatcagactcccttctccaggcttcaaacgtcccctgcttccctctttctggtgcaactaacaccctgctactttgggcctcaagggctggtttacccatcctcctgcctaagggatgaacagtggccattgaagccaggtaggggagtggcctggaacagatgatgaggggcacaatctccccagtaaggcactctgggctcaggcaaccatgatcaccccaaacctgccccaaacctgcaactcatccatggtattggg

SEQ ID NO: 25346 - DNA, 601 bp, Human
cctgcctgtgaaacagagccagtcacttcctcctcccaccctacggcagcctcagtggccacagaggctctcggggcagccctacagaaaccgacctgccagtttccaccaccctccctttccagatgtgccttcaccccaggccagatgttgccttagtcccgtccttctccaggaggatttatttttgggcgccaacacaccacccacttcctaccaatttcacactcaataaagctcactcattagccctcctcctgggctctgaacttctaggaggtttggggaaggcagagctgargagagggaatggggctgcttagataccaagtcccatttatccctgtcatgctgtgtgaccttgggacaagtgccctctctctctgggcctccggtggttcatccatcaagcagattcagggacaatgggctctggagggatgggaaggtcacattctgagttggccatatttcctggagcagaggctgcccttggccgggtttagagtagggaagaggacattcaaggctatcaggactcagttagggaatctcctcctccaggaagtcttccatgccccttaggctggatcagactccc

SEQ ID NO: 25347 - DNA, 601 bp, Human
ccagccagcccccaccacaggagatgcctggccactacttccagagacactgagccaggttccgtggtgggtgtggcatggggtgggaatgataaggcctgaagggagtgagaggggcagacaccctcttgtttggctggaaggaaacctaagtgggatgttcagggataaagaattcagtgggaaggaggccgcccactcttcggctatatctagcctccttgtcatccatctcttccagcagcctgggaggggcctgagttatttggcccaaagaggttaagagaccagccggggttayacagaaagtcctgcccaggcagagggaggggtgggtagtccatgggggcagagggggacagattctcgcttcacttccgcatgtccgtatgtctcccacccccttactctcagccctctgggttaaaattagctgagtctattggagagaaggagggaaccatttcagacacatcagcaccatctgcattcggggctgcctgccacaatgggtgctgatgaggaagccaggtgccagcagctctcctccctgggcgggggtcccctccccatctctgcttccctccctgggggcagcaga

SEQ ID NO: 25348 - DNA, 601 bp, Human
ctgaccaacccccatgcaacgcagccttgtccacaactctgctgttttctccgcaggaggatggagaagggcttgcctcccagctgagggtatcctggagggctttgggaggagctgacagtggagctacgtgttgaaggcccaccctcagtaagtgtggaatccttcccagaagaagcagttgccttccatgactctgagagcgtccacaatcctgccagccactcttcttgtcatcagctgtcgccagccagcccccaccacaggagatgcctggccactacttccagagacactgagycaggttccgtggtgggtgtggcatggggtgggaatgataaggcctgaagggagtgagaggggcagacaccctcttgtttggctggaaggaaacctaagtgggatgttcagggataaagaattcagtgggaaggaggccgcccactcttcggctatatctagcctccttgtcatccatctcttccagcagcctgggaggggcctgagttatttggcccaaagaggttaagagaccagccggggttatacagaaagtcctgcccaggcagagggaggggtgggtagtccatgggggcagagg

SEQ ID NO: 25349 - DNA, 601 bp, Human
gacaaatcacctcccacctgggatatttccctgcctgactccagcctcaggcattcagcaaacaataactgagcatccactctgagctgtaccagggatggggctcagaatgttctaggaagcatccctccttcacctctacaagaaaccacacacccataaccccagccaggggaggaacacagagcagggcactgcgccatcctccggtggggctggagagggcttcctggaggaagtgacctttcagctgtcactgagtgggaattagacacattcagggagtgggcagggtgcagamtgggctcccaggccttatagcaggtacacaggtaggtccagaggcgtataaagcatggagcatttaggaacagacagtgagggaaggggcacaggggctgggcccaaggtcagtagggctgagtgggatgggcttacgaacagaactggggcagggcaggacgtgcacagggagacgtgagcagatttgtattttggaccgattactcctcagagggagatcaaagctcttgctctttaatcctccctccccaagggcccagagcagctctggcctcagttccaggccatgtcttggcag

SEQ ID NO: 25350 - DNA, 601 bp, Human
gactttcccctcctggggcagctcatgtggggggtcctcacacaccagctgggactcaccatccagtaggtaggtgtagacagtttcctaggacagaaggcacttatgagaccctgtggagaggccctcccagctgcccagtcccagcctgtacacaggggtctgtggggcaaggtcatggaacctgtgggagtggagctctggcaatgatctgtttgtttttctctccaggtgattctaagatgcagccagggcagcaaaacacccggtgaactaagcacctcgtcctctcctcttggamggaattctaagcaggcaatgattcatgaacctatgaccttttttaccacccaaaacccaatgtgccaggtaaagagtttcaaggactgagggtgcagacaaatcacctcccacctgggatatttccctgcctgactccagcctcaggcattcagcaaacaataactgagcatccactctgagctgtaccagggatggggctcagaatgttctaggaagcatccctccttcacctctacaagaaaccacacacccataaccccagccaggggaggaacacagagcagggcactgcgccatc

SEQ ID NO: 25351 - DNA, 601 bp, Human
ccaaggaatcccacctggcagggaggcggggatcaatgttggaaggggagggtcagaccagatgaccttggatggtgcctcagccctgagaatccttggccatgcaagagggcaatgggggtgcagagaatggctcaccggactttcccctcctggggcagctcatgtggggggtcctcacacaccagctgggactcaccatccagtaggtaggtgtagacagtttcctaggacagaaggcacttatgagaccctgtggagaggccctcccagctgcccagtcccagcctgtacacagggktctgtggggcaaggtcatggaacctgtgggagtggagctctggcaatgatctgtttgtttttctctccaggtgattctaagatgcagccagggcagcaaaacacccggtgaactaagcacctcgtcctctcctcttggaaggaattctaagcaggcaatgattcatgaacctatgaccttttttaccacccaaaacccaatgtgccaggtaaagagtttcaaggactgagggtgcagacaaatcacctcccacctgggatatttccctgcctgactccagcctcaggcattcagcaaaca

SEQ ID NO: 25352 - DNA, 601 bp, Human
ctcatctgatgagttccacttcctctcactttcccctaaacagccaggagtcagaagacccgagtcctaggcctggctctgcctcatacctggcatgtggccttggtcatgtctcatgatatccacccatctggaagatgaggaggctgaattaaatgggcatcaaggtatcagggggccaagtgccctgatcccatgatcctgaagtcagtgattccagcattctctcacaatggtaatccccaacagacagccctcaccatggatcaggcctgatttaaatgctttacatgtgtgacayatttaatcctccccacaatcctataagcaccattattatcaccatttcataaacaaaactgaggcacagagaggttgtgtcatttgcccaaggttacacagctagtaaacagggagctgagatttgaacccaggcagtggggctccagaaccctcagcaggacgctgcctgtgatctccctgttctcagatgcaaggagttggcactgtgagctcctgcaggcccagcatgctgggattccaggtccagcctcgcagtagttctcacagcatgccggtgttctaactgatacaccccata

SEQ ID NO: 25353 - DNA, 601 bp, Human
tcaaggtcactcaaggctaatcattggttgggacttgggagtgcaagtagcaatcactgagctcctactgtgtgctgggcactgtgccaagcacttggcccctgttaccccattaagccaatagaccgggcctcaggtaggaaagcagagagacagggagggggctgagctagaatccagacctgtctgaatcccattccagtgctcttccctcgtccatacacctgggtctcaagtccccatcctgctgggagctcctgagagcagggcccagccaaccctggggcctctccgccctaaytgtggagatgggctcaccaccagacaccaggcacaaaggtgggcaagcagagctcagataccagagagagcactgggcctgggccttcccccaatcctttttcaggtagcagctgagcctggcaagccactcacctttcacaggggccatggaaagaattcctgtttggggatgatgacgggtgtgtcctgatgatgggtatgtcccctgggaggtccttgctgtcctcactctcttgccttctcatcccctggccctcctcctggaatcttcagcccctgtctaccagcaggcactcac

SEQ ID NO: 25354 - DNA, 601 bp, Human
ctcaccctctcactgagcccccatccccccactcagcccctatctaccactgagcccccatcccccactgagcccccatcccctcactgagacccaatcccctcactaagccctcaccctctcactgagccccatcacctcactgagcccccatcctctcactgagccccaccctgtcactgagcccccatccccccactcagcccccatctaccacttagccctcatcccccactgagcccccatcccctcaccgaggtctcatcctctcactgagcccccatcccctcactcagcccccatcccccactgagcccccatctcctcaccaagcccccatcctctcactgagcccccatcccctcactgagcccgaataccctcactaagccctcaccctctcactgagcccccaccttctcactgagacccaatcccgcactgagcccccaccttctcactgagcccccattccctcactgagcccctatcctctcactaagtccccatcccctcactgagccgcaacctctcactcggcctcatcccctcactgagcccccatcctctcactgagctcccatcatttcactaagccccc

SEQ ID NO: 25355 - DNA, 601 bp, Human
gctgactccccaccccctcactgagccccaatcccttcgccaggccctcaccctctcactgagcccccatccccccactcagcccctatctaccactgagcccccatcccccactgagcccccatcccctcactgagacccaatcccctcactaagccctcaccctctcactgagccccatcacctcactgagcccccatcctctcactgagccccaccctgtcactgagcccccatccccccactcagcccccatctaccacttagccctcatcccccactgagcccccatcccctcacygaggtctcatcctctcactgagcccccatcccctcactcagcccccatcccccactgagcccccatctcctcaccaagcccccatcctctcactgagcccccatcccctcactgagcccgaataccctcactaagccctcaccctctcactgagcccccaccttctcactgagacccaatcccgcactgagcccccaccttctcactgagcccccattccctcactgagcccctatcctctcactaagtccccatcccctcactgagccgcaacctctcactcggcctcatcccctcact

SEQ ID NO: 25356 - DNA, 601 bp, Human
agctatggcaccaagaggctaattcacttgcccagggttacacagtgaataagcggtagagccaggatttgaacccaggtaggtggcaccagggctaggtctaaccactatgctggaaccttcccaaatacctgtggaggtgtgagctttgaacagggggcaggtgtgagtggcagggtatgacagtggcagaggggtggtgggaaccaaggcaggggaggttggtatgggaagaatgagtttctctctgtcccaccacacaacccacctcctctaccccccagcctctggctcatcccgyttaattaagcacctgagtttgcaccaaatgtcactccttgatgattaattgtcctgggttcttcatccctcatgctgcctccacttaattgtgcttgtaggaactgcctggcctggacagaagagaaacttggggaactgtgtgcatacagggtcactaagggaagcccagcaaaggtcacatgaggaaaaggagggggtggcctgcaagtcacgagatcactaggtcagagactctagacaaatcgaggaccaaagaggttgagcatctcgttcaagctcacgcagcattctgaaccaa

SEQ ID NO: 25357 - DNA, 601 bp, Human
ttctgcagctcagacctaggactcctggatctccaccctaccccagcagacctcaggcccgggctctgacacctacctagtcccaggctctctagtgtccacctcctgcaggagctccaggccctgaaacccagcctgtttgcttggactccagagaccagcatcctatcagcatctctttgcatcaggactcagcccctcatctgtctacttctccccacctatgtgacacagcacaaactgctcatcctgccagcccaagtgtgaacctgcacccaggacagaaatggctcatcagacrcagcactgtttctccctgaactaagatccatttgcaataaaattcaggcacctactgcctgtttatgagttggtgtaggatatgaaatttatttatgacaccatttctagaccccaggtttgtcctcagttctcgagatatcctttccaactaagcctccaagcctgctttcctgtccactgtgccctgcccacaaaaaaagagatttttgtgtatcatttttatagctgccctgtcaggggctcaaaagatccacagcttttcccagtccccaagcatattccctttagccactgtcca

SEQ ID NO: 25358 - DNA, 601 bp, Human
ctatgccctgaaaatgagctttgagtcttatgaaatggggccatgactatatcacccatgcccagtgcagagcctggtacagaggaaacacttcggaggtctttgctaatgtcgtcagtgtatcctatccctggccttgccaccagccccatcccactcacagctgaagggcttctggagcccctgttctctggctacttagctgtgtttcaggaagcttctctgtagtcactgcactgagctgagccccaccctggctcatgcagtcattcaacactcactccctgaaatgcgtgggacmcagagatagccctgcccctgccctgggcctcaaagctgccaccaaggccccatccttatttcctgctgataccacctcttctccagctctggggccatcctagaacccaatctcacagccagcagcaagaagtcatggcccctgctggacccccattcactctaccttcccttccccaaaggccttcccaaggccatctggtcagcactgggatggcaacattaagtgctcaatatttgtttgctgaatggcataaattctcccaccattaggatgcccacaagttccaaatgccaccaa

SEQ ID NO: 25359 - DNA, 601 bp, Human
tcctgggtctgtctgcacacctttcttacatttgtggtccctcagctagccccacccacctgtcacccctcaacccagaacatctctcagcttcagccacacaaagatcctcatcattctgagaaaaccttgggctctttcacaccttcatgcttttttttctacactgttccctcggcctagaatacccttctcactctcttccctctatgccctgaaaatgagctttgagtcttatgaaatggggccatgactatatcacccatgcccagtgcagagcctggtacagaggaaacacttyggaggtctttgctaatgtcgtcagtgtatcctatccctggccttgccaccagccccatcccactcacagctgaagggcttctggagcccctgttctctggctacttagctgtgtttcaggaagcttctctgtagtcactgcactgagctgagccccaccctggctcatgcagtcattcaacactcactccctgaaatgcgtgggacccagagatagccctgcccctgccctgggcctcaaagctgccaccaaggccccatccttatttcctgctgataccacctcttctccagctctggg

SEQ ID NO: 25360 - DNA, 601 bp, Human
ccaggcagagagaacagtgcactcacccaggtgggtgaagaggttctttgccacttggagaagagcctggaatgaaggaaatggagatcataggggggtcggggtgtaggggtcaccctatccaaccttctgcctccaacagcacccgggtcttctccttccttccctagggctcactggacaagccagaaactgtcagtgtctaattatatcatttggctactaagtgaaggagtgagggaatagccccggtgcaggtgaggagtctcctgagtgtctcagccgccttcacgccagctcyagctgcctaggtgttgctgtagtgcacatattgaacactagagggcgatcacatacagtgcctgcgggcagtggcgcgggtcctgaacaactgcaagccttcaagttatgaggttatggagccacctggggaagggctgccaccagtccagaaagacatgggcatttcccttctgaatggctctcggggctgaaaactgagcgagtcggtgcccgagagaggctgaaggcaggtcactcacctggcactcacacttgagtttctgttccttctggaaggccagggtgctggtgagcacgg

SEQ ID NO: 25361 - DNA, 601 bp, Human
cccggacacccctagggccacatactccctccacgccctctcacctcatcatccaccacgcccccgtcgaacaccttggccaccagctcattctgatccagcaggaacacagagcagctgtggagggaggggtttggtcctctggggcctgacaaccccctctgatcgccctcacgtcccataaggaggcaaaggccggatttccgaggcctgggaggagtgctccaaggtaagacactctgctcagggctggctggctccagaaacgtgtccattcaagtgttttgttttttttttttttggaagcacctactatgtgccaggcactgtgataggagctgaggatccaaagccagccctgtccctgctgtattggagcctacagtctagcgagggagacaggcatgaaataaaggatccctcaaaaggtgatgaagtcccgcagaaggcagagaaagggaagtgggtggggcaggaaaggagatgatggggactgaaggccacagcctctctcgccctgtcccctgggtagagtcactcacatctctgcgttgctgaggtttctggcctccgtgatgatctcctggagcaggacagagac

SEQ ID NO: 25362 - DNA, 601 bp, Human
tgccctgatcggccgggatgcggatctcatagctctgccggagcagagatggagtcgagaggaagaagttagtgacccggccacagaggggactgttaaacctcgggccgctccccagcgccgccggcggactcccggacacccctagggccacatactccctccacgccctctcacctcatcatccaccacgcccccgtcgaacaccttggccaccagctcattctgatccagcaggaacacagagcagctgtggagggaggggtttggtcctctggggcctgacaaccccctctgatckccctcacgtcccataaggaggcaaaggccggatttccgaggcctgggaggagtgctccaaggtaagacactctgctcagggctggctggctccagaaacgtgtccattcaagtgttttgttttttttttttttggaagcacctactatgtgccaggcactgtgataggagctgaggatccaaagccagccctgtccctgctgtattggagcctacagtctagcgagggagacaggcatgaaataaaggatccctcaaaaggtgatgaagtcccgcagaaggcagagaaagggaagtgggt

SEQ ID NO: 25363 - DNA, 601 bp, Human
gagaaggccgtcgccaggtcctcgtcgaacttgctgaaccatggcccattgatcttgttcaccagctcggccacaccgatgacctctggggaagggagaggggcaaggaaccaccggtggagggagggatcggttggagggagggatccggccgggacctgccctcgcagtttccgcaggttacgtacgtcccaggcatggaacccgactcccttatgctccgggacgccggaggcggtggggaagtgttgccacccccgctcgctcggacccgccccgcccggcgcaggccccgcccctscgcccgggccgccacgcgcaccctggttctcgttcttgatggggaagcagaggatgttgcgcgtgcggaagccggtgctgtcgtccacgccgcggtagaaaagcggatgggcatatgcgtcagggatgttcaggatctggcccgtggtcgccacgtgtcccgcgatgccctgatcggccgggatgcggatctcatagctctgccggagcagagatggagtcgagaggaagaagttagtgacccggccacagaggggactgttaaacctcgggccgctccccagcgccgccggcggactcc

SEQ ID NO: 25364 - DNA, 601 bp, Human
ttgtacctagggaagccatggggacgggtcctgggtgagcttcctagccctcagtaattcccaagatgggaattattccctgaacatggggaatacctggctgaaccaattactccctgggctggttcctctggctacttccagccttgggactgagctcagaagcagcttggaggagaggtctctaagcaggggtgggagctgcccctaaggagggcaggaggcctgctgtggctctgggcctatcctctcatcctcagtagagattgatcaggaagccctgcctggccctgggtccccrgggaatctgggaggaggaccagaggtctctgcaagcctcaccttcatgtggtacatcatcatctcattggccaggtggctgcgatactgagcctcattcacttttttgtataggagagactaggggaaagagggaaagatggggctcaaggaaggtggctgtgaaaatttagcaatgcccaggactgggatgaaggggtcaaaaagacaccccacttcctgtcccattctggccccagtcaaaaccttcaagctccagtccacagtaaagacctcacccccactttcatccagacccccg

SEQ ID NO: 25365 - DNA, 601 bp, Human
cctcgggcagggaacgaggggtataggtgaaacttgcaaaattggagtcaatggcagccacaggctggatcccatcatggagaagtttggtatactcatcgtcggagacctagaggagaccagccagagcattagaagacagccttcaccccatctggtgtcttcaccctcaaattcccatggcaggtgggggatccgtcacccagaatgtaccacagttgggccaccacgctgtggactgtaactgggcaggaaatcaccaccctcccctcacagccctgcagcccaccccgcgcgcctycctgcaggtgaccaccctttatctgtaacagcataaccttggcaaagatcgacaacaccccttcatgacacccccaaaccatggcagcatttcatacacagtaactgtagcagtcctccttttgtggagacctttctactctctaaccttaactcttcctactacagttttgatccaactcacaaggtctgggcctctctggtttggacacaggtgagaggaaatgtccaaatgaacagcgactaccatatacatggaactaagccagcttttgtgacccagggtagggaatgggataga

SEQ ID NO: 25366 - DNA, 601 bp, Human
gaatgccgggggcaatggatgtgacagtagaggaaagagggaggcgaagactggggctgtctgtgggcgcacgaaccgggccagggtcgggcagtcaattttgtagttgttgatgaaattcatgtcctgcagcatgctcaggatggcctggagagggcagagggaggtatcagaggggctgccagtatcaagacagggcccttgcctgggtccttcttcaagctccacactcaagatctggagtcttagaaacttacatctaaactagagaaccacaaaatagttgaagcaaccgttctcrgagctatgcatttttagagatctaagaactaagaactcttgaaaccaagcccacacaaaatgttagaaaaacagggttgggagggatgcaaaccctgaggtcacatgccctgggcatggttggtccaagagcagcccttgggatcatccagtccagcctctagcccctgggcaggccccatggcttcctgatggcagactacaagcccctccatctctgagggaccctccacagccttccttgatgactctgtcttcccaggaagttcttgatgcgcatttaacttaagcctctggctac

SEQ ID NO: 25367 - DNA, 601 bp, Human
ctctcctcctccatcacggccccatgatggcaaactacatgtcccctccatccctgagggaccctccacagccttccttgatgactctgtcttagcaggaagttcctatgcacatctaacttaaacctctggctacacactctcggccttgcctccaggctttgccttgcctcatttcttgcctttattgacagttcagtgtctaggaattgcttctcattcatggatcctccccacccccataagactgggtctccccagtcatccttagagagatcctctccagaatgccgggggcaayggatgtgacagtagaggaaagagggaggcgaagactggggctgtctgtgggcgcacgaaccgggccagggtcgggcagtcaattttgtagttgttgatgaaattcatgtcctgcagcatgctcaggatggcctggagagggcagagggaggtatcagaggggctgccagtatcaagacagggcccttgcctgggtccttcttcaagctccacactcaagatctggagtcttagaaacttacatctaaactagagaaccacaaaatagttgaagcaaccgttctcggagctatgcattttt

SEQ ID NO: 25368 - DNA, 601 bp, Human
gtagcccttcttcaccatcaaacagaacctgggggagggaagagggcagaagaggggcctcagcctctcctcctccatcacggccccatgatggcaaactacatgtcccctccatccctgagggaccctccacagccttccttgatgactctgtcttagcaggaagttcctatgcacatctaacttaaacctctggctacacactctcggccttgcctccaggctttgccttgcctcatttcttgcctttattgacagttcagtgtctaggaattgcttctcattcatggatcctccccayccccataagactgggtctccccagtcatccttagagagatcctctccagaatgccgggggcaatggatgtgacagtagaggaaagagggaggcgaagactggggctgtctgtgggcgcacgaaccgggccagggtcgggcagtcaattttgtagttgttgatgaaattcatgtcctgcagcatgctcaggatggcctggagagggcagagggaggtatcagaggggctgccagtatcaagacagggcccttgcctgggtccttcttcaagctccacactcaagatctggagtcttagaaa

SEQ ID NO: 25369 - DNA, 601 bp, Human
gacaccccatggagggtccccactgtgagcagggcagggtctcaccgaggccacctggaaagagttgtttgtgcctctgtggtccaggtcatgacacatgcaggaaataaacaaggcaaagatctcgatgtccctggttgagaggcagaaaggagaaaaaaaagaggtcagcccacagttccctccctaaatccccaagaggacagacaggagatgacatgcccaggagccactgggacaggaggttggaacacctgggttcccttcctggaaagaagcactggtttggagtccagcagamccgggtttaaatcaggctcagtcttcactagctgcttggctgtgagcaagcccctcctggaagatggggctcacagccttcccctctagtcccctggggctaagaagatcccatgaggcagtgcgtgtaaagtgcctgacacacagggggtgcttccctgtcccagggaaggggaccccagtggctgccagatgtgggggagatgcagccactcactcgaggtagttggtgagctccaggttcttgtagagcaggtagcagaagtgggagacagaaaaggcgtgcatccagttgtggtag

SEQ ID NO: 25370 - DNA, 601 bp, Human
gagaggatgagactccaagacaccccatggagggtccccactgtgagcagggcagggtctcaccgaggccacctggaaagagttgtttgtgcctctgtggtccaggtcatgacacatgcaggaaataaacaaggcaaagatctcgatgtccctggttgagaggcagaaaggagaaaaaaaagaggtcagcccacagttccctccctaaatccccaagaggacagacaggagatgacatgcccaggagccactgggacaggaggttggaacacctgggttcccttcctggaaagaagcactkgtttggagtccagcagacccgggtttaaatcaggctcagtcttcactagctgcttggctgtgagcaagcccctcctggaagatggggctcacagccttcccctctagtcccctggggctaagaagatcccatgaggcagtgcgtgtaaagtgcctgacacacagggggtgcttccctgtcccagggaaggggaccccagtggctgccagatgtgggggagatgcagccactcactcgaggtagttggtgagctccaggttcttgtagagcaggtagcagaagtgggagacagaaaaggcg

SEQ ID NO: 25371 - DNA, 601 bp, Human
tccctagaccactctgagcctcagactcctcagctgtcacatgcagggacccaacaaggtaagctctggggtccctgaaagctggaacatttttgaaatgatcctttggagtcctagacaccaaatcatgcagaacacatttgtttgctgacaaggagaggcagtgatgaggcaagggcaaggcccccatttccggatgctgaagggctgtcactcagaaaaggagcagcttatctcaggggggcagagggcagaaccagcactgccaccaggcctcctgggagagagacagagaacctcrtctctgggggtgtgcaagcaggggcagcctctggagaggtgttgtgggaagtagcatgaggcaaggtgaccttggaaatgtgtctcctactctgtgccaagccctgtgccaagtgcagggaactcagaaatggctcagaccttgtgcacgaggaggtaggcagacccaaaccaaacaatctaaggtgacgctaagtgatgggagtggagcccatcccaagtttggcaggagggggctgaatggggtgttcccaggcagccaaagggaaacacgctgaacacaaatccttgctatcatccg

SEQ ID NO: 25372 - DNA, 601 bp, Human
cctactggacacccccacccatttgcccatcccagtgagcctccactccttggctccttatcccacctccagccagctcccagctccccctcaatccccaccccacccccaaccccatcaccttccgggagaaatgatcaaagatgttgcagccgtgggtgttgaggatggcgatggcctgagcaaagtggtgcctctggggggagaggagtgatgggggcccagctggggcagatgggctcccttaccattgaccccaagagaggaagcaggggcctcgtccagctccagcccccaggtmagcagagcagtcagaaagggggagtcaggggccccagttccctttctgagctctgtttcaaccctctgtgtgacccagggtgagtccctagaccactctgagcctcagactcctcagctgtcacatgcagggacccaacaaggtaagctctggggtccctgaaagctggaacatttttgaaatgatcctttggagtcctagacaccaaatcatgcagaacacatttgtttgctgacaaggagaggcagtgatgaggcaagggcaaggcccccatttccggatgctgaagggctgtcactc

SEQ ID NO: 25373 - DNA, 601 bp, Human
agggtgggcagcctgtgccttcccagggaggactacacctaccgcgatctttctcgtagtcttccagcccttggtctggtcagagaggtcacaggaggtcatgaggaggcagaggagaagtctgtggtgctgcttgttgtttcggtcgtagcccactgttgaggggaggatggggtcaaggagcggggcccagcctctttgcccttctgaggacaaggctcccagggcccaacccagagcggtccagggaattgggcacccttgatgggagccaaggggccagtgctgggtctgcctgggrggggccgtgcagccagagaagggttgatgttgcaggggatgggtctgcaccctgggaatgctcccctggcaaatccttcccctggttgttcctccccagccccaaggactggggctaacagcagtcaccctcagccatcttctggaggtccttgaagatgcggagatggtgggccaggtctgtggccaagatgatgtcccgcatcagatccagcatgcgctgatagtcctgaggcgagggcaggggtgtcatgccctcctactggacacccccacccatttgcccatcccagtgagcctc

SEQ ID NO: 25374 - DNA, 601 bp, Human
cagccaggctgagctgagcagagagagggtattcaggcacagggggcacccaaagctgggcagggtgggcagcctgtgccttcccagggaggactacacctaccgcgatctttctcgtagtcttccagcccttggtctggtcagagaggtcacaggaggtcatgaggaggcagaggagaagtctgtggtgctgcttgttgtttcggtcgtagcccactgttgaggggaggatggggtcaaggagcggggcccagcctctttgcccttctgaggacaaggctcccagggcccaacccagagyggtccagggaattgggcacccttgatgggagccaaggggccagtgctgggtctgcctggggggggccgtgcagccagagaagggttgatgttgcaggggatgggtctgcaccctgggaatgctcccctggcaaatccttcccctggttgttcctccccagccccaaggactggggctaacagcagtcaccctcagccatcttctggaggtccttgaagatgcggagatggtgggccaggtctgtggccaagatgatgtcccgcatcagatccagcatgcgctgatagtcctgaggcgagg

SEQ ID NO: 25375 - DNA, 601 bp, Human
gggcaacagagtgagactccatctcaaaaaaaacaagaacttccacaagaatgtgagacagaggaggacacctaggaaagcatgatggtctctttccactgaggaccaaggatgaagtgaaggacccactgaggggcacagcgggagacagttatgcccagaggcaaggggatgaatcagttggagctgggccaggccaatctcagcacctgtgtttcctgtgatgtccccactccagcctaccctctctgtgcagggtgcagcttgtccccatgagctcactcacttgtagatgggcatygcaatgtgctccatgaagctgatttgcagctcagggatataggccttctcccggtccatcatctccatcggcctgttgcccatggccttctcctgcaggcatcgagtcgtcaggcctgtccctctcattcctccatcgggtaccagggtcaggctagttcaagccctccctgtcccaggccaggaaccctcccccatcctggacatcctggggtcactccacacataccaggtctccctgggagaagaattctttgtagatcagctcctgaaaggccaacactctcatcacatcctctat

SEQ ID NO: 25376 - DNA, 601 bp, Human
gatggtgaacttgtgggacaccttggtccagtgctcacggttggaggccacgcgctcatacagctctgccgctttggggaacaggtcctgcaacagcctgcgggtgcatgggggcagagggtgagaggccagaaatcagaccatgggcagcaagaaagactagggctacacaacaaatagaatttccacaagggccaggtacggtagctcacgcctgtaatcccaacactcagagatgccgaggtgtgtggatcacctgaagtcaggagttcaagaccagcctgaccaaaatggtgaagcyccatctctactaaaaatacaaaattagctgggcgtggtggtgcatgcctgtaatcccagctacttgggaggctgaggcaggagaatcgcttgaacccaggagggggaggttgcagtgagccaagatcgtgccattgcactccagcctgggcaacagagtgagactccatctcaaaaaaaacaagaacttccacaagaatgtgagacagaggaggacacctaggaaagcatgatggtctctttccactgaggaccaaggatgaagtgaaggacccactgaggggcacagcgggagacagtt

SEQ ID NO: 25377 - DNA, 601 bp, Human
gtccagcgagttgttacttgggaggccgcggatggtgaacttgtgggacaccttggtccagtgctcacggttggaggccacgcgctcatacagctctgccgctttggggaacaggtcctgcaacagcctgcgggtgcatgggggcagagggtgagaggccagaaatcagaccatgggcagcaagaaagactagggctacacaacaaatagaatttccacaagggccaggtacggtagctcacgcctgtaatcccaacactcagagatgccgaggtgtgtggatcacctgaagtcaggagttcaagaccagcctgaccaaaatggtgaagccccatctctactaaaaatacaaaattagctgggcgtggtggtgcatgcctgtaatcccagctacttgggaggctgaggcaggagaatcgcttgaacccaggagggggaggttgcagtgagccaagatcgtgccattgcactccagcctgggcaacagagtgagactccatctcaaaaaaaacaagaacttccacaagaatgtgagacagaggaggacacctaggaaagcatgatggtctctttccactgaggaccaaggatgaagtgaagg

SEQ ID NO: 25378 - DNA, 601 bp, Human
gggatcactcagcatcaaggctgcagcagccattgatgggggccctagtgccatccagatcaggcacctcgtactcctcatccaggaagtccagcgagttgttacttgggaggccgcggatggtgaacttgtgggacaccttggtccagtgctcacggttggaggccacgcgctcatacagctctgccgctttggggaacaggtcctgcaacagcctgcgggtgcatgggggcagagggtgagaggccagaaatcagaccatgggcagcaagaaagactagggctacacaacaaatagaayttccacaagggccaggtacggtagctcacgcctgtaatcccaacactcagagatgccgaggtgtgtggatcacctgaagtcaggagttcaagaccagcctgaccaaaatggtgaagccccatctctactaaaaatacaaaattagctgggcgtggtggtgcatgcctgtaatcccagctacttgggaggctgaggcaggagaatcgcttgaacccaggagggggaggttgcagtgagccaagatcgtgccattgcactccagcctgggcaacagagtgagactccatctcaaaaaaaaca

SEQ ID NO: 25379 - DNA, 601 bp, Human
catctggccagaccagtggagggctgtgggaggtggcctgggcagggaagtgtccctggaggggatcactcagcatcaaggctgcagcagccattgatgggggccctagtgccatccagatcaggcacctcgtactcctcatccaggaagtccagcgagttgttacttgggaggccgcggatggtgaacttgtgggacaccttggtccagtgctcacggttggaggccacgcgctcatacagctctgccgctttggggaacaggtcctgcaacagcctgcgggtgcatgggggcagagggygagaggccagaaatcagaccatgggcagcaagaaagactagggctacacaacaaatagaatttccacaagggccaggtacggtagctcacgcctgtaatcccaacactcagagatgccgaggtgtgtggatcacctgaagtcaggagttcaagaccagcctgaccaaaatggtgaagccccatctctactaaaaatacaaaattagctgggcgtggtggtgcatgcctgtaatcccagctacttgggaggctgaggcaggagaatcgcttgaacccaggagggggaggttgcagtgagcc

SEQ ID NO: 25380 - DNA, 601 bp, Human
tcccagtgcatctggccagaccagtggagggctgtgggaggtggcctgggcagggaagtgtccctggaggggatcactcagcatcaaggctgcagcagccattgatgggggccctagtgccatccagatcaggcacctcgtactcctcatccaggaagtccagcgagttgttacttgggaggccgcggatggtgaacttgtgggacaccttggtccagtgctcacggttggaggccacgcgctcatacagctctgccgctttggggaacaggtcctgcaacagcctgcgggtgcatgggggcagagggtgagaggccagaaatcagaccatgggcagcaagaaagactagggctacacaacaaatagaatttccacaagggccaggtacggtagctcacgcctgtaatcccaacactcagagatgccgaggtgtgtggatcacctgaagtcaggagttcaagaccagcctgaccaaaatggtgaagccccatctctactaaaaatacaaaattagctgggcgtggtggtgcatgcctgtaatcccagctacttgggaggctgaggcaggagaatcgcttgaacccaggagggggaggttgc

SEQ ID NO: 25381 - DNA, 601 bp, Human
cttgtccagggtcacacaggaagtcctggtctaggacccaggacccgtggctctgttcccagtgcatctggccagaccagtggagggctgtgggaggtggcctgggcagggaagtgtccctggaggggatcactcagcatcaaggctgcagcagccattgatgggggccctagtgccatccagatcaggcacctcgtactcctcatccaggaagtccagcgagttgttacttgggaggccgcggatggtgaacttgtgggacaccttggtccagtgctcacggttggaggccacgcgctcrtacagctctgccgctttggggaacaggtcctgcaacagcctgcgggtgcatgggggcagagggtgagaggccagaaatcagaccatgggcagcaagaaagactagggctacacaacaaatagaatttccacaagggccaggtacggtagctcacgcctgtaatcccaacactcagagatgccgaggtgtgtggatcacctgaagtcaggagttcaagaccagcctgaccaaaatggtgaagccccatctctactaaaaatacaaaattagctgggcgtggtggtgcatgcctgtaatccc

SEQ ID NO: 25382 - DNA, 601 bp, Human
aggggaagagactcgcccagcgtcacacaggcaggaggaagcatggctggctcattcatacctgggcctgtctcccagtgcggggatccctcctgcccatcaatcccatcctgcttctccccagggcccctctctgcagagcactgagctgcccctctggcagcttcttcctggggcccctgtatcccccaggtcccaatcccaccatcagtatagtagtggtcctcagggggccttcgccccgcggctgtttctagtcctcccacagaactaaggactgtttccaagatgccacactctsctcactcagatgtctcaccttccccttccatgaggatcctggagaccccaaagggtgggagtcctcaaagggaaaggagcaaagatctggtggggcagaaatggggcaaggagaaaccatcaagctgctcagacaaagaatggcttgggaaagacttgccaaggtgtggtcagaggtgcagagtagggcccactgctcattggtcacccctgtgctctcagagaacaaattacaaagtctccgtgaggttggaagtcttgcttccattatacagacgagaaagctgaggcccaggaaggt

SEQ ID NO: 25383 - DNA, 601 bp, Human
tgcagacctcaggggcagtatccttccctacagtactcacaatagtcgaaaggtgggctttggcctggcccacatctattttcctgcctttgggtaacagcaccttgctcttcatttgggaaccacccttcctccagtccatgtgccaagtgagtggcccctcactcacctggcaaaagggtgaacagaggatgtaacttaggccaatcagactctttctcttgagcaagatccttcctgtagcttctccttgaggaagccatccagggattcctgcccatctgcatcttccaagccgcccagctctcccccttagtctttcagctcttgtattagccagagcctgtttctatgacttacaactacagaacactaaatgatgcacctgtattgtgaggtgtgagggaagaatttcatttttcttggtgggtatctcggtgctcccatttgtaaaatgggagagaccatggccttaccaaatcacacttgagctgagtttagggcaactgtttttgggggttctaaaaagttaagtagccgggcacggtggctcatgcctgtaatcccagcactttgggagtccgaggtgggcggatcacaa

SEQ ID NO: 25384 - DNA, 601 bp, Human
aagaagatcgtcgtcaaaaaactttgtttctatgataacgttcccactgtaagtaagaagagaaacagagggcaaaagagagtgagcatgttaggcacaagatttcatttccacaaagtggtttccatctggattcctgggccaatggacatgcacccacccagagtcttagcttggggacattaaaatccttgtctatatggggctacaagtctaacatgacatttaacttatgtggttacattcatccctgtcaagctcacaaatcagaagtgagagcatgtctccactccttggtacmctctaaagcccttagtagagtgctctgcacacagggtgcttatagatccgactgactttctgatactgcattcatggacacctctggctggcttacatatagaagcctgcagacctcaggggcagtatccttccctacagtactcacaatagtcgaaaggtgggctttggcctggcccacatctattttcctgcctttgggtaacagcaccttgctcttcatttgggaaccacccttcctccagtccatgtgccaagtgagtggcccctcactcacctggcaaaagggtgaacagaggat

SEQ ID NO: 25385 - DNA, 601 bp, Human
ttaattacattatgtaataatatcacagtctattttacaagttaaatgtatgagaatgtatgaaatagaaatggtaggaaaaaactaaacatgggtcaggaacacggaatttttccaaaaccaggggccaaaggtagatgtgtagcctgtagggcccaaggaggagacaaggagggtgacaggtacagttaccggtttgtggtatgtgtttgttccctgtgtgtatgctgggaaggacttgagacctgtcccctgccctggtctggggttgggagtttagtctggtcagctggaagatggyggcttgggaaaaagagccatctggttacctacacagagctggtcccctggtggctgcaggtaggttctgctgttgagggaattaggggtgtatgtgtcaaaaatcaaacgtgtggaggaaaaaagtaaacagtttcctcctccctccaaaaaacccaaattcttgaaatgtacacacattcttctttcaaacatagaaaagtctcactctggatgtgcttacaagaagatcgtcgtcaaaaaactttgtttctatgataacgttcccactgtaagtaagaagagaaacagagggcaaaag

SEQ ID NO: 25386 - DNA, 601 bp, Human
tgtggctggaatctcacctttttttttttttagacggagtctcgctctgttgcccaggctagagtgcagtggcacgatctcagctcactgcaagctccacctcctgggttcacgtcattctcctgcctcagcctccccagtagctgggactacaggcgcccgacaccacgcccggctaatttatttttttttttgtattttttagtagagatggagtttcaccatgttagccaggatggtctcgatctcctgacctcgtgatccacccaccttggcctcccaaagtgctgggattacaggsgtgagccactgcgcccggccaacccctctgattcttattgatgggtttattgctttctgcctcttgtctgtgctttgcagttggggtgctgtcagttcccttcacccactcacggaggcatccctgagcccctcagcaccatgacgggcaccccgcagtgctgatggagaatgacccacaaaatggggggcagggtccccaggcacggcgcccctgggaaaggggcctgtctcagagacttggtgctgagctgtgaagccctgcgttccccaaccccacttcatagagggacaagctggg

SEQ ID NO: 25387 - DNA, 601 bp, Human
agttagccctgattccaggctggtgggcgtctcccgggctgttgccctctgattcttttttttttttttttttgagacagagtcttgctctgtcacccaggttggagtgcagtggcgagatcttggctcactgcaacttctgcctcccgggttcaagtaattctcctgcctcagcctccggagtagctcagattacaggcatgcgccaccacacccagctaatttttctttgtgtttttagtacagatggggtttcaccatcttggtcaggctggtctcaaactcctgaccttgtgatccrcccgcctcggcctcccaaagtgcagggattacaggcgtgagccaccgcgcccggcctaaaaaagttttaatacctgccaaagtagccccctaggatcctattccagagctgtggctggaatctcacctttttttttttttagacggagtctcgctctgttgcccaggctagagtgcagtggcacgatctcagctcactgcaagctccacctcctgggttcacgtcattctcctgcctcagcctccccagtagctgggactacaggcgcccgacaccacgcccggctaatttatttttttt

SEQ ID NO: 25388 - DNA, 601 bp, Human
gccgcttctcatcacgcgtcgagttagccctgattccaggctggtgggcgtctcccgggctgttgccctctgattcttttttttttttttttttgagacagagtcttgctctgtcacccaggttggagtgcagtggcgagatcttggctcactgcaacttctgcctcccgggttcaagtaattctcctgcctcagcctccggagtagctcagattacaggcatgcgccaccacacccagctaatttttctttgtgtttttagtacagatggggtttcaccatcttggtcaggctggtctcraactcctgaccttgtgatccacccgcctcggcctcccaaagtgcagggattacaggcgtgagccaccgcgcccggcctaaaaaagttttaatacctgccaaagtagccccctaggatcctattccagagctgtggctggaatctcacctttttttttttttagacggagtctcgctctgttgcccaggctagagtgcagtggcacgatctcagctcactgcaagctccacctcctgggttcacgtcattctcctgcctcagcctccccagtagctgggactacaggcgcccgacaccacg

SEQ ID NO: 25389 - DNA, 601 bp, Human
gagccaccgcacccggcccagctgctactctgatgaaagtcctctgtggctcctgctgggaatgggcctgccaggcccagcagaggagcctgcctctgagctgcccttcctgatggttagtgggctgcctccatctcaagttcccgctcagggaggtctcccctgaacccccgccctgcagccactgtgtccttaggttctgatttgccgcttctcatcacgcgtcgagttagccctgattccaggctggtgggcgtctcccgggctgttgccctctgattctttttttttttttttttttagacagagtcttgctctgtcacccaggttggagtgcagtggcgagatcttggctcactgcaacttctgcctcccgggttcaagtaattctcctgcctcagcctccggagtagctcagattacaggcatgcgccaccacacccagctaatttttctttgtgtttttagtacagatggggtttcaccatcttggtcaggctggtctcaaactcctgaccttgtgatccacccgcctcggcctcccaaagtgcagggattacaggcgtgagccaccgcgcccggcctaaaaaagttttaatac

SEQ ID NO: 25390 - DNA, 601 bp, Human
gacagagttttgctcttgttgcctgggctggagtgcagtggcactatctcggctcactgcaacctccgcctcccgggttcaagtgattctcctgcctcagcctccccagcagctgggattaccggcgtctgccaccatgcccggctaatctttgcatttttgcatttttagtagagacggggtttcaccatgttgacgaggttgtctcgaactcctgacctcatgatccacccgcctcagcctcccaaagtgctggtattacaggcgtgagccaccgcacccggcccagctgctactctgmtgaaagtcctctgtggctcctgctgggaatgggcctgccaggcccagcagaggagcctgcctctgagctgcccttcctgatggttagtgggctgcctccatctcaagttcccgctcagggaggtctcccctgaacccccgccctgcagccactgtgtccttaggttctgatttgccgcttctcatcacgcgtcgagttagccctgattccaggctggtgggcgtctcccgggctgttgccctctgattcttttttttttttttttttgagacagagtcttgctctgtcacccaggttgga

SEQ ID NO: 25391 - DNA, 601 bp, Human
accagcctgccagctttgcttgggtccacccgcacgctcccattccccttgcctagtggatgcccccctgcaacgctggccacacacagctccggactcccccctgtcctggcctccctcgccccggcccacaatccacagcaaacctagcctcccaacctgtggcaggtcctgagcctggagtcctcaccacctccctgtgggtgaccactgacaacttcctgccccttcccctgcgttccccaccccagggaagcgtgactcccgtcggcatttaactgctactctgggtttttttttkttttgttttgtttttgagacagagttttgctcttgttgcctgggctggagtgcagtggcactatctcggctcactgcaacctccgcctcccgggttcaagtgattctcctgcctcagcctccccagcagctgggattaccggcgtctgccaccatgcccggctaatctttgcatttttgcatttttagtagagacggggtttcaccatgttgacgaggttgtctcgaactcctgacctcatgatccacccgcctcagcctcccaaagtgctggtattacaggcgtgagccaccgcacccg

SEQ ID NO: 25392 - DNA, 601 bp, Human
gacaggtcccccggccaccctggtggctgaccggaactcagccttgggcggttccaggttcatggtgaggctgacggagacaccgcggcaaccttggctcctggactccctcctgctgcggtctgggggcagaccaggcccgggtcccagtcagccctcctgcttccaacccttgtgggggtctcaacccaccggtggaggggctgagacccagccccgccagctccagcgtcatccagacagcagcccctgcaatccgccctggggtaaccagcctgccagctttgcttgggtccaccckcacgctcccattccccttgcctagtggatgcccccctgcaacgctggccacacacagctccggactcccccctgtcctggcctccctcgccccggcccacaatccacagcaaacctagcctcccaacctgtggcaggtcctgagcctggagtcctcaccacctccctgtgggtgaccactgacaacttcctgccccttcccctgcgttccccaccccagggaagcgtgactcccgtcggcatttaactgctactctgggtttttttttgttttgttttgtttttgagacagagttttgct

SEQ ID NO: 25393 - DNA, 601 bp, Human
tccctcacagacccagggtgagtctgctgcccagagcatcatggggctgaggcctagaaaaggaggtgcaagtcccaggatgctgggcaggtgcgtgccctgggggagtacgggggggtgcgtggttggtgcatggtctgagtgtagatttgtgaaggtggcttgtctgtgagtgtgcctcacgtgcatatgtggaggtgtgagcgtgtttgtgcataagagtgtcatgcccgtgtgtgcgcacacgtgtgagtggacactcctcggtgcgttgatgggagcgcggtgcctgtgtgcgcayacgagtgagtggacactcctcggtgcactgatgggagtgagatgcccgtgtgtgcgcatgtgtgagtggacactcctcggtgcattgtgccatggctgtccctgggtggcagtggttgtattttttttatttatttgagacggagtctcactctgtcgcccaggctggagtgcagtggcgtgatctcggctcaccgcaagctctgcctcccgggttcacgccattctcctgcctcagcctcccgagtagctgggactacaggcgcccgccaccacgcccggctaattttttgtatttttt

SEQ ID NO: 25394 - DNA, 601 bp, Human
caggccttccattccagggatgtcgtccccaaacctgcaaggacagagcactcagggacatggccgggcccagtcctggctcagtcagcctgaggcccgaggtcatctctagccttcctaggagatgaggtgtttggctgggagcccagtgggcagagacccgcctcctccccaacctcccagggcttggcgcatctgaggaggcttccctcacagacccagggtgagtctgctgcccagagcatcatggggctgaggcctagaaaaggaggtgcaagtcccaggatgctgggcaggtgcrtgccctgggggagtacgggggggtgcgtggttggtgcatggtctgagtgtagatttgtgaaggtggcttgtctgtgagtgtgcctcacgtgcatatgtggaggtgtgagcgtgtttgtgcataagagtgtcatgcccgtgtgtgcgcacacgtgtgagtggacactcctcggtgcgttgatgggagcgcggtgcctgtgtgcgcacacgagtgagtggacactcctcggtgcactgatgggagtgagatgcccgtgtgtgcgcatgtgtgagtggacactcctcggtgcattgtgccatg

SEQ ID NO: 25395 - DNA, 601 bp, Human
gaagtgatggacaggctgggggtccctaagtgaaaagcaggggaggtgggggccgaggtgggctgcaatgggccccgggcgtgctgggtgtgcctggggggacctgggcagacctcgggttggtactggcagccgtcatacctgttcccaggccttccattccagggatgtcgtccccaaacctgcaaggacagagcactcagggacatggccgggcccagtcctggctcagtcagcctgaggcccgaggtcatctctagccttcctaggagatgaggtgtttggctgggagcccagtggscagagacccgcctcctccccaacctcccagggcttggcgcatctgaggaggcttccctcacagacccagggtgagtctgctgcccagagcatcatggggctgaggcctagaaaaggaggtgcaagtcccaggatgctgggcaggtgcgtgccctgggggagtacgggggggtgcgtggttggtgcatggtctgagtgtagatttgtgaaggtggcttgtctgtgagtgtgcctcacgtgcatatgtggaggtgtgagcgtgtttgtgcataagagtgtcatgcccgtgtgtgcgcacacg

SEQ ID NO: 25396 - DNA, 601 bp, Human
taatatgtagggggagacctgaggttgcagtcccatcctggtgtccaggtgccatctgggctagggaggcatctcctcaacaggaatcctgagcagggtttagagcacagtgggcaggagggggagggtctggacttcagcagggcctcgtgctagatgatgccatattgggccagctcgtgcagctccaggtggttgaaggcctcccaagggcagatgactgtgatgtctgtgggagaaacgggccacggatcagagaggatcccacggcctagggacccccccatcccctgtggccctrtttcccacagcccaggtgtagccctacagtgtgctgagcggggacgtgcggacgctggagtggggccctcctctggggacacactggctgtgggggaaggagggtgggtgcagcaggtccaggggagggaaccagaggagggtggggcttgctgaaggggaggaggcagcgaggggttctgttctttcccaaacccctcccctcacctggtgcaagtgtcccaaatggggacagccccaccctctagatccagtggatctggagctcagtgttgggggaagaagtgatggacaggctggg

SEQ ID NO: 25397 - DNA, 601 bp, Human
aggggacgatctggggtccagcaggctcccgggctggggtccacttcccgttctccctgggagtggagaccgaccaagcctctctgtgggcaggactgaggggtgggcctgtatctccagatgttgagcagggcctggccagcccctgagggggcatcctagagggaggtggtgggctcctggtgactggtattaatatgtagggggagacctgaggttgcagtcccatcctggtgtccaggtgccatctgggctagggaggcatctcctcaacaggaatcctgagcagggtttagagcayagtgggcaggagggggagggtctggacttcagcagggcctcgtgctagatgatgccatattgggccagctcgtgcagctccaggtggttgaaggcctcccaagggcagatgactgtgatgtctgtgggagaaacgggccacggatcagagaggatcccacggcctagggacccccccatcccctgtggccctgtttcccacagcccaggtgtagccctacagtgtgctgagcggggacgtgcggacgctggagtggggccctcctctggggacacactggctgtgggggaaggagggtgg

SEQ ID NO: 25398 - DNA, 601 bp, Human
gcttggggcctcatctgctcaccgtgcacgccctggagtcctgctacccagcatgtccaaactaagggcacccccctgggaagggatgcagagacggggagcttctctgtatccccttacaggcaggacagggggctggggtgcagaagcactctggggagacctgccctagctttccagctgggaggaggggacgatctggggtccagcaggctcccgggctggggtccacttcccgttctccctgggagtggagaccgaccaagcctctctgtgggcaggactgaggggtgggcctgtrtctccagatgttgagcagggcctggccagcccctgagggggcatcctagagggaggtggtgggctcctggtgactggtattaatatgtagggggagacctgaggttgcagtcccatcctggtgtccaggtgccatctgggctagggaggcatctcctcaacaggaatcctgagcagggtttagagcacagtgggcaggagggggagggtctggacttcagcagggcctcgtgctagatgatgccatattgggccagctcgtgcagctccaggtggttgaaggcctcccaagggcagatga

SEQ ID NO: 25399 - DNA, 601 bp, Human
ctcctgggacatgactgcagagggaatttgaaaccggccaggactagcttaggggcatccttgtttttttctgttcggaccctacgacctagaagcccccgggtgaggaatgccatcagcataccccacgaagctgcaatgctaaaggcgataatgggtgggggtggaggaggcggggcgccaagaccagaataagaatagtcccagcagaaagtgaatggcccatttccctgcagcttccaaagccagtcccacgaggaggcccagctctccacaagcctccccttctgctagcaccccsccccagaaaaagccctgaaaccttctccaggaagcagccccccccccccacttttccaaacccatccaggaccagcgagattcaggcaagggattcccccccacaaaccagagccagatccttttccctagagttatccactgagggatccggtcaaaatccccccgcccagctgtgctgtgggagtgaaactctaccgcaccccccaccctccgcccccgataaggatcagcccagggatttcctgggtcaagaaactacagaaaccatcggccttgttagaaaatggttttggcatga

SEQ ID NO: 25400 - DNA, 601 bp, Human
cgagggaaagttcgttgcgttgggtttctcccagcacccagccccttcctcatgagcccctgcactgtcccctgcccctaacagaccagaagcacctctggattgaaaagggagtccaggacccggagggatgcttacccaatgagaactgacctcaaccagtttacaaccctccctacgacagagaacgggagttgaagaaaagacaccccctacaagctggaggagcagccggtgcctctcctgtcctcaggcgagagactgtgggtttctctggttctgttttcagccacacctgggraggggactggacaggaccaaggaggcccccctatgttacaaaaggtcccccaccaggggcaagagaggaggtagatgccacccccatattctcacacacaaagcctcccagacactaggagaatcctattcagaccccaaaacctctcacggacacaggagggctgagatccactctgcattccctggggcaggaggagagagctcctgggacatgactgcagagggaatttgaaaccggccaggactagcttaggggcatccttgtttttttctgttcggaccctacgacctagaagcc

SEQ ID NO: 25401 - DNA, 601 bp, Human
ggacgcagcctgcatgctgggaggagccaaatgccagtcacaaagccccacccacctggaggaggagtcagcatagctggggcgcacccctgggattcctcaaagcctcttttctgcttcctacagcgtgggccttagaggcacctaatgccaagaacatcagcctggaagggttataaagggactccgagggaaagttcgttgcgttgggtttctcccagcacccagccccttcctcatgagcccctgcactgtcccctgcccctaacagaccagaagcacctctggattgaaaagggartccaggacccggagggatgcttacccaatgagaactgacctcaaccagtttacaaccctccctacgacagagaacgggagttgaagaaaagacaccccctacaagctggaggagcagccggtgcctctcctgtcctcaggcgagagactgtgggtttctctggttctgttttcagccacacctggggaggggactggacaggaccaaggaggcccccctatgttacaaaaggtcccccaccaggggcaagagaggaggtagatgccacccccatattctcacacacaaagcctcccagac

SEQ ID NO: 25402 - DNA, 601 bp, Human
gacagagggggaatagctcccagtctaccaagcccaccctttgctcccagctcaagatgccgagagtggaccacgctcaccaaagccgcccacagctcaccaaacacagctctgagcagcccaggcccaggtggcctggccggcaagaatcacccctaaaactgctcccaggacagttaaccaggaggctttcccttttgtcttttaggcacagatgtcccaaggacaactccaggacagggagaatctcccaaccatcagtcctggtctggcattactggcccgagatggggctatttaygttatcagccgctcaatgaaccacgggcgccaggccagaccactttggggaacaaagctccccagctgccactgcacacaggacaaacaggccctaaacgcgggctgccggtcattaaaagaccacatgctggcctctggatctaaaagccacaggtgaaaagccttcactcttcactccagcacaccctccgaatgaaacgcttgggctccgggaggatggtgaggaatcccactacccgtgctcctccagccacagtcaaggagcggccaagaccccagacggtgcctggctcagtct

SEQ ID NO: 25403 - DNA, 601 bp, Human
ctcgcaggagactcatgtggtctgcgtccacagagcacagtccccgtgccccgccaccctctagccctggcttaataaacagagaagacggcagccgtgctagctcattgacccccagaaagcctgagctggcaaatttcttgagacaagggacagagggggaatagctcccagtctaccaagcccaccctttgctcccagctcaagatgccgagagtggaccacgctcaccaaagccgcccacagctcaccaaacacagctctgagcagcccaggcccaggtggcctggccggcaagaaycacccctaaaactgctcccaggacagttaaccaggaggctttcccttttgtcttttaggcacagatgtcccaaggacaactccaggacagggagaatctcccaaccatcagtcctggtctggcattactggcccgagatggggctatttatgttatcagccgctcaatgaaccacgggcgccaggccagaccactttggggaacaaagctccccagctgccactgcacacaggacaaacaggccctaaacgcgggctgccggtcattaaaagaccacatgctggcctctggatctaaaag

SEQ ID NO: 25404 - DNA, 601 bp, Human
aaagagtaacgggtccgttctccactcgtaggagaaaattcaataacaccagctcccattttccgatgccttgtgatagccacgtttgcattagctgctttaccaatgacttagcttctgagtgtgcggtgggtgctatcacttcttcacatccgaggaaactgaggcccagagaaatataacaggaccagaagtggctcgcaggagactcatgtggtctgcgtccacagagcacagtccccgtgccccgccaccctctagccctggcttaataaacagagaagacggcagccgtgctagytcattgacccccagaaagcctgagctggcaaatttcttgagacaagggacagagggggaatagctcccagtctaccaagcccaccctttgctcccagctcaagatgccgagagtggaccacgctcaccaaagccgcccacagctcaccaaacacagctctgagcagcccaggcccaggtggcctggccggcaagaatcacccctaaaactgctcccaggacagttaaccaggaggctttcccttttgtcttttaggcacagatgtcccaaggacaactccaggacagggagaatctccca

SEQ ID NO: 25405 - DNA, 601 bp, Human
gccatggccaaaccaaagagtaacgggtccgttctccactcgtaggagaaaattcaataacaccagctcccattttccgatgccttgtgatagccacgtttgcattagctgctttaccaatgacttagcttctgagtgtgcggtgggtgctatcacttcttcacatccgaggaaactgaggcccagagaaatataacaggaccagaagtggctcgcaggagactcatgtggtctgcgtccacagagcacagtccccgtgccccgccaccctctagccctggcttaataaacagagaagacrgcagccgtgctagctcattgacccccagaaagcctgagctggcaaatttcttgagacaagggacagagggggaatagctcccagtctaccaagcccaccctttgctcccagctcaagatgccgagagtggaccacgctcaccaaagccgcccacagctcaccaaacacagctctgagcagcccaggcccaggtggcctggccggcaagaatcacccctaaaactgctcccaggacagttaaccaggaggctttcccttttgtcttttaggcacagatgtcccaaggacaactccaggaca

SEQ ID NO: 25406 - DNA, 601 bp, Human
cagcagacaggctgggggagtctcaggtctctccaaatcccgcagtagggagaggacccacagtcctgcccatggacactgcccgcacctgggcaccgcgggtggctctgggcctccttgccttggccccctggtcccagctggggggtctcttcccatctccctccatcctgccccccccccaccatataaccaagggtgaacaggcgcggagacagtgagcctcacagccaggatgctccagaggcacagagatctccctgccccctcctgggaagcttgggaagtcccggtcaccagyccagacggctaatgggctctgcacctcctgggttcaggactagcagcccaaagtgtctctccccagcccatcgaggcatccgtgactatccacaaaccaaccggagaaacctcagcttcctccgcacccccgaggagcctgcggatttaaaatgaagcccgcaaacctcacagaaggtgtcaggcaaagacgaagctcgcccggagcccaactttttaccgaaaatgactcaatgttccaatgacactaattttttttgagacccaaaataagatcagaacagaactactcatgcagtaa

SEQ ID NO: 25407 - DNA, 601 bp, Human
acagcagacaggctgggggagtctcaggtctctccaaatcccgcagtagggagaggacccacagtcctgcccatggacactgcccgcacctgggcaccgcgggtggctctgggcctccttgccttggccccctggtcccagctggggggtctcttcccatctccctccatcctgccccccccccaccatataaccaagggtgaacaggcgcggagacagtgagcctcacagccaggatgctccagaggcacagagatctccctgccccctcctgggaagcttgggaagtcccggtcaccarcccagacggctaatgggctctgcacctcctgggttcaggactagcagcccaaagtgtctctccccagcccatcgaggcatccgtgactatccacaaaccaaccggagaaacctcagcttcctccgcacccccgaggagcctgcggatttaaaatgaagcccgcaaacctcacagaaggtgtcaggcaaagacgaagctcgcccggagcccaactttttaccgaaaatgactcaatgttccaatgacactaattttttttgagacccaaaataagatcagaacagaactactcatgcagta

SEQ ID NO: 25408 - DNA, 601 bp, Human
ggcaaggctcctggggacaggccccgacaagacagggcgcttaaggaatttatgatggctcttctctcctggaagctctcttggcccagaccaggactccaggaggagcaggcgggctggcgcaggagacaccctcgaaggagggaggcctcgggagaggccagagccagaggcaccagggccaggcctattttagggaggagggaacgggtggcttgcctgaggccactgcgctgggagagcgggcagctcctccccacccggccctgccctgcccatcgcggcctcctggactcacccygacccggccctgccctgcccatcgcggcctcctggactcaccgatgcttctcttcctccgaatgggcaggggccgcttctcgggcacatgcttagtggcatggaccccgtgagctctcaggctggtgtccaaagaatcctcactccctgcaggcggaaggagaacaccgtgaatgccccaggcccgtgcgctgtgccctgggcctgtccagccgcacttcccacagaccagctttgggagccactggggaacaggcacctggcggcacagcccctcacagctcccgccattaggggccct

SEQ ID NO: 25409 - DNA, 601 bp, Human
caaatggacgcgggggtggagccctggagccaggtgtgagtggggcggggcacacgggtgtggtgagggtgccggggggcagccgccggacacagcacgcgcgtccccaccagttcagcagccggcgcaggagcacgatgcccacactgcgaattggaaattaggcgcgaccacgtttccggcaaggctcctggggacaggccccgacaagacagggcgcttaaggaatttatgatggctcttctctcctggaagctctcttggcccagaccaggactccaggaggagcaggcgggctggsgcaggagacaccctcgaaggagggaggcctcgggagaggccagagccagaggcaccagggccaggcctattttagggaggagggaacgggtggcttgcctgaggccactgcgctgggagagcgggcagctcctccccacccggccctgccctgcccatcgcggcctcctggactcaccccgacccggccctgccctgcccatcgcggcctcctggactcaccgatgcttctcttcctccgaatgggcaggggccgcttctcgggcacatgcttagtggcatggaccccgtgagctctcag

SEQ ID NO: 25410 - DNA, 601 bp, Human
aaatccatcttcatggaggaaaccacagctcagagaggggggtccacctgctcagggccccagagccatgagcagcaccagggctcaaacccatcaggtgggacccccgaggacgcgggacttgggtagaaagcagggactggcccctgaactccccaaacctgctagttcctcctcagggggctggagggccatggggctgtcctgtaagaagggacaaaatatcccccaaatggacgcgggggtggagccctggagccaggtgtgagtggggcggggcacacgggtgtggtgagggtgycggggggcagccgccggacacagcacgcgcgtccccaccagttcagcagccggcgcaggagcacgatgcccacactgcgaattggaaattaggcgcgaccacgtttccggcaaggctcctggggacaggccccgacaagacagggcgcttaaggaatttatgatggctcttctctcctggaagctctcttggcccagaccaggactccaggaggagcaggcgggctggcgcaggagacaccctcgaaggagggaggcctcgggagaggccagagccagaggcaccagggccaggcctatt

SEQ ID NO: 25411 - DNA, 601 bp, Human
actgtctctttgttctcccgagtgttctcggacacagtttttcacggaggagaacaaagaccgcacactggcaataaagcaccgtacatagtaggttcaggaatgtaacacgccatgtacatccatgtcccaggaaagggctgcggctcatcctcacctcacatctgcagggagaagggaaagacagacactgagaccaccgaccaagtgaaccacccagcacacacatggctgcataggaggaaaacagggtgaaaacatttaacccaatcaggggcacacagggatttcaagttttcawgaaatttccagaatcacatttgccacattggccatgttgcagtaccctgacaggaattgggattaggctcacagcatctcacagaacatgtctagagaccaagccccattctcccattgtacagatgggggaaactgaggccaagaatggctcatttgcccttctctctgccttcctttcttccagcctagggcttagatgtgatttctggagctctggcagccaccttgggccatgagacaaccctgaggatggaggccaccagccagacagaagagtctgcacccaggcagacctatg

SEQ ID NO: 25412 - DNA, 601 bp, Human
aagcttcttactgcttcaccgagtgctacaatacttgctttgatgtcacattaaacaaatgtgcactgtctctttgttctcccgagtgttctcggacacagtttttcacggaggagaacaaagaccgcacactggcaataaagcaccgtacatagtaggttcaggaatgtaacacgccatgtacatccatgtcccaggaaagggctgcggctcatcctcacctcacatctgcagggagaagggaaagacagacactgagaccaccgaccaagtgaaccacccagcacacacatggctgcayaggaggaaaacagggtgaaaacatttaacccaatcaggggcacacagggatttcaagttttcatgaaatttccagaatcacatttgccacattggccatgttgcagtaccctgacaggaattgggattaggctcacagcatctcacagaacatgtctagagaccaagccccattctcccattgtacagatgggggaaactgaggccaagaatggctcatttgcccttctctctgccttcctttcttccagcctagggcttagatgtgatttctggagctctggcagccaccttgggccat

SEQ ID NO: 25413 - DNA, 601 bp, Human
gacaaggaagcttcttactgcttcaccgagtgctacaatacttgctttgatgtcacattaaacaaatgtgcactgtctctttgttctcccgagtgttctcggacacagtttttcacggaggagaacaaagaccgcacactggcaataaagcaccgtacatagtaggttcaggaatgtaacacgccatgtacatccatgtcccaggaaagggctgcggctcatcctcacctcacatctgcagggagaagggaaagacagacactgagaccaccgaccaagtgaaccacccagcacacacatsgctgcataggaggaaaacagggtgaaaacatttaacccaatcaggggcacacagggatttcaagttttcatgaaatttccagaatcacatttgccacattggccatgttgcagtaccctgacaggaattgggattaggctcacagcatctcacagaacatgtctagagaccaagccccattctcccattgtacagatgggggaaactgaggccaagaatggctcatttgcccttctctctgccttcctttcttccagcctagggcttagatgtgatttctggagctctggcagccacctt

SEQ ID NO: 25414 - DNA, 601 bp, Human
ctgtatgggcttaaatactacagcgaggaggtgtggtttctaaagttcgcgtggcggtttccaagacattcctgcttcctgcgggcccctgcagagcccaccagcacccctctggagtcgttcccaaagcaggctctgcatcctcggcaaaaaagcacctgtgaccacccggacagaaatccagtctgctgagacctctgcacttccatcccacggggcgaccctccatctcatcgagtttagatatttttgtgagtccgttttgtttttgtcatttgtggttttgttttctctctctctytctctctctctctttttgacaaggaagcttcttactgcttcaccgagtgctacaatacttgctttgatgtcacattaaacaaatgtgcactgtctctttgttctcccgagtgttctcggacacagtttttcacggaggagaacaaagaccgcacactggcaataaagcaccgtacatagtaggttcaggaatgtaacacgccatgtacatccatgtcccaggaaagggctgcggctcatcctcacctcacatctgcagggagaagggaaagacagacactgagaccaccgaccaagtgaa

SEQ ID NO: 25415 - DNA, 601 bp, Human
tgcaggaggatgtcctcggcctaacccccataggtgctgaagtccgaggtaggcaggcatcccacgggtgccaccatggaggcaggtccagggaccccacccagaaagctctgacctccgtttccacccaacacagcaccgcatgacctggcaaccagggtctagactcagtgctagaaaaacgtaccacaaaacgcttctcacgtccacgggttttgttggtggtatttttttttttaattttggatcaacaaaaaaagaacatagcaggctctcaggtatacaaaacaggtaatattargtaaacatacaaacttcacctttacaaaaaaacaaaccacacacacacatttctgttaatacaggtaaagcacaatatcttaccaaaaataaagaatttgggttctgtccaaacactggcagcagagggagtgaccgccaccacggcaccagggcacaccaacaacacagacagaagcggcaatgcatctcacgtgccgcgtgggaacacagcattctaggtgtgcactgcggggaacaagttgtcactcagccacaaacgggctctggggcaggtgccgcagggacggcgtacgattgg

SEQ ID NO: 25416 - DNA, 601 bp, Human
ggaaagggaggagtgaacacaggggaggtgggaactcggcgcggcctccccaaaacaacaggccgccccggcaaagcgtgggttaagggggcgggcccgggggaagccacgtgccggggcggaaggctattggttcgcccggagttgtttgtgagtggccattggcgacgtcgaggcgccatgacgagccgattggctgggcgttggaatgcccgccagggcaagggtagggaggaggcggccgaaccgcgtcgctgggccgaaaggtgcgcgagcgctgcccgcgcggggaccacaaccmaagtcgcggccgccgcagccatgcgctgggtgtgggcgctgctgaagaatgcgtccctggcaggggcgcccaagtacatagagcacttcagcaagttctccccgtccccgctgtccatgaagcagtttctggacttcggtacggagtgggcgggaggcggctggcagcggaggccggcggggcgctgggaggggcagccgggggctagggggacggaggagaagaaaggccccgagtgacagagaagggttgtttggaaaggtacaggcaggaaagagttaatggggaagcaggaaccgg

SEQ ID NO: 25417 - DNA, 601 bp, Human
gtctgcctgcacccctgccctgcctgagtcttgagcctcccccatgtaggaaagcctcctgggcccacccctagcccccagcagctgtccccacaaactgcaccctaattacagaaacatcacagctgtgaggggctcacagtagagtttggtcaacttgtagtactatgggggaaactgagaccttcaaaaggatgatggcatggcctgggtgacagagttggaagcagagcctgatggactggaacccagggcccctgaccctgggccaaggccatattcggtcccccaccctttccakcttgacaccagacaaggaccgaggcatttggactcctgttctcaggcccgtttgccccatggatgggcattaagacacagcagccccacatgggcattcaggccaggctgggtgaggtgggctggccagagacaacactgggagcctgcagtggtggtctagccatagcccccctcagccagagcccagtcctaggtagggatgggtttcccaggctcctttgccccctggaatcagcccctcaaagtgagtgtgctgggagggaaggaaagagaagtgaggtgactgaggccagaggca

SEQ ID NO: 25418 - DNA, 601 bp, Human
cctttccagcgctgttttctatgcatggacctgtggatatggggcttattctaattaaatgagatatggtgaggggcagtgttgtacacacaaggctaggggtgtagtgggtgcaccatgaatgtttgttgaatgacacgttgtggggcagttgctatggacatgcagaggaggtgacttgtcactggaccttacagggtacctaggcaagctgagagctaaaaggaagggaagggcattccaggctaaaggaatagcctgggcaaaggtgtggagacaggaaggggcctggctaagggarctgagaactgactttctggagattgtgctgttagtgtgggctgtgaggaaggggtggaggcatgaggcacagagcctgatcttcatggagcccaaccaggtcaccccttgctgtgccttgcctctcggaggtccaggacctctgagccaaccaacacttcccatcgtgggtggtgtggagtggtgggaaggagacagaaggtaccatctgttctccctggccctcctccggctctatccggctgcctgacctggctgcctctccacctggtccctgactccagggcaggacttctcaggc

SEQ ID NO: 25419 - DNA, 601 bp, Human
ctttccagcgctgttttctatgcatggacctgtggatatggggcttattctaattaaatgagatatggtgaggggcagtgttgtacacacaaggctaggggtgtagtgggtgcaccatgaatgtttgttgaatgacacgttgtggggcagttgctatggacatgcagaggaggtgacttgtcactggaccttacagggtacctaggcaagctgagagctaaaaggaagggaagggcattccaggctaaaggaatagcctgggcaaaggtgtggagacaggaaggggcctggctaagggagytgagaactgactttctggagattgtgctgttagtgtgggctgtgaggaaggggtggaggcatgaggcacagagcctgatcttcatggagcccaaccaggtcaccccttgctgtgccttgcctctcggaggtccaggacctctgagccaaccaacacttcccatcgtgggtggtgtggagtggtgggaaggagacagaaggtaccatctgttctccctggccctcctccggctctatccggctgcctgacctggctgcctctccacctggtccctgactccagggcaggacttctcaggcc

SEQ ID NO: 25420 - DNA, 601 bp, Human
ggcgggcggatcacaaggtcaggagatcgagaccatcctggctaacacggtgaaactccatctctactaaaaatataaaaaattagccgggcgcggtggcgggcacctgtagtcccagctactcgggaggctgaggcaggagaatggcgtgaacccgggaggcggagcttgcagtgagctgagattgtgccactgcactccagcctgggcgacagagcgagactccgtctcaaaaatgaaagaaagaaagattcagcttagaggagagcaggccgagggattgctaaagcatcccaacgcrctgaagagacagcctgccaagaatgtttccagagagaatgagcattggctacagcaagagagactgaggtgtgaagacaagaaggacttcccgacagggttgaggtggctgcctgtaagagagtggagacctctttctccaggagcaacagcctgccagctggaatgatggagatgggcaggttctaggtgcctgagaggaggggggagactttaccagggagcttggcaagagggcctctagcctgagtttgatgagtaagaagcaaaccctcctttctggaaaacacaagagccctcg

SEQ ID NO: 25421 - DNA, 601 bp, Human
agagtcactgggcaaggtgagaattcctggttctaaataaacctgatacatttcaactggacagacttgtgatagtgggccctgttttggtggagactggacggggagggaaagtcccaggtttggcctcagcatgtgtgactttgaagcttcatcctgggcaagccacatggcatctctgagcctcagcttcctcatgtgtaaaagggggacccattgtgtttgtaagggccaaaggccagtgctagatgtgaaaagtgtgcagaactctaccaatacaaggcatatccccaggctgccsggcagcaacacctccagcccacagaggatgtaattgtggtgtggcttcttgggcaaggtagtaataaatcatgataataacaaaagcaaacacctccaaaggctggctgtgtcccaggagctgtcctaagtgtctacgcgtattaactcatttcatcttcgcaaccttatgaggtagtctttgctatcatcccattttctagatgagaaactgaggttcagagaggtgaagaaccttatctgagatcacccagggactaggtggtggaattgggattcgaacccagctgttggatttgga

SEQ ID NO: 25422 - DNA, 601 bp, Human
ctcccacacagggctgcagggccctcctcccactcactcaccctctcctcccgcccccaccgcccattatcagccccacactctcagcaagcctcctggcttctgcctgcatccacccctcctccttctcattcctggggctctggactggctctggagccctggaaagcagggtttgggtggatctccacattaccttgggctgggcttgggagctccggatctcaccaagggactcctgggggccttgattactgcagaggtcagcaggcccagagaccccagcctccctgcaggtccyggggaggggtgggggcaatgcctctcccgcctgttggtgcctgtctgtcactgcaccactgcttcaggcctcccttatataagcccagttctctctctggcctgcaaggggtgggcagcccagaggccagcgccactcgtccccaatctcccttcttaggatcaagaaccggcccaaggttgacatttggtgcaccaggcccctgaggggcttcagggcaaggccagggacctcggggaaaatcctcatcctctcccctccattccaagagtagcctgggccccttgccctggaggagcc

SEQ ID NO: 25423 - DNA, 601 bp, Human
aatcccaacctgctgcttactatgtggcctggggcatatcactaacctctcagtgctggtctcgttgtctgcaaaaacagggaaataccttgtgctcatcaaggctgttggcagatgagagaccctgtgtgggactcggcacaagtgggtgttagtggtcgctatgttcttctccagggagacaggtgaggtcttaggagtgccagcctgattgtctgctggggtggcagggatggtgatgggggctgagagaaaggctgatcttttctgctgttggggcccccagccccatcagcagccrcagctcctcctatcgggctctgtgcagagctctgggtagggaggggtgggcggtgagctctgggcctgagacagcccccttcgtgtggcagtggggcaggtctccagggcacaggggctccaacatgctgtgattcagagcctacaagcagtgggagagtatcagatgctgcctgggggctcagaggatgcatgcagctgttgacagtgtttgagccaccagccataataagagcaagcattagagagtgctcactatgtgctaggcactgtgctaatcatcacatggaattctcaccac

SEQ ID NO: 25424 - DNA, 601 bp, Human
gatataacaatccccattttcctaatgagcaaactcaggcccagagaggttccatgacttacccagagccacacagctccaagtgcttaaagagccaggtctgggtccagagctggttctttcactctcttctctgtcaggcaagagcgagaagagcagcaatactaggtttaaggggaagggcattcctagcagagggcactgtgtgaacagaagcgtggaggtgagagtcgagcagaatcagcactctggagtggcaagagcgctggagactcgggggcttcatcatcccacttactarctatggggctgcttacgcctccctgggggaggctgtgcgtggggctgattcctgcctgtctgcctgttacaggttacagtgaaggccagagcactgtggacatgggaatgagtcctcgtgtggaggggccttttctagaaatactgttgggcccctggggcccttggcactgcagggctctaggtagcgcccccccttcctcctggttataagtgtttctgccagagagaggctcttcctgccttccccaaaggaacaagccacagactggacatgttagcagggaaacaggtcatggct

SEQ ID NO: 25425 - DNA, 601 bp, Human
ccccaaaggaacaagccacagactggacatgttagcagggaaacaggtcatggctccccagggcacggggcacagtggctccagcttggtaccatctgccaccacaggtggacctgactcccttgcagaaggaggcctgctgctgtccctgagttcagggcttattttttggggggacagagtcttgctctgtcacccaggctggagtgcaatagagcgatctcggctcactgcaaccattgcctcccaggttcaagcgattctcctacctcagcctcccgagtagctgggattacaggcrtgcaccaccatgcccagctaatttttgcatgtttagtagagacaggtttttgccatgttggccaggctggtcttgaactcctgacctcaggtgattcgcccacctcagcctcccagagtgctgggattacaggtgtgagccaccacacctggctaagttcagggattcttgatgctccttttagagcatcaagctcttctcttagcccagggaaaactggcctccccatcaggcctgtagatgggaggaggtggcagggcatcacccactgctacctggccttttgcagtagagtgagct

SEQ ID NO: 25426 - DNA, 601 bp, Human
ccacagactggacatgttagcagggaaacaggtcatggctccccagggcacggggcacagtggctccagcttggtaccatctgccaccacaggtggacctgactcccttgcagaaggaggcctgctgctgtccctgagttcagggcttattttttggggggacagagtcttgctctgtcacccaggctggagtgcaatagagcgatctcggctcactgcaaccattgcctcccaggttcaagcgattctcctacctcagcctcccgagtagctgggattacaggcatgcaccaccatgccsagctaatttttgcatgtttagtagagacaggtttttgccatgttggccaggctggtcttgaactcctgacctcaggtgattcgcccacctcagcctcccagagtgctgggattacaggtgtgagccaccacacctggctaagttcagggattcttgatgctccttttagagcatcaagctcttctcttagcccagggaaaactggcctccccatcaggcctgtagatgggaggaggtggcagggcatcacccactgctacctggccttttgcagtagagtgagcttctctggactctcca

SEQ ID NO: 25427 - DNA, 601 bp, Human
ccctcccgcccccacacaggtatgtccagagcctcctggacatcatggagttcctggacaaggatcccgaggaccatcgcaccctgagccagtgagtgggggccctgggtggggcaggaaggcaggtgttggccaggggcatctggggttgcagcccctggggcagaagtacagcaggatggaagaaaagacccctgccttcagaaacatccagtctgagtggggagacagactctgcttcagggagccccaagtttgatgggagagacatggactccattctcactgttccctgagcccsgtgggcaagacccaggccctgccatggggaggatgagaactctgggctttcgagtgggaagcctgccggcaggcagctaaaagatcagagtgggctttgggaggagcagggagggcactgggagtccatcggattgggaagggtagagcgggtgaagacaccgtggagaggggagtcagaagcggagaagagtctgggggtgtcccatgtgaacatctgccctgccccacaggttcactgacgccctggtcaccatccggaaccggcacaacgacgtggtgcccaccatggcacaaggcg

SEQ ID NO: 25428 - DNA, 601 bp, Human
gggtgccggccacagcggcggggagcgggcggtggggggggcggtgctggggcccagggccgggctgctgaggggacctagaccactcttcagaaccccacaaagggagtctttgaatagttactccagtaactatggagttaatggctccaacatggaaaaataaaatttttctttctcattgattttccatttcaaaacgttttgttttcagtgtttgcaaaatgtaaaattatgtcacatctttaaaagaatgtttaatttagtatttataaaaactctcattatgttcaaaaacaayttgttgtttagagtttcttattccaggaggattcactatgattttttgagaagttgtagccagtcataaattaaacaagttcctcatgctcaaataatttccaaagcaaggtggtaagagttctcttagaatgttatagtcaaagaaaagaataaatgcaatgtggagatgtgatgtggggagagacctctgaaaagacgtctgtttcaggtttgcaaaggtttaaaaacggcctaagccagggctggaggggtcaggggtcagggaagggaggacagaagcgggggagtggggcagctt

SEQ ID NO: 25429 - DNA, 601 bp, Human
gtcaggggtcagggaagggaggacagaagcgggggagtggggcagctttaggactggagcctacagaggcattggaggtgaaagtagaaagaggaggaaagcccgggggaagagggagcgctgggacagactgcagcccagccaacagcatcctcccttcctgcctgcagccctcatctttgatggcagcaccaacccagcccatcccaaacacatcggcagcatcgaccccaactgcaacgtctctgaggtggtcaaaggtgagccattcccacggtgcctggcccgcagagaagccccrgggacccctccaagcttacctggccagagggtgactcgttcctcagtaaggggtgccatggatttaatgctggtggtccccagtatcagtgtcaggaggactgcctgctgggtgggccacccatgccctgaatgaccccatcttctctcagatgcctacgacatggctaagctcctgtgtgacaagtattacatggcctcacctgacctggagatccaggagatcaatggtgagtgagcggggctgtgtatgtgtctgtcttggggctggggacgtggcagggcaaggtgagacggggag

SEQ ID NO: 25430 - DNA, 601 bp, Human
agaggaggaaagcccgggggaagagggagcgctgggacagactgcagcccagccaacagcatcctcccttcctgcctgcagccctcatctttgatggcagcaccaacccagcccatcccaaacacatcggcagcatcgaccccaactgcaacgtctctgaggtggtcaaaggtgagccattcccacggtgcctggcccgcagagaagccccagggacccctccaagcttacctggccagagggtgactcgttcctcagtaaggggtgccatggatttaatgctggtggtccccagtatcartgtcaggaggactgcctgctgggtgggccacccatgccctgaatgaccccatcttctctcagatgcctacgacatggctaagctcctgtgtgacaagtattacatggcctcacctgacctggagatccaggagatcaatggtgagtgagcggggctgtgtatgtgtctgtcttggggctggggacgtggcagggcaaggtgagacggggagtcaggagatggactgttttctagacaggggagaagcagagttattatattattaattcatttgataaatatttgggctgggcacagtgg

SEQ ID NO: 25431 - DNA, 601 bp, Human
atcacttccatgagtcaccagctaccccagctcaagggaggctggggatttagtctctcgctgggcagccatgtactcagaactttgtgggagggggtgcctcctttgggtaaggtggttgagcagtgacctcctgacggtttcctgacccttggtcttgacttgccctgtagcagccaactccaaacagccgattcacatggtctacgtcccctcccacctctaccacatgctctttgagctcttcaaggtgaggaggctgggagccggtgctttgcggggagcgtgagtagggctggcttctcccatgcatctcttacctctgcccctccgcagaatgccatgagggcgactgtggaaagccatgagtccagcctcattctcccacccatcaaggtcatggtggccttgggtgaggaagatctgtccatcaaggtatgtgaccctttgaccttggggaccagggagcagtagtgggggcttccctcctgccaggagacgggctttccttttctcctacatggtgggcagatcctgggggtggggaagaccatgagaaggtcaggggtattgggcggggtggggaaaatgagctgtaaag

SEQ ID NO: 25432 - DNA, 601 bp, Human
agcagattttgtttaattacacttggctgaaagatccaaggaagtccagaccctaagtgtagaatgaactcctgctgcagcccctcatggacaccgggccctgcgcttagctctttactgaccggggggccccgggtcacgcctcaccacagatccctgaacctgggcccgtgactgcctatgtcactgctgtggggaacaaacagcttctcccagacagtgtgggagcatggactgcagccccggccccagcccctcacccctcgcccctgcctggcccagcagtctgccccatcagacrgccgttcccaccttctcccctccacagccgtcggcacctctgcctatcctgacccccagctgatgcccctgcttccagattcagcaacgaagcctcccccgtggtcccaccaccatgtccacctgccacagcgttagtccctggcccaccagagccactactgcatgagctccttccagaacagccctctgaggaacccccttccttttgtccctagagctgcactggtcccctcagcccctacttgccaggcaaccccgcctccacacacaccctaaacaggaggccaccgtgacctcg

SEQ ID NO: 25433 - DNA, 601 bp, Human
gatccaaggaagtccagaccctaagtgtagaatgaactcctgctgcagcccctcatggacaccgggccctgcgcttagctctttactgaccggggggccccgggtcacgcctcaccacagatccctgaacctgggcccgtgactgcctatgtcactgctgtggggaacaaacagcttctcccagacagtgtgggagcatggactgcagccccggccccagcccctcacccctcgcccctgcctggcccagcagtctgccccatcagacggccgttcccaccttctcccctccacagccgtyggcacctctgcctatcctgacccccagctgatgcccctgcttccagattcagcaacgaagcctcccccgtggtcccaccaccatgtccacctgccacagcgttagtccctggcccaccagagccactactgcatgagctccttccagaacagccctctgaggaacccccttccttttgtccctagagctgcactggtcccctcagcccctacttgccaggcaaccccgcctccacacacaccctaaacaggaggccaccgtgacctcgtcgcagagccagtggtcaggtcttcgtcctca

SEQ ID NO: 25434 - DNA, 601 bp, Human
gccccatcagacggccgttcccaccttctcccctccacagccgtcggcacctctgcctatcctgacccccagctgatgcccctgcttccagattcagcaacgaagcctcccccgtggtcccaccaccatgtccacctgccacagcgttagtccctggcccaccagagccactactgcatgagctccttccagaacagccctctgaggaacccccttccttttgtccctagagctgcactggtcccctcagcccctacttgccaggcaaccccgcctccacacacaccctaaacaggaggcyaccgtgacctcgtcgcagagccagtggtcaggtcttcgtcctcagcgtacccagcctcacttgcatatttgatgtggtttcttgccccgtccatgttggtgagggatttgatgagctgctgtgacaggggcatggaagtggggctcaaaccagatgggaggctccctctctcctaggacagccaggaagtggctggacacccagggcccatgctggcggtgtgacctgccacctctgtatgtggttcccggccctgggctgaggctgtctggctgtctccatttcccagccagtggaaag

SEQ ID NO: 25435 - DNA, 601 bp, Human
cccccagctgatgcccctgcttccagattcagcaacgaagcctcccccgtggtcccaccaccatgtccacctgccacagcgttagtccctggcccaccagagccactactgcatgagctccttccagaacagccctctgaggaacccccttccttttgtccctagagctgcactggtcccctcagcccctacttgccaggcaaccccgcctccacacacaccctaaacaggaggccaccgtgacctcgtcgcagagccagtggtcaggtcttcgtcctcagcgtacccagcctcacttgcrtatttgatgtggtttcttgccccgtccatgttggtgagggatttgatgagctgctgtgacaggggcatggaagtggggctcaaaccagatgggaggctccctctctcctaggacagccaggaagtggctggacacccagggcccatgctggcggtgtgacctgccacctctgtatgtggttcccggccctgggctgaggctgtctggctgtctccatttcccagccagtggaaagtgacacgggaagccgagggcagccagctgtccttcagtggcacggtcagaagctacctgtgtcac

SEQ ID NO: 25436 - DNA, 601 bp, Human
ccaggcaaccccgcctccacacacaccctaaacaggaggccaccgtgacctcgtcgcagagccagtggtcaggtcttcgtcctcagcgtacccagcctcacttgcatatttgatgtggtttcttgccccgtccatgttggtgagggatttgatgagctgctgtgacaggggcatggaagtggggctcaaaccagatgggaggctccctctctcctaggacagccaggaagtggctggacacccagggcccatgctggcggtgtgacctgccacctctgtatgtggttcccggccctgggcygaggctgtctggctgtctccatttcccagccagtggaaagtgacacgggaagccgagggcagccagctgtccttcagtggcacggtcagaagctacctgtgtcaccagcaggagggtggcagcagtgtccctggggccacgtgccttgttacactggggcttcggtccctgtagcagggtagctggtgggcagcgtctgcagccccacatttccgctccccgcctccttttctgagaggtggtccctggacatccccacatcctcacctgctctgccagcctcatagctaagactctttc

SEQ ID NO: 25437 - DNA, 601 bp, Human
taggacagccaggaagtggctggacacccagggcccatgctggcggtgtgacctgccacctctgtatgtggttcccggccctgggctgaggctgtctggctgtctccatttcccagccagtggaaagtgacacgggaagccgagggcagccagctgtccttcagtggcacggtcagaagctacctgtgtcaccagcaggagggtggcagcagtgtccctggggccacgtgccttgttacactggggcttcggtccctgtagcagggtagctggtgggcagcgtctgcagccccacatttcygctccccgcctccttttctgagaggtggtccctggacatccccacatcctcacctgctctgccagcctcatagctaagactctttctgcactggtgatgccaaggctggtctggagctcaggcctctccgtcatgctaggctacgaagcaggcacctcagactccctgaacctgccccctggcttgatcgtttctgccgggcactccccatgccagtgagaggcctggttctaacgtgctctgtgccaactgaacgtgtgaccctcccagcaggcgctgaggccagatcccctcagggtc

SEQ ID NO: 25438 - DNA, 601 bp, Human
tggctgtctccatttcccagccagtggaaagtgacacgggaagccgagggcagccagctgtccttcagtggcacggtcagaagctacctgtgtcaccagcaggagggtggcagcagtgtccctggggccacgtgccttgttacactggggcttcggtccctgtagcagggtagctggtgggcagcgtctgcagccccacatttccgctccccgcctccttttctgagaggtggtccctggacatccccacatcctcacctgctctgccagcctcatagctaagactctttctgcactggtratgccaaggctggtctggagctcaggcctctccgtcatgctaggctacgaagcaggcacctcagactccctgaacctgccccctggcttgatcgtttctgccgggcactccccatgccagtgagaggcctggttctaacgtgctctgtgccaactgaacgtgtgaccctcccagcaggcgctgaggccagatcccctcagggtcctgatgagtgtggcgccatctgccttacagctccgtgtccgcagcctgcccggagaggacctgagggcccgtgttagctacaggctgctgggggtc

SEQ ID NO: 25439 - DNA, 601 bp, Human
ctctgtgccaactgaacgtgtgaccctcccagcaggcgctgaggccagatcccctcagggtcctgatgagtgtggcgccatctgccttacagctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcaggtgcgtgcgggggccacacatgggggctggggktgtcctgggcacttcacaaggacctgtaaggtgcacccaccttgacgctctgccccaccttccccagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggtgaggtgggagcctgctgccgtcctggggtggtcagcggctgtgccggcaagatgcacctggctgcagcagaagtggggagtctggctctgagcac

SEQ ID NO: 25440 - DNA, 601 bp, Human
ggctctgagcaccctccagttttgagggtacagaggtgggcatctttttaaaggctcccaggtaggtcagatgtgggttcgttgagggggttaaagttccaaattcacgtgtattgaggctttgccgaatgcaggttggggtagtggccagccctgaaaggccccacgcttgcaccacgcatcccagcacacccttcctcccggggtcctcaccacacttgaaaaccctagcacactgactcacacccaccgaagatgccggcagggtgagagcgcacgctttcccaggagctgggcttcstgggctgtgtcagctgcgggagcaggagggaacctcccggccgagccccacaccctgagccctacgcccccagccccgccccagcccccactgggactcggccttctgaaaaaaggctggctttcttggtcattagttgaaggaaatacaacatttatgttgtgtgtcatgtgcagagaatgtggacaggaaaagaaatgccgatggggatgggcatggcccagtggccccagctgctgtgaccccctttctcctctccgcaggcggagtgtcccctctgccgggagaagttccctcccc

SEQ ID NO: 25441 - DNA, 601 bp, Human
ggcagggtgagagcgcacgctttcccaggagctgggcttcctgggctgtgtcagctgcgggagcaggagggaacctcccggccgagccccacaccctgagccctacgcccccagccccgccccagcccccactgggactcggccttctgaaaaaaggctggctttcttggtcattagttgaaggaaatacaacatttatgttgtgtgtcatgtgcagagaatgtggacaggaaaagaaatgccgatggggatgggcatggcccagtggccccagctgctgtgaccccctttctcctctccrcaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacc

SEQ ID NO: 25442 - DNA, 601 bp, Human
tggggatgggcatggcccagtggccccagctgctgtgaccccctttctcctctccgcaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcrctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcgtgctgggtggggtggggcacggaggctggcgggttgcttcagccagtgcagtgagaaca

SEQ ID NO: 25443 - DNA, 601 bp, Human
cacattagaacttctttgctttgcccctatccagtaccacatagtctatgccatctgtgcctggtgtagggtgacccattgcccccttttatatgaaattgagggactgccaaaaatgggaaagccccagccaactcaggatgtgttgctcaccctactattctgccatccaaaaattcttactgtgtcccagagtagggtctagggccatggtgattcaaaaaagtatgaaactttgtgagattcacttcacctctagtttgttaaattgggccctctggtgttaggtatggcctttaaytccttggaagatactagttgtggttcactccgttttataggtatggaaactgaagtgcagagaggtgaagtaaatggtagaagaggaaatggcagaagaatgatttgaaccttggattttgattgcaaaatttctaattaccaactttttttttcctttcattgattcagtaaattttcgggggcacgtaatatggcgtagtctcagttttaagtggagacaactgtggtgaccagtgagaaagctcttctccccttaatctcatagccccaaagaacgtatgttccagggcagagcagg

SEQ ID NO: 25444 - DNA, 601 bp, Human
cattactcagatagtcagacagaaaactagtttctctgatgagaactgtgaaggaaaagtgcttatgaaatgagggccaaaatgaggtctgttttgagatcagagaagactttcctgggaaagtgccatttaagttgagatctgtgagattatgtaaggaaaggaagggagagttggatagggagcgaagcattctagagaggagtatctgcagagactctgagtgcatttaatacaaggaaggcccgatggcagataatcaggggaagagagtttgagccatgatgggaaaagaacttayagaggggtaggtggtggccaaaatataaaggagcttctttaactttggaggctttaagagtcacatgatagatgcagtgtcctcctgtagatgtttccagtgttaggaacaattcccgatagattagcttgcatgtacacttttcccctttgccctcactaggagaaaacatatgtgtatgccagtgagtgagagtgaaacagagagagatagccctttgagtttaattaaaagcaaatcgtacaatctggagtactttacgtttgtaacacatcgtatctctcaactggtcatgacttt

SEQ ID NO: 25445 - DNA, 601 bp, Human
gatagccctttgagtttaattaaaagcaaatcgtacaatctggagtactttacgtttgtaacacatcgtatctctcaactggtcatgactttgctggggagagtgtttagatgagatgattcagtcctctcctctctagagttctgccttctaagatccagttcttgaccataaggagatctgcactttgatttctgttcattatcctatatacaaatgtcctttcctcagagaggctacctttgacctttatctaaagaagcctccttcactccccaggcccccaaaactttctactcckaagctgttttattttcatcatcacgtttgtcaccattgaacattatcttgttcatcttgttttttgctctcttcctccaccaggatgtatgcttgccatttgtattcatgaaagtgggatagtggctctcttgtcacagtgcatggcgtataggaaacagtaattgttaaataaactactgcatggatgaaagttgaatacaaaaattaactgggcatgatggcgtttgcctataatcccagctactcgggaggctgaggcacgagaatcgcttgaacctgggaggcagaggtcgcagtg

SEQ ID NO: 25446 - DNA, 601 bp, Human
gcaaatcgtacaatctggagtactttacgtttgtaacacatcgtatctctcaactggtcatgactttgctggggagagtgtttagatgagatgattcagtcctctcctctctagagttctgccttctaagatccagttcttgaccataaggagatctgcactttgatttctgttcattatcctatatacaaatgtcctttcctcagagaggctacctttgacctttatctaaagaagcctccttcactccccaggcccccaaaactttctactccgaagctgttttattttcatcatcacrtttgtcaccattgaacattatcttgttcatcttgttttttgctctcttcctccaccaggatgtatgcttgccatttgtattcatgaaagtgggatagtggctctcttgtcacagtgcatggcgtataggaaacagtaattgttaaataaactactgcatggatgaaagttgaatacaaaaattaactgggcatgatggcgtttgcctataatcccagctactcgggaggctgaggcacgagaatcgcttgaacctgggaggcagaggtcgcagtgagccaagatcacaccactgcactcc

SEQ ID NO: 25447 - DNA, 601 bp, Human
atacaaatgtcctttcctcagagaggctacctttgacctttatctaaagaagcctccttcactccccaggcccccaaaactttctactccgaagctgttttattttcatcatcacgtttgtcaccattgaacattatcttgttcatcttgttttttgctctcttcctccaccaggatgtatgcttgccatttgtattcatgaaagtgggatagtggctctcttgtcacagtgcatggcgtataggaaacagtaattgttaaataaactactgcatggatgaaagttgaatacaaaaattarctgggcatgatggcgtttgcctataatcccagctactcgggaggctgaggcacgagaatcgcttgaacctgggaggcagaggtcgcagtgagccaagatcacaccactgcactccagcctggcgatagagcaagactcgtctcaaaaacaaaaaaacaaacaaagaaggttgaatacaaatacaaagcaaaagtttacatcatacagacttggtagatatgtttttaaaagtaaaaataaaagactgaaattggccagaatttatttctagggacccagctgtcagtgcagactccgtgt

SEQ ID NO: 25448 - DNA, 601 bp, Human
cgtgtaatacctagacttggtgtgaggcatgactgagtatggttcagtttcctcctctaatcccgtaagatattagttctcaagaaaagagcccagggaattttaatttttactttggatcccgagcaggcatatttctctttggcctagcagaatttctttctagatctggatctgttctttgtaatgatttttgataaacaatattcaggatgtaaaatgcttagctatcatttgactgactccatcatcaggctttctcctacatgttcattttatcaaccctataaggtaggaactrgcttctccattttacagatgagaaacctgaggtggttccaaagaattgggtaatttgcccaaggttcctgtttgcttggattggattgcagcctgactcttcccaccactctgtgtgctgcctcagatactataggatatgagttcttcctagagttcttctgactttgagagtagctacagctggtttccctgaaggcaggagttcctaaccttttggggttgtggatccctttgagaatctggtgaaagctatgaagaccttccagaaggatgcacatactatacatgccattttgca

SEQ ID NO: 25449 - DNA, 601 bp, Human
gtaatacctagacttggtgtgaggcatgactgagtatggttcagtttcctcctctaatcccgtaagatattagttctcaagaaaagagcccagggaattttaatttttactttggatcccgagcaggcatatttctctttggcctagcagaatttctttctagatctggatctgttctttgtaatgatttttgataaacaatattcaggatgtaaaatgcttagctatcatttgactgactccatcatcaggctttctcctacatgttcattttatcaaccctataaggtaggaactagcytctccattttacagatgagaaacctgaggtggttccaaagaattgggtaatttgcccaaggttcctgtttgcttggattggattgcagcctgactcttcccaccactctgtgtgctgcctcagatactataggatatgagttcttcctagagttcttctgactttgagagtagctacagctggtttccctgaaggcaggagttcctaaccttttggggttgtggatccctttgagaatctggtgaaagctatgaagaccttccagaaggatgcacatactatacatgccattttgcatac

SEQ ID NO: 25450 - DNA, 601 bp, Human
aaaagagcccagggaattttaatttttactttggatcccgagcaggcatatttctctttggcctagcagaatttctttctagatctggatctgttctttgtaatgatttttgataaacaatattcaggatgtaaaatgcttagctatcatttgactgactccatcatcaggctttctcctacatgttcattttatcaaccctataaggtaggaactagcttctccattttacagatgagaaacctgaggtggttccaaagaattgggtaatttgcccaaggttcctgtttgcttggattgkattgcagcctgactcttcccaccactctgtgtgctgcctcagatactataggatatgagttcttcctagagttcttctgactttgagagtagctacagctggtttccctgaaggcaggagttcctaaccttttggggttgtggatccctttgagaatctggtgaaagctatgaagaccttccagaaggatgcacatactatacatgccattttgcatacagtctccgggtatatcgacctgtcaatgtccattgaccacccccaccccccagttaagaattacccacttctggctgggcg

SEQ ID NO: 25451 - DNA, 601 bp, Human
ttttacagatgagaaacctgaggtggttccaaagaattgggtaatttgcccaaggttcctgtttgcttggattggattgcagcctgactcttcccaccactctgtgtgctgcctcagatactataggatatgagttcttcctagagttcttctgactttgagagtagctacagctggtttccctgaaggcaggagttcctaaccttttggggttgtggatccctttgagaatctggtgaaagctatgaagaccttccagaaggatgcacatactatacatgccattttgcatacagtctcygggtatatcgacctgtcaatgtccattgaccacccccaccccccagttaagaattacccacttctggctgggcgtggtggctcaagcctgtaatcccagcactttgggaggccgaggctggtggatcacctgaggttaggagttcaagaccagcctggccaacatggtgaaaccccttctctactaaaaatacgaaaattagccggacatggtggcatgtgcatgtaatctcagctacttgggaggctgaggcaggagaatggcttgaacccgggaagtggaggttgcagtgagccaaga

SEQ ID NO: 25452 - DNA, 601 bp, Human
tggctgggcgtggtggctcaagcctgtaatcccagcactttgggaggccgaggctggtggatcacctgaggttaggagttcaagaccagcctggccaacatggtgaaaccccttctctactaaaaatacgaaaattagccggacatggtggcatgtgcatgtaatctcagctacttgggaggctgaggcaggagaatggcttgaacccgggaagtggaggttgcagtgagccaagatcatgctactgcacttcagcctgggcgacagagtgagactctgtctcaccaaaaaaaaaaaaaaattacccacttcttgccaaaatgcagcttcaagaaatgtaggaatgttctaggacagtgagactaaaacagaagcctctgttagccatcaaaggcactgacatcttactgtctgctgtaaatggcactccactgggcggcatgcagtatatttgactcacacatcaactttagcccttaaccccagtgggaaaaccactgtaaagatctggataccaggggccacatgtgtgctgatgcctgtggtttggtggggctacaacaggaaattcctgctttggaaagacagaaagcagatagcc

SEQ ID NO: 25453 - DNA, 601 bp, Human
atagaagtaaaaaaggtattgaaaataattattagaagaataaaatttttttatactatagctactaaaactgaactcagttaacaagtgaatatatatttctctgggctgtttgttgcagatgaatgacgcgatccactctagttaagcagaaagtcattttttttttaagggatatgcgataacttacagagttgttgaggagcttgagtctagaccgaggttccaggaacaagtctcggagaacttggctggcggtggaacagctgttgcctccactgatcccagagtcagctgtcttcccaatgaggaagccacccttgcagacttaggaacaccaagctgctgctgccagtgccacctaccccagtaaatctggggcctgtgtccagccgtcccccttgagttgaaatccagctcaaatgcatttgattggtggaattgaagttattatcacttatgcatgctggcagaactttcattacccgcatgatttacttacaccctatcagcaagcaaggctgagaaatgtaggctggtttttttggttttgtttttgtaggaaggcagaattcacaaagtcaaaaattgttaaaataga

SEQ ID NO: 25454 - DNA, 601 bp, Human
atgcatttgattggtggaattgaagttattatcacttatgcatgctggcagaactttcattacccgcatgatttacttacaccctatcagcaagcaaggctgagaaatgtaggctggtttttttggttttgtttttgtaggaaggcagaattcacaaagtcaaaaattgttaaaatagaagaaattttgagtgaccatgtgcctgctgtccaccacagggcgcttattgtccagaggacaaagctttaggtagctctaagtgcttgcttgtgaaatgtcttctaaaaagttacaaattaasgtcttattctaatgtggtaataatacctttgtgagagggtccctcagagagttgctgtccccaaattacaattggcctttagcttctatcagagaactttgagtacattttctttgccattttgcatttatagaaacaactccaaaacctagaagatgcttgtgatgacatcatgcttgcagatgatgattgcttaatgataccttatcaaattggtgatgtcttcattagccattctcaagaagaaacgcaagaaatgttagaagaagcaaaggtatgttaaaggttaattctgaaatt

SEQ ID NO: 25455 - DNA, 601 bp, Human
tatggtttttgtggctattgtgaatcccctgccccatacacagatagctactgaacttttattttattttatttatttatttatttatttattttttgagatggagtcttgccctgtcgcccaggctggagtgcaatggcgcaatctcggctcactgcaacgtctgcctcctgggttcaaacaattctcctgcctcagcctcccgagtagctgggattacaggcgcccaccaccacgcccagctaatttttgtacttttggtagagacagggtttcaccatgttgggcagactggtctcgractcctgacctcgtgctcgtgatccacccgcctcagcctcccaaagtgctgggattacaggcgtgagccaccacacccggctgaacctttctttttttactcattctagaattctagaatgaatggagtgcttactctgtatcaggttctgccatgtactagggataattggggacaacaaaacctgcctggcccctgcctgcatggagcatatagtctagatggaaagaaaaaaaagtaaacaaaactgataatgagtagaaagtgatatgaggatagaggtggctttaagaacacagg

SEQ ID NO: 25456 - DNA, 601 bp, Human
agcaaaactttcttttttaaaaattttcatttatttaatggaaacttgcccattttcacatgtctgcttatttattttatatttttaaaagaagacagtattcacctatgtattttgcataacgattatatcaagtctaggggcttcatgtcatgttattaaaatcagttaagcaatcttttatgtttctatattatttagaatatttgttgttgcaattttcacataagaaaatttaacagttgtgtcatgttgtttctgtctgattttaattgctgtctaatgacggggaaagcacgaygaaaagatgtacaatcctgcatccttgcttatttcacaactaaagctttgtcatagacttcaaaatatatatgtatatattttatttaaatatatgttacatattatatttaaacatacatatttaacattttttacatatctatcaatatcagagatttgggtaaaagaatgggtaatgtttaaacatgtggaggcatgtggagctttatacaaacagggcagaaccacagaagaacgttttagaaaccaagagatgtgcagaaagaaatgtttagtgttttttcgttttaaattttag

SEQ ID NO: 25457 - DNA, 601 bp, Human
caattctcctgcctcagcctcccaagcagctgggattacaggcatgcgccaccacacccagcttttttaaaatttttttatttattttttatttttagtagagatagggtttcgccatgttggccaggctggtctcgaactcctgacctcaggtcatccacccgcttcggcctcccaaagtgtagtttttctcccttgaagcggttatgtaatttcagtgcaatattaaatatgaccagggaagcatattgtttaacagcaactcgatgagaggcggcattgaggcaaagcagctgtcccyaggtttgtgaacatcctcgtaggggatggagaaggctgcccgttggaagcagccaggcctcacggttcccgcttgtccacctcatcccgtctggcacagcacagtgagtgcacagaccgggacagtggccacaagtccgggcccaagcttgcccctggcccttcagtggttccgattccctttatgcagaactgcccagcccaggtctgtcctgagtgcgaggcagatgctcacccacgatccagcttcccacagatgcatgagaaatcagtgtgaagatggcctagtgtcttagattct

SEQ ID NO: 25458 - DNA, 601 bp, Human
acaggcatgcgccaccacacccagcttttttaaaatttttttatttattttttatttttagtagagatagggtttcgccatgttggccaggctggtctcgaactcctgacctcaggtcatccacccgcttcggcctcccaaagtgtagtttttctcccttgaagcggttatgtaatttcagtgcaatattaaatatgaccagggaagcatattgtttaacagcaactcgatgagaggcggcattgaggcaaagcagctgtccccaggtttgtgaacatcctcgtaggggatggagaaggcygcccgttggaagcagccaggcctcacggttcccgcttgtccacctcatcccgtctggcacagcacagtgagtgcacagaccgggacagtggccacaagtccgggcccaagcttgcccctggcccttcagtggttccgattccctttatgcagaactgcccagcccaggtctgtcctgagtgcgaggcagatgctcacccacgatccagcttcccacagatgcatgagaaatcagtgtgaagatggcctagtgtcttagattcttaattccgtaattgtaacgtatcctgttcaaagccgt

SEQ ID NO: 25459 - DNA, 601 bp, Human
ttatttttagtagagatagggtttcgccatgttggccaggctggtctcgaactcctgacctcaggtcatccacccgcttcggcctcccaaagtgtagtttttctcccttgaagcggttatgtaatttcagtgcaatattaaatatgaccagggaagcatattgtttaacagcaactcgatgagaggcggcattgaggcaaagcagctgtccccaggtttgtgaacatcctcgtaggggatggagaaggctgcccgttggaagcagccaggcctcacggttcccgcttgtccacctcatccygtctggcacagcacagtgagtgcacagaccgggacagtggccacaagtccgggcccaagcttgcccctggcccttcagtggttccgattccctttatgcagaactgcccagcccaggtctgtcctgagtgcgaggcagatgctcacccacgatccagcttcccacagatgcatgagaaatcagtgtgaagatggcctagtgtcttagattcttaattccgtaattgtaacgtatcctgttcaaagccgtgtcattctctgaagctgttgccaggaagtactgagatgtttgtttaccgat

SEQ ID NO: 25460 - DNA, 601 bp, Human
agagtttagaatggttgatttctctacccacggccattctgcctcacccctcgtggggcaccccccgaacgcgccatggttacggcgatgagacgtgctgtttgctccccgcgcaggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagaggtaaagcgctcagaggaascggcgggaggccagtggggcccgacgtgtgcccagctcagacgttaccacgggctctagaacattctgcagattgggtgtcctggtgctggtctcgtaacttgacttttaggagctattgccagaacattgttctctggtctacttttcatttttaattttaaaacattccttgtttttaacctgatgatagaaaacagtttattagaatttggaaggaagaaacaaagtaattatcctctaaatgtcctacccaaacatctccagaaggagtggcaagcaggaaactgttgtgtggatt

SEQ ID NO: 25461 - DNA, 601 bp, Human
acccacggccattctgcctcacccctcgtggggcaccccccgaacgcgccatggttacggcgatgagacgtgctgtttgctccccgcgcaggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagaggtaaagcgctcagaggaaccggcgggaggccagtggggcccgaygtgtgcccagctcagacgttaccacgggctctagaacattctgcagattgggtgtcctggtgctggtctcgtaacttgacttttaggagctattgccagaacattgttctctggtctacttttcatttttaattttaaaacattccttgtttttaacctgatgatagaaaacagtttattagaatttggaaggaagaaacaaagtaattatcctctaaatgtcctacccaaacatctccagaaggagtggcaagcaggaaactgttgtgtggattttccacactactcattagaaacgca

SEQ ID NO: 25462 - DNA, 601 bp, Human
acactactcattagaaacgcagccagcgatgtcctgccctgtgtaacctacggattcacgaagtgtcgtgggggccacagcgtttgatccgaggtgctctaggctcagcaggttatcactaaagactgtggggcgcaccgtacaatttctgaagcaatttgcatgaaaaccatgtggaatggtaaatagaataagtgtctcccctttaaggacgaggtgctcgagactgggagagtgcccgaatccagtccccagcatggcgcctcccagtcctctgtgtgcgtgtcctgttcccagtgaygcctcactggacattctcagtgcgtgggcgtgaaccccacagttggtggaaaatcaccgagttggaaggctgctcggagcagttggatttttccattccctgggaagacccacagtctctgggcattaagcacttagtgagtctggcactcacttgtttccgtgggagagatccagccgtggctgtcgacagcagctgccgactgtgcccaatagagaaggtatctgggaaagagcccagcacggggcctgggagtgtgagtgtgtcctggcacaggcaggcagaaggtgtccaacgtgc

SEQ ID NO: 25463 - DNA, 601 bp, Human
cccagcatggcgcctcccagtcctctgtgtgcgtgtcctgttcccagtgatgcctcactggacattctcagtgcgtgggcgtgaaccccacagttggtggaaaatcaccgagttggaaggctgctcggagcagttggatttttccattccctgggaagacccacagtctctgggcattaagcacttagtgagtctggcactcacttgtttccgtgggagagatccagccgtggctgtcgacagcagctgccgactgtgcccaatagagaaggtatctgggaaagagcccagcacggggcckgggagtgtgagtgtgtcctggcacaggcaggcagaaggtgtccaacgtgcaactggagagcgcagaggtggctcaagtccccttcgtcacaggagtctggaaggctactgcatagcgtttgccttagtagaaaatggaccatttttgaagcctaggtccctgcaggcctcctggctaactcggctgtcaaagccccttttctctgctttctgagctgtttccaggactgagtgggtgctccctctgtttctctgctttctgagctgtgtccggggctccctctgtttctcttccagccac

SEQ ID NO: 25464 - DNA, 601 bp, Human
cccacagttggtggaaaatcaccgagttggaaggctgctcggagcagttggatttttccattccctgggaagacccacagtctctgggcattaagcacttagtgagtctggcactcacttgtttccgtgggagagatccagccgtggctgtcgacagcagctgccgactgtgcccaatagagaaggtatctgggaaagagcccagcacggggcctgggagtgtgagtgtgtcctggcacaggcaggcagaaggtgtccaacgtgcaactggagagcgcagaggtggctcaagtccccttcstcacaggagtctggaaggctactgcatagcgtttgccttagtagaaaatggaccatttttgaagcctaggtccctgcaggcctcctggctaactcggctgtcaaagccccttttctctgctttctgagctgtttccaggactgagtgggtgctccctctgtttctctgctttctgagctgtgtccggggctccctctgtttctcttccagccaccagaggaccttcgttctggaggtgatgggacgacactgtgggtacgtacctgcggtgggtccggtggacgcggttcaggtggggga

SEQ ID NO: 25465 - DNA, 601 bp, Human
acagttggtggaaaatcaccgagttggaaggctgctcggagcagttggatttttccattccctgggaagacccacagtctctgggcattaagcacttagtgagtctggcactcacttgtttccgtgggagagatccagccgtggctgtcgacagcagctgccgactgtgcccaatagagaaggtatctgggaaagagcccagcacggggcctgggagtgtgagtgtgtcctggcacaggcaggcagaaggtgtccaacgtgcaactggagagcgcagaggtggctcaagtccccttcgtcrcaggagtctggaaggctactgcatagcgtttgccttagtagaaaatggaccatttttgaagcctaggtccctgcaggcctcctggctaactcggctgtcaaagccccttttctctgctttctgagctgtttccaggactgagtgggtgctccctctgtttctctgctttctgagctgtgtccggggctccctctgtttctcttccagccaccagaggaccttcgttctggaggtgatgggacgacactgtgggtacgtacctgcggtgggtccggtggacgcggttcaggtgggggaccc

SEQ ID NO: 25466 - DNA, 601 bp, Human
acttagtgagtctggcactcacttgtttccgtgggagagatccagccgtggctgtcgacagcagctgccgactgtgcccaatagagaaggtatctgggaaagagcccagcacggggcctgggagtgtgagtgtgtcctggcacaggcaggcagaaggtgtccaacgtgcaactggagagcgcagaggtggctcaagtccccttcgtcacaggagtctggaaggctactgcatagcgtttgccttagtagaaaatggaccatttttgaagcctaggtccctgcaggcctcctggctaactcrgctgtcaaagccccttttctctgctttctgagctgtttccaggactgagtgggtgctccctctgtttctctgctttctgagctgtgtccggggctccctctgtttctcttccagccaccagaggaccttcgttctggaggtgatgggacgacactgtgggtacgtacctgcggtgggtccggtggacgcggttcaggtgggggaccctcagcatcatctccctgaggctgcaccccacatcctgaatgctcccgtggaaagtcctgaaggggccggcatcccgcttcatacctggcgtta

SEQ ID NO: 25467 - DNA, 601 bp, Human
tgaagcctaggtccctgcaggcctcctggctaactcggctgtcaaagccccttttctctgctttctgagctgtttccaggactgagtgggtgctccctctgtttctctgctttctgagctgtgtccggggctccctctgtttctcttccagccaccagaggaccttcgttctggaggtgatgggacgacactgtgggtacgtacctgcggtgggtccggtggacgcggttcaggtgggggaccctcagcatcatctccctgaggctgcaccccacatcctgaatgctcccgtggaaagtcytgaaggggccggcatcccgcttcatacctggcgttaggtctgcacgtctgtcgctgagcggggtgcctgggctgccctcgtgggaaggatccttctggggtgttgatgctgttgccttgtccacataggtacctggccctggtgagtgccttggcctgcggtgcggactgggtgttccttccagaatctccaccagaggaaggctgggaggagcagatgtgtgtcaaactctcggaggtaatgcgggtcccgtggccgttgatagcgggcgatgctggctgcattgctttaatcaggatc

SEQ ID NO: 25468 - DNA, 601 bp, Human
agccccttttctctgctttctgagctgtttccaggactgagtgggtgctccctctgtttctctgctttctgagctgtgtccggggctccctctgtttctcttccagccaccagaggaccttcgttctggaggtgatgggacgacactgtgggtacgtacctgcggtgggtccggtggacgcggttcaggtgggggaccctcagcatcatctccctgaggctgcaccccacatcctgaatgctcccgtggaaagtcctgaaggggccggcatcccgcttcatacctggcgttaggtctgcaygtctgtcgctgagcggggtgcctgggctgccctcgtgggaaggatccttctggggtgttgatgctgttgccttgtccacataggtacctggccctggtgagtgccttggcctgcggtgcggactgggtgttccttccagaatctccaccagaggaaggctgggaggagcagatgtgtgtcaaactctcggaggtaatgcgggtcccgtggccgttgatagcgggcgatgctggctgcattgctttaatcaggatcccaagtgggacggcattttaagcaagtgaaaaaatttctctgtct

SEQ ID NO: 25469 - DNA, 601 bp, Human
tttctctgctttctgagctgtttccaggactgagtgggtgctccctctgtttctctgctttctgagctgtgtccggggctccctctgtttctcttccagccaccagaggaccttcgttctggaggtgatgggacgacactgtgggtacgtacctgcggtgggtccggtggacgcggttcaggtgggggaccctcagcatcatctccctgaggctgcaccccacatcctgaatgctcccgtggaaagtcctgaaggggccggcatcccgcttcatacctggcgttaggtctgcacgtctgtygctgagcggggtgcctgggctgccctcgtgggaaggatccttctggggtgttgatgctgttgccttgtccacataggtacctggccctggtgagtgccttggcctgcggtgcggactgggtgttccttccagaatctccaccagaggaaggctgggaggagcagatgtgtgtcaaactctcggaggtaatgcgggtcccgtggccgttgatagcgggcgatgctggctgcattgctttaatcaggatcccaagtgggacggcattttaagcaagtgaaaaaatttctctgtctccagttt

SEQ ID NO: 25470 - DNA, 601 bp, Human
gcccctgctgtagacggggctgcaggctgccggggctggggatgggctgtggctccagcagccacggggcagaagacgtccccacctggctttgcaagtcggcttctttattgtgctttgttatggtcagttaaggagcaaagcatatctctggatatgaaaacagtgatggacacctgggaaagacatctgccaatatttataagtggtcatccataaagtccaggcaaagattttatttcccgcttaactgtaattaaattataggacaatggaccgagaaggaaccaaggaatttacrtagcccagccccactgtccttacagaggaataagctgagttccagagacagtcagtggcctctccagatcaccgggccggtgtgcccatgggctggggcgaggggaacgccttgattgggctggcttgtgctgttcaaatcacagctgaacaaattaaagctggttcaaggaagatgtttacattttttgtaaaatataagtaatagtttaaatgcaagctactgaaacgttacttttttatttttcttttttaaagcaacgaacatattacttgtattcattttctaggtgcgagccaa

SEQ ID NO: 25471 - DNA, 601 bp, Human
aacgttacttttttatttttcttttttaaagcaacgaacatattacttgtattcattttctaggtgcgagccaagatcttgtctggtaacaacagtattatttttaaaaccaattttcagctgcctgttatatacactaaacgttctgctaggaaacaaaatttagaaataacttttcccatttagatctgaagaaagagcgaaaaaccttttccagtgcccagtacctccttccagatctgggctgctgtgtccgcatcacagttccgcatcctaacgagatgtttccttgcagcttgtygtcacgcagctgggctatgacacacgtgtgaccatcctcgggcacgtgcagagaggagggaccccttcggcattcgacaggatcttggtgagttgggaagggttgggcatcttcacaaggtctctaggaggaagcgtttctggagaggcacaggcaccagccggccacagaggctggcaaggtgctccccgagagatgcccgcggcccggccctcatcttaacgatccttgagacctttggtgtagaccagtctctaggcctgcagccattcagatgcggggagagctccctaatgtggg

SEQ ID NO: 25472 - DNA, 601 bp, Human
ggaggcagtcatcgccttgctagaggccaccccggacaccccagcttgcgtcgtgtcactgaacgggaaccacgccgtgcgcctgccgctgatggagtgcgtgcagatggtgagtgggcagcccatggccaagggcagggcggagacggctgggacagaagctgcttgtcaggccagcctgggcaccttgggtgtctcgtcggtgcacgatgcattacacggcctttctgagaaggaggtgagctgcccgtggggagggagaaggcttgtgttctctcccacacctgcagagcctgcgccrtcttcgctctttggttttctaagttaccatccatctgtgtggcacatagtcgtaacctcccctgagtgggggtctagagcatcgggatcctcaacagtcgaggatccaggtggccccagtgcaccaggtgctgcagaaggacagagtgcagggaggcagccgagagagagagatccgtggacagactgcagggaggcgggcgtgagagagacccatggggcagagggggcagggaggcagggaggcgggcgtgagagagatctacagggtggtattttgtaggggaaggtgggaccttcc

SEQ ID NO: 25473 - DNA, 601 bp, Human
agatacacccacccttcttgggccagggaactgtctgcctgcaaatgaacaaagggaaaagcagttccagcttttcaggcattggttcagtagtggaggtggctgtggagttagctgcatttgaagttatttaattaattaatttatttatttagagacggagtctcactgttgcccaggctagagtgcagtggcgtgatcttggctcactgcaagctccgcctcctgggttcacgccattctcctgcctcagcctcccgagtagctgggactacaggtgcccaccaccacgcctggctatttttttttttttttttttttttttgtatttttagtagaggtggggtttcaccgtgttagccaggatggtctggatctcctgaccttgtgatccatccacctcggcctcccaaagtgctgggattacaggcatgagccaccacgcccagctgttgttttatttttcagagttcattcatgattcatgactcctgttttgttgcctcttaacacacacaaagaagtcgtgaagcaatcaagtcagggacttgttgaaagtcaccttgtaaacataatttccaaaagcccaagggagaaaata

SEQ ID NO: 25474 - DNA, 601 bp, Human
tgtgtgtatgtatgtatatgtgtgtgcatgtgtatctctgtatatgcatatacatgcaggtttatgcatatatttatgcatgtgtgtgcatgtttgtgaggtagtttgggtctgcatgtatgtgtatgtttatatgcatgagtatgcatgtttgtggtagtatgtctgcatgtatgtgtgtgcatgtttgtgtgcatgcatgtttgtacgtgtgtgcatgtttttgtgaggtagtgtgtgtgcatgttagtgtgtgtgcatgtgtgtatatgcatgtgtacatttgagtgtgaggtagtaygtttctgcatgttagtgtgtgcatgtatgtttatatgcatgtgtatatatgtgtgtgaggtaatgcatctgcatgtgtgtgcatgtatgcttatatgcatgtgtgagcatgtttgagatagtgtgtgcatgtctgtgtgtgcatgtgtttatatggatgtgtgtgtatgtttgtgagaggtagtatgtgcctgcatgtttgtgtgtgtgtgcaggtatgtttctatgcagatgtgtgcatgttggcatgagtgtgaggtagcgtgtgtctgcatgtttgtgtgtgcaggtatgcttatgt

SEQ ID NO: 25475 - DNA, 601 bp, Human
cgtgtgtctgcatgtttgtgtgtgcaggtatgcttatgtgcatatgtgtgcatgttggagtgtgaggtagtgtgtgtctgcacgttagtgtgtgcctgtgtgcatgtgagaggcagtaggcttaaaaggctcagagcactgaacgacatgcggtacgtgtattttgagcctgtgtctcatgtctctgcttgtctagagacgaccgtggtaggtgtcacttgccctgaccttgaaaccacccttgtgtggctttgtttttaaagctgagggaccactactgtgcacctgctgtttgtcaggygtcttcctgagggtctgacatgcttgaataaccttagagatagctggaagtaggagtatttttctcatcttacagatgaggaaattgaagttcagagcgagaaagaacttgaccaagatcctgacgttgcccagggctgcctggcgtgcatcagtcccagccccgtgtcccagggcctccatccgggcccctctgctcccccgcccgctgtgacctcgctcccatcccacatcccccagtgagctggtgtgttctgttttgtttttccccaccataatcaaattgagaattccttagaac

SEQ ID NO: 25476 - DNA, 601 bp, Human
ttcctcagaagcctcctgagctaagcagtcccagggctctgacctcacagccgggccgtgtggggctggctgccaaccagcattaggacacacttggcggccggtcgtctagaccattaaccctggggctgctggctgcccgggtcagactggagggggctggtgggaaggaccgagccagtctctacctaccccatccatgatgcaccaggtcctgacacattctttcttcttttcatcattgttttaaaagactcaggatgtgcagaaggcgatggacgagaggagatttcaagatgcrgttcgactccgagggaggtgaggtgctttggagaaagctctgccctgtcaggaacacacacccctcaggcccagccactgcaaacgtgcttaggggttgtgcttattccatgtcactgtgaaaaatcagaaagtcaggcagtactcacagcaccgctcttgcagtagcaggccctggtgactggttagagagaaatcattttctaaatttgccattggtcctttttggtaaggtgatggttgtttaggagctaatgagattaaggcacaaggtgacttgtggccctttaacaacaaacca

SEQ ID NO: 25477 - DNA, 601 bp, Human
caaccagcattaggacacacttggcggccggtcgtctagaccattaaccctggggctgctggctgcccgggtcagactggagggggctggtgggaaggaccgagccagtctctacctaccccatccatgatgcaccaggtcctgacacattctttcttcttttcatcattgttttaaaagactcaggatgtgcagaaggcgatggacgagaggagatttcaagatgcagttcgactccgagggaggtgaggtgctttggagaaagctctgccctgtcaggaacacacacccctcaggcccrgccactgcaaacgtgcttaggggttgtgcttattccatgtcactgtgaaaaatcagaaagtcaggcagtactcacagcaccgctcttgcagtagcaggccctggtgactggttagagagaaatcattttctaaatttgccattggtcctttttggtaaggtgatggttgtttaggagctaatgagattaaggcacaaggtgacttgtggccctttaacaacaaaccaaaacaaaaaaaggagtctccttctgttgcctaggctagagtgcagtggtgccatctcagctccctgcaatctc

SEQ ID NO: 25478 - DNA, 601 bp, Human
ctctgccctgtcaggaacacacacccctcaggcccagccactgcaaacgtgcttaggggttgtgcttattccatgtcactgtgaaaaatcagaaagtcaggcagtactcacagcaccgctcttgcagtagcaggccctggtgactggttagagagaaatcattttctaaatttgccattggtcctttttggtaaggtgatggttgtttaggagctaatgagattaaggcacaaggtgacttgtggccctttaacaacaaaccaaaacaaaaaaaggagtctccttctgttgcctaggctaragtgcagtggtgccatctcagctccctgcaatctctgcctcccatgttcaagcaattctcatgcctcagcctcccaagtagctgcgactaccagctcgtaccagtgcatgtcaccacatccagctaatttttgtatttttagtacaggcggggtttcaacatgttggccaggctggtctcaaactcctgacctcaaatgattcacccacctcagcctcccaaagtgctgggattacaggcttgagccaccactcccatgtcttgcaagagaaagttatgaagtgtagaagcgtgcccttt

SEQ ID NO: 25479 - DNA, 601 bp, Human
tagagagaaatcattttctaaatttgccattggtcctttttggtaaggtgatggttgtttaggagctaatgagattaaggcacaaggtgacttgtggccctttaacaacaaaccaaaacaaaaaaaggagtctccttctgttgcctaggctagagtgcagtggtgccatctcagctccctgcaatctctgcctcccatgttcaagcaattctcatgcctcagcctcccaagtagctgcgactaccagctcgtaccagtgcatgtcaccacatccagctaatttttgtatttttagtacagrcggggtttcaacatgttggccaggctggtctcaaactcctgacctcaaatgattcacccacctcagcctcccaaagtgctgggattacaggcttgagccaccactcccatgtcttgcaagagaaagttatgaagtgtagaagcgtgcccttttctcttagtccatttccaccagacacggacagcaccgcgggtcgcggctaagggctctgccatgcacatggaatcctggggcctcctccttctgcccagatagtcgggcagacacatcgagtgctggcagataagccgccttttctcc

SEQ ID NO: 25480 - DNA, 601 bp, Human
tttctgcgattaccttagtttgcttagtaatctgttttccttttttctccctagtttgtaagaaaagaaattttcccttaatcttttaccaacttagaaaccatcatgttacttttcttttagttgccggtggcgggatacggtgagctgatgtatctcacacgtggctcaggatgagacacagaggccccgacaggcagggagaacgcagcccctctgctgctcttcatgagttgttaaccttggacttctgcttctcaccttgattcatccgggcatcgtgataaatgctgtctcataygcctctcaaatctttaccggaatgcagcttgttgaaaagtacagaaagctatttttagcactttgcaacttgcctttcattgttcactttagctgtttcgttctgtgtttgcacattagatcaaagaaatcggctggacagatgtcgggggctggaccggccaaggaggctccattcttgggacaaaacggtaacttccaaatctcaactctatgacctgcttttaaggaagaaggaagagccgtgttctgggagagaatcgctgggtgccgacgccagttggattcctggaaaggcgtc

SEQ ID NO: 25481 - DNA, 601 bp, Human
actttagctgtttcgttctgtgtttgcacattagatcaaagaaatcggctggacagatgtcgggggctggaccggccaaggaggctccattcttgggacaaaacggtaacttccaaatctcaactctatgacctgcttttaaggaagaaggaagagccgtgttctgggagagaatcgctgggtgccgacgccagttggattcctggaaaggcgtccctaagggaggggtgcaggcagttaccggtcctccctccagtggaactgcccgtgttccagggagctggggatgtgtcccagggcrtaagagagaagaggaggtaacttgtgaatgccttcctctaattcatatttccattcatttgaaaagccagctggcgagcctaaagcctccacttggaggtcataaagatgagtggtgtcacggagccgtggagatggcactctaagcaaaccctaaagcagcctggatagcaggtagcattggtgggaagcatagccctgagcagctgtgactcgaggctcagatttccacagccgaggaaaggacccaaggaattctagtctaaaaatctctttttcagacctacagtaagcctggcgt

SEQ ID NO: 25482 - DNA, 601 bp, Human
tttcgttctgtgtttgcacattagatcaaagaaatcggctggacagatgtcgggggctggaccggccaaggaggctccattcttgggacaaaacggtaacttccaaatctcaactctatgacctgcttttaaggaagaaggaagagccgtgttctgggagagaatcgctgggtgccgacgccagttggattcctggaaaggcgtccctaagggaggggtgcaggcagttaccggtcctccctccagtggaactgcccgtgttccagggagctggggatgtgtcccagggcgtaagagagawgaggaggtaacttgtgaatgccttcctctaattcatatttccattcatttgaaaagccagctggcgagcctaaagcctccacttggaggtcataaagatgagtggtgtcacggagccgtggagatggcactctaagcaaaccctaaagcagcctggatagcaggtagcattggtgggaagcatagccctgagcagctgtgactcgaggctcagatttccacagccgaggaaaggacccaaggaattctagtctaaaaatctctttttcagacctacagtaagcctggcgtccctgcatcc

SEQ ID NO: 25483 - DNA, 601 bp, Human
tctgtgtttgcacattagatcaaagaaatcggctggacagatgtcgggggctggaccggccaaggaggctccattcttgggacaaaacggtaacttccaaatctcaactctatgacctgcttttaaggaagaaggaagagccgtgttctgggagagaatcgctgggtgccgacgccagttggattcctggaaaggcgtccctaagggaggggtgcaggcagttaccggtcctccctccagtggaactgcccgtgttccagggagctggggatgtgtcccagggcgtaagagagaagaggakgtaacttgtgaatgccttcctctaattcatatttccattcatttgaaaagccagctggcgagcctaaagcctccacttggaggtcataaagatgagtggtgtcacggagccgtggagatggcactctaagcaaaccctaaagcagcctggatagcaggtagcattggtgggaagcatagccctgagcagctgtgactcgaggctcagatttccacagccgaggaaaggacccaaggaattctagtctaaaaatctctttttcagacctacagtaagcctggcgtccctgcatccctgggg

SEQ ID NO: 25484 - DNA, 601 bp, Human
gggcgtaagagagaagaggaggtaacttgtgaatgccttcctctaattcatatttccattcatttgaaaagccagctggcgagcctaaagcctccacttggaggtcataaagatgagtggtgtcacggagccgtggagatggcactctaagcaaaccctaaagcagcctggatagcaggtagcattggtgggaagcatagccctgagcagctgtgactcgaggctcagatttccacagccgaggaaaggacccaaggaattctagtctaaaaatctctttttcagacctacagtaagcctsgcgtccctgcatccctggggacaatgggatttcctaatgtagatgaagcctgagtaattctcacctttgatcatgtcagaggtgcgaatattaatctctgtcatcactacacattacaatttcacatggaaggaaggtagtttttggcaaatataataaatgatggattccatgtaattccggcttattgttccaagggagttagctgcaccctttgctttgctttacagccaggaccctggtactcccagccactggtgggatggtgggagcctcggagctgggttagctctacagctg

SEQ ID NO: 25485 - DNA, 601 bp, Human
ctactcgggaggctgaggcacgagaatcacttgaacccgggaggcggagcttgcagtgagctgagattacgccactacactccagcctggtaacaaagtgagactccatcttggaaaaaaaaaattgttattaattataacttcttaattttattttttctaatggggcagtagagttctttttaggtcaaggtatgagctgaaatgctttattccattttctcatgaaaacactgttttgagatgagattcctggtcattctgccatctgccagccacaacggcatgagtgaaaaggcaracgtttaccgctccttaattaaaaccacagactggggaaggcggccgggtggggaccggcgtggcgtcccgcggaccgcgtggagtttggggtgtctgacatcgttctccacgtggctattttcagcgttctcccggggaagtacttggaagagatcgccacacagatgcgcacgcacagcatcaacgcgctgctgatcatcggtggattcgaggtacgttaccgtttctctcttgccggtcttgcaggtgtgagccgcgccctgtgttggctaaacattaagttacttgttggctactg

SEQ ID NO: 25486 - DNA, 601 bp, Human
gagctgagattacgccactacactccagcctggtaacaaagtgagactccatcttggaaaaaaaaaattgttattaattataacttcttaattttattttttctaatggggcagtagagttctttttaggtcaaggtatgagctgaaatgctttattccattttctcatgaaaacactgttttgagatgagattcctggtcattctgccatctgccagccacaacggcatgagtgaaaaggcaaacgtttaccgctccttaattaaaaccacagactggggaaggcggccgggtggggacyggcgtggcgtcccgcggaccgcgtggagtttggggtgtctgacatcgttctccacgtggctattttcagcgttctcccggggaagtacttggaagagatcgccacacagatgcgcacgcacagcatcaacgcgctgctgatcatcggtggattcgaggtacgttaccgtttctctcttgccggtcttgcaggtgtgagccgcgccctgtgttggctaaacattaagttacttgttggctactggccacgatccgagatgataggttcccagacccagcggccactggagaattgtagaac

SEQ ID NO: 25487 - DNA, 601 bp, Human
acgtttaccgctccttaattaaaaccacagactggggaaggcggccgggtggggaccggcgtggcgtcccgcggaccgcgtggagtttggggtgtctgacatcgttctccacgtggctattttcagcgttctcccggggaagtacttggaagagatcgccacacagatgcgcacgcacagcatcaacgcgctgctgatcatcggtggattcgaggtacgttaccgtttctctcttgccggtcttgcaggtgtgagccgcgccctgtgttggctaaacattaagttacttgttggctactgsccacgatccgagatgataggttcccagacccagcggccactggagaattgtagaacagcaggatagcaggtggtaagacgtggcctacgagtggcccagttccagtaaagcaacttaaccgagaagcaaaagcttgactccttaaccgggcctcatctattcagtgagctcttaatgtatttcaggcctgtggaagtaattctatctcttgagtccagagtccagtggctacttagagactaaggtagttatacctagaattttgtttaaaatcacatattggactgtagaccctaatat

SEQ ID NO: 25488 - DNA, 601 bp, Human
cagacccagcggccactggagaattgtagaacagcaggatagcaggtggtaagacgtggcctacgagtggcccagttccagtaaagcaacttaaccgagaagcaaaagcttgactccttaaccgggcctcatctattcagtgagctcttaatgtatttcaggcctgtggaagtaattctatctcttgagtccagagtccagtggctacttagagactaaggtagttatacctagaattttgtttaaaatcacatattggactgtagaccctaatattttttctattcatgaagattagtcycatggtaacctttccatttacttttagaaaaagtaaaaactggccgggcgcggtggctcacgcctgtaatcccagcactttgggaggccgaggcgggcagatcacctgaggtcaggagttcaagaccagcctgaccaacatggtgaaaccccgtctctactaaaaatacaaaaattagccgggtgtggtggcgggtgcctgtagtcccagctacccgggaggctgaggcaggagaatcgcttgaacccgggaggcagaggttgcagtgagccgagattgcaccacctcactccagcctgg

SEQ ID NO: 25489 - DNA, 601 bp, Human
tggaagtaattctatctcttgagtccagagtccagtggctacttagagactaaggtagttatacctagaattttgtttaaaatcacatattggactgtagaccctaatattttttctattcatgaagattagtcccatggtaacctttccatttacttttagaaaaagtaaaaactggccgggcgcggtggctcacgcctgtaatcccagcactttgggaggccgaggcgggcagatcacctgaggtcaggagttcaagaccagcctgaccaacatggtgaaaccccgtctctactaaaaatacaaaaattagccgggtgtggtggcgggtgcctgtagtcccagctacccgggaggctgaggcaggagaatcgcttgaacccgggaggcagaggttgcagtgagccgagattgcaccacctcactccagcctgggccacaaagcgagactccgtctcaaaaaacaaaaacaaagtaagaacctcagaaatgagactcttacccatgagaggtttagtcatctaaccgatcatgtctgtcctgcgccctttgtgcttacaacctgccgatccttgtctgtggtcttaaggcaactgtgtgt

SEQ ID NO: 25490 - DNA, 601 bp, Human
aagtaattctatctcttgagtccagagtccagtggctacttagagactaaggtagttatacctagaattttgtttaaaatcacatattggactgtagaccctaatattttttctattcatgaagattagtcccatggtaacctttccatttacttttagaaaaagtaaaaactggccgggcgcggtggctcacgcctgtaatcccagcactttgggaggccgaggcgggcagatcacctgaggtcaggagttcaagaccagcctgaccaacatggtgaaaccccgtctctactaaaaatayaaaaattagccgggtgtggtggcgggtgcctgtagtcccagctacccgggaggctgaggcaggagaatcgcttgaacccgggaggcagaggttgcagtgagccgagattgcaccacctcactccagcctgggccacaaagcgagactccgtctcaaaaaacaaaaacaaagtaagaacctcagaaatgagactcttacccatgagaggtttagtcatctaaccgatcatgtctgtcctgcgccctttgtgcttacaacctgccgatccttgtctgtggtcttaaggcaactgtgtgttga

SEQ ID NO: 25491 - DNA, 601 bp, Human
tacttttagaaaaagtaaaaactggccgggcgcggtggctcacgcctgtaatcccagcactttgggaggccgaggcgggcagatcacctgaggtcaggagttcaagaccagcctgaccaacatggtgaaaccccgtctctactaaaaatacaaaaattagccgggtgtggtggcgggtgcctgtagtcccagctacccgggaggctgaggcaggagaatcgcttgaacccgggaggcagaggttgcagtgagccgagattgcaccacctcactccagcctgggccacaaagcgagactccrtctcaaaaaacaaaaacaaagtaagaacctcagaaatgagactcttacccatgagaggtttagtcatctaaccgatcatgtctgtcctgcgccctttgtgcttacaacctgccgatccttgtctgtggtcttaaggcaactgtgtgttgatctcggagtgttttcgtgatgccccagtgtgctccctgcgtgctgtggtggaggtggcgctcccagcctctcccagcgagaccccctcctccccagcttccctctcgccccacaactcccacgcttgtctgacaggcctacctgggactc

SEQ ID NO: 25492 - DNA, 601 bp, Human
ggcgggcagatcacctgaggtcaggagttcaagaccagcctgaccaacatggtgaaaccccgtctctactaaaaatacaaaaattagccgggtgtggtggcgggtgcctgtagtcccagctacccgggaggctgaggcaggagaatcgcttgaacccgggaggcagaggttgcagtgagccgagattgcaccacctcactccagcctgggccacaaagcgagactccgtctcaaaaaacaaaaacaaagtaagaacctcagaaatgagactcttacccatgagaggtttagtcatctaacygatcatgtctgtcctgcgccctttgtgcttacaacctgccgatccttgtctgtggtcttaaggcaactgtgtgttgatctcggagtgttttcgtgatgccccagtgtgctccctgcgtgctgtggtggaggtggcgctcccagcctctcccagcgagaccccctcctccccagcttccctctcgccccacaactcccacgcttgtctgacaggcctacctgggactcctggagctgtcagccgcccgggagaagcacgaggagttctgtgtccccatggtcatggttcccgctactgtgt

SEQ ID NO: 25493 - DNA, 601 bp, Human
agccgcccgggagaagcacgaggagttctgtgtccccatggtcatggttcccgctactgtgtccaacaatgtgccgggttccgatttcagcatcggggcagacaccgccctgaacactatcaccgacgtaagtccgtgtgcgccctgccaggcgggcgccggctgacgctaaccccggggccccggccctttttatctaccagtgcgctagaaatagccttttacaaataccctgaatgagagcttctcgttctttttttcccccagaaaagtatgttttaagactctgaaaatttttgawctcactcccagaaagttttaccacctcttcttctgtgtggccaccagggggacgtagtgtggccgagactccaggagtgcccgtgagcacccgaggcgctgaggagggctgggtcgcagtctcctgtgattgtaccagcattaaaaatcactttgtgtgtgtgtgtgtgtgtgtgtgtctgagcctaaattttctttgagcctccaatacccattatgatgaacccctgccttgatgctgagggtagaaattgaattgaatattttataattttattcattgccctgaatgcaccattgc

SEQ ID NO: 25494 - DNA, 601 bp, Human
ggttccgatttcagcatcggggcagacaccgccctgaacactatcaccgacgtaagtccgtgtgcgccctgccaggcgggcgccggctgacgctaaccccggggccccggccctttttatctaccagtgcgctagaaatagccttttacaaataccctgaatgagagcttctcgttctttttttcccccagaaaagtatgttttaagactctgaaaatttttgaactcactcccagaaagttttaccacctcttcttctgtgtggccaccagggggacgtagtgtggccgagactccaggrgtgcccgtgagcacccgaggcgctgaggagggctgggtcgcagtctcctgtgattgtaccagcattaaaaatcactttgtgtgtgtgtgtgtgtgtgtgtgtctgagcctaaattttctttgagcctccaatacccattatgatgaacccctgccttgatgctgagggtagaaattgaattgaatattttataattttattcattgccctgaatgcaccattgcatttgttatctctctggtcttggctgttgacctcattttcccctttgtaaactggggatgttaaattacctctaag

SEQ ID NO: 25495 - DNA, 601 bp, Human
actatcaccgacgtaagtccgtgtgcgccctgccaggcgggcgccggctgacgctaaccccggggccccggccctttttatctaccagtgcgctagaaatagccttttacaaataccctgaatgagagcttctcgttctttttttcccccagaaaagtatgttttaagactctgaaaatttttgaactcactcccagaaagttttaccacctcttcttctgtgtggccaccagggggacgtagtgtggccgagactccaggagtgcccgtgagcacccgaggcgctgaggagggctgggtygcagtctcctgtgattgtaccagcattaaaaatcactttgtgtgtgtgtgtgtgtgtgtgtgtctgagcctaaattttctttgagcctccaatacccattatgatgaacccctgccttgatgctgagggtagaaattgaattgaatattttataattttattcattgccctgaatgcaccattgcatttgttatctctctggtcttggctgttgacctcattttcccctttgtaaactggggatgttaaattacctctaaggcaataattggtgctactttagtttttttgccaagagac

SEQ ID NO: 25496 - DNA, 601 bp, Human
ggcgggcgccggctgacgctaaccccggggccccggccctttttatctaccagtgcgctagaaatagccttttacaaataccctgaatgagagcttctcgttctttttttcccccagaaaagtatgttttaagactctgaaaatttttgaactcactcccagaaagttttaccacctcttcttctgtgtggccaccagggggacgtagtgtggccgagactccaggagtgcccgtgagcacccgaggcgctgaggagggctgggtcgcagtctcctgtgattgtaccagcattaaaaatcrctttgtgtgtgtgtgtgtgtgtgtgtgtctgagcctaaattttctttgagcctccaatacccattatgatgaacccctgccttgatgctgagggtagaaattgaattgaatattttataattttattcattgccctgaatgcaccattgcatttgttatctctctggtcttggctgttgacctcattttcccctttgtaaactggggatgttaaattacctctaaggcaataattggtgctactttagtttttttgccaagagacaataataaaacatagaaatatattcttcttttttt

SEQ ID NO: 25497 - DNA, 601 bp, Human
gggatgttaaattacctctaaggcaataattggtgctactttagtttttttgccaagagacaataataaaacatagaaatatattcttctttttttctttgtgggacggggtcttactctgtcacccaggcttgagtgcggtggtgtgatctcagctcactgcagcctcgacctcccgggctcaggtgatcctctcacctcagcctcccgagtacctgggaccacaggcatgtgccaccattcccggctaaaagaaatatacacctattcccatgtttgtgtgtcacgcttggtaattgaygtgggagtttgaagatccgtacctaacacagaaagcatttcatttttttaaaatttgatgtctaaaagtttgtagtaattctcaagttttaatttttcttgtgagacttggttctcatgaatatttttcaaagatattttttcttgtaaaaccttggcatgaaacttatttctagcactggtaaataaaaaaacaagcttttaacatacagctcatatggtaagtaatgcttagcactcgtttcttgcttttctgagcgttttaaactttcttcactttctttgcgaaggaaacctgccc

SEQ ID NO: 25498 - DNA, 601 bp, Human
ttgccaagagacaataataaaacatagaaatatattcttctttttttctttgtgggacggggtcttactctgtcacccaggcttgagtgcggtggtgtgatctcagctcactgcagcctcgacctcccgggctcaggtgatcctctcacctcagcctcccgagtacctgggaccacaggcatgtgccaccattcccggctaaaagaaatatacacctattcccatgtttgtgtgtcacgcttggtaattgatgtgggagtttgaagatccgtacctaacacagaaagcatttcattttttwaaaatttgatgtctaaaagtttgtagtaattctcaagttttaatttttcttgtgagacttggttctcatgaatatttttcaaagatattttttcttgtaaaaccttggcatgaaacttatttctagcactggtaaataaaaaaacaagcttttaacatacagctcatatggtaagtaatgcttagcactcgtttcttgcttttctgagcgttttaaactttcttcactttctttgcgaaggaaacctgcccaggttttcctgtgttcactggctttgggggcaactttcaccttattttt

SEQ ID NO: 25499 - DNA, 601 bp, Human
ggggtcttactctgtcacccaggcttgagtgcggtggtgtgatctcagctcactgcagcctcgacctcccgggctcaggtgatcctctcacctcagcctcccgagtacctgggaccacaggcatgtgccaccattcccggctaaaagaaatatacacctattcccatgtttgtgtgtcacgcttggtaattgatgtgggagtttgaagatccgtacctaacacagaaagcatttcatttttttaaaatttgatgtctaaaagtttgtagtaattctcaagttttaatttttcttgtgagayttggttctcatgaatatttttcaaagatattttttcttgtaaaaccttggcatgaaacttatttctagcactggtaaataaaaaaacaagcttttaacatacagctcatatggtaagtaatgcttagcactcgtttcttgcttttctgagcgttttaaactttcttcactttctttgcgaaggaaacctgcccaggttttcctgtgttcactggctttgggggcaactttcaccttatttttggcagttgctaatctctgacctagacgttgcttctgttctcctggtggtgggtgtcac

SEQ ID NO: 25500 - DNA, 601 bp, Human
ctcacctcagcctcccgagtacctgggaccacaggcatgtgccaccattcccggctaaaagaaatatacacctattcccatgtttgtgtgtcacgcttggtaattgatgtgggagtttgaagatccgtacctaacacagaaagcatttcatttttttaaaatttgatgtctaaaagtttgtagtaattctcaagttttaatttttcttgtgagacttggttctcatgaatatttttcaaagatattttttcttgtaaaaccttggcatgaaacttatttctagcactggtaaataaaaaaacaagcttttaacatacagctcatatggtaagtaatgcttagcactcgtttcttgcttttctgagcgttttaaactttcttcactttctttgcgaaggaaacctgcccaggttttcctgtgttcactggctttgggggcaactttcaccttatttttggcagttgctaatctctgacctagacgttgcttctgttctcctggtggtgggtgtcacggctttgctgctgcggggctggcccggctctggaccgaccttcgcactgtgaatgtgaagatgagcctctttcacagactggattc

SEQ ID NO: 25501 - DNA, 601 bp, Human
ccacatcctgggcaccaggccagccagtgccccgacatgagtgttgctggccgggaagcagctggcatttggattgaagtcctgcaaaaactgccatggccagagcctgccaggcagagcctgcacagagcggcccaagagctgggcacgtgctgggcctgggtggatgtggaggctgtgccatggggcgcgggggaccctgctcacagctcaccttgtggtcacccagcactgaccctgctcacagctcgccttgtggtcacccagcactgacccacccgccccaccctcctatccaccrtgctgtgaactcacctgccacgggtctacacccactgtccgaagccctcggcccacacgggctccaggccttgggatgctttgcgttgcaccagggctgcagagtccagatcgctcactgtccgactctcccagggaggtgtgggcgccgccctgtgtcccaccagtagcatttctgcagcagatgtggggatattcacagtaagacggacacgtccaagaccataaatagttggttttgccaccacgtggatgtcaaaaacaccttgctgtgtggggccacttggaggtgggaacagtg

SEQ ID NO: 25502 - DNA, 601 bp, Human
ctgtcctgctgtgactttggttaacaccctgaggtggagtctgaaaaaccccggtgtacacgggctcaagaaccgctcccctttctgataccggagcgcatttcccagtggaaccccagagcagcaactcaggttcttgctcgcctgtgcggctttgtgtgcggcttgccgagggcagaaacggcagcttccgcccggagagcagagatgtggcgtggggctgagtgtggcccaccggtaatccagctgcatgcccccttccctgcctgcacctgggcgccgcctctgcacgatgaaggcrggcatttggtgtggtccttacagccgtgtgccccatcccactgatccttgcctgcctgcagaaagctacaggattggctttgcctttaagtgtcctgactgccctggcctcccttacctaccatgacacgccgagagctgagctgtcccactcgtgactaactcgccgttgcctgcaacctgctccgttgcctgcctcacacccaccccgctgtgctgcctgcaggcaccccctttcatgaggacctgggctgtgcccaggcggccccctgtgttgctggggcctgtgctgctctcgcac

SEQ ID NO: 25503 - DNA, 601 bp, Human
cgccgcctctgcacgatgaaggcaggcatttggtgtggtccttacagccgtgtgccccatcccactgatccttgcctgcctgcagaaagctacaggattggctttgcctttaagtgtcctgactgccctggcctcccttacctaccatgacacgccgagagctgagctgtcccactcgtgactaactcgccgttgcctgcaacctgctccgttgcctgcctcacacccaccccgctgtgctgcctgcaggcaccccctttcatgaggacctgggctgtgcccaggcggccccctgtgttgytggggcctgtgctgctctcgcacggcctccagagcctccctcggccccttgacccgcatgaaccggcttcccctggtgactcagtcccctcccgtcccttcctggacctcagcacaggccctggggctggcaggtgagcacccggcacccccgctaaccgcttggccctgctgcttcaggcttacaagagtgcgtgcgacatggccgaggcacgaggccgccaccaggagctttgcatccccctgtgtgtggtgccggccacgattagcaacaatgtcccaggcacagaaataagcctgg

SEQ ID NO: 25504 - DNA, 601 bp, Human
agattcacagagcaaggtggttctcacagagaagtcagtggcttttttctacgttaatgctgtagcaaacgccaccttttctttcaccaccaatttatatttcttaacacccatggagcaaagtgtggtgatgtttgaactgtagcctggggctctcgctcccatgggactcctcggggaatttcccagcagcaggatcgcctctgtgtccttgcagggggtggcgtctgctgggggcacatcccatcgtgcagggggaacggctgaggtcacaggctttgcctgacaagtgccactcacrgctgctgtccacgtgccagccctgggacacagccctctgccatccttccacccactcggaggccagggaggcacctccgtgccacactgcaggcaggcagggccgcgcttgggatctgccgccttcttgtcagtgctgctttgactaattgcctgaggcacggccggagtgacttgctatttttagaagctaattcaggcttcagatgccatctaggtaatgaggagagagttcaggaaagctgtatctaagctccagcaaaggcggcctcttccgtaccagctgtcgctgcgtttacac

SEQ ID NO: 25505 - DNA, 601 bp, Human
ggacacagccctctgccatccttccacccactcggaggccagggaggcacctccgtgccacactgcaggcaggcagggccgcgcttgggatctgccgccttcttgtcagtgctgctttgactaattgcctgaggcacggccggagtgacttgctatttttagaagctaattcaggcttcagatgccatctaggtaatgaggagagagttcaggaaagctgtatctaagctccagcaaaggcggcctcttccgtaccagctgtcgctgcgtttacactgagacgagcacacagtcgggggcrtggctcaggtgtcagggctgcgctgttccacagccccctggggcagcctggcgggaccagaactcagacacgcctgggcacaaatcagcctcttgggagagctgctttgcccgcagaattcttttgccattaagcggttgatgtcattctttgaatgagtgacagtaattccccacctcagggtgggctgcgggggagattcagttggaaaagtaacccatgaggttttgtgcctctgggggtcctgaggccccacccgtgcctgggattctctaagacaaaggacaagtcttaaagcct

SEQ ID NO: 25506 - DNA, 601 bp, Human
tggggcagcctggcgggaccagaactcagacacgcctgggcacaaatcagcctcttgggagagctgctttgcccgcagaattcttttgccattaagcggttgatgtcattctttgaatgagtgacagtaattccccacctcagggtgggctgcgggggagattcagttggaaaagtaacccatgaggttttgtgcctctgggggtcctgaggccccacccgtgcctgggattctctaagacaaaggacaagtcttaaagccttacagcatcttaagtcttagatcacatttagagagaccyggtacaggtggaacagtgcaaccctcagaattctgcactggcccttcaagaaggcagttgtgggctctttggacccttgacggggatctgtcctctgtcctcctaagcacaaagatgggaattcttcccattgcctgtttctctccccatctcggcttctacacaatgcaaagtggcccgctaactagagtccgtgttcagttttgaatacatcaaccaattattttgggaagaaaagaatctgccaaagaaactggaaatacagtttggaatcatttaatcaagcctgcatttattaat

SEQ ID NO: 25507 - DNA, 601 bp, Human
atgtttgctccaggagcgtccctcgtggtccgttcaggtgcccagagttgcgggccttgcacgccttgtacgccttgttccctggcgcctcctccttccatgtgggtgtgcagcatcccgctccagggccttcagcctctgcgcccctcatctgctgatgcaggtgatggcatttagggcccacctgggtactcctaggattcacctttatcaccgcatgagggagcattcccaggttctagggattagggataggactgggattcctttggggactgctctcccgcccaccactgtgccrgaatgtgatgcacacagcggccagcatatccaaaggccccaggaggacctggggtggctggaacaggacctggtgccgggagcaggcggggccggggattcccgacaaaggcttgatgtgtacttgaagtgagcaaagggttttgaataaaccaagaactggatcagatttatgttttttatagatggggtcctttctgtgtgaacggattggagggtcccggggtgggagctgaggcccaggaagagggcgttgcagccggactgatgtatgggtgggaaggcggccgatgcatttctt

SEQ ID NO: 25508 - DNA, 601 bp, Human
gaggacctggggtggctggaacaggacctggtgccgggagcaggcggggccggggattcccgacaaaggcttgatgtgtacttgaagtgagcaaagggttttgaataaaccaagaactggatcagatttatgttttttatagatggggtcctttctgtgtgaacggattggagggtcccggggtgggagctgaggcccaggaagagggcgttgcagccggactgatgtatgggtgggaaggcggccgatgcatttctttgccatttttctccccgccgagcttgggtcctcatggagggcrgatggcagacatttcactctgggacccgatgcctgtgcatctggaagacttccccaggtgcctgggtctaagaaccaccatctgcctttgagtagagtttccataaatgtaacattcgccaatggatggaagatggccgcacctctaaaatcacagggagcttttcagaagaaaatagaatagcacagcggttctcacggactaagctggcaggggacagtcccctaacatctcagctaacacctaacggtgtctgtgtccggtgaaagcggcttcagcagggacagtcacagagcagcg

SEQ ID NO: 25509 - DNA, 601 bp, Human
gaaaatagaatagcacagcggttctcacggactaagctggcaggggacagtcccctaacatctcagctaacacctaacggtgtctgtgtccggtgaaagcggcttcagcagggacagtcacagagcagcgtggagtgagctggcttgtggggtcgtcttttccgtccccttctatggggcctgggagaagggagcggcagatggccaggcccccaaaacgggacatcgaggtcacctccaggtggctgccatggtggggttgcgggggaccacgttcacacccactccgagggcacatccyggctgctgcacacccttcacctctgcgggatgctgggaccgcatgtttgggcgcggtgggggggccttgctgcactcactcttgggggagctctgggatggtgggcgcgccccgggcctgggctggagtgactgatctcttctctgtgaccagacctgcgaccgcatcaagcagtccgccagcggaaccaagcggcgcgtgttcatcatcgagaccatgggcggctactgtggctacctggccaacatgggggggctcgcggctggagctgatgccgcatacattttcgaagagcccttc

SEQ ID NO: 25510 - DNA, 601 bp, Human
gctggcttgtggggtcgtcttttccgtccccttctatggggcctgggagaagggagcggcagatggccaggcccccaaaacgggacatcgaggtcacctccaggtggctgccatggtggggttgcgggggaccacgttcacacccactccgagggcacatcccggctgctgcacacccttcacctctgcgggatgctgggaccgcatgtttgggcgcggtgggggggccttgctgcactcactcttgggggagctctgggatggtgggcgcgccccgggcctgggctggagtgactgatckcttctctgtgaccagacctgcgaccgcatcaagcagtccgccagcggaaccaagcggcgcgtgttcatcatcgagaccatgggcggctactgtggctacctggccaacatgggggggctcgcggctggagctgatgccgcatacattttcgaagagcccttcgacatcagggatctgcaggtatgtgacggggctggcctcagggcccgtccccttgggatccactgggtgctacggagtgaatcatcgtgtctagggtggtttgctttccgaggggcatggagatggagatgctacaga

SEQ ID NO: 25511 - DNA, 601 bp, Human
ggggaccacgttcacacccactccgagggcacatcccggctgctgcacacccttcacctctgcgggatgctgggaccgcatgtttgggcgcggtgggggggccttgctgcactcactcttgggggagctctgggatggtgggcgcgccccgggcctgggctggagtgactgatctcttctctgtgaccagacctgcgaccgcatcaagcagtccgccagcggaaccaagcggcgcgtgttcatcatcgagaccatgggcggctactgtggctacctggccaacatgggggggctcgcggcyggagctgatgccgcatacattttcgaagagcccttcgacatcagggatctgcaggtatgtgacggggctggcctcagggcccgtccccttgggatccactgggtgctacggagtgaatcatcgtgtctagggtggtttgctttccgaggggcatggagatggagatgctacagaacacgccacgcttgatacacttcgcatcgcccaggtgcccctactgcgtgtcaggtgacggcgggtgtgcctggttgaggacaccttctagtctcatgtgtgaaacacaagcttgtttgacgtagt

SEQ ID NO: 25512 - DNA, 601 bp, Human
gcactcactcttgggggagctctgggatggtgggcgcgccccgggcctgggctggagtgactgatctcttctctgtgaccagacctgcgaccgcatcaagcagtccgccagcggaaccaagcggcgcgtgttcatcatcgagaccatgggcggctactgtggctacctggccaacatgggggggctcgcggctggagctgatgccgcatacattttcgaagagcccttcgacatcagggatctgcaggtatgtgacggggctggcctcagggcccgtccccttgggatccactgggtgctrcggagtgaatcatcgtgtctagggtggtttgctttccgaggggcatggagatggagatgctacagaacacgccacgcttgatacacttcgcatcgcccaggtgcccctactgcgtgtcaggtgacggcgggtgtgcctggttgaggacaccttctagtctcatgtgtgaaacacaagcttgtttgacgtagtctgttgtgtagttaatgttgtctcacttatgtcatcaatgattcgagaacctccgctgacagtcaccacccacgtctgcgacaggctctgaaggttgctgcagcttct

SEQ ID NO: 25513 - DNA, 601 bp, Human
ccccgggcctgggctggagtgactgatctcttctctgtgaccagacctgcgaccgcatcaagcagtccgccagcggaaccaagcggcgcgtgttcatcatcgagaccatgggcggctactgtggctacctggccaacatgggggggctcgcggctggagctgatgccgcatacattttcgaagagcccttcgacatcagggatctgcaggtatgtgacggggctggcctcagggcccgtccccttgggatccactgggtgctacggagtgaatcatcgtgtctagggtggtttgctttccraggggcatggagatggagatgctacagaacacgccacgcttgatacacttcgcatcgcccaggtgcccctactgcgtgtcaggtgacggcgggtgtgcctggttgaggacaccttctagtctcatgtgtgaaacacaagcttgtttgacgtagtctgttgtgtagttaatgttgtctcacttatgtcatcaatgattcgagaacctccgctgacagtcaccacccacgtctgcgacaggctctgaaggttgctgcagcttcttttaaatcctgaggcccctgatgctgcgtctgcctcta

SEQ ID NO: 25514 - DNA, 601 bp, Human
ctctgtgaccagacctgcgaccgcatcaagcagtccgccagcggaaccaagcggcgcgtgttcatcatcgagaccatgggcggctactgtggctacctggccaacatgggggggctcgcggctggagctgatgccgcatacattttcgaagagcccttcgacatcagggatctgcaggtatgtgacggggctggcctcagggcccgtccccttgggatccactgggtgctacggagtgaatcatcgtgtctagggtggtttgctttccgaggggcatggagatggagatgctacagaacaygccacgcttgatacacttcgcatcgcccaggtgcccctactgcgtgtcaggtgacggcgggtgtgcctggttgaggacaccttctagtctcatgtgtgaaacacaagcttgtttgacgtagtctgttgtgtagttaatgttgtctcacttatgtcatcaatgattcgagaacctccgctgacagtcaccacccacgtctgcgacaggctctgaaggttgctgcagcttcttttaaatcctgaggcccctgatgctgcgtctgcctctaaacggacacagacatgaccgtggtttctcggc

SEQ ID NO: 25515 - DNA, 601 bp, Human
tgttcatcatcgagaccatgggcggctactgtggctacctggccaacatgggggggctcgcggctggagctgatgccgcatacattttcgaagagcccttcgacatcagggatctgcaggtatgtgacggggctggcctcagggcccgtccccttgggatccactgggtgctacggagtgaatcatcgtgtctagggtggtttgctttccgaggggcatggagatggagatgctacagaacacgccacgcttgatacacttcgcatcgcccaggtgcccctactgcgtgtcaggtgacggygggtgtgcctggttgaggacaccttctagtctcatgtgtgaaacacaagcttgtttgacgtagtctgttgtgtagttaatgttgtctcacttatgtcatcaatgattcgagaacctccgctgacagtcaccacccacgtctgcgacaggctctgaaggttgctgcagcttcttttaaatcctgaggcccctgatgctgcgtctgcctctaaacggacacagacatgaccgtggtttctcggcatctgtggctcttttagggaagggtgtcgctgaccccgcggtctgcccctgcttggac

SEQ ID NO: 25516 - DNA, 601 bp, Human
cacaggtcactctttcctctgagagcaccgagaacatcgtcatgcaaataaacaaggagcaatagagccatgaatgatcactaggcaaagcacggaattaccattttcagagggaccctgttgactctggaaggtgttgctagtggccgccgtgagggctgctcaccgtgccctgtcctcagcgttcatcgctgcagacgtgtcctccctatctgggaggaggctccccaagacccaagccgcgagagctgcagcctccttggccacgctcactgccacacttggttggcacttcccagcctgcagtgcctggcacacagtaggtacttagtagaagtttattgtctgattaacaaaatactctcttccagtccaacgtggagcacctgacggagaaaatgaagaccaccatccagagaggccttgtgctcaggtgagagagagagaccaggggctgatcttaccctcaccgccacaccctggttcttagattctagtctgtgacttgggctggatgagtggtcatttctttgccgctagagtgcactacacacactgagcaggtgcagaagacagctgtggtgcattgctctaaaggctt

SEQ ID NO: 25517 - DNA, 601 bp, Human
catttctttgccgctagagtgcactacacacactgagcaggtgcagaagacagctgtggtgcattgctctaaaggcttgcctgcatttagacaactaatatttttgctttatagtctcttattctttgatatcttgcaatcatttccctaattagcacctgatgtttatgaagaaagaaggaaatacagtcatccctcttagcctcagggactgtgtcccaagactgcagtgggtgtctgaacctggggatagtacccgccccctgtatacacgaggttgcttccatctgataaccaaggyggctactgagtgactcgggcaggaggcacagacagcatggagacgcagggcacagggatgattcacgttctgggtgggacagagcaagagagcacgagatttcatcacgctactcagaatggtgtgcaatttaaaacttacatatttatttctggaattttccatttaatatttgtgggcctcagttgaccactggaccatgggtaacaaactgcagaaagcaaaaccgtgaactggagggactggtgttgatgtagaatcaccatagggttgggggatgcgggagtccagcctcccagg

SEQ ID NO: 25518 - DNA, 601 bp, Human
tgataaaaaacatctgaactttttgagacagagtcttgctctgttgcccaggctggagtgcagtggtacaagcttggctcactgcaacctccaccttccaggttcaagtgattctcctgcatcagcctcccgaggagatggcagtacaggcacccaccaccacgcccagctaatttttgtatttttagtagagatggggtttcaccacgttggccaggctggtctcaaactcctgacctcaggtgattcacccacctcagcctcccaaagtggtgggaatacaggcctgagccactgtgcscagccaaaacatctgaacttttaagtgatgccaaacatcaccagctttaggattcttttgttggtgaggtttgagtaatggggattttaagggaactgtcagctttcatgaaaacagtgatacccccattacttggaaatgcttattcaaattaaacacttcatcaagttaaaaactggagcttccctaagatttaaaatggattatcagacatgtagtatacttgacaccccaagtcagaatgacctggaatgagctgcacacaggcacacacgtgttatgagctgagcctgggacaca

SEQ ID NO: 25519 - DNA, 601 bp, Human
tgatgccaaacatcaccagctttaggattcttttgttggtgaggtttgagtaatggggattttaagggaactgtcagctttcatgaaaacagtgatacccccattacttggaaatgcttattcaaattaaacacttcatcaagttaaaaactggagcttccctaagatttaaaatggattatcagacatgtagtatacttgacaccccaagtcagaatgacctggaatgagctgcacacaggcacacacgtgttatgagctgagcctgggacacagggtccaggcctcctaacttgcacayactccttcctcaccacctcctattcttatacttttaagccagagcccatgaatcccctgcaatgatgatgaaatagtaggcatatgtgtgatcttcttaaagaatccacaacggttatcagattaaagctgtgacccatccccagctcagatgagttcatgaaatcctgatttaagattttaaaataatgaagattgttagttgacttgttcagtttattaaaatcctcatcttactgagcggggggaacacttgatactttttcttaacaggccaagttcaggctacgggaatcacagg

SEQ ID NO: 25520 - DNA, 601 bp, Human
aaaactggagcttccctaagatttaaaatggattatcagacatgtagtatacttgacaccccaagtcagaatgacctggaatgagctgcacacaggcacacacgtgttatgagctgagcctgggacacagggtccaggcctcctaacttgcacatactccttcctcaccacctcctattcttatacttttaagccagagcccatgaatcccctgcaatgatgatgaaatagtaggcatatgtgtgatcttcttaaagaatccacaacggttatcagattaaagctgtgacccatccccagytcagatgagttcatgaaatcctgatttaagattttaaaataatgaagattgttagttgacttgttcagtttattaaaatcctcatcttactgagcggggggaacacttgatactttttcttaacaggccaagttcaggctacgggaatcacaggttttgttctgttccaactataaggacctagaaataaaaacatgaattctgcaaaatagaaattgtcatttctatttaacagcaaagtgttactgtataactggtatttcatataactctaaccaccaacagggtggggcaccctct

SEQ ID NO: 25521 - DNA, 601 bp, Human
tgcaggccgtcctgccttggtgaaaatgctgtcctatcggggagaagtagggtgctggttccttcttcagttcagtactgagctgcacgtgatgttttactcctgatctctgagtgttgctatttaaccaaccttggattcctgggataagatcagcttgggtatgacatgttctcttttatcactgctagatgcagtctgcagttcttttgtgcaggctttttgctctagagatcctgaacgttggccagcaatttcccctcacagtttaagtggggccttctattttttgaatgtttgstaggacaacctccttgtgactatccatcaaaacttccagttttgaggaagatctgactgctgaatgaattgttcatgtttgtagaactgcatgttcgtagaactgtgcatgttcttccttaaatcagttttgtaagttacatattctaagaaatctttaaactgaagtttcaagaaacatgacttttttataatactcttgttaatggttccaacatggctgttccccactcattcctgagtggctctttgtgccagcatctttctcacccccacccccctcagctttcttaatcagtca

SEQ ID NO: 25522 - DNA, 601 bp, Human
accttggattcctgggataagatcagcttgggtatgacatgttctcttttatcactgctagatgcagtctgcagttcttttgtgcaggctttttgctctagagatcctgaacgttggccagcaatttcccctcacagtttaagtggggccttctattttttgaatgtttgctaggacaacctccttgtgactatccatcaaaacttccagttttgaggaagatctgactgctgaatgaattgttcatgtttgtagaactgcatgttcgtagaactgtgcatgttcttccttaaatcagttytgtaagttacatattctaagaaatctttaaactgaagtttcaagaaacatgacttttttataatactcttgttaatggttccaacatggctgttccccactcattcctgagtggctctttgtgccagcatctttctcacccccacccccctcagctttcttaatcagtcatagcagatgtgtgcttttattccggcaaaccactatcactgccagtgtccaacttagaaaaatgacagtctataaaaaccagtgatgtgaatagtttcaatgggtttgtctttttgaagaactgactttg

SEQ ID NO: 25523 - DNA, 601 bp, Human
gtttgtagaactgcatgttcgtagaactgtgcatgttcttccttaaatcagttttgtaagttacatattctaagaaatctttaaactgaagtttcaagaaacatgacttttttataatactcttgttaatggttccaacatggctgttccccactcattcctgagtggctctttgtgccagcatctttctcacccccacccccctcagctttcttaatcagtcatagcagatgtgtgcttttattccggcaaaccactatcactgccagtgtccaacttagaaaaatgacagtctataaaraccagtgatgtgaatagtttcaatgggtttgtctttttgaagaactgactttggctttgattctttctacagcgattttcttttgctaatttagctatggatgctttttgcctctgtgtgtgtatgtgtgagcataaattagtgtcctgctgtaatttaagctaatttccctattccactatttagtgaaaaattctctccactgggaggaaaaaacaaaagctgctttccaggaagccctcagggcagtcccacaggagcagagctgcacgaggccaggtgctggccccactgcgcggc

SEQ ID NO: 25524 - DNA, 601 bp, Human
aaaatcttttataggaaaaaaatttaccaccgatgattccatttgtgtgctgggaataagcaaaagaaacgttatttttcaacctgtggcagagctgaagaagcaaacggattttgagtaagttggctgggttccctgaggcaataagaccccaatgtgagtacgggacaggggaatggccattgctgttgctgtcggcaactcattcaggggtttgaggaactggcttttctgaagctcagttaaaaaaatactaggtcttggctgggcgcggtggctcatgcctataatcccagcactktgggaggccgagacaggtggatcacaaggtcaagagatcgagaccaacctggctcatatggtgaaaccccatctctactaaaaatacaaaaatgagccaggcatggtgatgcacacctgtagtcccagctactcaggaggctgaggcaggagaaatcgcttgaacccgtgaggcagaggttgcagtgagctgagattgcaccactgtactcaagcctggcgacagagagagactccaccactgggtcttcgggaataattttaaacaatggtttcatttgatcctgaaattggctttatc

SEQ ID NO: 25525 - DNA, 601 bp, Human
aggggaatggccattgctgttgctgtcggcaactcattcaggggtttgaggaactggcttttctgaagctcagttaaaaaaatactaggtcttggctgggcgcggtggctcatgcctataatcccagcactgtgggaggccgagacaggtggatcacaaggtcaagagatcgagaccaacctggctcatatggtgaaaccccatctctactaaaaatacaaaaatgagccaggcatggtgatgcacacctgtagtcccagctactcaggaggctgaggcaggagaaatcgcttgaacccgkgaggcagaggttgcagtgagctgagattgcaccactgtactcaagcctggcgacagagagagactccaccactgggtcttcgggaataattttaaacaatggtttcatttgatcctgaaattggctttatcatctagttgattcagccgaccctacaaaccctgtgtttctggcaagaccgctcgctgtgctggccaggcggaggcatctcccgccagtgactgcaggcctcactgctgtctcctcttacctccacaggcacaggattcccaaagaacagtggtggctcaagctacggcc

SEQ ID NO: 25526 - DNA, 601 bp, Human
gaactggcttttctgaagctcagttaaaaaaatactaggtcttggctgggcgcggtggctcatgcctataatcccagcactgtgggaggccgagacaggtggatcacaaggtcaagagatcgagaccaacctggctcatatggtgaaaccccatctctactaaaaatacaaaaatgagccaggcatggtgatgcacacctgtagtcccagctactcaggaggctgaggcaggagaaatcgcttgaacccgtgaggcagaggttgcagtgagctgagattgcaccactgtactcaagcctgrcgacagagagagactccaccactgggtcttcgggaataattttaaacaatggtttcatttgatcctgaaattggctttatcatctagttgattcagccgaccctacaaaccctgtgtttctggcaagaccgctcgctgtgctggccaggcggaggcatctcccgccagtgactgcaggcctcactgctgtctcctcttacctccacaggcacaggattcccaaagaacagtggtggctcaagctacggcccctcatgaaaatcctggccaagtacaaggccagctatgacgtgtcggact

SEQ ID NO: 25527 - DNA, 601 bp, Human
tttctgaagctcagttaaaaaaatactaggtcttggctgggcgcggtggctcatgcctataatcccagcactgtgggaggccgagacaggtggatcacaaggtcaagagatcgagaccaacctggctcatatggtgaaaccccatctctactaaaaatacaaaaatgagccaggcatggtgatgcacacctgtagtcccagctactcaggaggctgaggcaggagaaatcgcttgaacccgtgaggcagaggttgcagtgagctgagattgcaccactgtactcaagcctggcgacagagmgagactccaccactgggtcttcgggaataattttaaacaatggtttcatttgatcctgaaattggctttatcatctagttgattcagccgaccctacaaaccctgtgtttctggcaagaccgctcgctgtgctggccaggcggaggcatctcccgccagtgactgcaggcctcactgctgtctcctcttacctccacaggcacaggattcccaaagaacagtggtggctcaagctacggcccctcatgaaaatcctggccaagtacaaggccagctatgacgtgtcggactcaggccagc

SEQ ID NO: 25528 - DNA, 601 bp, Human
atctagttgattcagccgaccctacaaaccctgtgtttctggcaagaccgctcgctgtgctggccaggcggaggcatctcccgccagtgactgcaggcctcactgctgtctcctcttacctccacaggcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctstttttgtaacacttaagttattttatcagcactttatgcacgtattattgacattaatacctaatcggcgagtgcccatctgccccaccagccccagtgcgtgctgtctgtggagtgtgtctcatgctttcagatgtgcatatgagcagaattaaacatttgcctacaactccaacagtcctctgttttagttttttaagtaggagattagtacctcaatctatgggtggctactaaaggttttctcagttttgtgggcaaactatgcacacgtcatacaaggagaacaaagccaggagt

SEQ ID NO: 25529 - DNA, 601 bp, Human
ctcgctgtgctggccaggcggaggcatctcccgccagtgactgcaggcctcactgctgtctcctcttacctccacaggcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattracattaatacctaatcggcgagtgcccatctgccccaccagccccagtgcgtgctgtctgtggagtgtgtctcatgctttcagatgtgcatatgagcagaattaaacatttgcctacaactccaacagtcctctgttttagttttttaagtaggagattagtacctcaatctatgggtggctactaaaggttttctcagttttgtgggcaaactatgcacacgtcatacaaggagaacaaagccaggagttcacacaggccaaggggaaggccacgtttactcaccgttccatagctgcc

SEQ ID NO: 25530 - DNA, 601 bp, Human
ggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagccccagtgcgtgctgtctgtggagtgtgtctcatgctttcagatgtgcatatgagcagaataaaacatttgcctacaactccaacagtcctctgttttagttttttaagtaggagattagtacctcaatctatgggtggctactaaaggttttctcagttttgtgggcaaactatgcacacgtcatacaaggagaacaaagccaggagttcacacaggccaaggggaaggccacgtttactcaccgttccatagctgccatgtgtcagtttccatccacagcagcaggccgggaccctgggcctcgaccccaggctcctgctctcctttgaaagtaaaacatgaatcttagttacttgtcct

SEQ ID NO: 25531 - DNA, 601 bp, Human
aaaatcttcatgagcactacgtgactctgaacgtttaatctccaccttggaaaacataaataacagcagaggaataatgagctgccaaagcaccacagaagactcaggttcctgccctgggaccagccgtcagcgaggggacagcagcagagaaggggcaccccagccccctccatcctgcaaacagacacccacccagctgggctgcggggccatggccacctttggcagaactggctgggcctcggcagcagaagaagggatttcctttcctcaccccacatcccaccatgcaggttcmgggtccctgaaaccctggaatctgccactttcccagccctgtggccgaactgtgttgggggagggctgagaaggaggtgggctggagcctggtttacctggcagccaccaggaaagggcaattcatccctgaaggccccgctatgggtgtgtgggagaaacaaaaggggctgggtgaggggccgggctgagggagtacagtgaccgctcccagatgtgggctgtgtccctcaggaaagagctctgctcagctgtccccgagagcacttccgctggccccagacctgctccgggagggggt

SEQ ID NO: 25532 - DNA, 601 bp, Human
tcagtaagtgctcagtaaaccactgcgtgtgtgacatgtaagctgcacttgcttgaaaagggaccaaatgctcctggtgtcaacagggactttatacaagcagatttctttccagctttaactagacaccctgagtcttgggataggactcagcgtgaggctgagaatgctggtgggggtggagatgagtgggctcagagccatcggagggcttaggaagaagaggccctgggctggggtggtaggagcactggcctgggagtcaggctccagccctgggacctgggcctatcttcttccytctccaggtaccttctagtgggcagattcggtggccccctgggcagggtatggacctacctgcatggtgacattggccgtctccaccggcacacagtgcagattctcatcgccgcagcagccggtgcagcgcagcagggagacacaggatgggctgaacatgtgctccacctcgctggggtactcggacacgacgtccaccagcctctccagcgcccggcagtagctgcggccccacacttcctggaagggtaccactgcgaggaagcaagggggctgggtcaggccagcagagacctgc

SEQ ID NO: 25533 - DNA, 601 bp, Human
gggagtgaaatggaaatacaagttccaggaaaaaagaaacaatgtaaatatataattatgaaaggaagtgttcctgtatttttttttttttttgcttgttaattttctttttttttttttgagacggagtcttgctctgtcccaggctggagtgcagtggcgtgatctcggctcactgcaagttccgcctcccgggttcatgccattctcctgcctcagcctcccgagtagctgggactataggcacccaccaccacacccggctaattttttgtatttttagtacagatggggtttcacmatgttagccaggatggtctcgatctcctaaccttgcgatccgcccgccttggcctccaaaagtgctgggattacaggtgtgagccaccgcgcctggcctgcttgttcattttcttaaaagtggatgatggtgagtataacattaaaatggcgtatttaataggatacacctggagagtgttctacaatagctttgtattaaaatattaataatatgccagaaattatatcctttgtaatgacttatacttttttttttttgagacaggttcttactctgtcacccaggctgaggtgcagt

SEQ ID NO: 25534 - DNA, 601 bp, Human
gcccactctgtatgtgtctcttagggggggcagggtggtggcaccttggccggaaagaacaatgtcccagtacaagcaaatggcaaagtgtgaggggagatcacgggggacaaggagtggcaaaagcccccaggcaaccactgttctccagagctgaatgttctgatcttcagaagaagagggggaagtggctggatcccctccgcccgctgccggccttcccaccagccaggccgtggcggccccagcaggatccgcatccctactttggacaggagctccgaaagcaagggctgcttgwctgtgcagagcctgaggcccaagaacaggtagcagggcccccttctttccttctgcaggcccctggagacctccagggcctctggggcctagcttgcccctcacgaggccacgtgtcttgcttctttcaaagcggaagctcccaggggtctgtggctggcttctctctttctctcacgttgttgaaggcactgaattcctgagggtcctgtccttccctgcccctcgtcttgaagggagcgaggcattcagcagggaaacagttggctaataaatagagggcaggtaccagcaggagtca

SEQ ID NO: 25535 - DNA, 601 bp, Human
tcccggctgacactcactgccccggaagacacacccactagatcagcgtttccacactagaatactttattcaagagaatctggcttggcagtcagatggccctgcagggacagcttgtgggggtgccagggcccttggggaacctgctcccctgccactgccttcagctgggacgcacaggctcctcccctggtgacctcatccccactggctgagctgtttctcatccaggcagctctttctccagcccggggcccactctgtatgtgtctcttagggggggcagggtggtggcacctyggccggaaagaacaatgtcccagtacaagcaaatggcaaagtgtgaggggagatcacgggggacaaggagtggcaaaagcccccaggcaaccactgttctccagagctgaatgttctgatcttcagaagaagagggggaagtggctggatcccctccgcccgctgccggccttcccaccagccaggccgtggcggccccagcaggatccgcatccctactttggacaggagctccgaaagcaagggctgcttgtctgtgcagagcctgaggcccaagaacaggtagcagggcccccttct

SEQ ID NO: 25536 - DNA, 601 bp, Human
cctgggtctgtctggcttccgttcccggctgacactcactgccccggaagacacacccactagatcagcgtttccacactagaatactttattcaagagaatctggcttggcagtcagatggccctgcagggacagcttgtgggggtgccagggcccttggggaacctgctcccctgccactgccttcagctgggacgcacaggctcctcccctggtgacctcatccccactggctgagctgtttctcatccaggcagctctttctccagcccggggcccactctgtatgtgtctcttagkgggggcagggtggtggcaccttggccggaaagaacaatgtcccagtacaagcaaatggcaaagtgtgaggggagatcacgggggacaaggagtggcaaaagcccccaggcaaccactgttctccagagctgaatgttctgatcttcagaagaagagggggaagtggctggatcccctccgcccgctgccggccttcccaccagccaggccgtggcggccccagcaggatccgcatccctactttggacaggagctccgaaagcaagggctgcttgtctgtgcagagcctgaggcccaaga

SEQ ID NO: 25537 - DNA, 601 bp, Human
acagctaaggccaggccaaacttgccaatggactcaaacactttggcagccatgtttccttctgctggaccctctcacacctaaggggataaaaacaaaatacaatcaaacttgatgccaaatcctcagagaaggccctctctgacacacaacagtcacttttcaacctggctatttatttccccattcctgaaagtgctaaatcatccattgaaggatacctaataaataatgctttatagcttggaaagtgtactatcaattcttctgctttttttttttttcagtttcttttctttcytttttttttttttggagacagggtcttgctctgtcacccaggctggagtgcagtggtgcaatctcagctcactgaagcctcgacctcccaggctcaagcgatcttctcacctcaacctcccaagtagctgggaccacagaagtgtgccaccatgcccggctaattttgttcattttttgcagagatggggtcttgctacgttgccccaggtggtctcaaactcctgggctcaagtgatccccctgcctcggcctcccaagtgttgggattacaggcatgagccatcatgcctggctgatt

SEQ ID NO: 25538 - DNA, 601 bp, Human
tcaccacgcctcctgcaacagctaaggccaggccaaacttgccaatggactcaaacactttggcagccatgtttccttctgctggaccctctcacacctaaggggataaaaacaaaatacaatcaaacttgatgccaaatcctcagagaaggccctctctgacacacaacagtcacttttcaacctggctatttatttccccattcctgaaagtgctaaatcatccattgaaggatacctaataaataatgctttatagcttggaaagtgtactatcaattcttctgctttttttttttttcagtttcttttctttcctttttttttttttggagacagggtcttgctctgtcacccaggctggagtgcagtggtgcaatctcagctcactgaagcctcgacctcccaggctcaagcgatcttctcacctcaacctcccaagtagctgggaccacagaagtgtgccaccatgcccggctaattttgttcattttttgcagagatggggtcttgctacgttgccccaggtggtctcaaactcctgggctcaagtgatccccctgcctcggcctcccaagtgttgggattacaggcatgagcc

SEQ ID NO: 25539 - DNA, 601 bp, Human
acaaatcactccaaatggtttttcccagagaatctagaaacacgaccccttcccctcaccctcctcaacctgaaacgctatcctgcctgcattgctttctgagttatgacatccaatgtcatataaacacacaagctatagtgtctcaagaggatagcttacgcctcagagatgtcccttgccccctataccaggcctgggggaatccaaccgttcgtttacactctatcacctttcactggggttcccagagcttacttcactgagcttcggactgtaaagtgttaggaagctcccaggrgtcaggctgggaggtctgtgctagggagaaggactacccgagctgttctctggtctctaccaggcagtttctgcctgtgtcaaacagggttaacaaggcatcactctctgggtaacagtttggagaaggtaaaacatttagtggttagagactatctggatacaaccagaggtcataagaaaaatgtgtgtggcagggggaaggtaaaagaaccctcaactgaaaaacccacggagactgcctcacctcagcatgtttccgtgttttcaagtctcacatctagcaaagcagaagggagga

SEQ ID NO: 25540 - DNA, 601 bp, Human
aactccacatatccttgactagcccctgaagactctggaaccaattgcagaagtacaattccttcaagccccttctgattatcccggaagaagggatgacagatgatgaatttccaggccacccagcaaatggggaagctgagtgccggagaaaggggagagagaggctcctgccatctggtcgaaggctcaccttttccaccacaaatctggccctctctgcttcctgctgagccacctgtttggcttccaccgcttctgtgaactccttcccgaaggtcagatgtgtctaaggggagasagtgagcacaagatgaggcagtgtgattgcttcgacagcactgctgggagggctccatggccgctggaagaagaggccagcaatggctctagcagctggaggcatccgtgaggccagaacactcttccacctccgtatctgtatccaaactgagtttacacccagactctctggctgcccaaactgctcctgtatattactctgtcactctcagtacagtgacctcatgtagcaaatggcaccgggggcttttgatggggcccacaggcaccagaaggtatctactcaatcgaccacctc

SEQ ID NO: 25541 - DNA, 601 bp, Human
gacacatctggatggatttagcactagaaaaaaatctagtgacgaaagcacatctggtgcaacgtttgatcttttttgctgtcagctttcactatgtaactatggttaaaaatgacttctcagtgaagctgaaaatactccaggagaaacatttttatttgtaagagagtgtttttgatctcagagaagtggaagaaaaattacccttcagtgatttaggaacataactccacatatccttgactagcccctgaagactctggaaccaattgcagaagtacaattccttcaagccccttcygattatcccggaagaagggatgacagatgatgaatttccaggccacccagcaaatggggaagctgagtgccggagaaaggggagagagaggctcctgccatctggtcgaaggctcaccttttccaccacaaatctggccctctctgcttcctgctgagccacctgtttggcttccaccgcttctgtgaactccttcccgaaggtcagatgtgtctaaggggagagagtgagcacaagatgaggcagtgtgattgcttcgacagcactgctgggagggctccatggccgctggaagaagag

SEQ ID NO: 25542 - DNA, 601 bp, Human
cttcccaggctcctgaaggaactcggggagtttacttcctcctgatggctagcgggggaagcggggggaagcagagcacattgcccaccagtcctcccctatcctttcatgctcactccttgtcacgggagggatacatctctgttggctgcaggaatatttgtcttatttcaaagtcctcattaatattaattgcaatctagtttaacaaccctactctgagccaggagaagccaaggccaaggaaaacagaagcaaaagaaaggtggaatcaatcctcaaggctcatcttttcctccarccttaagtctaaaggacttcatcaaagccaggacagggccgggtgtggtggctcatgcctgtaatcctggcactttgggaggcggaggcaggaggatcacttgagcccaggaggccaaggctgcagtgagctatgatcatgccattgcactccagcctgggccacagagctgtcacaaacaaacaaacaaacaaacaaacaaacaaaaaacctcgggatggctaaggaagagcagcatgcacttttgactgttcctagagctgcctgtgagttaggctggttcctgaccagaatccaggc

SEQ ID NO: 25543 - DNA, 601 bp, Human
gggttggggatggatctggaacacaacacaaagtgttttctgaaaacaaagcattttctgccttactggagactctgtcccagctggcaatgcaaacatgtacacacaaaaactgctagaacactctgttctgatcccacggctcccacaaacaaaaaaccaacccatggctgagccggaaggtctgggtgtcatttattgacagcagtttatacacatttgtttccttcccagtgcaggcatagagcccgtgagaagggcagtctctgaacgagggggccaggaacgtaggtcggacacrtctttggcaggcatgttcagccccagcaggatgcaatccttcaagttggaattccactgggtatctgagagggaccaaggtggggggtagagaggaagtcttcaacaggactcacatctcggtccaggcctcctctctcactatacaagtccatccaagttttaggaccctggggggcaacagtcaggcccacccacctcaacaggggcagattcttcaatctgtgcccagttcacacacacctgtttccgctggtcacacagttaaagagaatcagacttatggtaacagacagaccac

SEQ ID NO: 25544 - DNA, 601 bp, Human
cctcacctgctaccacagagattcccttcgggttggggatggatctggaacacaacacaaagtgttttctgaaaacaaagcattttctgccttactggagactctgtcccagctggcaatgcaaacatgtacacacaaaaactgctagaacactctgttctgatcccacggctcccacaaacaaaaaaccaacccatggctgagccggaaggtctgggtgtcatttattgacagcagtttatacacatttgtttccttcccagtgcaggcatagagcccgtgagaagggcagtctctgaaygagggggccaggaacgtaggtcggacacgtctttggcaggcatgttcagccccagcaggatgcaatccttcaagttggaattccactgggtatctgagagggaccaaggtggggggtagagaggaagtcttcaacaggactcacatctcggtccaggcctcctctctcactatacaagtccatccaagttttaggaccctggggggcaacagtcaggcccacccacctcaacaggggcagattcttcaatctgtgcccagttcacacacacctgtttccgctggtcacacagttaaagag

SEQ ID NO: 25545 - DNA, 601 bp, Human
gaaagggctcgggacgatggctcaggtaaccccctccattcccaactcccagtctcctagatagtggggtgacaaggacaaggaggcagactgtgtgactgtgtgtggctggggagtaagcgtgcatatcgcagtgggacgagtagggatgcacgtgtgtggaagccccccatccttttctgagaaatatcagcaggtgggaagggacctctgtggtcagcatatgtaattctactctttcagcttggtctgtgcctggatttcctaactcctcatagttgattaactgtgtggccttagrcaagccacctaacctctctgatcctcagtttcttaatctgtaaaacaaagatagaaataacacctatcattcagggtcaatgtgggttcaaatgagaaaacacaggtgaaatagctttgtaacctctagaatgaaataggaattgtttcatatttttcagtttagtttaattaatcaaggatttattgaacaccaacagacctggaattagatagtgcgcataaagtatggcacctagcaagtcctcttccattctttgaggtttcccacttgtggctttctggcaaaggcatgttcagc

SEQ ID NO: 25546 - DNA, 601 bp, Human
gtcttcccagagccagatctggaattctctctccatccttgtcccgcccctggatgtgctaaagtagcagaaagaacactgagccaggagtcaggaaagcaactctctctgcttatctcctagtgccgctagacctctgtggctttaggtgataaaaaatggggtcacacaggcttccatttagtaaacccacttgccctgggctttcacaccttcgtctcattctcccttgataccaacgaggaggtaggcagggttggttttgtgatgtcattccctagttgaggaaaccaagacaccrtgagtctatgtgagtggtgtgaagtcaccagcaagtttgaacgatgaggttttggtacagccattttgatatggtcatgaggacattttgatgtcacctaaaaagcaaactatccaacttaaaaaaaaatacctatgcattgtgctcagcagagaccttcatctatgtcttgccctctctctggaggggctggggctggagtcccaatgtcactggcatcgacacagtatggtggagtggaaagaggctttggcgtcaacatgcctggttatacccatggttatgtaacatatcctacac

SEQ ID NO: 25547 - DNA, 601 bp, Human
gaaagaggctttggcgtcaacatgcctggttatacccatggttatgtaacatatcctacacatggtaggtgctaaataaatagcagctaatattttccaggaagaaatttctctgttggcacctacctctgggtccaggtgtctcttcattttttaattttttatttttttgagatggaatcttgccctgtcacccaggctggaatgcagtggcgtgatcttggcttactgcaacctccacctcctgggttccagcgattctcctacctcagcctcctgagtagctgggattacagacccrtgccaccacacccagctaacttttgcacttttagtacagatggggttttaccatgttggccaggctggtcttgaactcctgacctcatgatccacccacctcagcctcccaaggtgctgggattacaggcgtgagccactacgcccggccccaggtgtctccttataagaactgccttttccgtgaaaggcagagaggaaagaactgaacaaattctcagttcgctaagattgaatatcctgcttcttcctctctccactgcttcctctcaataggaagaccctctgaggtaaagcagag

SEQ ID NO: 25548 - DNA, 601 bp, Human
gggtccaggtgtctcttcattttttaattttttatttttttgagatggaatcttgccctgtcacccaggctggaatgcagtggcgtgatcttggcttactgcaacctccacctcctgggttccagcgattctcctacctcagcctcctgagtagctgggattacagacccatgccaccacacccagctaacttttgcacttttagtacagatggggttttaccatgttggccaggctggtcttgaactcctgacctcatgatccacccacctcagcctcccaaggtgctgggattacaggygtgagccactacgcccggccccaggtgtctccttataagaactgccttttccgtgaaaggcagagaggaaagaactgaacaaattctcagttcgctaagattgaatatcctgcttcttcctctctccactgcttcctctcaataggaagaccctctgaggtaaagcagagtggctaagggcctatgctcttgatctagaatcccatctaagtcacttaccaactgtgcaaccttgggcaaatgtctcacctctctgtgcctcaattatctcactcatgaaatggggttgcccattttgtc

SEQ ID NO: 25549 - DNA, 601 bp, Human
ttcattcaacaggatttatgtcagttgctggagatacaaagccaaatagatgtcacagaaactctaaggtcaactagtcttggaagacaaggggcgcttcatctccttgtgattattgtttttcagcattgcacaggagaagtcggcctgagtggtgcggcgctcgggacccaccagcaatgctgctcttcgtgctcacctgcctgctggcggtcttcccaggtgtgtctgccaggccccaactctccaagctccaccccttcagcctgcccgactccagggttcacctccctggggacastaaaatcagactcatccccagggatgtccctctcaaagttggcacttccttgaggaagagtcatacagagaagacactgaaaggccacatctgtgagcattggaagtcagggacaggaatggcacttcctaatctcaaggccaggggtctgtgaaagatcttctttgagaataacaaagaccttaacttcaaccaagcatctctatgacccgctgtgaaatctgagggaagtcacttatcctttctggctctcaatatttttatctgggggaaaaaaaagaaaagaaaatcatctacaaa

SEQ ID NO: 25550 - DNA, 601 bp, Human
gtcttggaagacaaggggcgcttcatctccttgtgattattgtttttcagcattgcacaggagaagtcggcctgagtggtgcggcgctcgggacccaccagcaatgctgctcttcgtgctcacctgcctgctggcggtcttcccaggtgtgtctgccaggccccaactctccaagctccaccccttcagcctgcccgactccagggttcacctccctggggacactaaaatcagactcatccccagggatgtccctctcaaagttggcacttccttgaggaagagtcatacagagaagacrctgaaaggccacatctgtgagcattggaagtcagggacaggaatggcacttcctaatctcaaggccaggggtctgtgaaagatcttctttgagaataacaaagaccttaacttcaaccaagcatctctatgacccgctgtgaaatctgagggaagtcacttatcctttctggctctcaatatttttatctgggggaaaaaaaagaaaagaaaatcatctacaaagtgcttttagaaatataaggaaataacacatggcaagtgcaaacatgtaacaccttacgaaagtggtgttattgtt

SEQ ID NO: 25551 - DNA, 601 bp, Human
gaaatataaggaaataacacatggcaagtgcaaacatgtaacaccttacgaaagtggtgttattgtttgaaaaaacaatggatggctggatgctggctcacagctgtaatgccagcactttgggaggccaaggagggtggattgcttgaggtcagtagctcaagaccagcctggccaacatggagaaaccttgtctctactaaatagaaaccaaaattagctagcatgcacctgtagtcccaactacttgggaggctgaggcatgagaatcgcttgaacctgggaagcggaggttgcagtragccgagatcgtgccactgcacaccagcctgggcgacagagagagactttgtctcaaaacaataaaaatatataaaataaaaaacaagggttatcataaatttgtcattcccttgtccttgaaatggttatcattaatgaataacaattccaatttaatcatgattaaaacagtcactttatttaatctcagcaattttccagctgtgatatatgataaattatcaacacagggcctacgtgtcaggtagaaaaccacatctactcatagtgggttatctggaacaggctttacctccca

SEQ ID NO: 25552 - DNA, 601 bp, Human
cttgtaatttttagaaacttctattgtatgcgttgaaatccatcaccctgcatttacattcattctgttcatttcagcacacattaatttggccacctactacccagaggcattgtgcttgtcacagcagaggggtcaaacatgagaaaaacatgttccagccttcaaggaacttccagtccatggagaacataattacccatacaccagattggatgtaataagtgatgcagatgtatcaagaaagcacagggcagggagagattagtgttagcttgggaaaggtttcatggagaagacmgctgtcaagctgggccttccgacagcattcctctgggaaggagggcattccaggttataagtccacccacaccctaactaggaatagcaaatagtcctatgttgcaagaaagtagaatcgtaacttgcctgccccctaccttgcacccctcatcctgcaggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtc

SEQ ID NO: 25553 - DNA, 601 bp, Human
gacagcattcctctgggaaggagggcattccaggttataagtccacccacaccctaactaggaatagcaaatagtcctatgttgcaagaaagtagaatcgtaacttgcctgccccctaccttgcacccctcatcctgcaggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtraatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtc

SEQ ID NO: 25554 - DNA, 601 bp, Human
tatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcrtcaatgagggtaagaccctagagagggagggggagtaggtggggcagtctcgcaggtgagagccaagctcagctccctctgagtgtattcatcaatagtcatcaatcagccaacagcatccactcaatgaccagccccgaactggaggctgcgtgggctgctgcacaggacagcaagaaaaagcaacctctgcctgatggcagctcctaattactcttctgttatcaaagtcattttgatggctgtccctgcttaacaagcaagaggtgagtaaagctcttgattgaggcaggacttata

SEQ ID NO: 25555 - DNA, 601 bp, Human
cagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgagggtaagaccctagagagggagggggagtaggtggggcagtctcgcaggtgagagccaagctcagctccctctgagtgyattcatcaatagtcatcaatcagccaacagcatccactcaatgaccagccccgaactggaggctgcgtgggctgctgcacaggacagcaagaaaaagcaacctctgcctgatggcagctcctaattactcttctgttatcaaagtcattttgatggctgtccctgcttaacaagcaagaggtgagtaaagctcttgattgaggcaggacttatagactgtgtttcagggctgtggcaggctctgcaggggtcctctgtcccctcccctggcccctgaacaagatgggtgcctcatccctc

SEQ ID NO: 25556 - DNA, 601 bp, Human
ctgtgtttcagggctgtggcaggctctgcaggggtcctctgtcccctcccctggcccctgaacaagatgggtgcctcatccctcacattcagatggaaaaaggattggcttatcttggtctcaatgcgttcccaggagtgccccagcctctaaatgtttcactgtcacatttcgtagggttatttgtgaatttcagcaccatctggcccactcagccctactccagtgagccatcagcatggtgaaagaattaaatcccagctccttctcatcccagagcaccctgcatagagttgccctygtgagaagcagcaaaccagtacttgcagttccaagtatctgtgcttgtgactttttttttttaaaggggcttatattctctgcatgccatgtccacatccagctctgggttttcaccagaatcccctgcatctttggtcacctgcttctctctggacctcagctttagctgcctggagaatggctatcgtctttgagatgccccttggggccccaacaattaagctcacctttgctacatactttatagtttacatcataccatcctaaatatattttcttgatttgggcataatccatt

SEQ ID NO: 25557 - DNA, 601 bp, Human
aaagaagagctgatatcctctccttcaactccttccattctctgctcagaataagatgggggaaaagaacaacatgtgcaggctgatggggagactccaagcccttggagtctggccctgatggctccagctgcaggctctgtgacattaggaaagctccttttcattttctgaagagggtaaggtgatgcgtgtaaacttcactccccatcctggctgagaccccgggaagaaggcttctcaggccacgcaaggctcttcctgcgtggccatcctcccatcccatctctgtctgtgcttycagagtccacgattccccgcagccccactgtggtgaagggggtggcaggaggctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactc

SEQ ID NO: 25558 - DNA, 601 bp, Human
taagatgggggaaaagaacaacatgtgcaggctgatggggagactccaagcccttggagtctggccctgatggctccagctgcaggctctgtgacattaggaaagctccttttcattttctgaagagggtaaggtgatgcgtgtaaacttcactccccatcctggctgagaccccgggaagaaggcttctcaggccacgcaaggctcttcctgcgtggccatcctcccatcccatctctgtctgtgcttccagagtccacgattccccgcagccccactgtggtgaagggggtggcaggargctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggtaggagttgacagg

SEQ ID NO: 25559 - DNA, 601 bp, Human
tacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcgggtgagtctccaaggacagggcctgcacccctcagacccagaggcaggacttcctgaaggcccctgyctgagagcttctcaatcagtgctggcccctatgtttggctgtaagaggctgaaagtggagagtgggaagggaggggacatttaggtcctatatagcctcgttgagcccttcaaaagggacatctcaaataaacataccaactaagtaaaaatagtgggtttgctatttaacctcggcattaagacaactcccagctgaatgtggtggctcacacctgtaatcccagcactttgggaggccgaggtaggcagatcacttgaggccaggagttcaacaccagcctggctgacatggagaaaa

SEQ ID NO: 25560 - DNA, 601 bp, Human
gagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcgggtgagtctccaaggacagggcctgcacccctcagacccagaggcaggacttcctgaaggcccctgcctragagcttctcaatcagtgctggcccctatgtttggctgtaagaggctgaaagtggagagtgggaagggaggggacatttaggtcctatatagcctcgttgagcccttcaaaagggacatctcaaataaacataccaactaagtaaaaatagtgggtttgctatttaacctcggcattaagacaactcccagctgaatgtggtggctcacacctgtaatcccagcactttgggaggccgaggtaggcagatcacttgaggccaggagttcaacaccagcctggctgacatggagaaaactc

SEQ ID NO: 25561 - DNA, 601 bp, Human
agattgaagtctcttctatatctggaaatattcttctctgtatagaagaataatatgcatacatcactgtcatatgcaatatgttcatcccccttccccctgccaaagctcgccctcgaaagagggccagataccttcatttacaaggtctgatcaggaaaattaggaaacatctagtaaatttgcatttcaagtccccttttaaaatttcacatgaaatgttttagccctaataagggtatttgtagtccctcaagaaatcctattgggtctggaccctgcggatgggactcactgaggrgcccatcgccaggctacctccagggggcagcactatcatacccagctgggcagtcaggaagcctggggcagcgtctcagagccttgaaaatctcccgggcataagtgatgggtcagcctttatgcacagctggtctatgacacgaagccttgaaggtccccactatacttttggtagtaatggggcagagatcatctgtgacagctgaagaaggccatcacagctgtttctaatgtcatcctgggtcctaccccaacagccttgagatcgaaccctgaccctgtgattcctcatgaagtc

SEQ ID NO: 25562 - DNA, 601 bp, Human
aacttaagccttcttccagctctgaggaacaaggtggaagctccagagcgctggtctccaccctggtgcccctgggcctggtgctggcagtgggagccgtggctgtgggggtggccagagcccggcacaggaagaacgtcggtgagtccctgggatactccctgcctcccacctccaacccgagccctcagtcctgaatcatccacccatagaggaagctgctgtgtctcttctttttcatgagctaaaacaaaggatcccgagaaagcaggatggggaaagataaacccacacatactcraaactgaaattcagagctgctgtccaaatactaacactggaaaatcatctccaattacccaggatctaggttcagagacagggctgccaggaagaggagattgggtttcaggagaccctgggcttggactaattggataactaatgagctgtgtgacattgagccatccttatgccatgcctcagtttcctcatggctcaagtcaaggatgataatcaggacctcacggggctgatgtgaggaccaaaggagatgctgtgcattgaaaggtcccagagtgacaaagatcagggattacca

SEQ ID NO: 25563 - DNA, 601 bp, Human
ttcgaccaaagagaaagtgttgatgtcactgggctgggagatcttggaggatgagggggacccctttctgggaggcaggggaggggtatcccagatagaagctcggggaggcagaggaggtggggatagtttcttgcaagagccctctatgtcccctggtcctggggacgaagagactcccccatctgaaccatcaaaaatgtagagatagtctccagacagggagcctttgggccagggatctgagccaggctgtggcccttgggaggtagagtggttgggcggcccttcctgtggggakagtgagttgtagttaagggtaggatcagagccagagagaccgcgtaacagcttgaggtcggtccgccttcctgctggcttgctgtaaaagtctaccccaggctcatcccagctgatgagagaggggtctgcgttctgcttggctctgttctcctccttgtcatgccggagccgggacagggcatcatactccatctgcagggcttcggccatcgctagctctttgcggctgatgcccactgactccagggacttccagtgttccccattgccctgagtcgaagacatggtgaggatgggg

SEQ ID NO: 25564 - DNA, 601 bp, Human
cgcattctttcggttgccatagcgggaggcataggtgcgggggggcacctgagggggcatagtcttgctcctggccacgggttttccagaggtgtctttgctgaagtccagcggccctcggccctccttccagcccctggtggcatcccgcaacatctccgcatcataggtcgatttcaagttgagcctagtaattgcatcattgataccatcatagtccacagaccccagtaggcgcccctgacccccacctcccagcacctcttcctcttctaggatccgatgctctagcagtttgccyggcaattgttcgaccaaagagaaagtgttgatgtcactgggctgggagatcttggaggatgagggggacccctttctgggaggcaggggaggggtatcccagatagaagctcggggaggcagaggaggtggggatagtttcttgcaagagccctctatgtcccctggtcctggggacgaagagactcccccatctgaaccatcaaaaatgtagagatagtctccagacagggagcctttgggccagggatctgagccaggctgtggcccttgggaggtagagtggttgggcggcccttcc

SEQ ID NO: 25565 - DNA, 601 bp, Human
aacaagtggttactattgtgaatgatcttcatcgccacgcagcgtttttggcagagcagggcctcagagcaagcggaagcaacttgctccggtccagagggccattcagccagtcaataatgaatcccataactcccaattcagtccttacatcaggaagcaggcacacgctaggaaccaggattcccaaatgcctgccccagaagggccgttttggccaagatacatgaaacctggccctgagaaggagccctccctctactggtgtccacccctaatcaagcctcccctggacctcccycaccagggccagggtcccaaagagggtaggagaggcctaaaggggtaaggacttggcagagttggatgtagaacagcagagactagtccctgtttctgaaggacatggagaaaggaaggcagaagaaacacaagaaggtcctcaccggggctgcagaaatccggcggttcttgccaggcgtcgcattctttcggttgccatagcgggaggcataggtgcgggggggcacctgagggggcatagtcttgctcctggccacgggttttccagaggtgtctttgctgaagtccagcggccctc

SEQ ID NO: 25566 - DNA, 601 bp, Human
cagtaattgtaatttctcccctgggctccacaagggaacttctgcccagtcctcattttgccccagccataaaaacaccacacataatctagagcaggagatacagcactacccatatagtctccccaagcccacccctccccacaaatacacacatctctccataagcagaatctgcaagcagatatgacctagtctttgcctaatcccagctccaagctctttccacagcagacttggctcaggacgtcagccaaccctgctggaagacagagctcctggggaaagtgctacgtggccragagtgtgcccagaaagcaggagtcttgactgtgggattggggcggagctgccaggccggtcccagcaccaatcccatgaagccccctcacactcttactaccaggaaggcaggggctacctcccacccattcactcacttctgcaggaactcctccagcccgcagggctttagcacaaagtcacccacgtccacattcctcaggtcatcatgggtgtagcacagggtctggtagataagcaagtctacagtggaggaacctgtgaagggtaaggtagggggagcaatcatgatggatgt

SEQ ID NO: 25567 - DNA, 601 bp, Human
aagggggtagtacccgtgttgtaccctactttggctcctagaaaatgacacggtagagcttaggagaaggaacagaggtctatctaaacaaaagccacctaatatacttaatccttggccggtataaatattgactctcttagatatttattacccgtgtggtaatcactggttcactccagggctgggaactgttggagagagcggggaaacagaggcacatcacagggagcagttgctgaagccctatcttctgggcctctgtataggggacaaccaggaagagacatgttggagtccrcctgtgctcaggctccagggtgggagctcagcgagagacccctcttccaatgctaccaactagggtgctgaggccaaaaaaacttggggcaagcctaccaagcctccagatcagtgtccccacccaacttctttttctgccttccatctgttggccctgcctgcttgtgaataaccttacaaatttctatgacttcttgaaaagtcccaaatgcatgccagtcccacctgctcaagcacccatgtgtgagactccccctttcagagataaggcctaggagccctcggcgatccaacctct

SEQ ID NO: 25568 - DNA, 601 bp, Human
aagaagtgacctattcagagaggggcggtgcccttatctcagctcagcactcctacccccctcccacctgatgtgttctatattgtattcccattccacctccccagccctgggcaaccctccaccaccctcacacgaaccgtccgggccaggtcactgcgcacaaccttctgctccatcagctgtagccgaatgtcaatgtcaaacttgcggcagtattggatgtactcatgactgcccaaggcatgcttgctggtagggtagagggacaagaccattagcatcctggggactcagtggsaagggagatacataccttagccttggggagagacatacagaaagaaggtttaggtaagggggtagtacccgtgttgtaccctactttggctcctagaaaatgacacggtagagcttaggagaaggaacagaggtctatctaaacaaaagccacctaatatacttaatccttggccggtataaatattgactctcttagatatttattacccgtgtggtaatcactggttcactccagggctgggaactgttggagagagcggggaaacagaggcacatcacagggagcagttgctgaagc

SEQ ID NO: 25569 - DNA, 601 bp, Human
gggatcttctctgataagatgtgtgggccccaacccctgacacctgcaagaatcccttagccctgacagaaaggcaagcaggcacatctgatgggatccctgcacagttcttgtttggagcacatccaagatggtgcccacactcacctgctgatggtctgcttgacaggcctctcttggagatggacgaggtagttcaaggtggaggggctctggtcatcattcacctgtataagaagtgacctattcagagaggggcggtgcccttatctcagctcagcactcctacccccctcccacmtgatgtgttctatattgtattcccattccacctccccagccctgggcaaccctccaccaccctcacacgaaccgtccgggccaggtcactgcgcacaaccttctgctccatcagctgtagccgaatgtcaatgtcaaacttgcggcagtattggatgtactcatgactgcccaaggcatgcttgctggtagggtagagggacaagaccattagcatcctggggactcagtgggaagggagatacataccttagccttggggagagacatacagaaagaaggtttaggtaagggggtagta

SEQ ID NO: 25570 - DNA, 601 bp, Human
ccaaggctatgacaattcttacacttctctacccatcgtagccactagcaaagggccagaccagcacagcacaggtgttcagagagcttcccccgcatcactggaaatgttcaagcacaggctgctggagaagggattctggcagtgactagacataatgctgaacccctcaaaaaggaagcgtttatgactactattaactggatcaatgagacagggattggtttttgttttgttttttgagatagggtctcactctgtcacgcaggctggagtgcaatggtgtgatcatagctcactacagccccaaactcctgggctcaagcgatcctcccacctcagcctccagagtagctggggctacaggtgtgtgccaccatacctggctaacttttgtattttttgtagagatggggtcttgctgtgttgcccaggctggccttgaactttggggttcaagcaattctcccacctcagtttcccaaagggttaggattacaggcgtgggccatcacactcagcaagggattgtttttgaagatcactgtcagattttctttggcgttgtgacatttaagacaaatgttgactctcatggttt

SEQ ID NO: 25571 - DNA, 601 bp, Human
tttttttgagacggagtcttgctctgtcacccaggctagagtgcaatggcgcgatctcggctcactgcaacctctgcctcccgggttcaagcaattctcttgcttcagcctcctgaatagctgggattacaggcgcctgcaaccacacccagttaatttttgtatttttagtagagatggggcttcaccatgttggccaggctggtctcgaactcctgacctcaggtgacccgcccacctcagcctcccaaagtgctgggattacaggcgtgagccaccgcacctggccaaggctatgacrattcttacacttctctacccatcgtagccactagcaaagggccagaccagcacagcacaggtgttcagagagcttcccccgcatcactggaaatgttcaagcacaggctgctggagaagggattctggcagtgactagacataatgctgaacccctcaaaaaggaagcgtttatgactactattaactggatcaatgagacagggattggtttttgttttgttttttgagatagggtctcactctgtcacgcaggctggagtgcaatggtgtgatcatagctcactacagccccaaactc

SEQ ID NO: 25572 - DNA, 601 bp, Human
ccttttctgtttgaagccatcatccaactcccctctcattctcaccgtggaccatagcctcttccttctcccaagtcctgtaaaagcttacgccctccaagaggacttgtgagctaaccacaccctggtctggatgacttggtggcagggatgccttcatgaggtggggaggctgggctagatgacctctaaggttcttccaatgacaagaccagatgatctattacccaagcattgcttttccatgtatccttaacatggtcctgtgccaccagaaccgctcagtggctcttggttacaycaatagtcctggtcaccagttctgtgcttggggatcctctggacttcaccagtgagccccacatggccaactctcccaaggtgcactggccagtgcagcagccaggcccctttctctgtccccctcctccctttccaaggccaagaagctgtaccctggggctcacatactgcctgaagttgaagagtggggtagtgacccagcccagggcttcaggcacccgccgctgcttattggcctctgaggagctccccggtggggggatgggcagagcatagagagtggcacacagcagtgtct

SEQ ID NO: 25573 - DNA, 601 bp, Human
tcctcttctccctggagaataggtccatcctgccaaagcactgagtcactggcaggggcaaaggtgtcccctcaagccccaagaggacacaggtcaggtttgatcagacttagacgtatgaagattcaatacaagggactcagaagctgagccctgaatgcagagggtctcagaccccatcttcaggctccacgaaatcaatttaacctccaggagatgggagatggataccccagagctcacctcacaatccacatctaaccatattccctcagttgcttcagtcacatcatcctcccaygcttgaagttctagcactctctcctgctgtcccagcccaaatctccaggagaaaaatgtagagttgactggaatggtcttgctggtgactgggagggaagggctaaagcctcacctgcaggatgacactgtctggctggtggaaattaggtgcactccaacgggcgctgggattttcctgtgttgctggccacaaacccagaagcttccggccacaggtcaggaccctaagaaggagggagagtgggaagagctgctaaagtggctaagcagagaatatttctactgctcccccaatcca

SEQ ID NO: 25574 - DNA, 601 bp, Human
acaagaaggggaagctgggaactgagaagtgcaccttgggcgtgaccagctcctcctcttctccctggagaataggtccatcctgccaaagcactgagtcactggcaggggcaaaggtgtcccctcaagccccaagaggacacaggtcaggtttgatcagacttagacgtatgaagattcaatacaagggactcagaagctgagccctgaatgcagagggtctcagaccccatcttcaggctccacgaaatcaatttaacctccaggagatgggagatggataccccagagctcacctcayaatccacatctaaccatattccctcagttgcttcagtcacatcatcctcccacgcttgaagttctagcactctctcctgctgtcccagcccaaatctccaggagaaaaatgtagagttgactggaatggtcttgctggtgactgggagggaagggctaaagcctcacctgcaggatgacactgtctggctggtggaaattaggtgcactccaacgggcgctgggattttcctgtgttgctggccacaaacccagaagcttccggccacaggtcaggaccctaagaaggagggagagtggg

SEQ ID NO: 25575 - DNA, 601 bp, Human
gtgggaggatgatttgtgcctgggaggcagaggttgcagtgagccaagattgtgccattgcattccagcctgggtgacagagatcctgtctcaaaaaaaaaaaaaaaaacctgcctcagggagctttcattctatgtcaacattcatactccataccaaagtatctcataaccacaagaaggggaagctgggaactgagaagtgcaccttgggcgtgaccagctcctcctcttctccctggagaataggtccatcctgccaaagcactgagtcactggcaggggcaaaggtgtcccctcargccccaagaggacacaggtcaggtttgatcagacttagacgtatgaagattcaatacaagggactcagaagctgagccctgaatgcagagggtctcagaccccatcttcaggctccacgaaatcaatttaacctccaggagatgggagatggataccccagagctcacctcacaatccacatctaaccatattccctcagttgcttcagtcacatcatcctcccacgcttgaagttctagcactctctcctgctgtcccagcccaaatctccaggagaaaaatgtagagttgactggaat

SEQ ID NO: 25576 - DNA, 601 bp, Human
aattagccgggcgtggtggtgtgcgcctgtagtctcatctactcgggaggctgaagtgggaggatgatttgtgcctgggaggcagaggttgcagtgagccaagattgtgccattgcattccagcctgggtgacagagatcctgtctcaaaaaaaaaaaaaaaaacctgcctcagggagctttcattctatgtcaacattcatactccataccaaagtatctcataaccacaagaaggggaagctgggaactgagaagtgcaccttgggcgtgaccagctcctcctcttctccctggagaayaggtccatcctgccaaagcactgagtcactggcaggggcaaaggtgtcccctcaagccccaagaggacacaggtcaggtttgatcagacttagacgtatgaagattcaatacaagggactcagaagctgagccctgaatgcagagggtctcagaccccatcttcaggctccacgaaatcaatttaacctccaggagatgggagatggataccccagagctcacctcacaatccacatctaaccatattccctcagttgcttcagtcacatcatcctcccacgcttgaagttctagcactc

SEQ ID NO: 25577 - DNA, 601 bp, Human
ccatactgagaaccagacctctcccaggggtgggttctccgtagtagtcggtatgaaaaccaccccctgagaagtgtggacaccctccagaagatccttaaggaggaggaccccctacaccccagcctgggactgtacgctaacagcaagaccaaatagctctagaggggagcagatggcagaacagcatgaagcaggccacagtgcacagagagggcaggctgtctctcaagggggaagagctatttaggcttctgccaagaaaagctaacaatctggacgttgatacaaaatctctcartttttaaatgtcgttaaccaggaacactgctggctggttacaatgtcttcgtacaaacagataaaggtgtcctctctgggtggcatcaggcctgagccatgggtcacagcatggtgaacaaaatatggctggatttcagccctcacttgccccttctggctgagtgctcttgtgcaatgaacaacttacacaactgtgcttagcctttaaaacaaacagctaaataaatttcaatattttacaggacaaacaaaacacatccacgggctgtatccagcttgtggactgcctgtttacggc

SEQ ID NO: 25578 - DNA, 601 bp, Human
ccctgcaagctgtcaggcttctaaaagtccatacacattaggaatgggaagaggccacagatatgcctttcttcctaatctctctcttattttatggcttatatggagatgctcacctgtgcccataccccagtctgtgccctcattctgtctttaagcagagttcacagcccctctgcctcgtttctcctttctatttctgccatgtgtgggtagaggagagacaggataacataatcctcaccatgttgcatgggggtgagctgagacccctgaggaaaagatgctaggccaagaccayatggtaagttagcaacatactgacgcccagacaactcagctcctcgaccttgcatgcctggttagtgaagacctcacctccactgagccctcccactctgagagccccaaacctaccagtcactcaccctgggcacaattcccttaaccagcagactggggctgagtggcaagcggcacgagccattgagggcaaagaactgcttcacctcctccaggcccgtgcggaggattccctggaaagaaggggaggagtacagcaggggtgaaatggagggtccatactgagaaccagacctct

SEQ ID NO: 25579 - DNA, 601 bp, Human
gaaagacacctgcctagccgcccaacctccaacccaattcctctaccctgcaagctgtcaggcttctaaaagtccatacacattaggaatgggaagaggccacagatatgcctttcttcctaatctctctcttattttatggcttatatggagatgctcacctgtgcccataccccagtctgtgccctcattctgtctttaagcagagttcacagcccctctgcctcgtttctcctttctatttctgccatgtgtgggtagaggagagacaggataacataatcctcaccatgttgcatgrgggtgagctgagacccctgaggaaaagatgctaggccaagaccacatggtaagttagcaacatactgacgcccagacaactcagctcctcgaccttgcatgcctggttagtgaagacctcacctccactgagccctcccactctgagagccccaaacctaccagtcactcaccctgggcacaattcccttaaccagcagactggggctgagtggcaagcggcacgagccattgagggcaaagaactgcttcacctcctccaggcccgtgcggaggattccctggaaagaaggggaggagt

SEQ ID NO: 25580 - DNA, 601 bp, Human
atgaaatgccataaccaacattaagcactcagaacagggccgggcacagagagtgctcaataaatgacagatgacagctgctatcaccaccaccacctccgacttcatccccaacatcatcagagaaagacacctgcctagccgcccaacctccaacccaattcctctaccctgcaagctgtcaggcttctaaaagtccatacacattaggaatgggaagaggccacagatatgcctttcttcctaatctctctcttattttatggcttatatggagatgctcacctgtgcccataccccmgtctgtgccctcattctgtctttaagcagagttcacagcccctctgcctcgtttctcctttctatttctgccatgtgtgggtagaggagagacaggataacataatcctcaccatgttgcatgggggtgagctgagacccctgaggaaaagatgctaggccaagaccacatggtaagttagcaacatactgacgcccagacaactcagctcctcgaccttgcatgcctggttagtgaagacctcacctccactgagccctcccactctgagagccccaaacctaccagtcactcaccctg

SEQ ID NO: 25581 - DNA, 601 bp, Human
ctgagctcaagcaattctcccatctcagcttcacaaagtgctgggattacaggcatgagctagcatgtctggcccaaaaaatatttccttacaattggtttgttttaatcaggatccaaagtctacacaatatgcttggctgtcacggcaccaagtctgttttactttataacagtctctctcccatgcctcccttttaaggctatcccacagcttctcatgaaataatcttgcccttttcactttcctggaggaggacacagtttgtgttggcaatgggcagaaggacaataagcaaagsggtcccctcctccaccctcacccctactcccaactgacctctgccccggccggtggagaagcagcggaagatgaccatgcgcatgtccagcccctcctggacccagatcttgctcatgatgcgaatcatctgcagcgttagcatgtcctggcgaaggtcgtccccacactggatggagggagaaagtgaccagatctaatctccactacctccccagctctcaggtctcccaagtgctcaaccttggccctaaactaacagtgacagggagttccccagcctcacacccctgacctgctc

SEQ ID NO: 25582 - DNA, 601 bp, Human
tgaacatgcagagttagtttctctctgtgtgtattctcgtacattcttctgtacatttatttttattatattcttatacattcatctgtacatttattattatttagtattatttccatacatttacacatatatgactattacattggcagggagtaatcacaactccagcacctagtacagtgcctctgcatatgggtgtttaatacctgaaaaatgcatattagcataaagagtaagtatatgggaggttggtagtagaaaggaaaaaaatcattactcctctccaagggtagagggycttgaaatgtatagcatagagtggcagagttttgaggaatgagaagggaagaaatgactttccaggcaaaggaaatattactgcctacagtactgcagaaatgaaagtagtagccccctctgcccccaccgcatgatctagctagtaacctagctggagcataggttagcataagatggtaggttgcagtggatgggattacaggagtcagcagggctggattataaaaggctctgtgtgcaatgctatctgttaggatacacagaggctttgaagaacttatccacacttaaaaaaaaa

SEQ ID NO: 25583 - DNA, 601 bp, Human
cctccattcatacagcactgactttgccctttcagtcccatggggtttacagatctgttctcctaacagcttcttgcctatttcacaatgcctattgcaaaactagctccacacagaatgcacccacccagctacttgtcgaattacaacctgatgatggatccaccagaaactaagaatggaaaggttataaagaaatcacagcattcatcttctggaagaaaaagactatttcttagaaagtaaaataaatgaataaaagcacttaataaggagcataacgcgtaactcccagtcgtgwcctggatctctatcaaatcctctccctgtcacagatgctctttctaccttaaatgaatcctattttggctgagaaaatagctgtgtgcctgtgggtaaatgactaaactcttttcacctccctaagttatgcagggtgttagccacttactggcaagaagtctcactctataaagggacactctgcctctgatttcaggggtttcatgtgtagggtgtgggatactctcttgctgagtaggtggccaagagaaaatacctctagtttctttcttctggaagtcatcaaatgaaactacca

SEQ ID NO: 25584 - DNA, 601 bp, Human
gcccagactgaggggaccttaagagatgggaagactgacatttacaacttccccaactggccgtgatgatcttaagtacagccactgaggaagccaacttaagaatctcttcctgaccctgctcagaattctatcatccttcttcctgccccaaataaaattcccatttccagagttcttggtaacagctaaatgctaatctaattaaagtcactgcactccaaagaagagctgaggcagcttaacacgtctagagagtgttttacacttgaaaatgggacatctttagttggtaaaataygttagagatatttctgagtttaaagcaggagaggagtggtgaggggttgactccatcttattttgtctggtcaacatccatccccttatctgtctttccagaaagaaaaactacatggaatgaggaaatagaccactcctgccttcaaaatcctcttcgtgaggtttatagaattcctaagaactcaggaaagacatcagcagagagcaatgatcgtcatagccaggtaggaatgcatgaaattaggaatgagggaaagcttactagatatggaatgcccgccctccttgcctccttcca

SEQ ID NO: 25585 - DNA, 601 bp, Human
cggccaaaaaattcatttaaaaagttgtttgtttgttttgagactgagtctcgctttgccgcccaggctggagcgcagtcacgtgatctcagctcactgcaacctctgcctcccgggttcaagcgattctcctgcctcagcctcctgagtagctgggattataaaagcatgccaccacactaatttttgtatttttagtagagatggggtttcaccatgttggccaggctgctctcgaactcctgacctcaggcaatctgcccacctaggcctcccaaagtgctgggattacaggcgtgarccactgcgcccggcctgaaaagtagtttttaaaaaaattgcagtaaaatatgtgtaacataaaatttgccatcttaaccatttttaagtgtacagttctgtggaattaaccatattcacactgtcatgcaaccatcgccactatccaacttcatagctcttttcatcttgcaaaactgaagctctgtacccattaaacaaccacacctacctcccctcagacctgggcaactagctttctactttctgcctctaggagtctgactactccaggtaactcagataagtggaatcgtgccgt

SEQ ID NO: 25586 - DNA, 601 bp, Human
cgtaggcagcggggatgcaggaggtgaagatggggaaagaaaatggacacaatgggcttttttcacatttcatttgcgtttccagtcccctagcacccatttcccagcagcctccatttctagggaccctcacaattcctcctgtgctgcacatctgtgcccaggtctgacacctgctcagcatctcatgactacatttccaagggccccagacaagaaaaccaaacagcaggccagagtcctgtggctccccagaaatggctcgggagccctcagtttctcccatcgatgtaaaaatcctttttttttttttgagatggagtctcgctctgtcacccaggcgggagtacagtggcgcaatctcggctcactgcaacctccaccacccgggttcaagcgattctcctgcctcagcctccccagtagctgggattacaggcacacaccaccgcacccagctaatttttgtatttttagtagaggggggtttcaccatgttggccaggctggtctcaaactccttagctcatgatctgcctgcctcagcctgccaaagtgctgggattacaggcatgagccaccgcacccggccaaaaaattc

SEQ ID NO: 25587 - DNA, 601 bp, Human
ctttggagcgaaacacaaaagagcaaatgtaaaatccatctggggcggggcatggtggctcacgcctgtaatcccagcactttgggaggccaaggcaggcagatcacgaggtcaagagatcgagaccatcctggccaacatggtgaaaccccgtctctactaaaaatacaaaaattagcttggcgtggtggcacatgcctgtaatcccagctactcgggaggctgaggtaggagaatcgcttgaacccgggaggcagattttgcagtgagtcgagatcatgccactacactccagcctggygacagggcgagactccgtctccaaaaaaaaaaaaaaaaatccatctggtagggaataaagaatatgaagagataagggagtcagtctcagtctctcccttcgggctcctgagcttagctccaggggaataatcaccactccaatccagcctcctactgaccaaagaaaaatcatggggcaaaaaacaacagttttgatggaatcccccaccccatgcccctttccttcagatagggcatccctttggctccagactaaataggtttatggccccacagaatgaggaaaagtcttataaaa

SEQ ID NO: 25588 - DNA, 601 bp, Human
agcgggttcatgccccagagagctttgctcatcattaacatgagctacgtcctgttcaggaaccattcctcttgttgaagaaacactgcgatgtaatatgataaacacgtccccatcacgagtgtagatttgtctagaaagatctgcattaaggtggctgcattttgcatgaatcacatgctggggaggggtaggtagcactaaaaactagtcccacttgagccttcaagtcattatggcatatgtgcctgcttcactataaacctcaaaggcctgtgacgtctggctttcattgtttaastcccctcctcctttgcaagggtggaattacctgtttgtaataccagcaattactatgcaccttggaattgagcagagagtgtgctcgagtgtgcatgtttagattggagggaattacccctaccttcaaagtcaaattctactcccccttcaatttgaaatcatgcacctcagcctctggaaagttgggaatggcagccagaaggaaacaagtcacatcaatttggctgatgtgagagaggagcctagccctggaaactccacacaaactcagaaagagaacattacgtccccacctccc

SEQ ID NO: 25589 - DNA, 601 bp, Human
acatctcctttagaagacggtagcgagctcgcattggaatttactcctctccaccagcctgattgtctgagggcttgcatcatctctctttcatctctatatacctaatatctagaaaaggaaccctaactttatttcagataggtaaactagtcactgaatgcaggttgattctcagggaccaacctaggcccaggtagttctggtttaaactgggttcgcagccattcccaagtggggagccgaaatcttaaagtctgattctttctcttgttgaatagaaggggagatgtgcaagaaygacacaactccattccagatactaatccagaggaagaggatgggagttaccacactgactctcaaaaggggacaagagacccacattcatactcccaagcttaccacagattaccaaccacgatgcaacctgctacaacagggggattccctttgaagagatggtgccaaaatttgatcatgaggcttttccatgtgaagagagaaaagggggtgtctggggattatccacgagaatctggggagggctccaactgcacaaactagctgtgggccacagaatgcttgctcagctcattag

SEQ ID NO: 25590 - DNA, 601 bp, Human
agttacaaaagagtggctccaaagccttgaccgctggtagggagggagaagcatgagaagtggtgtctcaggagttctagtgccaaaggtggagaggtgcaagtgggaacaatcagctaaggaagtcagctgacacacaaagaaatcggactggaatttttccaaacccctctatggaggcactaggttatcatggtgaacacccttttccctcgccatagaccctactctccagaggtgaaggtcatggccaattccttccacagcaggttcagagttccaggagaggccagggtgggawcccagaggaatctggacttttctggccaacacctgcctaaggcaaagtttcttattacataaatatccttgttaaaaagcaaaatattgatcctgtacaatataacctgttaaaaaaatcgtgcttacaaacagctcctagataagagggcaggtggagagaggacggagaaaacagctaccaaaaagggaggggggagtttaaaggactactagggaaagttttagggcagtgggagaattccaacttaggacaatatctacgagcaaaaaagtaatcacacctgcttcccggattttc

SEQ ID NO: 25591 - DNA, 601 bp, Human
gaaggaggccagaaatttgccaggaaatctaccaggaggtccattcgactgccagaaaccattgacttagggtgattttctgtgtttacttctctttacccattccttctgaaagacacaaacatagcagatcctgctccaaggcttgctttgaccacctctgatgttgtatccactctgccaggtcaatactggcacttggtgtactaaaatgtttacctgggtctgaaggagtgatccaaggcctactagctgaggagaggaggcgaatggagtacaaattccctcatactgggtaccggagagagagagagagagagagaaagaaacatcatcattgcatttataacatagccataataagtcagtcttgaaataaagctttaggatctttaggtagaaaggaaaaagcaggggctatgcatccaagcaagcaaggtttcaagttcaagttcattcatttacacactcaggaagggccagccagggtaaacacccatcctggtggaagccatttatgtcctgacccagtttaatggccgctgatgttggttggcttggaattgcaggtgatagttgtagactaaaggtggtcagaggc

SEQ ID NO: 25592 - DNA, 601 bp, Human
acctttcatctttgacctctaaattggggcaaatttccatcccaggaaccaataattaaatcaacaaacagctgaatgaatttaagagaatttaggagacgttaagtaccttccagcattgctaaacgctgtgcaggctacagagttatgcagatatgaatgttgcccctccactacttatgatctgatggagggagattaagctcaggggatacctggggtgggggagcttgtgctcacctcccagagagaacttaccattctgaaatgttccccactcatccaactgggtttttttttgtttgtttgtttgtttgcttttttatctctgtgcagtgccttatatttgtccatgaaagacactgaaaaaggaataaaagaactgaatctagagaaggacaagaagatttttaatcactgcttcacaggtaaaagcacttgcaggcctgaaatagggcgactgggaaggcgatatggagtcctccttcggcctcgtctgtgaggtgggggtatgaagtatgggggttggaaggggtcccagaatgcagcctggtgagcctgaggatgaagctcctacagagtgaaaatagaaagaagtttg

SEQ ID NO: 25593 - DNA, 601 bp, Human
aataacttagcctctctgtgcttcactttctctgtctatttagtggggataatcacagtgcacctacctcataggcttgccattatgtgtgtagagtagtgcctggcacacactcagtgctatatggtgcaagctcaagtggttattgtgttttaagtggtcacatgtctgtacaaccaattccaggggttcaaaaaaagagaaagaactcaggggttgatgggatgaataggaggtggtacccaaatttgaccctgaaagatgggtagaatttcattaaatatttacaggaggatttttratgaggagccagggcagaggatgagcagaggatgggccagggcagaggatgagcagaggatgggccagggcagaggatgagcagaggatgggcaaaggatggtgaggacaaagttatgaggcagacatgtgcagaatatgcatctagaaaaagaaactgaccagcctagtagggctgacggttcatcagggggagcaaaatgggatgtacaatttggtactaagtttgtcagataccaggcctggctttcttatggtgacaggagagatcaaaggaagaaaactctgagctgatacagca

SEQ ID NO: 25594 - DNA, 601 bp, Human
ctaagtttgtcagataccaggcctggctttcttatggtgacaggagagatcaaaggaagaaaactctgagctgatacagcaaatgtggaatctaagaggatgtgccatcaacagataatccatgaaattggtccaggtcaggatcagcaaggctaaggggaaaaggctttgatcactgacgatgagatagtcccccgtgggaataagcctcagagtcaaggcagcagcccagcatcagacaaggcagggctgagatttgggatcaagacaccaagctgtgggtggtggtatgagaaagtgrcaagaacaagggaagttcccaactctatcaggaccgaggtcactgcaacagccttgggcaaagggaacaggagggcatttcaatgtagacttgggcacccaatccaggtcagactgatttccactgtaatgtgttactgagtcccagactattgggctggtttttttcttcttgttctccttctccttctccttctccttctccttctccttctccttctcctccttcttcctcttgttcttattcttcttttctcctttttcctcttcctcttctttttatttgagacggagtttcact

SEQ ID NO: 25595 - DNA, 601 bp, Human
ttttgttgttcaggctcactgcaacctctgccgcccgggttcaagcgtgattctcgtgcctcagcctcctgaggagctgggattacagatgtgcaccaccatgcctggctaatttttgtatttttagtagattcggggtttcaccatgttggccagactggtctcaaacttccaacctcaggtgatctgcctgccttggcctctcaaagtggcctgtaatccctaagattacaggtgggctagtacttcttaaatccttcttgttgaaggccagggtgggttttggacatttctatgggtrgagccttcatgggggagtcaggtggcctcggctgggagatgaaggctgtagcagagactgggacccagcagtactgacacatgatggaagaccttaaatgtccgatgacaggcagactagaccaaacttgtctttcaagcttcagcatgcctcactgagtgagcgtggatgcaagggttagaacacttaaaagtgacagcccagagcagttgtaactttggcctaagatcactcagattccctgagccttaattttcttatccttaaaatgaggactgcaattaccaccctgcctctttc

SEQ ID NO: 25596 - DNA, 601 bp, Human
aaacttccaacctcaggtgatctgcctgccttggcctctcaaagtggcctgtaatccctaagattacaggtgggctagtacttcttaaatccttcttgttgaaggccagggtgggttttggacatttctatgggtagagccttcatgggggagtcaggtggcctcggctgggagatgaaggctgtagcagagactgggacccagcagtactgacacatgatggaagaccttaaatgtccgatgacaggcagactagaccaaacttgtctttcaagcttcagcatgcctcactgagtgagcrtggatgcaagggttagaacacttaaaagtgacagcccagagcagttgtaactttggcctaagatcactcagattccctgagccttaattttcttatccttaaaatgaggactgcaattaccaccctgcctctttcacaggctgctatgaagataaaaagaagaaatgcagtgtcacttagtttatctttgtagagaaagaaaagtgagcaaaagcctttcatacatgaaattcatggaaggctcgctatccaactgctgtcactcctgttttgagggtggcatccctactgcttttgccc

SEQ ID NO: 25597 - DNA, 601 bp, Human
aggactgcaattaccaccctgcctctttcacaggctgctatgaagataaaaagaagaaatgcagtgtcacttagtttatctttgtagagaaagaaaagtgagcaaaagcctttcatacatgaaattcatggaaggctcgctatccaactgctgtcactcctgttttgagggtggcatccctactgcttttgcccggatgacaggacaggcaggctgtcatgttgactcccttgttggctacatttgtaaggaacacactgctttttatttttatcttttttaattgacacataatagtacrtatttatggggcacaattaatgttctgatacacatatacattgtgcagtgatcaaatcgtggtaactagtgtatccatcacctcaaatatctatctttttttgttgtaagaacaaacatgctgtttttaatacaaagcttcattgtaacctgctaataatccaatgtatgggtcaatttcattttcttctctttgcaatcatctcttgaccagaagattgcttaaatgacttctcaaggtccctgctagactctgcaaagtcatgacaatcagtgcaggtgatgtcatcaaattttaatt

SEQ ID NO: 25598 - DNA, 601 bp, Human
aaatttcttactgtgccatcaaagctctccccacccacccttcacctccctcctcctcttatttccttttgccttctttccaccaactcctcccctgccccatggggctgctttatgcctgagtgcatctgttcacactgctgccccctcagcttgtgctggttcctctgcatcctgcttcatatgcttggcaaacgcctactcatattttaagcctctgcccagtgtcacttcctctatgaatcttttcctgatggtgatgcacagccctcttctctcacctccttcacctctttcacaycttcagatttgacccagtagtctcgcaactgacttatagcagagcacttgttacaagacttatttattacacccatcatgcccttttacactccttgagggaatttctccaacacccagtagagtacctagcatcgagtaggtgctcagtaaatgtttgttcatcaatgggataagtgagtgggttagtaaaacctatttctttgatgcatgtgttgcttttttttaagacaaagactttatttttttatttttaaagttattatttttttattttatttttgtttttatttatttattt

SEQ ID NO: 25599 - DNA, 601 bp, Human
gacttatagcagagcacttgttacaagacttatttattacacccatcatgcccttttacactccttgagggaatttctccaacacccagtagagtacctagcatcgagtaggtgctcagtaaatgtttgttcatcaatgggataagtgagtgggttagtaaaacctatttctttgatgcatgtgttgcttttttttaagacaaagactttatttttttatttttaaagttattatttttttattttatttttgtttttatttatttattttttattatactttaagttttagggtacatattttttgagatggagtcttgttatgttgcctgggctggtcttgaactcctgggctcaactatcctactgcctcagcttccagagtagctgggacaacaggtgtgccaccatacctggtcatgtgtttcttcttaagcagcatgtagatgttcttaaaaaccctttacatagttttttgtttgtttgtttgtttctagtgggtatctatcccacttattttgttttctctttcttgaaataacaggggagacgagacaagtcagacctgtgggtgagctggagtcagttcaggggtgattgt

SEQ ID NO: 25600 - DNA, 601 bp, Human
aagcagcatgtagatgttcttaaaaaccctttacatagttttttgtttgtttgtttgtttctagtgggtatctatcccacttattttgttttctctttcttgaaataacaggggagacgagacaagtcagacctgtgggtgagctggagtcagttcaggggtgattgtcaggggcttgttcttcggtaaggagagttaaccttccctgtgctggtcccatctaggtaactgcgtcattgattggctggtatccaaccagtctgttaggaatcgccaggaaggcctcatgattgcttcatcrctgctcaatgaggggtatctgcagcctgctggagacatgtccaagagtgcagtggatggaactgctgaaaaccctttcctggacaaccctgatgccttctactactttgtaagaaaagctccccatctcttcttcctgtaagggaggctgccctgagcagattctagattgatttcagttcatagacatctatagagcgctgttaggcagcgggtagggaggtcagccaggaagaacaagggaatacctgaagctcccaggcccatttagagcttctgttataccagcatttcccaactc

SEQ ID NO: 25601 - DNA, 601 bp, Human
ccatctcttcttcctgtaagggaggctgccctgagcagattctagattgatttcagttcatagacatctatagagcgctgttaggcagcgggtagggaggtcagccaggaagaacaagggaatacctgaagctcccaggcccatttagagcttctgttataccagcatttcccaactcaacagctgccctctctacaacactcgccctgtccaagtgaatttgttattataaaaggatactactgtttacttgaaaaaaaatttttaaaggacattttaaagtttattgtttcctatttayttattattattttttatttatttagatgtagtcttgctctgtcacccaggctggagtgcagtggtgtcatctcggctcactgcaacctccgcctcccgggttcaagcgattttcctgtctcagcttcccgagtagctaggattacaggcatgcgccaccacactcagctaattttcgtatttttagtaaagacagcgtttcaccatgttggccaggctggtctcgaactcctgacctcaagtgatccacctgcctctgcctcccaactatctattcttattctaagcaataattcattta

SEQ ID NO: 25602 - DNA, 601 bp, Human
tgttaaaacacatgactcttaatacaaaatgtgtccacagatgtcacttcctgcagtcatcttgtgtacctcccacagtatgcttacccacgattgggaaacactatattatacaatgtgaacctgttcttaggccatgtgagcaatggtggatttcttgggggattttggcagttttgtttctatcttggatcagagcacagaatttaggaagttacctaagagaaccattcttcttataaacatgaagtgaacaccctagagggtttcatttcactttaggggaagttccacagtctgttttttttgttcttcagtcctttgatctggtcgtttatagccatttcaatgcaggattctaaaaatacccatcacagtggctcctcttcctcggtctgattcatcatctacttttgctgagcaagtcccacttccctcataacctcaggggaagaggctggacacatgctgtcacttttctccaagagggggctcagtggcaaatgttgagctggtgatagtattgccaatgagaaattagcctgccctgctttcaaggatgtgaccatgatatcccaagagaaggaaggctttgaaggca

SEQ ID NO: 25603 - DNA, 601 bp, Human
cacatgactcttaatacaaaatgtgtccacagatgtcacttcctgcagtcatcttgtgtacctcccacagtatgcttacccacgattgggaaacactatattatacaatgtgaacctgttcttaggccatgtgagcaatggtggatttcttgggggattttggcagttttgtttctatcttggatcagagcacagaatttaggaagttacctaagagaaccattcttcttataaacatgaagtgaacaccctagagggtttcatttcactttaggggaagttccacagtctgttttttttkttcttcagtcctttgatctggtcgtttatagccatttcaatgcaggattctaaaaatacccatcacagtggctcctcttcctcggtctgattcatcatctacttttgctgagcaagtcccacttccctcataacctcaggggaagaggctggacacatgctgtcacttttctccaagagggggctcagtggcaaatgttgagctggtgatagtattgccaatgagaaattagcctgccctgctttcaaggatgtgaccatgatatcccaagagaaggaaggctttgaaggcagacatgtg

SEQ ID NO: 25604 - DNA, 601 bp, Human
gagggggctcagtggcaaatgttgagctggtgatagtattgccaatgagaaattagcctgccctgctttcaaggatgtgaccatgatatcccaagagaaggaaggctttgaaggcagacatgtgcctggttaggaagatggagctaaagttaggatacagcttgggagaccctccagaataaaaggatattgacaagatcacacctgagtggagacaagaaaggaacagccccggaagcaagtaaaaggaggaggagaaactcgctcatcaaggacctttgaagttcagattgggatgtayacaggaatggaggaaaaaggaggaggctgccctcatggctggaggggagggggaatggagatggcacaagttgcaatgtgcctaagactggtgatgttagcttgctgtttgattttccaacagccagacagtgggttcttctgtgaagagaattccagtgatgatgatgtgattctgaaagaagaattcagaggggtcattatcaagcagggatgtttactgaagcaggtgagtggccacaactgctcccatctagccttttccctttacaaggtcctttttgtttctaagttacccagt

SEQ ID NO: 25605 - DNA, 601 bp, Human
actcgctcatcaaggacctttgaagttcagattgggatgtatacaggaatggaggaaaaaggaggaggctgccctcatggctggaggggagggggaatggagatggcacaagttgcaatgtgcctaagactggtgatgttagcttgctgtttgattttccaacagccagacagtgggttcttctgtgaagagaattccagtgatgatgatgtgattctgaaagaagaattcagaggggtcattatcaagcagggatgtttactgaagcaggtgagtggccacaactgctcccatctagccytttccctttacaaggtcctttttgtttctaagttacccagtgacttttggtttgtttggttaatagtcaagcagaaaatgaaacccacaaagtgaaagatagatgagtagctctttagatatcaaagtggctttagatcaggaagattgagtttgacagggcagaagatgtccctaaaagtaggaaaatgcctcttttatcaatatcataggaaaaaaaaaggtgtttcaagaaaaatatggccggaggagataaattgtctaagagatgccatccaaaagacaaagctgtctcatggta

SEQ ID NO: 25606 - DNA, 601 bp, Human
attctgaaagaagaattcagaggggtcattatcaagcagggatgtttactgaagcaggtgagtggccacaactgctcccatctagccttttccctttacaaggtcctttttgtttctaagttacccagtgacttttggtttgtttggttaatagtcaagcagaaaatgaaacccacaaagtgaaagatagatgagtagctctttagatatcaaagtggctttagatcaggaagattgagtttgacagggcagaagatgtccctaaaagtaggaaaatgcctcttttatcaatatcataggaaaaaaaaaggtgtttcaagaaaaatatggccggaggagataaattgtctaagagatgccatccaaaagacaaagctgtctcatggtaaaagtacttccattttacctgtccctcctcccttcaaagcaaccaggaaaacaggaacaggctacacccagaagaggaacagagtacaccactgagagcaaagaagagtcattccagtctgtgcttagggcatgacaagaccaaaacctgggcatgcagaggccagttcacaggaacagcaggcaaaagtcaaatgcagattgagggcatgga

SEQ ID NO: 25607 - DNA, 601 bp, Human
caagcagggatgtttactgaagcaggtgagtggccacaactgctcccatctagccttttccctttacaaggtcctttttgtttctaagttacccagtgacttttggtttgtttggttaatagtcaagcagaaaatgaaacccacaaagtgaaagatagatgagtagctctttagatatcaaagtggctttagatcaggaagattgagtttgacagggcagaagatgtccctaaaagtaggaaaatgcctcttttatcaatatcataggaaaaaaaaaggtgtttcaagaaaaatatggccrgaggagataaattgtctaagagatgccatccaaaagacaaagctgtctcatggtaaaagtacttccattttacctgtccctcctcccttcaaagcaaccaggaaaacaggaacaggctacacccagaagaggaacagagtacaccactgagagcaaagaagagtcattccagtctgtgcttagggcatgacaagaccaaaacctgggcatgcagaggccagttcacaggaacagcaggcaaaagtcaaatgcagattgagggcatggacagagtcctggggggatgtccaggtgtccaca

SEQ ID NO: 25608 - DNA, 601 bp, Human
ctttagatcaggaagattgagtttgacagggcagaagatgtccctaaaagtaggaaaatgcctcttttatcaatatcataggaaaaaaaaaggtgtttcaagaaaaatatggccggaggagataaattgtctaagagatgccatccaaaagacaaagctgtctcatggtaaaagtacttccattttacctgtccctcctcccttcaaagcaaccaggaaaacaggaacaggctacacccagaagaggaacagagtacaccactgagagcaaagaagagtcattccagtctgtgcttagggyatgacaagaccaaaacctgggcatgcagaggccagttcacaggaacagcaggcaaaagtcaaatgcagattgagggcatggacagagtcctggggggatgtccaggtgtccacaggtacaggccaccatcagtcttggaggcaagggctggagagtgctgaggagctctagtcggttaccaggtgccaaggcatatgatgccaagaggtaagagatggacaggggccaagatgactgaggaagccaggaccagtacctggtggaggaagtcgcaggaagacatgagaatattcaggggga

SEQ ID NO: 25609 - DNA, 601 bp, Human
agataaattgtctaagagatgccatccaaaagacaaagctgtctcatggtaaaagtacttccattttacctgtccctcctcccttcaaagcaaccaggaaaacaggaacaggctacacccagaagaggaacagagtacaccactgagagcaaagaagagtcattccagtctgtgcttagggcatgacaagaccaaaacctgggcatgcagaggccagttcacaggaacagcaggcaaaagtcaaatgcagattgagggcatggacagagtcctggggggatgtccaggtgtccacaggtasaggccaccatcagtcttggaggcaagggctggagagtgctgaggagctctagtcggttaccaggtgccaaggcatatgatgccaagaggtaagagatggacaggggccaagatgactgaggaagccaggaccagtacctggtggaggaagtcgcaggaagacatgagaatattcagggggaagctagttgatacttgcacaaggcatcttagaggccaaggctgctttgcaggaccaaggtcttgccttcctggctgcactgtgagctgccttaaaagtgctgctcagtatataatggag

SEQ ID NO: 25610 - DNA, 601 bp, Human
caaaagtcaaatgcagattgagggcatggacagagtcctggggggatgtccaggtgtccacaggtacaggccaccatcagtcttggaggcaagggctggagagtgctgaggagctctagtcggttaccaggtgccaaggcatatgatgccaagaggtaagagatggacaggggccaagatgactgaggaagccaggaccagtacctggtggaggaagtcgcaggaagacatgagaatattcagggggaagctagttgatacttgcacaaggcatcttagaggccaaggctgctttgcaggrccaaggtcttgccttcctggctgcactgtgagctgccttaaaagtgctgctcagtatataatggagagaatctgttgccatcaggagatttccatgtactgtctataggctccacgggactgggggatctgatttatttcatgttaggaccctgaatgtccatcttagtgattaatggaatgggcaaggagggaagaaccagagaagagcccatatttacatttataaagagggactctgggctgggatagctgaaaggaggtataggtatggattttgagtttcacagggggaagtggg

SEQ ID NO: 25611 - DNA, 601 bp, Human
aaagaaaggcatggggcagagccagccttatgccgggaaggctcgggcagttgcctacggacagtttgcccgctgctgctttctcgttggttttgccaaatattcctatgttcctggctctttgattgcaggtgctggaatgtggctgttaagacaagaagagtaacttgggaggaaatttctttattttgttgatttcttccataattctatattgttatcagttatttcttgaattagttgattgggcaaaccctaatctagaatggggctcttggaaagccaaggatgaaggctaacggtagataaagttgggactggactggagccacgtctcagtgaagcagcccagtaggagacctgggatggtcaaaaattgtgtgtgggtaatgagtgtctggatgtattttgaagacaatagggacaaggattgaacttatgtgttttcctttgccttcctttgtctggcctttgataggtacaatttagccttagctagctcggttggtgcacatttggatctcccagggaactgttaaaactgcatgccaggccaatttaatcagagcctctggatttttacagctcccaagtgattctg

SEQ ID NO: 25612 - DNA, 601 bp, Human
ctctggatttatgaaggaggcactgtttgctaagaccacacatgttttattgctttcagcacaagtaaaatgaaaaatgttggaaaatttgtatacatgcttgccaatatgtggtgctttagaaattacaaataatatttcttgtattggcaagatagaaactccgtatcttttaatataatactatttttggcttctggagttaagtcatttgaatttcctgtgggaaatcatagagtcaggtttaccatgacagtttaaaatctgctacacactaatggaaataacttggtaactcacrgcaagtacaaacagatatgaagcagctgctatatgccaggcactgtggccctggggaacaaagataagcaagacacaaatcctgcccttaaaactcagtctagacaatgtcagtgtttaattctgttgggaaaggccaagtcgtcaccttctttcttcttcttctttctttcttccttcctctttccttcctcctaccttcctcccccttttctcctcctcctccttcttcttcttcttctttctcctcctcctcctcttccgcctcttcttcttccttcatcatgtctgttacagcaac

SEQ ID NO: 25613 - DNA, 601 bp, Human
cagcacaagtaaaatgaaaaatgttggaaaatttgtatacatgcttgccaatatgtggtgctttagaaattacaaataatatttcttgtattggcaagatagaaactccgtatcttttaatataatactatttttggcttctggagttaagtcatttgaatttcctgtgggaaatcatagagtcaggtttaccatgacagtttaaaatctgctacacactaatggaaataacttggtaactcacggcaagtacaaacagatatgaagcagctgctatatgccaggcactgtggccctgggraacaaagataagcaagacacaaatcctgcccttaaaactcagtctagacaatgtcagtgtttaattctgttgggaaaggccaagtcgtcaccttctttcttcttcttctttctttcttccttcctctttccttcctcctaccttcctcccccttttctcctcctcctccttcttcttcttcttctttctcctcctcctcctcttccgcctcttcttcttccttcatcatgtctgttacagcaacaggcatttccattcctactgcagctacctaaggtttagttcctaatgattttatgc

SEQ ID NO: 25614 - DNA, 601 bp, Human
aacagatatgaagcagctgctatatgccaggcactgtggccctggggaacaaagataagcaagacacaaatcctgcccttaaaactcagtctagacaatgtcagtgtttaattctgttgggaaaggccaagtcgtcaccttctttcttcttcttctttctttcttccttcctctttccttcctcctaccttcctcccccttttctcctcctcctccttcttcttcttcttctttctcctcctcctcctcttccgcctcttcttcttccttcatcatgtctgttacagcaacaggcatttcyattcctactgcagctacctaaggtttagttcctaatgattttatgcctggattattgtgatccttccctaatgaattcttttttacttaccatcttttcctgggctttcctttaatctagccagctggtccatcctgcactttgtcaccatattaatcttcttaaaatgtaattgtaattctttcacttcctactcaaaagccatcaacaacaaaccctgccttttatttccactaaatctctgtccacttttcccaccttgcctctgctactcttcatgaaccctacattctagccaga

SEQ ID NO: 25615 - DNA, 601 bp, Human
aattgtaattctttcacttcctactcaaaagccatcaacaacaaaccctgccttttatttccactaaatctctgtccacttttcccaccttgcctctgctactcttcatgaaccctacattctagccagactggtcttattcatcaacacctgagtatgtctcttgcattcccacttctgctcttgtgttgtcagttgtcctcctacccacctttgtcttgcccatctaaatcctgtgtcccacatggataagtgcaggtctttatgaggctttctttgatatccaaagcccacaattacrtattccctacttaatgcctttggaatccattatctataccaattatttgatttgggcatttgctactttatatttcaacataggtcataaactctttaaagatcagggcatcttaaacctctttattccccctacattacctaacacagcacattgtacctagtactgccttatatcatactaaaactggaagacaataattagaaataatttaatccacctcttcgatctaataacatccatattatttattggctgtagcactatctccctgacaaagacctaggccgggatattgtt

SEQ ID NO: 25616 - DNA, 601 bp, Human
attctagccagactggtcttattcatcaacacctgagtatgtctcttgcattcccacttctgctcttgtgttgtcagttgtcctcctacccacctttgtcttgcccatctaaatcctgtgtcccacatggataagtgcaggtctttatgaggctttctttgatatccaaagcccacaattacatattccctacttaatgcctttggaatccattatctataccaattatttgatttgggcatttgctactttatatttcaacataggtcataaactctttaaagatcagggcatcttaaamctctttattccccctacattacctaacacagcacattgtacctagtactgccttatatcatactaaaactggaagacaataattagaaataatttaatccacctcttcgatctaataacatccatattatttattggctgtagcactatctccctgacaaagacctaggccgggatattgttatcctggagttagtatttcattttctctttcttttctcaattcagcaaataattattctgtaggtattgtttgtacagagtgatgctgggaattcaccatcccttcttttaatgttga

SEQ ID NO: 25617 - DNA, 601 bp, Human
ctaaatcctgtgtcccacatggataagtgcaggtctttatgaggctttctttgatatccaaagcccacaattacatattccctacttaatgcctttggaatccattatctataccaattatttgatttgggcatttgctactttatatttcaacataggtcataaactctttaaagatcagggcatcttaaacctctttattccccctacattacctaacacagcacattgtacctagtactgccttatatcatactaaaactggaagacaataattagaaataatttaatccacctcttygatctaataacatccatattatttattggctgtagcactatctccctgacaaagacctaggccgggatattgttatcctggagttagtatttcattttctctttcttttctcaattcagcaaataattattctgtaggtattgtttgtacagagtgatgctgggaattcaccatcccttcttttaatgttgatcctggatacaggggcatagaaggaaaaactggaaagtgaggaagttcatcttgagagaagaccctgcctacctgcactactatgaccctgctggggtaaggtcctgt

SEQ ID NO: 25618 - DNA, 601 bp, Human
gcccacaattacatattccctacttaatgcctttggaatccattatctataccaattatttgatttgggcatttgctactttatatttcaacataggtcataaactctttaaagatcagggcatcttaaacctctttattccccctacattacctaacacagcacattgtacctagtactgccttatatcatactaaaactggaagacaataattagaaataatttaatccacctcttcgatctaataacatccatattatttattggctgtagcactatctccctgacaaagacctaggycgggatattgttatcctggagttagtatttcattttctctttcttttctcaattcagcaaataattattctgtaggtattgtttgtacagagtgatgctgggaattcaccatcccttcttttaatgttgatcctggatacaggggcatagaaggaaaaactggaaagtgaggaagttcatcttgagagaagaccctgcctacctgcactactatgaccctgctggggtaaggtcctgtggttcataaatccattcaaataaataaatccactgcatttataatctgggcttcctattccc

SEQ ID NO: 25619 - DNA, 601 bp, Human
tatcctggagttagtatttcattttctctttcttttctcaattcagcaaataattattctgtaggtattgtttgtacagagtgatgctgggaattcaccatcccttcttttaatgttgatcctggatacaggggcatagaaggaaaaactggaaagtgaggaagttcatcttgagagaagaccctgcctacctgcactactatgaccctgctggggtaaggtcctgtggttcataaatccattcaaataaataaatccactgcatttataatctgggcttcctattcccctctctactctrttgatatcccctttttctctttactggcccacttttttttctcccattctcctctacctttttctatcccctttcaatgcaaagatctgagatcttgggcctctgaggtcagtataagcttagggatggaacaaaatatcactatattataatttatttggtcaactcaacatatttttccccaatctgatattttcaggggaattaaatcagtccatggtttaatatgcataaaggtgataattcctcatccaggtcaacttggatgagggtattgtttaagtccagcaatttgggctg

SEQ ID NO: 25620 - DNA, 601 bp, Human
ctggccccactgaagcagggtgtggaggatctggaaggaccttagatctgtcagcagtttttctttaatctccttctgctcttacttattttggggggccctgatctatattagagtgagtctggctttttcaccaagaggatgaggtctatctatactctgcattttggaaacataatgaacaactcctttcttctttaggcagaagatcccctgggagcaattcacttgagaggctgtgtggtgacttcagtggagagcaactcaaatggtaagatgaatttctgtgtgagagaggtgkgtctgctcagactcccctcccacacctggacatcctgggccaacattaatcaatcaatcaattaatcaggataagcaggaatggggcaggcatggtggctcccacctgtaatcccggcactttgggaggccgaggagggcagatcacttgtgatcaggatttcgagaccagcctggctaacgtggtgaaaccccatctctactaaaaatacaaaaattagctgggcatggtggcacatgcctgtgaattgtttgagcttggcaagttgcaatgagctgagattgtgctactgcactccag

SEQ ID NO: 25621 - DNA, 601 bp, Human
tttggggggccctgatctatattagagtgagtctggctttttcaccaagaggatgaggtctatctatactctgcattttggaaacataatgaacaactcctttcttctttaggcagaagatcccctgggagcaattcacttgagaggctgtgtggtgacttcagtggagagcaactcaaatggtaagatgaatttctgtgtgagagaggtgggtctgctcagactcccctcccacacctggacatcctgggccaacattaatcaatcaatcaattaatcaggataagcaggaatggggcargcatggtggctcccacctgtaatcccggcactttgggaggccgaggagggcagatcacttgtgatcaggatttcgagaccagcctggctaacgtggtgaaaccccatctctactaaaaatacaaaaattagctgggcatggtggcacatgcctgtgaattgtttgagcttggcaagttgcaatgagctgagattgtgctactgcactccagcctgggtgacagagcaatactctgtctcaaaaaaaaaagcaggaatgaatttactgtctgaaaaccttggagaaaccagagttattttt

SEQ ID NO: 25622 - DNA, 601 bp, Human
gacatcctgggccaacattaatcaatcaatcaattaatcaggataagcaggaatggggcaggcatggtggctcccacctgtaatcccggcactttgggaggccgaggagggcagatcacttgtgatcaggatttcgagaccagcctggctaacgtggtgaaaccccatctctactaaaaatacaaaaattagctgggcatggtggcacatgcctgtgaattgtttgagcttggcaagttgcaatgagctgagattgtgctactgcactccagcctgggtgacagagcaatactctgtctcaaaaaaaaaagcaggaatgaatttactgtctgaaaaccttggagaaaccagagttattttttgtctcccaactgctgtccaggctctccaggccttggggagttggatggctttgtggatgcctcaagcaagtccctgagcaatgctgggaaaactccatcacttcacaatggcttagaagaagagcagtgagggggttgcactagaggaccccagaccacaaggctatgatttggtgcatggaataaccacgtgggtgtagtttgacttctcaggtgctgaggacaaattgtatctctgg

SEQ ID NO: 25623 - DNA, 601 bp, Human
tgaaaccccatctctactaaaaatacaaaaattagctgggcatggtggcacatgcctgtgaattgtttgagcttggcaagttgcaatgagctgagattgtgctactgcactccagcctgggtgacagagcaatactctgtctcaaaaaaaaaagcaggaatgaatttactgtctgaaaaccttggagaaaccagagttattttttgtctcccaactgctgtccaggctctccaggccttggggagttggatggctttgtggatgcctcaagcaagtccctgagcaatgctgggaaaactcyatcacttcacaatggcttagaagaagagcagtgagggggttgcactagaggaccccagaccacaaggctatgatttggtgcatggaataaccacgtgggtgtagtttgacttctcaggtgctgaggacaaattgtatctctggggtgatgtggttttgacatcccaaaccctggttttgtcctgacattttggtttgtagtatgataaaggctgacaggaaaacatcataactgcaaatgcctagagttttactgtgcctgaatttgcccacctccactcccaccacctagaattatact

SEQ ID NO: 25624 - DNA, 601 bp, Human
aaaaatacaaaaattagctgggcatggtggcacatgcctgtgaattgtttgagcttggcaagttgcaatgagctgagattgtgctactgcactccagcctgggtgacagagcaatactctgtctcaaaaaaaaaagcaggaatgaatttactgtctgaaaaccttggagaaaccagagttattttttgtctcccaactgctgtccaggctctccaggccttggggagttggatggctttgtggatgcctcaagcaagtccctgagcaatgctgggaaaactccatcacttcacaatggctkagaagaagagcagtgagggggttgcactagaggaccccagaccacaaggctatgatttggtgcatggaataaccacgtgggtgtagtttgacttctcaggtgctgaggacaaattgtatctctggggtgatgtggttttgacatcccaaaccctggttttgtcctgacattttggtttgtagtatgataaaggctgacaggaaaacatcataactgcaaatgcctagagttttactgtgcctgaatttgcccacctccactcccaccacctagaattatactttggttttagggcaggga

SEQ ID NO: 25625 - DNA, 601 bp, Human
ataaatatatattataaatacaaatctatattaacagaaagacagatagataggtagatatcaggagcaacccttgatttatattatgagcagagggaaggtacccattagaaactattagaggttactcattaaacgctgttgctatacaaaggtgagaaatttagtttgcctgtaaactatgaaagaaaatgtttctccttaagtgttttacctatttcttaaaaatatatatatacacacagtcatactatgtatctactctatcaatactatgtatataactgtgcaatgaattatyctataatcataccttgtttgtatgtttgaaagccacatagtcaatttccttagaacacgaagaaaacagagatttcatggcttgcagaggagggtggagcaagtggtctttctgatgcctgtgcgtgctgccatttgccttctctttccccaggcaggaagagtgaggaagagaacctttttgagatcatcacagcagatgaagtgcactatttcttgcaagcagccacccccaaggagcgcacagagtggatcagagccatccagatggcctcccgaactgggaagtaaagagactcct

SEQ ID NO: 25626 - DNA, 601 bp, Human
atctactctatcaatactatgtatataactgtgcaatgaattatcctataatcataccttgtttgtatgtttgaaagccacatagtcaatttccttagaacacgaagaaaacagagatttcatggcttgcagaggagggtggagcaagtggtctttctgatgcctgtgcgtgctgccatttgccttctctttccccaggcaggaagagtgaggaagagaacctttttgagatcatcacagcagatgaagtgcactatttcttgcaagcagccacccccaaggagcgcacagagtggatcaragccatccagatggcctcccgaactgggaagtaaagagactcctgcattcctcctcccctcctgagggaagcccatggacaagctcagtccaggacctgtccacttctgtgacaaatcaacgggaaacagcccaggggtgggaagttttcatttgcaggggggtctgaatgtaactcaccatgtggtgtgcaaggttcccctgcattgtattgctcactgcagcccctctgcccctatccatgacccccaagcagatataacaagctgtgcagcctcagtaggctgcttgccctctccag

SEQ ID NO: 25627 - DNA, 601 bp, Human
aattatcctataatcataccttgtttgtatgtttgaaagccacatagtcaatttccttagaacacgaagaaaacagagatttcatggcttgcagaggagggtggagcaagtggtctttctgatgcctgtgcgtgctgccatttgccttctctttccccaggcaggaagagtgaggaagagaacctttttgagatcatcacagcagatgaagtgcactatttcttgcaagcagccacccccaaggagcgcacagagtggatcagagccatccagatggcctcccgaactgggaagtaaagasactcctgcattcctcctcccctcctgagggaagcccatggacaagctcagtccaggacctgtccacttctgtgacaaatcaacgggaaacagcccaggggtgggaagttttcatttgcaggggggtctgaatgtaactcaccatgtggtgtgcaaggttcccctgcattgtattgctcactgcagcccctctgcccctatccatgacccccaagcagatataacaagctgtgcagcctcagtaggctgcttgccctctccaggcctcagggcctcttctggaaaatgaagaaattcaact

SEQ ID NO: 25628 - DNA, 601 bp, Human
atcacagcagatgaagtgcactatttcttgcaagcagccacccccaaggagcgcacagagtggatcagagccatccagatggcctcccgaactgggaagtaaagagactcctgcattcctcctcccctcctgagggaagcccatggacaagctcagtccaggacctgtccacttctgtgacaaatcaacgggaaacagcccaggggtgggaagttttcatttgcaggggggtctgaatgtaactcaccatgtggtgtgcaaggttcccctgcattgtattgctcactgcagcccctctgcycctatccatgacccccaagcagatataacaagctgtgcagcctcagtaggctgcttgccctctccaggcctcagggcctcttctggaaaatgaagaaattcaactagtagattcctgaggtccccctagcttaaaaaaaaaaaaaatctgccccatgattctaacactcgcagtagtgatagtgtatctagttgttctgctggtgtccttccttggctaagtcttggccttcagttatcttcaaatgtaccagaacctgagccaacgcctccctgtgaaactgttgctgatctgtagtac

SEQ ID NO: 25629 - DNA, 601 bp, Human
cccctcctgagggaagcccatggacaagctcagtccaggacctgtccacttctgtgacaaatcaacgggaaacagcccaggggtgggaagttttcatttgcaggggggtctgaatgtaactcaccatgtggtgtgcaaggttcccctgcattgtattgctcactgcagcccctctgcccctatccatgacccccaagcagatataacaagctgtgcagcctcagtaggctgcttgccctctccaggcctcagggcctcttctggaaaatgaagaaattcaactagtagattcctgaggtcyccctagcttaaaaaaaaaaaaaatctgccccatgattctaacactcgcagtagtgatagtgtatctagttgttctgctggtgtccttccttggctaagtcttggccttcagttatcttcaaatgtaccagaacctgagccaacgcctccctgtgaaactgttgctgatctgtagtacagtaccaggaagaaacctcttttgttctctttagacatcttctacttgctcttggccttgagatcgtgtaacaaaatgaaggagggctctcttctttcttcctcatcctactcaaaaacttcc

SEQ ID NO: 25630 - DNA, 601 bp, Human
tcctgagggaagcccatggacaagctcagtccaggacctgtccacttctgtgacaaatcaacgggaaacagcccaggggtgggaagttttcatttgcaggggggtctgaatgtaactcaccatgtggtgtgcaaggttcccctgcattgtattgctcactgcagcccctctgcccctatccatgacccccaagcagatataacaagctgtgcagcctcagtaggctgcttgccctctccaggcctcagggcctcttctggaaaatgaagaaattcaactagtagattcctgaggtcccccyagcttaaaaaaaaaaaaaatctgccccatgattctaacactcgcagtagtgatagtgtatctagttgttctgctggtgtccttccttggctaagtcttggccttcagttatcttcaaatgtaccagaacctgagccaacgcctccctgtgaaactgttgctgatctgtagtacagtaccaggaagaaacctcttttgttctctttagacatcttctacttgctcttggccttgagatcgtgtaacaaaatgaaggagggctctcttctttcttcctcatcctactcaaaaacttcccgag

SEQ ID NO: 25631 - DNA, 601 bp, Human
ggaagcccatggacaagctcagtccaggacctgtccacttctgtgacaaatcaacgggaaacagcccaggggtgggaagttttcatttgcaggggggtctgaatgtaactcaccatgtggtgtgcaaggttcccctgcattgtattgctcactgcagcccctctgcccctatccatgacccccaagcagatataacaagctgtgcagcctcagtaggctgcttgccctctccaggcctcagggcctcttctggaaaatgaagaaattcaactagtagattcctgaggtccccctagcttaaaaaaaaaaaaaatctgccccatgattctaacactcgcagtagtgatagtgtatctagttgttctgctggtgtccttccttggctaagtcttggccttcagttatcttcaaatgtaccagaacctgagccaacgcctccctgtgaaactgttgctgatctgtagtacagtaccaggaagaaacctcttttgttctctttagacatcttctacttgctcttggccttgagatcgtgtaacaaaatgaaggagggctctcttctttcttcctcatcctactcaaaaacttcccgagagcagtg

SEQ ID NO: 25632 - DNA, 601 bp, Human
gtccaggacctgtccacttctgtgacaaatcaacgggaaacagcccaggggtgggaagttttcatttgcaggggggtctgaatgtaactcaccatgtggtgtgcaaggttcccctgcattgtattgctcactgcagcccctctgcccctatccatgacccccaagcagatataacaagctgtgcagcctcagtaggctgcttgccctctccaggcctcagggcctcttctggaaaatgaagaaattcaactagtagattcctgaggtccccctagcttaaaaaaaaaaaaaatctgccccrtgattctaacactcgcagtagtgatagtgtatctagttgttctgctggtgtccttccttggctaagtcttggccttcagttatcttcaaatgtaccagaacctgagccaacgcctccctgtgaaactgttgctgatctgtagtacagtaccaggaagaaacctcttttgttctctttagacatcttctacttgctcttggccttgagatcgtgtaacaaaatgaaggagggctctcttctttcttcctcatcctactcaaaaacttcccgagagcagtggtggttttgagggttttgact

SEQ ID NO: 25633 - DNA, 601 bp, Human
gtccttccttggctaagtcttggccttcagttatcttcaaatgtaccagaacctgagccaacgcctccctgtgaaactgttgctgatctgtagtacagtaccaggaagaaacctcttttgttctctttagacatcttctacttgctcttggccttgagatcgtgtaacaaaatgaaggagggctctcttctttcttcctcatcctactcaaaaacttcccgagagcagtggtggttttgagggttttgacttctattacttttggcagcctggaaagttgtgtcttctgggaaagagaccyggggaggccaggagtagctgagggtcctttctgtgcccttaaaccgcccagaggagccctattccactctggttttaggctgatctgagagggtctccctttgttcctttctggagcatttctctaacgtttattacaattaggagggggaccccacatctgtgagattctgtttcatttgaggtttacagaaaaaaaaaagtggccagatgtgttccccccatgggtgagaggcctgggcaactgcctggtgaatgtgtcttgcggcagctgcagcaagtggaggggctgaactactgg

SEQ ID NO: 25634 - DNA, 601 bp, Human
tcttcctcatcctactcaaaaacttcccgagagcagtggtggttttgagggttttgacttctattacttttggcagcctggaaagttgtgtcttctgggaaagagacctggggaggccaggagtagctgagggtcctttctgtgcccttaaaccgcccagaggagccctattccactctggttttaggctgatctgagagggtctccctttgttcctttctggagcatttctctaacgtttattacaattaggagggggaccccacatctgtgagattctgtttcatttgaggtttacagaaaaaaaaaagtggccagatgtgttccccccatgggtgagaggcctgggcaactgcctggtgaatgtgtcttgcggcagctgcagcaagtggaggggctgaactactggccagctcactggatgatgggttaatacaacaactgcactgtaaggactcagagccacacagaacttctgagaggggctgttagcattgcgcagcatcttcagttctccagtaaatgatattgcgttcgtgcctcagctttaagcacaagtagcagcagctcctgcttgagttctgagggcatcatggcccta

SEQ ID NO: 25635 - DNA, 601 bp, Human
ggcagcctggaaagttgtgtcttctgggaaagagacctggggaggccaggagtagctgagggtcctttctgtgcccttaaaccgcccagaggagccctattccactctggttttaggctgatctgagagggtctccctttgttcctttctggagcatttctctaacgtttattacaattaggagggggaccccacatctgtgagattctgtttcatttgaggtttacagaaaaaaaaaagtggccagatgtgttccccccatgggtgagaggcctgggcaactgcctggtgaatgtgtctygcggcagctgcagcaagtggaggggctgaactactggccagctcactggatgatgggttaatacaacaactgcactgtaaggactcagagccacacagaacttctgagaggggctgttagcattgcgcagcatcttcagttctccagtaaatgatattgcgttcgtgcctcagctttaagcacaagtagcagcagctcctgcttgagttctgagggcatcatggccctatgattaaccagagtgatctaacctagactaaaattgggaacttatttgcaatttttgaccctgaccactaa

SEQ ID NO: 25636 - DNA, 601 bp, Human
actggatgatgggttaatacaacaactgcactgtaaggactcagagccacacagaacttctgagaggggctgttagcattgcgcagcatcttcagttctccagtaaatgatattgcgttcgtgcctcagctttaagcacaagtagcagcagctcctgcttgagttctgagggcatcatggccctatgattaaccagagtgatctaacctagactaaaattgggaacttatttgcaatttttgaccctgaccactaactagtgattcttctccaaaattgagaaagacagcacccattgaarcagatatgtgtgtgaaagtatatttttcaattccagatttttaattttaaggctccaggaaagaaaggagagtagaacatttttcctcattttatcaaatcctctcttgccctccctcaattcccctgtaacattcctgaagctgttcccactcccagatggttttatcaatagcctagaggtaaagaactgtctttttctctgattctttaataaattatctttatagaatatgcacaagtttttctacactcagtgttaaagtatttattaatgggaagtcaacttaatgttttgaaa

SEQ ID NO: 25637 - DNA, 601 bp, Human
gttttagtccacctttgattggtggcttctccaaacatttttctggtctttctggggtactgcctccctgcctgtgtatcccgaccccactgcctagaatgctcaccttccctcccacagcccttgctgcctggcagaatgccattccttcaagactctgcttgaccagcactccccctgtgaagcttccagactctcctccatcacgtcggaaaccactccctccctggctctctccacattcgtcacaccgtgctgtggttatgtgtgttcatctcactccccgtagactgtcatctcygcatccccagagtgtaggccaaacatggcacagtaatattagctgaatacgtgaaccacagtcagggctgtgcctagtagaatgtgtaggtttagatctgcccaactgcacagaatcacagaatcttaggggactttgtagtaagaatcctttccatccttcctctggtcgacttgtatttgtttttatttatttattattttttatagagacagggtttcactctgttgctcaaactgaagtgcattagtgccatcatagttcactgtaacctccaactcgtgggctcaaacagtcccc

SEQ ID NO: 25638 - DNA, 601 bp, Human
agagccatgggcctctatactcctggggctgggagaggcccagtatgttaaaatgttgccagggcactgaggactggagtggggggcggtctccagaggagtaggggaaaggagggggactgcagccccttcagtcaaatctactttatctgccatgtccaggcccccttgggacactaacagtttgccaggggtggtactcaccggcacgtaatgcaccactgtgtccaccacgttgtcagtaacgcccttcagggcatctgatagggacatggccctccccttggttgaggagacagcrggggctggtgtgaggtgcagcaccctccctgccatgcccagcacagctgcaggtgcccatgtcacagccgagatggtggtctggagggtcttctgcagggtatgtgccacaccacccaggaggcctcgagggcctggcagggctgctacctgggggccaaagcagggtcagtgcctcctgtggtaactcccctgacccttccctccccaccagccccagggctagaggggaaagcatgagaataccaaatttacaaaacttcaggcctattctgccactagcagtgtggccttggacagg

SEQ ID NO: 25639 - DNA, 601 bp, Human
caggccagagccatgggcctctatactcctggggctgggagaggcccagtatgttaaaatgttgccagggcactgaggactggagtggggggcggtctccagaggagtaggggaaaggagggggactgcagccccttcagtcaaatctactttatctgccatgtccaggcccccttgggacactaacagtttgccaggggtggtactcaccggcacgtaatgcaccactgtgtccaccacgttgtcagtaacgcccttcagggcatctgatagggacatggccctccccttggttgaggaracagcgggggctggtgtgaggtgcagcaccctccctgccatgcccagcacagctgcaggtgcccatgtcacagccgagatggtggtctggagggtcttctgcagggtatgtgccacaccacccaggaggcctcgagggcctggcagggctgctacctgggggccaaagcagggtcagtgcctcctgtggtaactcccctgacccttccctccccaccagccccagggctagaggggaaagcatgagaataccaaatttacaaaacttcaggcctattctgccactagcagtgtggccttg

SEQ ID NO: 25640 - DNA, 601 bp, Human
tttcaatgaaggggaacaggggagctcggggagaaagacacacatccttttgcaatatttgaattctgtaattgtatgaatgcattttctagatttatcaaatattaacatttcgaagactagggttggggatgaactgtggctatacataaagtctatatatcatcaccattttggttccccagcatcaaaagagtgactatgcaggtgaaggcagtaatgatgcaaatggaaatgtggctgtgagcaagcagctggctctacaaagcacacaggcctggactcagcctgtgaagcggcrggtactcagaaagtgacactagtattttaaataaacacccaagagcttttgcatctgattgttcccttcaaagtagcctgctgggagcctagatcatcagaggatgttcatcagagggggaacagatcatcctagatcacagaggagttcagtgctaagaatgtgtcaaaaccttctgtctggaccttcagagtggtgacaggagttactcattcgtggcaaatatttatccgcagaggcagaatctgaattttggaaacggtcaaatatcttttggccacaagtttggttaaagagatg

SEQ ID NO: 25641 - DNA, 601 bp, Human
gggctcaaggaccccagttacagaatcttctgggttccaaataccccctagaggtttcccattggccacttggtgttcaccccattggttgcagaaagcaaccaaccagacgtactttcaattttccatctgccctgcaggaaatggggtgatttgcaaagagagtagcctctcttccttttgttactgaggcatggagagttgcggttttcctttcgatttagttctaggaagtcagagggaatcggccttaggttccctgcctccagaccctattctcctgcctcagaatcatacagtrtttgaccttttgtgactggcttatttcacttagcataatgtcattgaggtctatctatgttgtagcatgtatcagaatttcatttctttctaacgctgagtaatattccattatatgtgtagaccacattttgtttatctattcatctgttgatggatacttggattgtttctacattttgtctattgtgaatagtgttgctgtggacattgttgtacaagtatctgtttgggccttgtttttacatcttttggttatatatctaagagtggaatttctgggtcatattgttgttccatg

SEQ ID NO: 25642 - DNA, 601 bp, Human
catttctgactcaattttcccaactttgcagcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggtaaggttctccccagccccagccttccctcctgaaggcctgagttccaccaggaaagtgagctggcactggggtgggaatccaggccttcatcagatcagctctttgtgggaaagtgtttgctcracgccttctctgtgctctcccctgttcttggctgcatggtcagggagcttcccataagcatggcccactcccagcccagcaggggtgctgagacactcagggttgtcagaggccagcagagactggtggacagcagatagtaccagcttgggaaggcttcctgtctgaagagagacgtaatctgcgtggttgagagcagaggagaggggacagcaggagcaaaagggtggccacaagtccctggcagtcagggcaggctctgcccactcacccctgcaggcacctgacctggctctgtga

SEQ ID NO: 25643 - DNA, 601 bp, Human
tgcccactcacccctgcaggcacctgacctggctctgtgactccctctatgcaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcrccggggaggcaggtagggaggtgggtagggcagtggcctgggtgctgcccgccagggtctgggcggtgcccctcttctgtattttggccccatccagaaagcccaaagccaacaggagtcccttattcccactgaataagatagggaaagttcacagtgtgcgtgggggtgagagtggacacagtttaccatgtgttttgccatgattgaggtgtggggagcctgacaggctaaaatgcacagttctatgagtcctttctcccaaacactactgtgcctttgcacagggcaggtctccac

SEQ ID NO: 25644 - DNA, 601 bp, Human
ttgaggtcaacccagaggaatctggaacaagagagttctaaggatctgcttcacccagagtacagctttgttcctcattctgactgagccctagccttggtcacacactgagcactgactgatattccttacccacaaatgctattggtaatcgatgggttttgattaactaaatgaagcgtcttttaactctagacatcccagctcatggagctgagaatggggacagtgtgcttctttaggattgcagaaggttccagaccaggtagcagttgtcaggcctcctgtacagggggcaaaytctgaattctgggcagataacttaattgaatattcatagataaggcacagcaagaaattatggaaacccatttgtgaattactcaaatccaaatgcaaagcagagtcacattggcacacacagtggctgttcccgtccccctgcagggcatccatttcccccagccgactggcctgcaaggattcccataggtgcacacccacacccctcccagcatgcatcctaggcagttcataatgcatctccccttccccgtttcagaggaacgcgttgtggtgatcagcagctcggaagactcag

SEQ ID NO: 25645 - DNA, 601 bp, Human
atgggttttgattaactaaatgaagcgtcttttaactctagacatcccagctcatggagctgagaatggggacagtgtgcttctttaggattgcagaaggttccagaccaggtagcagttgtcaggcctcctgtacagggggcaaactctgaattctgggcagataacttaattgaatattcatagataaggcacagcaagaaattatggaaacccatttgtgaattactcaaatccaaatgcaaagcagagtcacattggcacacacagtggctgttcccgtccccctgcagggcatccrtttcccccagccgactggcctgcaaggattcccataggtgcacacccacacccctcccagcatgcatcctaggcagttcataatgcatctccccttccccgtttcagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgc

SEQ ID NO: 25646 - DNA, 601 bp, Human
cttgttgaaccatcacccttgcgaacccttattccacgaccatcgcgttctccgatggatccagctcctccctgcaggctgttctctcttccctatgctggaactcagttctcctctggggataccatgtcccctcttcctcccacactcatgggcatcagaggtgggaggtagggtcaaggccccctgcttcctggactgttccagccccttcctggccgtctggtaagatcctctgtccctctcagggtgggccccatgctccccagctcatcccagacacccacctgcccaccctcaytgagggcagacgtgagcattcacctcccagatttcttctccctgctcaggtcctgccttcctcctgagtgacttctatttccacccacctgcccgccactccttaacctctcaggggttgtcaccccattcccccagacagctgcctgccccgtggccgtgccctgcacctcgccatcaccgagcactgtcagtccctcagccggtcctctcagactctgaccgcagcctcctgttccttgagctctcagtcctaccttcgcctccctccagccccgcgcactccccatttcatcccatc

SEQ ID NO: 25647 - DNA, 601 bp, Human
ttggagtgccaacagtgtccccagatgtcatggagaatcaagtagagggaccccagcaatattgggggtggggcggggagtatgtaatgctcagctatcagcaaggagtcattaggggctatacagtgaattaagggagggggtaaaagcacatttcaggtgatgatgaattaaatacctaggagctcacattagagagcaggcctagagacgtggggagagagccagaggaccgctgcttttgtgtatgtagctttaagacacaggttttaaaaattgttataggagtcccaaactttagaaaatatatattttaaaaccccaacaaattaggtcccccctatgcatttctcacccaacttctgggccctttccagacccctggtgcccccagagtacacccagcaccaccactgcaaattcctactccccagcttggagggggtggggtgatattcccaaggtgatcccggctcccacctaacccatcctccccagctctgcagcttatatccagccttgcagtgaggaaagttgcagaatactggtctgctacattactactttccaagtgtatcagggcatttaggaacccctccct

SEQ ID NO: 25648 - DNA, 601 bp, Human
agagagccagaggaccgctgcttttgtgtatgtagctttaagacacaggttttaaaaattgttataggagtcccaaactttagaaaatatatattttaaaaccccaacaaattaggtcccccctatgcatttctcacccaacttctgggccctttccagacccctggtgcccccagagtacacccagcaccaccactgcaaattcctactccccagcttggagggggtggggtgatattcccaaggtgatcccggctcccacctaacccatcctccccagctctgcagcttatatccagcyttgcagtgaggaaagttgcagaatactggtctgctacattactactttccaagtgtatcagggcatttaggaacccctcccttgagcttcacctgtgtcctagggattcagtgagagactgtttgtgtaagaaggagcgagaggcagcagggcatagtcatggggtggagcagtgagtcccccaggcctggttgtggagtacctggggtgaggactttgcttaaaaactgccagagtgggtcagcagtgcgcctgccctggggcccctgctttaggatccaaagtggaaaagataggtgt

SEQ ID NO: 25649 - DNA, 601 bp, Human
agacacaggttttaaaaattgttataggagtcccaaactttagaaaatatatattttaaaaccccaacaaattaggtcccccctatgcatttctcacccaacttctgggccctttccagacccctggtgcccccagagtacacccagcaccaccactgcaaattcctactccccagcttggagggggtggggtgatattcccaaggtgatcccggctcccacctaacccatcctccccagctctgcagcttatatccagccttgcagtgaggaaagttgcagaatactggtctgctacattactactttccaagtgtatcagggcatttaggaacccctcccttgagcttcacctgtgtcctagggattcagtgagagactgtttgtgtaagaaggagcgagaggcagcagggcatagtcatggggtggagcagtgagtcccccaggcctggttgtggagtacctggggtgaggactttgcttaaaaactgccagagtgggtcagcagtgcgcctgccctggggcccctgctttaggatccaaagtggaaaagataggtgttctcacccactcttgtgacagattactggctccggtgcct

SEQ ID NO: 25650 - DNA, 601 bp, Human
atttctcacccaacttctgggccctttccagacccctggtgcccccagagtacacccagcaccaccactgcaaattcctactccccagcttggagggggtggggtgatattcccaaggtgatcccggctcccacctaacccatcctccccagctctgcagcttatatccagccttgcagtgaggaaagttgcagaatactggtctgctacattactactttccaagtgtatcagggcatttaggaacccctcccttgagcttcacctgtgtcctagggattcagtgagagactgtttgtgyaagaaggagcgagaggcagcagggcatagtcatggggtggagcagtgagtcccccaggcctggttgtggagtacctggggtgaggactttgcttaaaaactgccagagtgggtcagcagtgcgcctgccctggggcccctgctttaggatccaaagtggaaaagataggtgttctcacccactcttgtgacagattactggctccggtgccttggtggcagcagcaacaggagggggccaaggtgagggggcagcctgtggcagaagtggcagtggtgacggcggaggaagggaggcctg

SEQ ID NO: 25651 - DNA, 601 bp, Human
tgcagtgaggaaagttgcagaatactggtctgctacattactactttccaagtgtatcagggcatttaggaacccctcccttgagcttcacctgtgtcctagggattcagtgagagactgtttgtgtaagaaggagcgagaggcagcagggcatagtcatggggtggagcagtgagtcccccaggcctggttgtggagtacctggggtgaggactttgcttaaaaactgccagagtgggtcagcagtgcgcctgccctggggcccctgctttaggatccaaagtggaaaagataggtgttytcacccactcttgtgacagattactggctccggtgccttggtggcagcagcaacaggagggggccaaggtgagggggcagcctgtggcagaagtggcagtggtgacggcggaggaagggaggcctgtggggaatggctgatccaggggaggggccgtggcactggtgagtgtgcatctgagaaaatgaaacggaggtgctggccaagaggctggagctaggcagaagggcagcagaggccacaggctggccgagtttatggtccagttcactcctaacatgtgcagtattcctggggtct

SEQ ID NO: 25652 - DNA, 601 bp, Human
gatccaaagtggaaaagataggtgttctcacccactcttgtgacagattactggctccggtgccttggtggcagcagcaacaggagggggccaaggtgagggggcagcctgtggcagaagtggcagtggtgacggcggaggaagggaggcctgtggggaatggctgatccaggggaggggccgtggcactggtgagtgtgcatctgagaaaatgaaacggaggtgctggccaagaggctggagctaggcagaagggcagcagaggccacaggctggccgagtttatggtccagttcactcmtaacatgtgcagtattcctggggtctttgaggctttgcaagagctggggttttgtgtctgcagaaagatagcaatgcatgtgtcttgccaaactgatcccagctgtagctgatgcttaagtgctcagaaagttcttcaggagcttgagggctcttgataagcatgaatgtcagatgttctgtatcttccagaggctggatgctgactatcagagtttggcttgtgtttggctgatgagcaaacctggaatgaatcagtgataaggacaattgttctcaagctggctgtacactggggagt

SEQ ID NO: 25653 - DNA, 601 bp, Human
gttttgtgtctgcagaaagatagcaatgcatgtgtcttgccaaactgatcccagctgtagctgatgcttaagtgctcagaaagttcttcaggagcttgagggctcttgataagcatgaatgtcagatgttctgtatcttccagaggctggatgctgactatcagagtttggcttgtgtttggctgatgagcaaacctggaatgaatcagtgataaggacaattgttctcaagctggctgtacactggggagttttcccaactacagattcctaggtcctacgccctgagattctaatcgartcagtcttgggtgcagcctgggcctcagttttttcttaaagctatgaatgcctaaccaaagtcaagaaccactgaatcgggggattcattgcatgtctgtggtagaggaatgctgctcatttgtttatagatgtggcagtcttgaatgcaggtgacattttcataccagggtgtaataccgcagaggaggggagaggctggatcttccctgatgtacctcctggacttttggagtgtgattacaatgccaatccagccacttcctctgagcatgcttgggacgactgttagacctgctgt

SEQ ID NO: 25654 - DNA, 601 bp, Human
taaaaatggtagtaaggttaaagaaagtataggtaaatcttactagtttgggctcacaaagaagaaagcaagtctaaattttaaaagcaaaacactctctgcaaggtgtattttgtagactatttgcaaagtcatttgtagactatttgcagatatcccacaattttgaattcaagagcccatagtaacttagaatcaatcatgtcaataaagcaagctgagctcattggagacttctagttggcagatgaaaataatgacaaaggttgtatgtgatgacctttgatgattttttttttttagggttaaggctttatgttcactaattaacacatacattgaatgtaaatagattcatgtactcttccgaatgtttctttctttagtacagtggttcttagcccttgctgcacaacagatttacttggggagtaaataccaatatggaggcctccaaacagataattcaatgtaaatctcttgggggaggaggaaccatcactatatttaaatattccccaggtaacgcaaatatgtagacatttttgaaaaccactgtcttattagatttaaatgcaagtgaactatacataaaaacttg

SEQ ID NO: 25655 - DNA, 601 bp, Human
ggagactgacatactgatattttattcctttctaaattaatcttatgagtttattttgaatttctatttttattacaaattttctgttctctggtttgaacttgagatactcaattaacctctctcttttttaaggaatgtaaaatgaagggcgtggtgtgcaccagaatctatgagaaggtctgaaaaatcatttcttcattgaagtggctttttatcatttaatgatggaaatcaattgcttccattgacaaaactgaatacactgcaaatatttgtttttgcttttgtcttaatataycagatatgcaaaggcctaaactgagaattaatctaaaagtcagtgttatttaaacattttcaatgtgcatgcatgtcattattacatcaaagcatatatattggccagacacaaacagttgatgatgtcattcaattaactacaaaattctaatctatgttgaactttgtatacttgaaatgataataaaaaggatataatttcttagtaaaatgaaatcaaagtattgatcagggtagcaaactcaaatgctgacaggggccagaggagatatggggaaggagcatcagaaatgaggca

SEQ ID NO: 25656 - DNA, 601 bp, Human
tccgagaactcagggattgtgaaacccgccccgactctgcgctagcagcgggatccaggcacccgcagctaactggggagggagatgactgcctggctgacttttcattggctcagagtcacaaaggctgcaggttcttcccccttccggtcgctgagtggttgaggccggaagacaacgctcatcgtcattggctgagcccggctgtcagtcctttcgcgcctcggcggcgcggcatagcccggctcggcctgtaaagcagtctcaagcctgccgcagggagaagatggcggtcgccgtragaactttgcaggaacagctggaaaaggccaaagagagtcttaagaacgtggatgagaacattcgcaagctcaccgggcgggatccgaatgacgtgaggtaagggcctaacgggaactcggaactcggagctcggagaggcagccctcaggtcggggtgaattgggggcggggagggcggccagccttaagaagactggaacctcgaggcctgttcgcggggcggcgggtaaaaccctgttgtcgccgaggtggagaggccccaggtcccctccgtagagcgctggtctcaggtccctga

SEQ ID NO: 25657 - DNA, 601 bp, Human
aaaggtatttccctgggggaaaaaaactctagtgaaataatgcagttataaggaaaatcaagggattgttcaagcatcctgtagtatttcttagaaaatgatgggtttaaatgaaatggatcctgttgacagtaaattttcttattctgttctttaggaaccggcgaatatttggcttgttgatgggtacccttcaaaaatttaaacaagaatccactgttgctactgaaagggtatttatccaagttttgttttgcatcatatatttaagttatcaaagtagtagattaatgtttttttwaaaaaatccttaaagctcttttaagacctaactgtaaacctgaaacaaagccaagtaaaaacttggtttaacttcttatagaacagctttacttaaacattgtgttggaatataacagttgttgatatcatagctaatagccttgaaatttagatatgtgaaaaaaaaaagcctcaagtctccatttccttaaagacaaattacagtcagtaccaagtgctaagttctagttagttggtatcctgaattgaaaatgtgaagcggccaggtgcagtggctcatgcctgtaatcccagcact

SEQ ID NO: 25658 - DNA, 601 bp, Human
gttgctactgaaagggtatttatccaagttttgttttgcatcatatatttaagttatcaaagtagtagattaatgttttttttaaaaaatccttaaagctcttttaagacctaactgtaaacctgaaacaaagccaagtaaaaacttggtttaacttcttatagaacagctttacttaaacattgtgttggaatataacagttgttgatatcatagctaatagccttgaaatttagatatgtgaaaaaaaaaagcctcaagtctccatttccttaaagacaaattacagtcagtaccaagkgctaagttctagttagttggtatcctgaattgaaaatgtgaagcggccaggtgcagtggctcatgcctgtaatcccagcactttgggaggctgaggcaggtggatcacctgaggtcagaagtttttcgagaccagcctggccaacatggtgaaaccctgtctttactaaaaatacaaaattagccgcctgtggtggcatgcgcctgtaatccccagctatttgggaggcggaggcaagagaatcacttgaaccctggaggtgaggttgcaatgagccaagatcacactattgtaccccag

SEQ ID NO: 25659 - DNA, 601 bp, Human
gaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaawccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtac

SEQ ID NO: 25660 - DNA, 601 bp, Human
agaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaratacagactgtttgtttaccagacattcttgtactttttgcataattttgtaagagttatttatcaaaattatgtgaggttccaaaatatgtaaaaatgataataataaaaaaagattaacatcccttgtcatcttttttaaatatcctatactcttcagtaagaatctgtatattttaataggcaaatctttaagtctgttcccttctaattctgtatcatacattgcttttgtagaaataaatgtgtgtttatttcattatttttgggatgtcctcgttgacacttgtataataaata

SEQ ID NO: 25661 - DNA, 601 bp, Human
gttcgtgtgcatatgctgcgcagactatcatatccccctctatacgggcataagcaatctgacaattgatatctctgtttgttatatgaactatcatcctctatttgggtgtgttgtatttatttttatcctgtattaccaagcgtttctgagcatagtaatcagttttaccatcttgtcatctttaagtttcatttggtatctcttaaagtaggccttattcttaacaactttaacaaagtccatcctgtggaacagagacctgcaggcccagcagcactagggggtggaaaggcgggarcaatttttaaaaactgatgtaggggccaggcacagtggctcacgtctgtaatcccaccactttgggatgccaaggcgggtggatggcatgaacccaggagttcaagaccaacctgggcaacatagcaacatcccatctgcattaaaaaaaaataaattgatatagggacataagggaatgcagtttgaaactatgaattttaaaatagctatccaagggctgcgtgtggtggctcatgcctgtaatcctagcactttgggagaccgaggcaggtggatcatttgaggtcaggagttggaa

SEQ ID NO: 25662 - DNA, 601 bp, Human
tgtattaccaagcgtttctgagcatagtaatcagttttaccatcttgtcatctttaagtttcatttggtatctcttaaagtaggccttattcttaacaactttaacaaagtccatcctgtggaacagagacctgcaggcccagcagcactagggggtggaaaggcgggagcaatttttaaaaactgatgtaggggccaggcacagtggctcacgtctgtaatcccaccactttgggatgccaaggcgggtggatggcatgaacccaggagttcaagaccaacctgggcaacatagcaacaycccatctgcattaaaaaaaaataaattgatatagggacataagggaatgcagtttgaaactatgaattttaaaatagctatccaagggctgcgtgtggtggctcatgcctgtaatcctagcactttgggagaccgaggcaggtggatcatttgaggtcaggagttggaaaccagcctggccaacatggtgaagacctgtctctactaaaaatataaaattggctgggcgcagtggctaacgcctgtaatcccagcactttgggaggccaaggcaggcagatcacgaggtcaggagatcga

SEQ ID NO: 25663 - DNA, 601 bp, Human
tttaaatgaagggattattatcttaaaatttgagctggtaccaaggtgggcttttttgacactggctgaagtaaagattaacattgaaatattaaggctttagtgctctcatctttatggcatggggcattcctttaaatataatgatttgttctttaaatggcagcattttcggtgaaagttattctaaaacatattaaattcttaaacctagtatgttgaaaatgaaaatgactgcttggggactcaaggccattataaaattttcattggaagaattacaaaaattttttttttttttagagatagtgtcttattctgctatctaggctagagtgcagtggtgctattatagctcactgtaaccttgaactcttggggtaaagtgactctcctgccttagtactccttttgagtagctgagactacaggcttgcgcaaccatgtgtggccaatttttgtatcttttgtagagaagaggtctccctatgttgcctaggctggtcttgaactcctggcctcaagccttcctcccacttaagcctcccagagtgctaggattataggtgtgaaccacaaggtgttttagagagcatctatt

SEQ ID NO: 25664 - DNA, 601 bp, Human
ctgacattctgatttatttatatgaataaagtgatattttagaaacctaaatcagattttatcattgctttgtgcagtgtcctctaatagctttccattgcactcagaataaaatccaaacctatcaccatggctctaaaagcacagtagagtgtaacacctgcgtactgttccatagcacctcataccgtcacttacatcactctatgcatcctagtttttctcttctcttgaacaggccaagctcatgccagccttagggcccttgcactaattgtttccttttcccgaaacgtttttmtctttgatcccctagatagctggttctttagtcattcaaacctcagcttagataccatctcagagaccttctaccactcagtctaaagtaggacccagccattctgtcatattctattttaatttatccatctgattttttcttgtttatgtaactaactattgtctctatctacccacttacattcttattcctgctacattttcagcacccaggaaagtatctgacacataatggccctcagtaaatcttagttcaatgaatgaacagttttcaagtgccatctgtacatgggcacta

SEQ ID NO: 25665 - DNA, 601 bp, Human
agacagagtttcaccatgttggtcaggctggtctcgaactcctgacctcatgatcctcccacctcagcctcccaaaatgctgggattacagtcatgagccactgtgcccggctcaacaggattttgagcacaatgactgcacaaatctactactcagtgctaatggaatgaaagagtgaaagaacaaataaactatgaataaacctagttaatcagaaaacattcagaagttatggttactactgttgctcttaacaataaattaaaccactatagtcagtaaaatttggtgtgattctgkttttttttgttgtcgttgttgtttttcgagacggggtcttgctctgttgcccaggctggattgcagtggcgcaatctcggctcactgcagcttccacctcccaggttcaagcgattctcttgcctcagcctcccaagtagctgggattacaggggcacaccaccatgcctcgctaattttttgcatttttagtagagatggggtttcaccatgttggccaggctggtctcgaactcctgaccttgtgatccgcccgcctcggcctcccaaagtgctgggattacaggtgtgagccaccac

SEQ ID NO: 25666 - DNA, 601 bp, Human
gtctcgaactcctgaccttgtgatccgcccgcctcggcctcccaaagtgctgggattacaggtgtgagccaccacgcctggccctgaagagtcacttttatctagctcttcatatctgaaatttttgtctcattgtgttttcagtcatttcaatgtatttgttccccaggtggttctttataaaaagggtcattgagtttagcattttccccccaaaaagcatttaaattaacatgtcaactttatttatcttctatacagatctcagaaaaaatgaagataaattgaaccatcatcagcraattgggctgaagtaagatggcagattttcttttgacacttgagatataaaagtaaattttttatagacattcttttatacaccagaaggactcttcaaacttagctaaaccacaaccattttcctattcagaagtgctaagatttgtggactcttacagagtatctgcctgtgttcacacaatgctttcacttttgctttctagtttacttgttttgaggatttcccttattcttttgactttagcagggaacttcctcttaaaatacctaggactgagtgtatcaggcagtcagcggg

SEQ ID NO: 25667 - DNA, 601 bp, Human
aaagggtcattgagtttagcattttccccccaaaaagcatttaaattaacatgtcaactttatttatcttctatacagatctcagaaaaaatgaagataaattgaaccatcatcagcgaattgggctgaagtaagatggcagattttcttttgacacttgagatataaaagtaaattttttatagacattcttttatacaccagaaggactcttcaaacttagctaaaccacaaccattttcctattcagaagtgctaagatttgtggactcttacagagtatctgcctgtgttcacacartgctttcacttttgctttctagtttacttgttttgaggatttcccttattcttttgactttagcagggaacttcctcttaaaatacctaggactgagtgtatcaggcagtcagcgggtgtttatttcatgctcacattgtacaaagcactacactaggtctagggtaaagatacagagaggttgagtgtagcttttaagaagtttatagtctacccgagaaggtaggacatgaatatgaaaaactaaatttaaaaaaaggacaaacctcatacctaaataaccatataggaataactact

SEQ ID NO: 25668 - DNA, 601 bp, Human
tgaaagacatccagcttttaggaggaggaaatgagaacaagagaaggcaatagaattttcttgattaaaatagtttccatggatgtccagtacacattcagtctagtcttctttttttcttttttttttgaggcagagtctcgctttgtcgcccaggctggagtgcagtggtgtgatctcagctcactgcaacttccacttcccaggttcaagcaattctcctgcctcaacctcctgagtagctgaggttacaggcaaacaccaccatgcccggctaatttttgtatttttttttttttttagtagaaaaggggtttcaccatgttggccaggctggtcttgacctcctgacctcaagtgatccgcccaccttggcctcccaaagtgctaggattacacgtgtgagccaccttgcccggcctggccttctttatatttaaatatttggttaaggcactgtggctcatgcttgtaatcccagcactttgggaggctgaagtgggaggatcgcaaagacactgcaagctctttagttaccaaaagggtgtttggcctctgttgtacttatcaaaatgaaagggaggagatagattggattctt

SEQ ID NO: 25669 - DNA, 601 bp, Human
aggatcacttgagtccaggagttcaaggctatagtttgccatgattgtacctgtgaatagcacagtctccagcctgtgcaatatagcaagactgtgtctctaaaaatattgttaaatattttcttgccattacaaagtaattactctttttcttattccctaattatgattctacagccaaaactgttacatcaggttgtggagcagttacaaaaggttcattttatcacagataccctgtcaaagggtgagacaaagttcatggtaagtacttgttagagttagcacatctaaaaaaaaacttggagactgttcagtagccattctgagtgtgtgacttcatggtagctttgaattacagtcaccaaatagagtatccatgagactttaaagaaaaataatagcaggggccgggcgcggtggctcacgcctgtgatcccagccctttgggaggccgaggcgggtggatcgcctgaggtcgggagctcaagaccatgctgaccaacatggagaaaccccgtctctgctaaaaacacaaaattggccgggcgtggtggcgcatgcctgtaatcctagctactcaggaggatgaggcgggaaa

SEQ ID NO: 25670 - DNA, 601 bp, Human
tctacagccaaaactgttacatcaggttgtggagcagttacaaaaggttcattttatcacagataccctgtcaaagggtgagacaaagttcatggtaagtacttgttagagttagcacatctaaaaaaaaacttggagactgttcagtagccattctgagtgtgtgacttcatggtagctttgaattacagtcaccaaatagagtatccatgagactttaaagaaaaataatagcaggggccgggcgcggtggctcacgcctgtgatcccagccctttgggaggccgaggcgggtggatcrcctgaggtcgggagctcaagaccatgctgaccaacatggagaaaccccgtctctgctaaaaacacaaaattggccgggcgtggtggcgcatgcctgtaatcctagctactcaggaggatgaggcgggaaaatcacttgaacccaggagacggaggtgcggtgagcatagatcgtgccactgcacttcagcctgggccacaagagagaaactccgccaaaaaaaaaaaaagaaagaaaaataatcagcaggatgcctgattctcatagctactctcagaatattttaggaaagaattttct

SEQ ID NO: 25671 - DNA, 601 bp, Human
acttcatggtagctttgaattacagtcaccaaatagagtatccatgagactttaaagaaaaataatagcaggggccgggcgcggtggctcacgcctgtgatcccagccctttgggaggccgaggcgggtggatcgcctgaggtcgggagctcaagaccatgctgaccaacatggagaaaccccgtctctgctaaaaacacaaaattggccgggcgtggtggcgcatgcctgtaatcctagctactcaggaggatgaggcgggaaaatcacttgaacccaggagacggaggtgcggtgagcrtagatcgtgccactgcacttcagcctgggccacaagagagaaactccgccaaaaaaaaaaaaagaaagaaaaataatcagcaggatgcctgattctcatagctactctcagaatattttaggaaagaattttcttttaattctccacttgtaaataacacgtgtcatcagaatagttaattaggcctgggcatggtggtgtagtcccagctctttgggaggccgaggtcagcggattacaaggtcaggtgatcaagaccatcctggccaacacggtgaaactccgtctctactaaaaata

SEQ ID NO: 25672 - DNA, 601 bp, Human
agtggcgaaacatggctcactgcagcctcaccttccagggttcaagcaatcctcccacctagtagctgggactgcaggtgcgcaccaccatacctggctaatttttgtattttttgtagaggtggggtttcaccatgttgctcagactggtctcgaactcctcagctcaagtgatccaccctccttggcctcccaaagtactgggattacatgtatgagccactgtgcccgggcctcttctttcttaaggtgacatttagtgttctgtcacttatatacatcattcgagtccattttctcmacaccccacttttcccgggtgatatgactgaaaggaaagagactgtgcttttggagagtggatgtgctaaaattagtaagagtctcagtgcatagatttgacaagagttttagccaaaactagaagatagttgagaaagataattaaattgtcatgtcattcagaaagtagagtggtgtttgccagggcctggaaggagggggtaatagggagttcctgtttaaatggcacagagtttcagttggggaagatgaaaacattctggagatggatggcggtgatggttgcacaacagtgtga

SEQ ID NO: 25673 - DNA, 601 bp, Human
tgcatagatttgacaagagttttagccaaaactagaagatagttgagaaagataattaaattgtcatgtcattcagaaagtagagtggtgtttgccagggcctggaaggagggggtaatagggagttcctgtttaaatggcacagagtttcagttggggaagatgaaaacattctggagatggatggcggtgatggttgcacaacagtgtgaatgtacttaatgccacagaatggtacacttaaaaatggttaaaatagtaggcacagtggctcatgtctataatcccagtgacttgggargctaaggtgggagaatggcttgagcccaggagttcgagggtatagtgagccatgatcgcactactgcactccagcctgggtgacagagcaagaccccatctcaaaaaagaaaaaaaaaatagatggccaatagatggtaaattgtatgttgtgtatatttaacccacacacatacaaaaaatcatgtcattaagttcagcatggtgatattagtgggctgtgaaagtgtattttctaaggtggtcacactttaacaatgcttccaaacgaactttggaaagataaaagtaaaggttctag

SEQ ID NO: 25674 - DNA, 601 bp, Human
gtctgagagatttcttcaatttcaaactcttttacttctgctacctatcattttaaattttgatttaaacctttccctgagggttttctatagtattctgttcttacttcatggatagagtatcttctgttattactggaagcttttttgtttgagactatactggtagcttttttgtttgttttcttcttcctgcataatcatcgtttcttccacgttgctctcttctgtttattttgatgtctgtgtttcgtgttcagggttttctttgattagtttcttgcttagaatcacacaaagrccaaatcctcataatgagaatccttatttgcagttttgtgtagttctctaattatcgtgaagtgtaatagaaaggtagggatagtgtattgctcacagaagctgctaagttaaaagtgctcagaattctagagctgctaacattaaaaacaaaaatggccttgtgttttacttgattaaaattaagccttaagtttagaacatctttaaacttggtttaaaatgttcattttagggtgtttgccagcttcccagtaaaaatgatgaaaaagaatatccacacagaagaattgatatcagg

SEQ ID NO: 25675 - DNA, 601 bp, Human
cactggtgagtgtccatgtgtgtattagagatcatctctcatctggagagaaggttattttcaaagatactttggtttagcaaaccttctaataactatgccagttagtgtagtttctttgtatttttagtccttcaggcaacgagagaggatttaatgcataacatgctcctaggccctcagttgaaggccatcaaggcaagcgttagttccagctttgttaaaatggattaaatccttgcatgctcagtaaaatatcttattcatctaaaagggtttttttttttttttttttttttttgctgttgtttaatgtacctctaggacccctgaaaaactcaagtatcattgttttcagtgccacatactttgcttttagtgccatggtatctttggccccatgcttttaaagtttaaagaataaggattgctgaatctatgcttaatgggttctgttaacatttcacagtatactatgtggtttactgttctctactaggagaatgaatttttgtcattttgtcctcaaagtataaaatactttgtcctcaaagtataaaatacctcatccctggtagactagggcagtgcttctcacaat

SEQ ID NO: 25676 - DNA, 601 bp, Human
gtccaggctggagcagagtggcacgatcttggctcactgcaacctccgcctcccgggttcaagcgattctcctgcctcagcttcccaaatagctgggactacaggcatgcaccaccatgcccagctaatttttgtattttttagtagagacggggttttgctgtatgttggccaggctggtctcgaactcctgacctcaggtgatctgcccacctcggcctcccaaagtgctgggattacgggcatgagccactgcgcccagcctgcttttctgctttcttacccccaagagcaacacctrgacaaggggctttactgagtgggggtggaataggggttgggaaaaggaaaactgatgcgatatggtacatggctctgtgcaggactgttgagctcatattacgttctgcctccaaatctgggagcaagagaatgtataaacagaagaataaagtgaatgcagattggtgtgggggaaaataagtaaataaataaataacaggtaactttagggtaaacaacgagtaacgtctattttaggataataatcaaacttcagtacaatcattttgaatttctattgatggctttaggaacattc

SEQ ID NO: 25677 - DNA, 601 bp, Human
gacagtgtggcccttgctgtgcagaaccaactcagcatcccacaaagccccacgcattcttcaggagtgtggcagctcctggcctcaatgatgactgtggacctgcagcagcaccctcacaatgcttgcctcctcagtcagctggaggtactgcagcccccagctcctggccagcacactgcccaaatctgaacaaagcagtggccatattgagaaggtggcgccttgtgccttggaaagaggctcccatcactcactggaatctctacccattctttctttattttattttatttattttatttttttttttttgagagacaagtctcattctgttgtccaggctggagcagagtggcacgatcttggctcactgcaacctccgcctcccgggttcaagcgattctcctgcctcagcttcccaaatagctgggactacaggcatgcaccaccatgcccagctaatttttgtattttttagtagagacggggttttgctgtatgttggccaggctggtctcgaactcctgacctcaggtgatctgcccacctcggcctcccaaagtgctgggattacgggcatgagccactgcgcccagcc

SEQ ID NO: 25678 - DNA, 601 bp, Human
gctatttcttcatccagaacctgggggagagtgggttcagccatgtggacctagtggaggggttacaggatggacacttctacgccctgaagcgaatcctgtgtcacgagcagcaggactgggaggaggcccagccaagaagcaaacatgcatcacctcttcaatcaccccaacatcctttacctcacggcttactgtctgagggagtagggtgctaagcatgaggcccagctgctgcttccgttctttaagagagatatactgtggaatggagagaaaggccgaaggacgatggcaactycctgacttaggatcaaatccttcagctcctgctgggtatctacagcggcttgaggccattcatgccaagggttaggcccacagggacctgaagcccaccactatcttgcttggagacgaggggcagccagttttaatacacttggatgccatgaatcaagcatgcctcacatgaagggctcccaccaggccctgaccctgccggactaggcgacccagcagtgcaccatctcctactgagccctagagctcttccctgagcagtcactgtgtcattgatgaacagactgatgtctggtcc

SEQ ID NO: 25679 - DNA, 601 bp, Human
agagcctctattgtggtatgatataatgactctctgacaattgaaggtacaaaaatcctttaccattcagtccccactggacctccatgtaggctggctataacatataaacagcctgacagaaatagccgagccaggtcagtgaggagtacgggctggccgacccaggcactgcgcactgaggccagggatgggcctgagccatgcacctcctctgaaactaccctgtgccctgcctttgaggcctgacaggtgtgggagcaggagctgcccaaaagtgggctggggttggaggaagcakcctggtcgttgctatgtgccctgaggctttaaggcacctgaccccacccttgctgaactggcatcaccaggacctgtttactctagatgagaatcatgatccctgggcgcttagtgcattgcctggaagagcccactcatcctggacgagccctttggcagcctcagacagtccttgaggaggatgactgagacatcatgggccatgcactgtgtgcctgctcttagggaaatgtcatcattgacaatagctatttcttcatccagaacctgggggagagtgggttcagccatgtggacc

SEQ ID NO: 25680 - DNA, 601 bp, Human
gccatctcttcatctatgagaacaagagcctctattgtggtatgatataatgactctctgacaattgaaggtacaaaaatcctttaccattcagtccccactggacctccatgtaggctggctataacatataaacagcctgacagaaatagccgagccaggtcagtgaggagtacgggctggccgacccaggcactgcgcactgaggccagggatgggcctgagccatgcacctcctctgaaactaccctgtgccctgcctttgaggcctgacaggtgtgggagcaggagctgcccaaargtgggctggggttggaggaagcatcctggtcgttgctatgtgccctgaggctttaaggcacctgaccccacccttgctgaactggcatcaccaggacctgtttactctagatgagaatcatgatccctgggcgcttagtgcattgcctggaagagcccactcatcctggacgagccctttggcagcctcagacagtccttgaggaggatgactgagacatcatgggccatgcactgtgtgcctgctcttagggaaatgtcatcattgacaatagctatttcttcatccagaacctggggg

SEQ ID NO: 25681 - DNA, 601 bp, Human
ttcagatacttttaataatataaccatgtttaaaagaagttaaaaatttccacagcactactgtataaatatcccaacctaaaaatctttcctaaaattacatgtttatctcccaaattgaaaatgatcaaaaaagattcatgctaccctagaggtaacaagtatagagtggctgagaatcactgaacttgaggaaaacctagactccagacactgctccactattttctggtagatcagtctgagtaagttattgaacttctcatgccatctcttcatctatgagaacaagagcctctaytgtggtatgatataatgactctctgacaattgaaggtacaaaaatcctttaccattcagtccccactggacctccatgtaggctggctataacatataaacagcctgacagaaatagccgagccaggtcagtgaggagtacgggctggccgacccaggcactgcgcactgaggccagggatgggcctgagccatgcacctcctctgaaactaccctgtgccctgcctttgaggcctgacaggtgtgggagcaggagctgcccaaaagtgggctggggttggaggaagcatcctggtcgtt

SEQ ID NO: 25682 - DNA, 601 bp, Human
agcctcccaaagtgcagggattacaggcatgagccactgcgcccggccatgagctacagtattattaaaggatatgattaagttccaacaattttttattttttttgtttttgttttgttttttgagacagtctcactctgatgcccaggctggggtgtgatcttggctcactgcaacctctttctcccggcctcaagcgattctcccgcctctcaagtagctgggattacaggcatgtgccaccacacccagctaatttttgtatttttagtagagacagggttttgccatattggccargctggtctcaaactcctgacctcaagtgatccgcctgcctcagcctcccaaactgctgggattacaggcatgagccaccatgcccaaccccaacaattttaaaaatctaaaatgttttttgtttgttgtttgtctgagatggagtctagttctgtcgcccaggctggagtgcagtggcacgatctcagctcactgcaacctctgcctcctgggttcaagtgattctcctgcctcagcctcccaagtagctgggattacaggcaccctccaccacgcccagctaatttttgtatttttagt

SEQ ID NO: 25683 - DNA, 601 bp, Human
gaaatccactcacctcggcctcccaaagtactgggattacagatgtgagccaccatgcccagcccataatttcttatagtgtcaaaaatacaatgggtgtaaaatgtttagcttgtgcattttcatctcaagggacaagaaagcattgccaaaactctcaagaaaaaaattaatcaagttaatttccagttaagaatttcatctgttgaaaaagaagaattatataaacaatagtcacatcttaaagaaatctctccctatatgtactactcttatgagctacagtattttttttttttttgagacagagtttcactcttgttgcccaggctggagtgcaatggctcgatcgtggctcaccacaacctccgcctccagggttcaagagattctcctgcctcagcctcccgagtaggtgggattacaggcatgcaccaccacgcccagctaattttgtatttttaacaaagacggggtttctttatgttggtcaggctggtcactaactcccaacctcaggtgatccacccacctcagcctcccaaagtgcagggattacaggcatgagccactgcgcccggccatgagctacagtattatt

SEQ ID NO: 25684 - DNA, 601 bp, Human
gtacatttgaaattaatttaaaatcagtggatgacatacttacggaagaaatttttttctttctgaattgtacacaaagcgtggaatatcaaatgctcctatgatattgaaaacgtgctctctgaaaaacatcccacaaaatacagacctgatttactaaaacataagtactctaggtgaacatgataacttgcattataagtatttgtaataacacacttttcacattttctcaggccaggcacacaatttctttttctttttctttttcttttttaagacagagtttcgctattgttgyccaggctagagtgcaatggtgggatatcagctcactgcaagctccgcctcctgggttcaagcgattctcctgcctcagcctcccaagtagctgggatcacaggcatgcaccaccacgtccagttaattttgtatttttagtagagatggggtttctccgtgttggtcaggctgatctcaaactcccgacctcaggaaatccactcacctcggcctcccaaagtactgggattacagatgtgagccaccatgcccagcccataatttcttatagtgtcaaaaatacaatgggtgtaaaatg

SEQ ID NO: 25685 - DNA, 601 bp, Human
agtacatttgaaattaatttaaaatcagtggatgacatacttacggaagaaatttttttctttctgaattgtacacaaagcgtggaatatcaaatgctcctatgatattgaaaacgtgctctctgaaaaacatcccacaaaatacagacctgatttactaaaacataagtactctaggtgaacatgataacttgcattataagtatttgtaataacacacttttcacattttctcaggccaggcacacaatttctttttctttttctttttcttttttaagacagagtttcgctattgttscccaggctagagtgcaatggtgggatatcagctcactgcaagctccgcctcctgggttcaagcgattctcctgcctcagcctcccaagtagctgggatcacaggcatgcaccaccacgtccagttaattttgtatttttagtagagatggggtttctccgtgttggtcaggctgatctcaaactcccgacctcaggaaatccactcacctcggcctcccaaagtactgggattacagatgtgagccaccatgcccagcccataatttcttatagtgtcaaaaatacaatgggtgtaaaat

SEQ ID NO: 25686 - DNA, 601 bp, Human
tcagttgccagagaaaacctaatatagaaaacatatagatgatctttggtagggaaatataagtaatgtcaatttctaaaatctaatttatactctaataaaagttttgtttgtttgtttgagaggggtccttacactgtcacccaggctggagtacggtggcatgatctcagctcactgcagcctcaacctcccaagctcaagtaatcctcccacctcagcctctccagtagctgggaccacaggtgcacaacatcacgcctggctaatgttttttattgtttataaagatgaggtcttrctatgttggccaggttgtgggacccatttgtgttctcttattcattctataaatgttgtttccttagtaccttaagttttcacttcaaccaatataacacattctagttcaataactgtgtgtggtggtcactgagggatgagttgggcaaggaaccagcatttgagttccttagtgttatggtcactaagggatgagtgagggcaagaaaagaaatgttgaaaagttatcagaaagccagtgtagtatccaaatgagctaggaatctaccttggaggccagagtgtatctggggctagc

SEQ ID NO: 25687 - DNA, 601 bp, Human
gttgataaatgtaatttaagtagggaatgtgccatcacagatacagaattaagacagtttgaaaagaataattatttagttaagccttaaaattactttgtcaaagaggagaaaagggaaaaggctcctgggctgtgggcatctcagttgccagagaaaacctaatatagaaaacatatagatgatctttggtagggaaatataagtaatgtcaatttctaaaatctaatttatactctaataaaagttttgtttgtttgtttgagaggggtccttacactgtcacccaggctggagtacrgtggcatgatctcagctcactgcagcctcaacctcccaagctcaagtaatcctcccacctcagcctctccagtagctgggaccacaggtgcacaacatcacgcctggctaatgttttttattgtttataaagatgaggtcttgctatgttggccaggttgtgggacccatttgtgttctcttattcattctataaatgttgtttccttagtaccttaagttttcacttcaaccaatataacacattctagttcaataactgtgtgtggtggtcactgagggatgagttgggcaaggaacc

SEQ ID NO: 25688 - DNA, 601 bp, Human
agactctgccagaaagaaaggaaaggaaagggaaggaggaagggggaagggggaagggaaggcaaaagaacctagctaagagtagtggtgcacacctattgtccaagctactcaggaggctggggcaggaggatcacttgaggccaggagttcaagaccagcctgggcaacatgacaagaccccatgtctctatcaaaagaaaaaaaaaaaaaagaacctaaaacaacacaagagaagtaaaaataacagtattttttagcacatcatttttgcaattggtaaaaggatattatacaggtwgataaatgtaatttaagtagggaatgtgccatcacagatacagaattaagacagtttgaaaagaataattatttagttaagccttaaaattactttgtcaaagaggagaaaagggaaaaggctcctgggctgtgggcatctcagttgccagagaaaacctaatatagaaaacatatagatgatctttggtagggaaatataagtaatgtcaatttctaaaatctaatttatactctaataaaagttttgtttgtttgtttgagaggggtccttacactgtcacccaggctggagtacggt

SEQ ID NO: 25689 - DNA, 601 bp, Human
aaccgacatttcatcaatccaaggccaaaaataaaagtttgacgcttattaagttacctcttttaactgcgttatcattccaagaacaatcgcatctccgattttggttgtactacccaataaggtttctattgttttaagctaaaataaaacaaaataaattttaaagactgtaaatatattctttcaagaaacaaaactttttataaataactatatttggggtacacatttcagcatttatagctactttacagtagaaaatcaaataaaatggaaataaagttgtaaaattaaactyaggatgtttaattttgtcctacaaaaaagctgtaagatcaagtgtatgatgcctaaagaaacaccacatcgactcaggctcttaccaatgactgaatcctcacaccatatcattctgaataatgataagtacatttattttttaaatatagaaaagaatatcaattttattttctttgaacagtaccttttgaaaactagcaagctatttaaaaatatatattccaattttacttagtattttaaaaggctctcattattatttacattctcaatctgatctttttttctaatcagaaag

SEQ ID NO: 25690 - DNA, 601 bp, Human
atattgttctgttggtgaggcgagttttcaataaagaatacattcctgtgcccactacaaaaatgttctatgtaaccgacatttcatcaatccaaggccaaaaataaaagtttgacgcttattaagttacctcttttaactgcgttatcattccaagaacaatcgcatctccgattttggttgtactacccaataaggtttctattgttttaagctaaaataaaacaaaataaattttaaagactgtaaatatattctttcaagaaacaaaactttttataaataactatatttggggtayacatttcagcatttatagctactttacagtagaaaatcaaataaaatggaaataaagttgtaaaattaaactcaggatgtttaattttgtcctacaaaaaagctgtaagatcaagtgtatgatgcctaaagaaacaccacatcgactcaggctcttaccaatgactgaatcctcacaccatatcattctgaataatgataagtacatttattttttaaatatagaaaagaatatcaattttattttctttgaacagtaccttttgaaaactagcaagctatttaaaaatatatattccaa

SEQ ID NO: 25691 - DNA, 601 bp, Human
agggtttctccatgttggtcaggctggtcttgaactcccggcctcaggtgatccgcccacctcagcctcccaaagtggctaggattacaggcgtgagccaccgcgcccagccaacagccattatttatccttgttccaaggcttctgacatgatgatactatttcctcgtattaccactattccaatattgttctgttggtgaggcgagttttcaataaagaatacattcctgtgcccactacaaaaatgttctatgtaaccgacatttcatcaatccaaggccaaaaataaaagtttgaygcttattaagttacctcttttaactgcgttatcattccaagaacaatcgcatctccgattttggttgtactacccaataaggtttctattgttttaagctaaaataaaacaaaataaattttaaagactgtaaatatattctttcaagaaacaaaactttttataaataactatatttggggtacacatttcagcatttatagctactttacagtagaaaatcaaataaaatggaaataaagttgtaaaattaaactcaggatgtttaattttgtcctacaaaaaagctgtaagatcaag

SEQ ID NO: 25692 - DNA, 601 bp, Human
atacaatagggagaaagtggattttaaaaatcagctattatttctagtccaggctcttccatttactagtctgataaccccagactaatcacttaactgagattctgactcctcacaggtacaatggagaatgactcctacagataagaaatggcaagagggacatttgatgtctgccataaggagggtctccccaggtaccttctaagacagccaacagcatgtccaagggaccaggacatactctgcagcttgcttgttcagaaacccagtactctccgtttatccagaggtcactacrggcctaatttcaggctatgcaaactgggctcctgcacaagacactctgtcctgatgtcttctcaggaaaccaaacacagatgaaaaagacacttggtgactgagaaaaggtttttgttttttctgggttttttttttttttttttactattacaaaagtttatttaacaaaaagtctaatatgaaaatgtacatgacctaatttttacgtcattgtaaaacaggccctatggagagagaaaatgggtttctctgctgaacagccattattattttatttatttatttatttttgagacaa

SEQ ID NO: 25693 - DNA, 601 bp, Human
aggcagtaataaagtcaacatacattttgagtccaacaaggcttctaaataataaatttaaagacttcccatttgaaactgtgaatagaccacagcttagaaagagcttaaaaaattttagttttaaatgtcctcatgtttaattcttggtaatattgacagggtggatcattcttaccatgatataaatttcgtcagtgattcatctagattctccaaataagagaaaattaaagttgttctgtccctgtttaggattatatctctacattcctacaccagcaacatagagaagttacaytgagaacccaaataggtaaattttagaaggatatataatcaatttccccaattcacgtaatgcagattttaaaaaatacagacaagtgaaggatatagctttactaaggtctagttggactgttccagtaggatcttccagaaaaaattttccctaaaaaaatgaaaataaataaatccacatttatgtaacaatgaaaaccgttgacaaaaaaattaaactacaagtttgacaacagaatacaatagggagaaagtggattttaaaaatcagctattatttctagtccaggctcttcca

SEQ ID NO: 25694 - DNA, 601 bp, Human
tgcagtggctcatgcctgtaatcccagcactttgggaggctgaggcgggcggatcacaaggtcaggagatcgagaccatcctggctaacacagtgaaaccccgtctctactaaaaatacaaaaataaaaaaaaattagccaggcgtagtggcaggcgcctgtagtcccagctattagggaggctgaggcaggagaatggtgtgaacccgggaggcagagcttgcagtgagccgagatcgtgccattgcactccagcctgggtgacagagtgagactccatctcaaaagaaaaaaaaaaaaagtatataattcaggccgggcatggtggctcacgcctgtaatcccaacactttgggaggccgaggcgggtggactgcctgagctcaggagtttgaaaccagcctgggcaacatggtgaaaccccgtctctactaaaatacaaaaaattagctaggcatggtggcatgcgcctataatctcagctactcggaaggctgaggcatgagaatcacttgaacccgggaggcggaggttgcagtgagccgagatcgcgccactgcactccagcctaggtgacagagtgagactctgtctccaaaaa

SEQ ID NO: 25695 - DNA, 601 bp, Human
taaatagcaaagcagcagtccactgacactaactagggcacacatacatgccctgcccaaagtgggcaaccactgcagtttagtttttgctgtgtgagaattcaggctctgtattgccagatcctcctgttaagagaactctgaaacctaggcctttatgagaaatcttctagtttttatacactggaaactaactcgaaatgtttttaaacacctcaaagtggggagaagaaaagaaaggtctataaactactttcaacccatgggccaccaagtacaatttttatactatcattcaggytctgcccaaataattcaagtgacagggagctcagctcctctaagagaaggccattttggaatagctctaatattatgatgctttcacttatattaaggagctataagctacctcacataactttcattcattggaatataaaaatgagaattttatattaacatggaattatattcttctaagtgttatcctagttgtcttatctcacttcaacttctcatcaaccccagagataaaacagactggaaatctttcccagttaaagccgaagtacaaagacggtattgcaactaattgttg

SEQ ID NO: 25696 - DNA, 601 bp, Human
ctcaaatgcttacaggctccaggaagataacactaaatagcaaagcagcagtccactgacactaactagggcacacatacatgccctgcccaaagtgggcaaccactgcagtttagtttttgctgtgtgagaattcaggctctgtattgccagatcctcctgttaagagaactctgaaacctaggcctttatgagaaatcttctagtttttatacactggaaactaactcgaaatgtttttaaacacctcaaagtggggagaagaaaagaaaggtctataaactactttcaacccatgggmcaccaagtacaatttttatactatcattcaggctctgcccaaataattcaagtgacagggagctcagctcctctaagagaaggccattttggaatagctctaatattatgatgctttcacttatattaaggagctataagctacctcacataactttcattcattggaatataaaaatgagaattttatattaacatggaattatattcttctaagtgttatcctagttgtcttatctcacttcaacttctcatcaaccccagagataaaacagactggaaatctttcccagttaaagcc

SEQ ID NO: 25697 - DNA, 601 bp, Human
gttactagaaggaatacaagtgataatgtacagaaagcccacagggcacagtgcttagtacggtgtgagcccttagatatggtaactgatattgttattgttcccaccaagtggaccaactggcattttcaaaggtacaataataattttatagttgctagaggaatgcagtaagtagacataattgtatgatgatttcagttaagcatatacccaaacataaatcagagcatcacagaaacacctattaagctaaatattgagaaattaaacttcagaaaagccttactcacatcttccrtttaaaaaaaaattatttgcattaactacacaatggtagggagggtattgagtcagtgtaaatctctttaggataggaccatgctgtagacctatttgcacttatttgtaaaacagtattttacacataaaacatactcactaaaatattagttgttgaattgattgactaccaccagatttagccccctgaattttatattttgaaggcattttagagaaaatttataatcctaacaagaataaaatgatcattttattttaatgtactttattacacctcataccaatcctttggttt

SEQ ID NO: 25698 - DNA, 601 bp, Human
atttttgtatttttaatagagacagggtttcaccatgttgcccaggctagttctgaactccaaagctcaagcgatccacccacctcagcctcccaaatcgacacttcttaacctaactcttcaaatgcaaaaaaaaactaaactgatatctactgcacagggttactagaaggaatacaagtgataatgtacagaaagcccacagggcacagtgcttagtacggtgtgagcccttagatatggtaactgatattgttattgttcccaccaagtggaccaactggcattttcaaaggtacartaataattttatagttgctagaggaatgcagtaagtagacataattgtatgatgatttcagttaagcatatacccaaacataaatcagagcatcacagaaacacctattaagctaaatattgagaaattaaacttcagaaaagccttactcacatcttccatttaaaaaaaaattatttgcattaactacacaatggtagggagggtattgagtcagtgtaaatctctttaggataggaccatgctgtagacctatttgcacttatttgtaaaacagtattttacacataaaacatactc

SEQ ID NO: 25699 - DNA, 601 bp, Human
caacccttcttttttggggggtagggggacaaagtctcagtgtgtcacccagggtggagtgcagtggcaggatctcagctcactgcaacctccgcctccaaagttcaagcgattctctcacccaagtagctgggactacaaccgcatgccaccacacctggctaatttttgtatttttaatagagacagggtttcaccatgttgcccaggctagttctgaactccaaagctcaagcgatccacccacctcagcctcccaaatcgacacttcttaacctaactcttcaaatgcaaaaaaaaactaaactgatatctactgcacagggttactagaaggaatacaagtgataatgtacagaaagcccacagggcacagtgcttagtacggtgtgagcccttagatatggtaactgatattgttattgttcccaccaagtggaccaactggcattttcaaaggtacaataataattttatagttgctagaggaatgcagtaagtagacataattgtatgatgatttcagttaagcatatacccaaacataaatcagagcatcacagaaacacctattaagctaaatattgagaaattaaacttc

SEQ ID NO: 25700 - DNA, 601 bp, Human
ggatcaaagcacatctctaacaataaaaagtttgggccaggcacagtggctcacacctataatcccagcctccctctgggaggccgaggccagtggatcacctgaggtcgggagttcaagaccagcctgaccaacatagcgaaaccctgtctctactaaaaatacaaaattagctgagtgtggtggcacatgcctgtaatcccagctacttgggaggctaaggcaggagaatcacttgaaaccgggaagtagaggttgtggtgagccaagatggtgccattgcactccagcctgggcaacragagcaaaactccgtcttaaaaaaagtttgtgaccatggacaaattacccaacccttcttttttggggggtagggggacaaagtctcagtgtgtcacccagggtggagtgcagtggcaggatctcagctcactgcaacctccgcctccaaagttcaagcgattctctcacccaagtagctgggactacaaccgcatgccaccacacctggctaatttttgtatttttaatagagacagggtttcaccatgttgcccaggctagttctgaactccaaagctcaagcgatccacccacctca

SEQ ID NO: 25701 - DNA, 601 bp, Human
acacaactgtatatacatatataaagtaatgttaacagtttttttctgtttagtaaaattacaggtgattttcctttccttttgtgtgccttcatatattttctaatttttttttttgcaatcatgaactacattattaataagaaaaaacttttctttttttaaagactcaactacttttccaatgcagcatactggcttgagtcggaaaccttgggatcaaagcacatctctaacaataaaaagtttgggccaggcacagtggctcacacctataatcccagcctccctctgggaggcygaggccagtggatcacctgaggtcgggagttcaagaccagcctgaccaacatagcgaaaccctgtctctactaaaaatacaaaattagctgagtgtggtggcacatgcctgtaatcccagctacttgggaggctaaggcaggagaatcacttgaaaccgggaagtagaggttgtggtgagccaagatggtgccattgcactccagcctgggcaacaagagcaaaactccgtcttaaaaaaagtttgtgaccatggacaaattacccaacccttcttttttggggggtagggggacaaagt

SEQ ID NO: 25702 - DNA, 601 bp, Human
ctcgatctcctgacctcgtgatccgcccgcctaggcttcccaaagtactgggattacaggcctgagccaccgcgcccggcccctctggtcatctcttaatgaggctgaaacaagaaggcagtatggcctgttcgacttcagctgggaacatgcatgccaggtgactcaaaattttttgctgttctgctaagcataaatgaccactaaagcacctttagtattgactttaggaggtacaaaaacattttagcacaaatctgtaaattaatgaggatctactacatatggactgtcatgcacrgcataaaaacgttttggcaatgacggactgcatatatgagtggtttcacagaatgataatggaactgaaaagctcttattgcctactgacatcttagctgtcacaatgtcctagtgccacacattactgtgtctgtagagacactggtgtatacaacctactgagctgccagttgtaggaaagtacagcacatataataatgtacaatatgtaacacttgataacaataataaatgactatgttactagtttatgtatttactgtacttttaatcattattttagagtgtagtccttcta

SEQ ID NO: 25703 - DNA, 601 bp, Human
actgcaaccttcatctcccgggttcaagcaattctcctgcctcagcctcctgagtagctgggattacaggcacatgccaccgcatccagccaattttgtatttttagtagagatggggtttcaccatgttggctaggctggtcttgaactcctgacctcaaaatgattcaccctcctcgcccttccgaagtgctgggattacaggcatgagccaccacgcccagccagttgattcttgttattagtgatattatgttctataaaatctccacaaacaatgaattggcaaacactgaaccaytgctccttgggaaaatttgtacttatatatacatggattgattatagtcttaagtcctaaaaccaatttatcctggtagattctatttttacaaatgagaaaagttggttcagaaatgttaagtgacttatctgaggttgctccaaaaacaggtgccagaggtgagattcaaatgccccctccccacacaaaactggccccagggccagagcttcttgcactaccctgtactgctccctgcagtctctgtcctctggtcatctttttttttttttcttttgagacagagtctcgctctgt

SEQ ID NO: 25704 - DNA, 601 bp, Human
caggccagggtggctcacacctataatcccagcactttgggaggccgaggtggggggattgcttgaggtcaggagttcaaaaccagcctgaccaacatggtgaaatccaccccatctctattaaaaatgtgaaaattagccgggcatggcagcaggcacctataattccagctactcgggaggctgaggcaggagaatcgcttgaacctaggagatggaggttgtagtaagccgagatcatgccactgcactccagcttgggcaacaaagcaagattttgcctcaaaaaaaaaaaaaaaaattgtagtcagccaattgtaattgggcgattgtttcatgtctgtctccccacctagtggcaatacagtatgtgctcaaaacatatttcctgaatgtcacgaatcatgctataaaacaatatttcacagtaatagaaaatgttgatagcatattattagatgaaaaacacaggttacaaagcaaggtacagtatgtatccatttataatgccaaaaaaagggaatagatatagacctgtgcattcatgcataaaaagaaactctccagatatacacatacatatcttgttatagttgattcc

SEQ ID NO: 25705 - DNA, 601 bp, Human
cagatcttatcaaatttgtaatcaggccagggtggctcacacctataatcccagcactttgggaggccgaggtggggggattgcttgaggtcaggagttcaaaaccagcctgaccaacatggtgaaatccaccccatctctattaaaaatgtgaaaattagccgggcatggcagcaggcacctataattccagctactcgggaggctgaggcaggagaatcgcttgaacctaggagatggaggttgtagtaagccgagatcatgccactgcactccagcttgggcaacaaagcaagatttygcctcaaaaaaaaaaaaaaaaattgtagtcagccaattgtaattgggcgattgtttcatgtctgtctccccacctagtggcaatacagtatgtgctcaaaacatatttcctgaatgtcacgaatcatgctataaaacaatatttcacagtaatagaaaatgttgatagcatattattagatgaaaaacacaggttacaaagcaaggtacagtatgtatccatttataatgccaaaaaaagggaatagatatagacctgtgcattcatgcataaaaagaaactctccagatatacacatac

SEQ ID NO: 25706 - DNA, 601 bp, Human
tgactaaacggccgggcacggtggctcacgcctgtaatcccagtactttgggaggccgaggcgggcggatcacgaggtcaggagatcgagaccatcctggctaacacagtgaaaccccatctctactaacaatacaaaaaattagccgggcgacgtggcgggcgcctgtagtcccagctactctggaggatgagacaggagaatggcgtgaaccccggggggcggagcctgcagtgagccgagattgcgccactgcactccaacctgggcgacagtgagactcttgtctcaaaaaaaaaamaaaaaaactgactaaagcaaacattaaaataataatttcctatgtcactgaaagtagaagaaatgagtacaccatttgaacaatatctcatagaaacctcaaaatatgtgctaaccatctgcccaagtaattctacttctggaatggctaatcctaaggaattaaagatatatacaaagactagcctatatccaagaactgtgaaaaaattattcaacggttccttcaaagcttggttttattcaatgctcaccaagcaagggtcagtaggaaagtgggtaatctacacactcccagcct

SEQ ID NO: 25707 - DNA, 601 bp, Human
ataggccaggcctgcattggcttaattactcctcagaacatccataaaatctgagacttaggttaagtaacctgcccagggtaataggcttgcacttaaacccagtttgtttttgtttttgtttagagatggggtctcactatgttgtccagctggtcttgaacttcaggactaattcttacttatcatgactataaacacacacacacacacacacacacacacacacaggtttttttcttaatgtaaaaatttaagtctttaaaatgaaatctaatttaaattatctcattgctaactatgtttttttttaaatagaatactcaaaaagataaatagaatactcaaaaagttttaaaacatgaacccttaaaagagttcaagaaagaagaaaaaaaataagacctaccagcaaacattatgcgaagtttttccaatacttccacctggtccaaccaaacatcagataaaaacacaaacatagcatctttattctcctcttctagctgttttagttttgcagaagtcttcacagatgtattagaaggacctccaaaaaaattaatatttccatagtatgccctagataattataacataa

SEQ ID NO: 25708 - DNA, 601 bp, Human
agccattcattgagcacttactataggccaggcctgcattggcttaattactcctcagaacatccataaaatctgagacttaggttaagtaacctgcccagggtaataggcttgcacttaaacccagtttgtttttgtttttgtttagagatggggtctcactatgttgtccagctggtcttgaacttcaggactaattcttacttatcatgactataaacacacacacacacacacacacacacacacacaggtttttttcttaatgtaaaaatttaagtctttaaaatgaaatctaatytaaattatctcattgctaactctgtttttttttaaatagaatactcaaaaagataaatagaatactcaaaaagttttaaaacatgaacccttaaaagagttcaagaaagaagaaaaaaaataagacctaccagcaaacattatgcgaagtttttccaatacttccacctggtccaaccaaacatcagataaaaacacaaacatagcatctttattctcctcttctagctgttttagttttgcagaagtcttcacagatgtattagaaggacctccaaaaaaattaatatttccatagtat

SEQ ID NO: 25709 - DNA, 601 bp, Human
accaatgaggtttctatattaatcaggcttagatttttgggacctgtgcaatttccaaaaatcaaaatcattctcaaaggacaagtaccaccaatatgcaggctctgaagcaattcccagaaaggaatcccaagataagttctgaagaggagaaaattactcttttggatttatgttttggtatgcttgtgggtatgcttgtttttttgttttttaagtcatgttactttatagtcactatactgaaagtttaagaactttctgtgtataccaactttctgtgtatagaaacttaattcartgtttcactaatagcatatttttacttcgacaataatcttattaaatatatatttttaaattaaaaaatgcactctaatcttgataaataatgactatataagattaactacattcttacagggtttatgcagaggcattcggtatttgtcgtagtgaaaggatcatatttgtctgcaatgacaagtagatcgggcacaggatacactctcaaagcatagtcatatgcccaatacactgggcagacataaagaggtaggggagtcagatgtccttgggataagatagtctttacaaacta

SEQ ID NO: 25710 - DNA, 601 bp, Human
ccaccatacctggcctaaaagtcaattatatttctgcagaaattctgaagcaacctcaagattctgaagcaatttcaaggttctacataaaattaagtaataaaatatgtaccaatgaggtttctatattaatcaggcttagatttttgggacctgtgcaatttccaaaaatcaaaatcattctcaaaggacaagtaccaccaatatgcaggctctgaagcaattcccagaaaggaatcccaagataagttctgaagaggagaaaattactcttttggatttatgttttggtatgcttgtkggtatgcttgtttttttgttttttaagtcatgttactttatagtcactatactgaaagtttaagaactttctgtgtataccaactttctgtgtatagaaacttaattcagtgtttcactaatagcatatttttacttcgacaataatcttattaaatatatatttttaaattaaaaaatgcactctaatcttgataaataatgactatataagattaactacattcttacagggtttatgcagaggcattcggtatttgtcgtagtgaaaggatcatatttgtctgcaatgacaagtaga

SEQ ID NO: 25711 - DNA, 601 bp, Human
ccggcctatatttcttttctttttttttgagatggagtctcgctctgtcgcccaggctggagtgcaatggcgtgatctccgctcactgcaacctctgcctccctggttcaagcaattctcctgcctcagcctcccaagtaggtgggattacaggcgcgcaccaccacgcccagctaattattgtaatttttagtagagacggggtttcaccatgttggtcaggctggtcttgaactcctgacctcgtgatccacccacctcggcctcccaaagtgctgggattacaggtgtgagccaccayacctggcctaaaagtcaattatatttctgcagaaattctgaagcaacctcaagattctgaagcaatttcaaggttctacataaaattaagtaataaaatatgtaccaatgaggtttctatattaatcaggcttagatttttgggacctgtgcaatttccaaaaatcaaaatcattctcaaaggacaagtaccaccaatatgcaggctctgaagcaattcccagaaaggaatcccaagataagttctgaagaggagaaaattactcttttggatttatgttttggtatgcttgtgggtatg

SEQ ID NO: 25712 - DNA, 601 bp, Human
caagatgtgactataaagtaacacaacagatttttacacgatctttttacagagttgttactataaaatatctccacttgaagcaaaagtcttttgagttggctagacagtcttaatgctaaaagatgaggttggaaatgcttaggaggagctctacttagtgtaaaaaataaacagactgtgtaacgccaaatatgcatgtgagacaatcagcaagttcaagaagtctttcctgcccctctctctaatgcaaaactgatttgcattcctatgtacctgtttgattcccttcctatgtgcmtgtaaagcaactgagcaataatcacacatacaattgtttgtctactatgaaactctcacgtggctgagcagaggccctgtcttttcagtctttgtgccccaagcaccgaacccaacacctagcctatggcaggcattcgttaatgtgaataaatatcaagaaaggatgaagtaatgtctaaggctagttttgagcttgcccaaaaggtataaataaggtaaaaaagatataatgatggtgtaggaggtggtggtttactcacagggatgaaaaagtagaaaaattcagaaataaggtata

SEQ ID NO: 25713 - DNA, 601 bp, Human
tcctgttttttaaaagtccttggttgtgacttaaaatgacaagatgtgactataaagtaacacaacagatttttacacgatctttttacagagttgttactataaaatatctccacttgaagcaaaagtcttttgagttggctagacagtcttaatgctaaaagatgaggttggaaatgcttaggaggagctctacttagtgtaaaaaataaacagactgtgtaacgccaaatatgcatgtgagacaatcagcaagttcaagaagtctttcctgcccctctctctaatgcaaaactgattkgcattcctatgtacctgtttgattcccttcctatgtgcctgtaaagcaactgagcaataatcacacatacaattgtttgtctactatgaaactctcacgtggctgagcagaggccctgtcttttcagtctttgtgccccaagcaccgaacccaacacctagcctatggcaggcattcgttaatgtgaataaatatcaagaaaggatgaagtaatgtctaaggctagttttgagcttgcccaaaaggtataaataaggtaaaaaagatataatgatggtgtaggaggtggtggtttactca

SEQ ID NO: 25714 - DNA, 601 bp, Human
ccacttcttggaaaagagccctttgggggagaaaaatgcctgtaagtgaatgctcagactttttttaaaataaatttttttaaacacaatatgtatattttttattttttattttatttatttattttttttttgagacatggtctcactctcatcacccaggctggagtgcagtggggcaatctcactgcaacctccatttccgggattcaagcgatcttcccatctcagcctcccaggtagctgggaccacaggcatgggccaccacgcctagctaatttttgtattttttgtaaagakggacagggtttcactgtgttgcccaggctagtcttgaactcttgggcacaggtgatctgctcacctcggcctctcagagtgctgggattacaggcatgagccaccgtgcccagccgaatactcaagttttataaaataattcctgttttttaaaagtccttggttgtgacttaaaatgacaagatgtgactataaagtaacacaacagatttttacacgatctttttacagagttgttactataaaatatctccacttgaagcaaaagtcttttgagttggctagacagtcttaatgcta

SEQ ID NO: 25715 - DNA, 601 bp, Human
taatttaacacctagagaaagatctttcttgctgtgtctgtgcacacacttacctatcttctactgtcttattagaaggataaaaaactttgaatgaaaatccacttcttggaaaagagccctttgggggagaaaaatgcctgtaagtgaatgctcagactttttttaaaataaatttttttaaacacaatatgtatattttttattttttattttatttatttattttttttttgagacatggtctcactctcatcacccaggctggagtgcagtggggcaatctcactgcaacctccayttccgggattcaagcgatcttcccatctcagcctcccaggtagctgggaccacaggcatgggccaccacgcctagctaatttttgtattttttgtaaagagggacagggtttcactgtgttgcccaggctagtcttgaactcttgggcacaggtgatctgctcacctcggcctctcagagtgctgggattacaggcatgagccaccgtgcccagccgaatactcaagttttataaaataattcctgttttttaaaagtccttggttgtgacttaaaatgacaagatgtgactataaagta

SEQ ID NO: 25716 - DNA, 601 bp, Human
aacgtaccatcatgtacccacaattctgtgtcacacagcataaccgtgataagctcagccaataatatttctttatgggccactgtagacattttcaaaaatcccaacacactgatagaacatctcattttcagtaatttaacacctagagaaagatctttcttgctgtgtctgtgcacacacttacctatcttctactgtcttattagaaggataaaaaactttgaatgaaaatccacttcttggaaaagagccctttgggggagaaaaatgcctgtaagtgaatgctcagactttttttaaaataaatttttttaaacacaatatgtatattttttattttttattttatttatttattttttttttgagacatggtctcactctcatcacccaggctggagtgcagtggggcaatctcactgcaacctccatttccgggattcaagcgatcttcccatctcagcctcccaggtagctgggaccacaggcatgggccaccacgcctagctaatttttgtattttttgtaaagagggacagggtttcactgtgttgcccaggctagtcttgaactcttgggcacaggtgatctgctcacc

SEQ ID NO: 25717 - DNA, 601 bp, Human
tccaaccccataccatcaccaaactcacacacagctccctcactgtcaatttaagggaaagtacctaagaagcaaccatacggagggcaggactgacctctcagaagagtgagaccatcgtcaggagttggcctgtaagagaactagctcacctccacagctggcctgagatttcccccagaaaacagttcttgatctatttcaacacaaacgtaccatcatgtacccacaattctgtgtcacacagcataaccgtgataagctcagccaataatatttctttatgggccactgtagacaktttcaaaaatcccaacacactgatagaacatctcattttcagtaatttaacacctagagaaagatctttcttgctgtgtctgtgcacacacttacctatcttctactgtcttattagaaggataaaaaactttgaatgaaaatccacttcttggaaaagagccctttgggggagaaaaatgcctgtaagtgaatgctcagactttttttaaaataaatttttttaaacacaatatgtatattttttattttttattttatttatttattttttttttgagacatggtctcactctcatca

SEQ ID NO: 25718 - DNA, 601 bp, Human
gtgggtgatctatgtagatcaccctgtgaaaactactacccactaggtgattattttcttctttctcaagacctttccgtaactccaaccccataccatcaccaaactcacacacagctccctcactgtcaatttaagggaaagtacctaagaagcaaccatacggagggcaggactgacctctcagaagagtgagaccatcgtcaggagttggcctgtaagagaactagctcacctccacagctggcctgagatttcccccagaaaacagttcttgatctatttcaacacaaacgtaccrtcatgtacccacaattctgtgtcacacagcataaccgtgataagctcagccaataatatttctttatgggccactgtagacattttcaaaaatcccaacacactgatagaacatctcattttcagtaatttaacacctagagaaagatctttcttgctgtgtctgtgcacacacttacctatcttctactgtcttattagaaggataaaaaactttgaatgaaaatccacttcttggaaaagagccctttgggggagaaaaatgcctgtaagtgaatgctcagactttttttaaaataaa

SEQ ID NO: 25719 - DNA, 601 bp, Human
ctccaggctgacagccctcagagttgacttagtcctggggtcacaaaatcaagtgccctcaggatatccagcgtagacaagtgggctggaaaagagccacagcgtctggcctcctttttaattttatatttataagcatgttttgaaaattattcattttatattcacttttattttaaataaatatgttaattccaaaaagaaaaagacaactgggctgtgttcaagattatattctctgacaataacctggaggggagttacttgatttggtcagttgtttttttgttggttttttttkttttttttttttttttttttttttgagatagagtctcactctgttgcccaggctggagtgcagtggcgccatctctgctcactcaacctgtacctctcaggttcaagcaattctcctgccttagcctccttctcctgagtagctgggattacaggcacacgccaccacacccgggtaatttttgtatttttaataaagacggggtttcaccatgttggtcaggctggtctcaaactcctgagctcgtgatccacacacctcggcctcccaaagtcctgggattacaggcatgagccaccg

SEQ ID NO: 25720 - DNA, 601 bp, Human
atctgcctgccttggcctcccaaagtgctggattacaggtgtgagccaccacgaatggctgcagactgttttatgtctacaagttttatgccaaatgttatttcagtaaaagacattctaacagtggataagactgtatgctccaggctgacagccctcagagttgacttagtcctggggtcacaaaatcaagtgccctcaggatatccagcgtagacaagtgggctggaaaagagccacagcgtctggcctcctttttaattttatatttataagcatgttttgaaaattattcattttrtattcacttttattttaaataaatatgttaattccaaaaagaaaaagacaactgggctgtgttcaagattatattctctgacaataacctggaggggagttacttgatttggtcagttgtttttttgttggtttttttttttttttttttttttttttttttttgagatagagtctcactctgttgcccaggctggagtgcagtggcgccatctctgctcactcaacctgtacctctcaggttcaagcaattctcctgccttagcctccttctcctgagtagctgggattacaggcacac

SEQ ID NO: 25721 - DNA, 601 bp, Human
aaaacataaacttacatcagtttgtttgatctagcattgaaaagattccccagttaccaatacaaaattatagtttggaaattatgtcaaggctttcagcatctgaggccacagcagataaaggaagcaactatttcagtggacaaagagtgagcatcaactgcaagtaccatgagacagggtacttgacagctgtcacccaggctggagtgcagtgtggaccaatcacagttcactgcaacctctgactcccgagctcaagtgagctcaagtgatcttcccacctcagtctccccagtamctgggactacaggtgtgggccaccacacccagctaattttttgtatttttttgtagagaacaggccttgccatgttgcccaggctggtcttaaactcctgacttaagtcatctgcctgccttggcctcccaaagtgctggattacaggtgtgagccaccacgaatggctgcagactgttttatgtctacaagttttatgccaaatgttatttcagtaaaagacattctaacagtggataagactgtatgctccaggctgacagccctcagagttgacttagtcctggggtcacaaaatca

SEQ ID NO: 25722 - DNA, 601 bp, Human
acaatatgatttcacaaatattctaacagaaggcttcttaggagaaactaagtggcaagaaggccagattatttcaatatatcttgaaacttttctgttttcctaaaacataaacttacatcagtttgtttgatctagcattgaaaagattccccagttaccaatacaaaattatagtttggaaattatgtcaaggctttcagcatctgaggccacagcagataaaggaagcaactatttcagtggacaaagagtgagcatcaactgcaagtaccatgagacagggtacttgacagctgtyacccaggctggagtgcagtgtggaccaatcacagttcactgcaacctctgactcccgagctcaagtgagctcaagtgatcttcccacctcagtctccccagtacctgggactacaggtgtgggccaccacacccagctaattttttgtatttttttgtagagaacaggccttgccatgttgcccaggctggtcttaaactcctgacttaagtcatctgcctgccttggcctcccaaagtgctggattacaggtgtgagccaccacgaatggctgcagactgttttatgtctacaagtttt

SEQ ID NO: 25723 - DNA, 601 bp, Human
ggcaggagaatctcttgaacccagaaggcggaggttgcagtgagctgagattgcgccattgcactccagcctgggcaacaagagcaaaactccgtctccaaaaaaaaaaaaagtattctaatcatatataagcacatgtatatgtgggcttatgctttaaaaacatacagaagtgataggatattatgcatactttctacaccttttttccattagtagtaaatacattatatttacttctttgaggcttagaaatttaagtaaatcagaaagttctgaataagtacaaatatttagatayatatacatttttaaaatttcttggtataaaaactgcagtaaaaaggctgggcgcagtggctcatgcctgtaatcccagccactttgggaggccaagaccggtggatcacctgaggtcaggagtttgagaccagcctggccaacatggtgaaactccatctctactaaaaatacaaaaaatcagccaggcgtggtggcatgtgcctgtgatcccagctacttgggaggctgaggcaggagaatcgcttgaacccaagagatggaggttgcagtgagccgagactgtgccgctgcactctag

SEQ ID NO: 25724 - DNA, 601 bp, Human
gaaaactttctcaagtataccatcatatttatcacttagtatcaaaatttcacaaaatacaaatttaagcagaacatcctaaagtttaccataattttattgtaatatcagaatcacataagatatagagttaagcagaaaactgatgaattttcttcagatgatctttaagaatctcaaaagccttgaagtttgctgaaaatagaaaaaaaaattaaatatttggaaacctaagttgtatacttactaatagttgtagttaatttttttaaataggtatagttaattgatttttaaaaayaggtcaatacatacatactgtttcaaattcaaaaggagactctaaaaaataagtcattctcatgcccccttttctgctcccaaaaagcaaatgtatgtcttttttttttttttttttttcgagagggagtctcactctgttgcccaggctggagtgcaatggcgtaatctcggttcaccgcaacctctgcctcctgggttcgagtgattctcctgcctcagcctcctgagtagctgagattataggcacttgccaccatgcctggctaatttttgtatttttagtagagacgaggtttca

SEQ ID NO: 25725 - DNA, 601 bp, Human
ttttttttttagcagagatagggttttgctaccttggctaggctggtctcgaactcctgacctcaggtgatccacccgccttggcctcccaaagcactaggattacaggcgtgagccactgcgcctggcccccatatatttttcttaaaagactatgcagaaaatatttttcctagaaaactttctcaagtataccatcatatttatcacttagtatcaaaatttcacaaaatacaaatttaagcagaacatcctaaagtttaccataattttattgtaatatcagaatcacataagatayagagttaagcagaaaactgatgaattttcttcagatgatctttaagaatctcaaaagccttgaagtttgctgaaaatagaaaaaaaaattaaatatttggaaacctaagttgtatacttactaatagttgtagttaatttttttaaataggtatagttaattgatttttaaaaacaggtcaatacatacatactgtttcaaattcaaaaggagactctaaaaaataagtcattctcatgcccccttttctgctcccaaaaagcaaatgtatgtcttttttttttttttttttttcgagag

SEQ ID NO: 25726 - DNA, 601 bp, Human
atttttgaaaggaatacagcagaaatgatgctgagtccctctcggtgcattcagaagccgtatcatattgctttgtcccattattgtgatattaagtttgattattttattaaggtagtgtttattagatttgtccactgtaaatatgtctttttgcctcctggtaagtaatactctgtgaggcagtactttaaagactgtgtaaatatcccattcctcaacagacttttaccctgaaacgtaataagtaaaaatcacataaaatttttatcttcttcaaatctttgtacctgaagttctytccttgggctctttgacttcttagcctttaggccttaaacatattatctgttcagataggcctctcctgattacactgtattttaaatgtgttctacatatgtcttcagattttggttttttgtttttgtgtttgagggttctcatctactaacaggactagcagtttcaaataaaggacatagtagtcaattcattttagctcttaactcttcactgagctccataccaacatttatatttaatctcaggacatcttgatgctatctggtgtatacaaaatggaactcattatcttctc

SEQ ID NO: 25727 - DNA, 601 bp, Human
agcctagtttatagtctctttctccctcctcagtctttctttgtttcaggacattgactgttttgaacagtgtacactggttattttgtagtgtttctcagtttgggtttgtctgattttcatcatgattagattcagattctacacttttgttagggatgcagcataagcaatgctgtattcctctcagtgcatcttagcagaaggcctgtgtctccttcctggtgactcttgtttgtgctcacttgattatttgtctgccaggtttctccactgaaaagatactattttaccctttgtragtatcaagtatcattggagacatagctgagaatatgtaaatatcctgttactcctcagatttctcacccattagttatccattgatgactctgcctaaatcatagttattatcatagttgccaaatgatggtcttaattccatgtgtatccttattttcacataaccatgatttgaactttctgaatgtatgaaatgtattaaatgttttgacagacttttatgtgtggtttatagggtagattttctatttcagctaagagttttaagttatgattataaatgttttaaggacttggc

SEQ ID NO: 25728 - DNA, 601 bp, Human
actcctcagatttctcacccattagttatccattgatgactctgcctaaatcatagttattatcatagttgccaaatgatggtcttaattccatgtgtatccttattttcacataaccatgatttgaactttctgaatgtatgaaatgtattaaatgttttgacagacttttatgtgtggtttatagggtagattttctatttcagctaagagttttaagttatgattataaatgttttaaggacttggctgtgtgggtgtgtaaatatatttctactctggtgtatacatggaacattcraaattaaaataagtagatggttctgattgtttctaataataaagaatgtatatagatagcttatatgttctttaacacaatgtggaaggttaattaaatttttagaatcttaagcattctgtgaatacaaacaatgttatgtaaggagcattcaatacaagtgtggcatggctgataatgttcatttagtgtgggaaaacatcttcaaaaaaagattaacagcatttttctgtgggacccgttggggtggggtagggtgggttgagaagggactgagcttgttcataaagttttaactcc

SEQ ID NO: 25729 - DNA, 601 bp, Human
gtgatgacaaccccttgtgatgaatgtcaacagtattaaactagaacttcccctgattacttataggtccaactcgctggaacaagtttacaggctgctgctcagtctttaaatgtacaggtaagctgggacctgggattatgggtcaatcttttatttattttttcttatatttttctgtagtgagcatatattttataataggaaatgcttagaagtattaccttttcaaaattagtgaatctcgtgaagattcaaataatgataattattaccattaatgaaaatcagttttatattmtgctactgtgcatgaaccaaaaatggacaggaaaagtctactttcaaagttgtatgtgtaagttcagtaaaaatgtttctaagttatactgctataacacatacctaaacacacagcctgaaagttctcttaaatgccagtttgtttccaaaagacttgttatttatcatttttgatgtcttagggagaccttatagggaagaggaaagaacactggactgagacacaagggtcttaggtttgcattctcattctgccactgactagctgtgtgacctttggcaagtcacataacctcct

SEQ ID NO: 25730 - DNA, 601 bp, Human
taagctcatgttttaaatgattcctaaaagatggggttttaagtacatttcttttaatcaaccatttgcaatcttttatttcctacccaccccacctcagtctaaatctaatgaagaatcgggggattcgcagcagccaagccagccttcccagcagccttcagtgcaggcagccattccccagacccagcttatgctagctggaggacagataactggggtaagtgttcactgagagaattataacaaactttttctgtgtcagaactgccattggccaatagctgattagaattgttcrccatagctggtagtaacatggctatgcctggcactattgtgtctttaaggaacttcctacactgtaggtagtaagttgctctgaaaaaggaattatctttgtcgtaagttttcaggatatcttttattagaattgtggatgctctggataaattaaaaaccttattaaacccctgtttcaggtgttgcttcatcatgcaatggagtaattatcatatggttgagatcattacactgaaaatggcagttatccatttggcattaagacatcactgcagggtagaagttaaagaatggatta

SEQ ID NO: 25731 - DNA, 601 bp, Human
atgcctggcactattgtgtctttaaggaacttcctacactgtaggtagtaagttgctctgaaaaaggaattatctttgtcgtaagttttcaggatatcttttattagaattgtggatgctctggataaattaaaaaccttattaaacccctgtttcaggtgttgcttcatcatgcaatggagtaattatcatatggttgagatcattacactgaaaatggcagttatccatttggcattaagacatcactgcagggtagaagttaaagaatggattagtacctgcaaaagaaaaacatttktctttaagttactgtgtaatgatctaaaataaagcatgtggcttcatatcctagctctgcaacttaccgtatggcctaattacttcatttccctctacctgttttccttctgttaaatggagatactaataatacctatctcacattactgttgtaaagattggagataatacatgtaaaacttatagaacggtgcttggcatgtagcattcaacaaatattgtttatttttgtacttgatcttagccaaaaggctgagacgttctgtcatttattttttatggttaataaattggcctg

SEQ ID NO: 25732 - DNA, 601 bp, Human
atgtattttcatatcttgtcagtggtgattcttttttttttttcttgcttactagttaattacttttttgcccaaaccctagggccctggacaagcttgaatgattaagtccatagtggggaccaccattttaatttaaatgttctgctagtaatggtagtttgatcactgatgaacattttagctgtctgctaagcaagtgaagttgggtagctggggactgatatcatttgagttacctattttaaagcagttggcttgcattaggagactttctccttcaacactttcccataatgtrttctggttttgtttagcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggtgagtgaggaactccaatagctggggcagcaagtgaggaataaagtggcaggttttatttaatgttagattaactttttgattgttagtgtggg

SEQ ID NO: 25733 - DNA, 601 bp, Human
aatatttaaaaactgttttctcacttgatttttaaaacccatattggtctttacatgataaaaaacagaagtatatttgttctgagggaattttaaagaaacattgaaaattaggcttatcataacaatatatgtcagtccacaaaaatagtcagttgcagaggctccaggttgcttcacgtgctttgtcaagcacacacagagcataccctgtttggaatatgaaagcatgcgaagtatttactcttctttatttggatgtgacagaagtcatcagctggaagccttataattaagcgamcttttatttcagaatctccaatccatgttttaattccaatttttcaggatcttcaacaactgcaacagcttcaacagcagaatctcaacctgcaacagtttgtgttggtgcatccaaccaccaatttgcagccagcgcagtttatcatctcacagacgccccagggccagcagggtgagctcctccttagagcttattagtggtataccaaggctgttcgctgaatgttacacatgcatgaactactatcattttggccctgaaactattagaccaatgtttttattaaattttatttga

SEQ ID NO: 25734 - DNA, 601 bp, Human
taagcgaacttttatttcagaatctccaatccatgttttaattccaatttttcaggatcttcaacaactgcaacagcttcaacagcagaatctcaacctgcaacagtttgtgttggtgcatccaaccaccaatttgcagccagcgcagtttatcatctcacagacgccccagggccagcagggtgagctcctccttagagcttattagtggtataccaaggctgttcgctgaatgttacacatgcatgaactactatcattttggccctgaaactattagaccaatgtttttattaaattktatttgattataaactttcgtttaaaaaaagttttgttttgttttttgtcataaataccacattattgaaggttgccctgaactgccattcatctgcttaatcactaaggaagaaccaagagtttggccaaaagtctaagtgaaattattcaacatgccaaacataaattggataagttgctgctagtgttttgattgtttttcatggaagtgtattcaaagaatatagactgagtgttgaaagtatgtgcttctaaccattgtttttttaatttaaggagggaagactgctataataga

SEQ ID NO: 25735 - DNA, 601 bp, Human
acagcttcaacagcagaatctcaacctgcaacagtttgtgttggtgcatccaaccaccaatttgcagccagcgcagtttatcatctcacagacgccccagggccagcagggtgagctcctccttagagcttattagtggtataccaaggctgttcgctgaatgttacacatgcatgaactactatcattttggccctgaaactattagaccaatgtttttattaaattttatttgattataaactttcgtttaaaaaaagttttgttttgttttttgtcataaataccacattattgaagsttgccctgaactgccattcatctgcttaatcactaaggaagaaccaagagtttggccaaaagtctaagtgaaattattcaacatgccaaacataaattggataagttgctgctagtgttttgattgtttttcatggaagtgtattcaaagaatatagactgagtgttgaaagtatgtgcttctaaccattgtttttttaatttaaggagggaagactgctataatagaaactacaaatttcgtgagttataaaaaacatctttgagtcatttgagtggtaaatgttatataattaatata

SEQ ID NO: 25736 - DNA, 601 bp, Human
aaagtatgtgcttctaaccattgtttttttaatttaaggagggaagactgctataatagaaactacaaatttcgtgagttataaaaaacatctttgagtcatttgagtggtaaatgttatataattaatatatcaaacaaccactcgtctgtaaggtcagttaatgtaatcagggtgaagaatgtcagagtatcaaggcttcaacccaaggaacattagtgcatcactaatgattctttattatttctgagtgggtttttttgccttttttcttcttgatcattcattccaaaatcttttktcatgaaataattattctagcatatattcaagattcagagataagtaattcagtatttacttgcagagggctcacaatttagtggcagggaaacagacctaaattatgttagatttgatatgcacacaatgctatgggaaccaagcaaagagacccctgtaactttgtgctcagataagtcttcacagtgaatttgggaaaatacattcataggcttacaaaagagagaatgtcagtcttggaaaatgaacagcatttgcaaaccttagaaacatggaagaaaaatcaataagctgtgtt

SEQ ID NO: 25737 - DNA, 601 bp, Human
gattatcctgactcagcctcccaaggagctgggattacaggcatgcgccaccacacccagctaattttgactttttttttttttttgagacagagtcttgctctgtcacccaggctggagtgcagtggcacaatcatggctcactgcagtcccagcctcttgggatcaagcagtcctcccaccttagccttcaaagcagctgggagtacagtgtgtactacctcacctggctaattgagaaaaaaaaaaaagttttttatagagacatgtcttgctgtggttgcgcaggctggtcttgaastcctgggttcaagcgatcctcttgcatcagcctcccaaagtgctgggattataggcatgagccactgtatctggactcacttagaggagtctaatgtgaatggcccaatatcttccaataagaaagtcttctgtcaactctactaaaccacagatttaatcagaaaagtggcatttccaagtttttatttaataaagttcatgttgaaacttgggtagggaaaattggtaaataagtaggtagatggacaggacctggtggccagttatatttgattaatgataggaaagaggtatctag

SEQ ID NO: 25738 - DNA, 601 bp, Human
gtcttgaactcctgggttcaagcgatcctcttgcatcagcctcccaaagtgctgggattataggcatgagccactgtatctggactcacttagaggagtctaatgtgaatggcccaatatcttccaataagaaagtcttctgtcaactctactaaaccacagatttaatcagaaaagtggcatttccaagtttttatttaataaagttcatgttgaaacttgggtagggaaaattggtaaataagtaggtagatggacaggacctggtggccagttatatttgattaatgataggaaagargtatctaggtataatgcctgggtttttaggaaactacgagggttgatagggtcagagaaaatatatatgtagtgttagaagaaccttggtgaaaccaaccttttaggtgtaaaggattaagtagattcaaaagatactgcattttcagaagtcaaaaactagtggagagtggtaatcgcaatggaagaaaatgccaagagggaaggagaaagtgacctagatcagaaagacttaggaaggtcaatgcaaagtgtgtttattagatttgttaattgccaaagccttaagatagaatgagat

SEQ ID NO: 25739 - DNA, 601 bp, Human
gatgtagttcatatttttggtaatattgctatgattatataactgtaactgtctagaatttaatttctagcaagggaaatttaagccttttcctcagaattatttttcatgggaaaattcttactgatagattactggacttgagtcataatttattggttatcttattctgccctatctactctcagcactaattataaaaataatcaaagaaatgtttttggttagaaaactgttgttcatttgagttttgtttgggttttcattgtttaggtaagggaaagtggcaagcgtttttttkttgttgttgtttttgagatggagtcttgctctgtcgcccaggctggagtgcagtggtgtgatcttggctcactgcaacctccgtctcccaggttagaaggattcttctgcctcagcctcctgagtagctgggactacaggcgcatgccaccacgcctggctaatttttttgtatttttagtagagactgggtttcaccgtgttagccaggatggtctcgatttcctgacctcatgatccacatgcctcggcctcccaaagtgctgggattacaggcgtgagccatggcgcctggccaagc

SEQ ID NO: 25740 - DNA, 601 bp, Human
tggtttagataccaataagtactagtcaggtagcggatcatagtaatctggtaatggttaacctaaagaagaatgggcccatggtctggaaaagtctctctggagaagcaatatttgaattgggaactggtgaggaaggatgagggagaggttaccacacctagaatctgaagacaagagtcttgtaggcaaaggaatgtgaaacacctgagatgggaacagcttgacctgatccaggaaaagaaaagccaaagtagctggagttcagtgagtcaaaggaagtggtagaagttgagatactatagctagacagggccagatacctagggctgcatagattttgttctaattctaatataaggccatgacagcattttaattgggaaataataagattataaagatcaccctaactattatatggagattgaactatagggagacacttggggaaggaggatggtcatttaaacttccataaacctgccttttaagaaatgtttgtagtaatatatgctgaattttatttaatcatatttgcttcaatatatatttcacttgtcccagatcagcaaaagtcagggttctttagaaaaattca

SEQ ID NO: 25741 - DNA, 601 bp, Human
ccacttcttatctagctgttgctttgaacatgtcattttatctctctggacctcagtcttctcatctataaattaggtgactgaactggctgatcctgaatctccttccagctctgactttctttgtctgcagtatggaagttatcacttaatactaacacattaccagatttgacagaattcagcatccatttatgataagaactcttgcaaactagatatagaaggtaactttcttaacctggtaaagagcatgtattaagaaaaaaaaaagaaaagaaaaaaaccaacatcatacttmacgaaaaactgaatactttccccctaagatcagaaacaaggcaaagtgaccagttgccacttttattccacattatactcaaggtgccagtaatgcaataagacaataaaataaaatattaataaatgacatacagattagaaaggaagaagtaaaactatcttagttgctagatgacatgattgtctatgtagaaaatcttaaggaatctaccaaaaaaagctactggaataagtgagcttagcaagtatgatacaaactcaatatataaaaatcatttacatttctatacactagcag

SEQ ID NO: 25742 - DNA, 601 bp, Human
aggggtaaacaacaaaatatttgtaaggcctatacaaatagttctatagttgaaaactatagaacattgctgcataaaattaaagacctataaaatagaaagaagtaatatgttcatgaatcagaagacttaagttaaatgttaaaatgtcagtttttcccaaattgacctctagattcaacagtctcaaccaatacctagcaggcttttttgtagaaatttgcatactgtttctaacatttatatagaactgtagaaaacacagaataaccaaacgattttgagaagaaaattgaaggaytactgatgtcaagaataattataaaactcaagtaatgaagacagtgtaatactggcatatggatagaaatagagatcagtggaacagaatagaaggtccagtagatccacatgtatatggccaactgatttgccaaaggtgccaaaggatttcaatgggaaaaaaaaagtcattcaaaaaatgcagctgaaacaatagggaaaaaaaataaaaaaccttgactattatttcacaccatgtacaaagatttgtttgatgggtcatagacctaaacttagagaaaaaagcttggaaaaaaat

SEQ ID NO: 25743 - DNA, 601 bp, Human
tttaaaggtttatgtaccctgaaaaataaaaggaagaaagcaaattggaaaagcatttgcattaatatgacaaagcttcctttataaaatttgaggatctctctaaggataaggatgagaataaatatcattaatatataaattggttaaggacgtaaatccaattcacattcaaagaaatacagataataattgacacatgggaaaattttgacattgagtagtaagagaaatacaaattaaagcagcagggaactaccatttacttcttgaattagcaaaacattttttaaaactgctracgtaagtcatgtggaagagtgttgcatagtgggaaccaacgttatgatatgtatcaaaaaccatgaaattgtttatctagttaccagaaaagcccttgagaatttatctcaaaagaactaattacacacataggtggaaaaaataactaatatgcataaagtttttcattgtgttatctatgttagtgaaaacataaaaactgtctagcaattaagaactggttaagtaaattatgagaatattgccttagtttttaaaaaggataactatgaaaactgaaatactcctgatttcagta

SEQ ID NO: 25744 - DNA, 601 bp, Human
gcagagagtaaaattttgtataccataattacagtgaaggtttaaagatataggtccttggggaaaaaactggaacagatatacaaaagcgaaacctgttataagctatttaaactgcaggtggtttacttttcccccttaatgattttgaattatgatcttgaatactatttttataatactgtgtcacaggttggagatgtaatagtggtaaacaagacagatatgctgtctactgttttgacagttgaagtgctagacttatgaaatagattttttgaaataaagagtaatttattaraagacataagatatatgtattcagaccatttgaaaacccagttataataggtttcatttttgtgtattcatttcatttttgtgtattcatgttttttctatagaattacataattacttgtaattacagtatacataatttcactgtctgctttgctcactgaacattatgttgtacattctgtagtgttacatggtcttcatcgttatccataaatgtggctctttccttcagttgtttacttggagtaaacctaaatatctcttcacgtgtttttcctcattgttttattctttctcc

SEQ ID NO: 25745 - DNA, 601 bp, Human
gtggtttacttttcccccttaatgattttgaattatgatcttgaatactatttttataatactgtgtcacaggttggagatgtaatagtggtaaacaagacagatatgctgtctactgttttgacagttgaagtgctagacttatgaaatagattttttgaaataaagagtaatttattaaaagacataagatatatgtattcagaccatttgaaaacccagttataataggtttcatttttgtgtattcatttcatttttgtgtattcatgttttttctatagaattacataattacttktaattacagtatacataatttcactgtctgctttgctcactgaacattatgttgtacattctgtagtgttacatggtcttcatcgttatccataaatgtggctctttccttcagttgtttacttggagtaaacctaaatatctcttcacgtgtttttcctcattgttttattctttctccaacagccagcaaccccaacacgcacaatagcagcaaccccaattcagacacttccacagagccagtcaacaccaaagcgaattgatactcccagcttggaggagcccagtgaccttgagg

SEQ ID NO: 25746 - DNA, 601 bp, Human
gattttagaggaaatacagttacatttgtgaggagtttgacttgtgaagaagcaaattatccagaaacattttaatactttcaaagcatcttaaatgatctgacctgttttaaaaagaaagctaggccgggcacagtggctcacacctgtaatcccagcactttgggaggccgaggcaggtggatcacctgaggtcaggagttcaagaccagcctggccaacatggcgaaaccccgtctctactaaaaaatacaaaaattagccgggcgtgctggcgggcgcctgtaatcccagctaatcrggaggctgaggcagggacagtggcttcaacctgggaggtggaggttgcagtgagccaagatcacgccactgcacaccagctttgggggtgacagagccagactctgtctcaaaaaaaaaaaaaaagaaagaaagaaagctaaacatagaactagattgatatgagtaagttacaaagctgaaataagtataaggttagcatatttagcagtgcctcaagttttaaactattagcacagcatactctggggttccctgagagattgttgcgtaagtgatatgccaaagatgttaaggcttt

SEQ ID NO: 25747 - DNA, 601 bp, Human
cccaacatattgccagtgttatgtttttctctccctccgcacatctctccaggtaaaggagcttccctatggtctggtgttttgttttgtggttttatcctattttttggcatgaccattccttatttttcgaaatgactttgagacagcagtggcaatggttcacaaacttggactatgtgggttaaagtacatactactgctgcagaatggaaaatcagtctatcaacctctgtttttaagtcagatacttcaattttagttattcaaaggttgctctgtgtccaatttatttatatayacacacaaagttttagccattaaagttatttgctgaaacaaaaaaagctctattctctgtgtaaatatacacattattagatgttttaaagttattttctaatttcataattgcttattaaaggattaccatggctgtctttgcataattagaaaacatgtcatagcataatacatttatcacatgtggtacattcattatttcccagtctcagtttttgttccttttttgttatgttctttttaaaaatatcaaagggatataatatagttaagattatatatgaatcgactacttaaa

SEQ ID NO: 25748 - DNA, 601 bp, Human
gtctacttcagtatattcagaactgtcattaaaactttctgtgatgatggggtgttctgtacattggacatgggatgtccaatacaatagccactgtctacttatggctattgagcacttggaagggctagtgatgctgaagaactgaatttttaatttattgggttttaattaatttaaatagccacttgtggctggtggctatatgggaaggcagaggatatcaatcacttgaagttcaggtattctgggtgcctcattttgtcttacatttcaatatttctcatctgttaaacttttcatcagaagttgctcaccaaaaagaaaatggggttttaaaaatatgttacttttttaacccaactaccacctaataaaaaatgtagtattcaatgtgctaataaaaaatgtagtgttcaaaagatggatttaggggtaggggggaatcaaaagactgggataatcccagttcaaacaagtgttgccaggatagttgagagttggctgtctcatagtaggattagttgtatagtactttggaccagaaatgatgttgcctttctgccctgtcactaaactaattgaaatgaatgggtgaatc

SEQ ID NO: 25749 - DNA, 601 bp, Human
taaatagccacttgtggctggtggctatatgggaaggcagaggatatcaatcacttgaagttcaggtattctgggtgcctcattttgtcttacatttcaatatttctcatctgttaaactttttatcagaagttgctcaccaaaaagaaaatggggttttaaaaatatgttacttttttaacccaactaccacctaataaaaaatgtagtattcaatgtgctaataaaaaatgtagtgttcaaaagatggatttaggggtaggggggaatcaaaagactgggataatcccagttcaaacargtgttgccaggatagttgagagttggctgtctcatagtaggattagttgtatagtactttggaccagaaatgatgttgcctttctgccctgtcactaaactaattgaaatgaatgggtgaatcatttaaactccgtgagcctctgtttcctgtatataaagcaactatcttacgcttttttcccagtttgatcaagagagattcagcaagaagaaaagctctgtatacatttcaaaggttataggcttatagagaaagacatcttttgtaatatattcagggcatcattgttctattgct

SEQ ID NO: 25750 - DNA, 601 bp, Human
aagacatcttttgtaatatattcagggcatcattgttctattgctataaggttactaagtttccattgcccatgaaggtttgactaaatgggtcaaacctctctactgtgaatttctatttctatgatggttacaaaagtagtcttttagaatacctgttttttgtaactaactttgaaatccaaactaggagtgaaaatagatttttttttcactgcgtccagaaatacttgatagggaaaagaagaaaagagatgatttctaatttttaaagtgatttttgggaagtttgattagttcrtaaatatcttgggttatctagagagttatacataatatctgtaggtgatacagataaatttatttttatttttcttttttaaatttttttctttttttgagacaggatctcgctctgtcacccagactggagtgcggtgccatgatcacggcttgctaccgccttgacctcctgggctcaagcgatccttccacctcagcctcccaaatggctaggactacaggcacacgccaccatacctgcctaatatttgtattttttgtagatgttttgccatgttctccaggctggtctggaaat

SEQ ID NO: 25751 - DNA, 601 bp, Human
ctgggattaaaggtgtgagccactgtgcccagaccagataaatacatttttaaaaattacttaaatcactttggttgtatcaattaaggggcttgttagaatattagcactatttttgatacctagttgaaattttggtatctccatgattacataaggtggcaagaagagattcaaaatgggaaagtatgtgggacagtattgaacattgtaacgatcaggcctaaaagagtcctcacagtaacactgtgactggcttagggatggagtttatgtgggaccccgtaagtggaataattaytgactccttgtctaaagcagttattggagcaacaccccagagtgaaggctttaagcactggtgagataactctgtctttcctctcctcttctcctgctctgtattgtgtgtagggtgatgttgggctcgctatggggaaactatatggaaatgacttcagccaaactaccatctctcgatttgaagccttgaacctcagctttaagaacatgtgcaagttgaagccacttttagagaagtggctaaatgatgcaggtaagtgactgtataagacatttctttgtcattcattggaatttt

SEQ ID NO: 25752 - DNA, 601 bp, Human
aagttgaagccacttttagagaagtggctaaatgatgcaggtaagtgactgtataagacatttctttgtcattcattggaattttacatggggattgttatataaattggggtttatatttcttactctatttttgttgttacagaaccttgaagcttactaatcctgggaggatcattataaattatggtgatataaatcagaaagctgattcatttaaatattctagtaattacagtataaataattagccgtaatttttagcctgaaatactcttgtatttgagccaggattaggaaaacacacacacacacacacacagttgaaggaataggataagtaaggcttttgtatttagataagcttgaagtagaagcttattgtttcttccttgatgaattatcatagaacttgttcttgcaatagttctgcttttgttatttcaaatgaccacacatttcattcagaaaagttggactactagctttgtcttacgtttttttgtgctgagagttccttttggaagattggaattttgagtcacaggatcatagactatgaaagctgtaggagtcatgtagatcccttaaactatggttc

SEQ ID NO: 25753 - DNA, 601 bp, Human
tcagcctctgctcttatggatgattataaataggtgaagtaagtaagttactaacataggagacagaaccagagttctgcagggttcaggagagactagaatcacatccatgcaagcactcagtatgagagaggtggcagcttaccataggatacataggaattaattccacagactagaaaaggtggggggaaagtactttaagcagaggaaatgcatgagcgtttccccctcagagtgggggagaaacactggagtgagggaaaccatagggtgtatgaggagacactctagtagattrgttggttaaattgtagtgtctgtatgcctggaatagtagtttgggactggaacactagagaccttgagtgttaggctatggagcttaagttaatgcaagagatatttggcaattatttttttgtaccaggtaatatcataacaaagcttttaagaaaattttgacttctctaattcagaaaagacttgagcacattgggaggactctgaattaggagtttttgtcagctctgccacttaaactgtgtgattgggcaaatcatgtgatttctttaagctaaaggtccttcatctgtgaaat

SEQ ID NO: 25754 - DNA, 601 bp, Human
cgtgctctctctctctctctgctgaggtcactggtcttgaggtgcccctgcatggagggtgaaatctcgtgttgttattaacccaagaacttattggtcttgcttattttttatttatttttctatttattttatttttttgagacagagtctcattccatcacccaggctggagtgcattggtgcgatcttggctcactgcaacctccgcctcctgggttcaagcgattcttgtgccttggcctcccgagtagctgggattatagacgtgtaccaccattcccggctaattttttgtacycttagcagaagcagggtttcaccatgttggccaggctggtcttgaactcctgacctcaagtgatcccttggcctcccaaagtgctgggattacgggtgtgagccaccattcccagtctttttttttttttttttttttttttttttgttgagacagagtttcactcttgttgcccaggctggagtgcaatggtacgatttcagctcactgcaacctccgcctcctgggttcaagcgattctcctgcctcagcctcccaaagtagctgggattacaggcgcccgccaccagacccagctaa

SEQ ID NO: 25755 - DNA, 601 bp, Human
attgttgagtttgcatttctgttctttttaaatttggttttattttatttgaatgtcattccatactggcaggctttttaaactaaggtcagcattaaaagcacatgttagtttatgtgaaggttgtagttgttaaatggtgggcctgtagtcataaagttatgagatagttatgaaaaagataattattaatcaacaattttgttttgtaaaggtgatgtttgtgttttagatttgtactaaaagaaagacagtatttcttgcaaaactagaattttttgttatttcaaaactaatccgttttttttaaaagtttgcttcacattattttcataattttattttattaaaaccaaacctaaggcaatactgcccccctacagagtcaaaagtaaaagtaatacatgtaccccagattccctgatcctgtcaaatagttttcttatttaggtaaagttgataattagtataatgtttcttaccgacttagagtatatctgtctcaacgctattgaaatttacgaactttttattatttatttttaaaacccaggcaaagctatctgtgatatcagtgaacaaccatcttcgaatagcagct

SEQ ID NO: 25756 - DNA, 601 bp, Human
aactaatccgttttttttaaaagtttgcttcacattattttcataattttattttattaaaaccaaacctaaggcaatactgcccccctacagagtcaaaagtaaaagtaatacatgtaccccagattccctgatcctgtcaaatagttttcttatttaggtaaagttgataattagtataatgtttcttaccgacttagagtatatctgtctcaacgctattgaaatttacgaactttttattatttatttttaaaacccaggcaaagctatctgtgatatcagtgaacaaccatcttcsaatagcagctttccaacataggatgtcaggtgtctcaattccaagatcaaagaaagactgtaaaatcatttcctctttaagttttgattttaagtgctttgtccatgttttcatttctgacctcaaggtggcgaccacaccaagccttgtgactagcagtgcagcaactaccctcacagtcagccctgtcctccctctgaccagtgctgctgtgacgaatctttcagttacaggtaagcagctgccaggccatgcacctgctgagcacatgggaggcccgttttgggttattataagagt

SEQ ID NO: 25757 - DNA, 601 bp, Human
agccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctgggtaaggcgctttctcatctcattcacgtctgaggtggaggtcatccctggaattactcacaggggagactttacatcactgacttagatggggaaaaaaatgtctttaaagcagtaatctctttgaagtgggctgttttgtgatcmtacaaggactttgattatagttgagtttatgtttcttaacaccctgggaagggcagtagtcatacctttgtttccagatgaagacccaaaataccaggtcactaattaccttagtgacggggccaggaagaaagcctagaattcttgactcttattttccccattaaactctctcaactgcctacttcctaattctcaagcatagataagagatgtaataggagtctcaattttatactgttattgtcacacattataagaattatcttgtaaatatatctttttctctagaatgtttct

SEQ ID NO: 25758 - DNA, 601 bp, Human
attatagttgagtttatgtttcttaacaccctgggaagggcagtagtcatacctttgtttccagatgaagacccaaaataccaggtcactaattaccttagtgacggggccaggaagaaagcctagaattcttgactcttattttccccattaaactctctcaactgcctacttcctaattctcaagcatagataagagatgtaataggagtctcaattttatactgttattgtcacacattataagaattatcttgtaaatatatctttttctctagaatgtttctttcattttggaaaraaagagaaataagtctttcaaagaagggtcaaaatgactataaaagttttacattttgtgctgatcataacctcgtttgtatgagtaagcatccaggaaagcagtaactgagaagcacaaaccatagaagagtaaagaaaaataaatatttccacctatttccccagctggattttcgttttgtaagttccttttggtgtgttgtcaaaatgagacctgcgtctgcatggtaataaagtgactcctcttttggacttgcagaggtgccttactcagtctgaatccagggaccctgagcgg

SEQ ID NO: 25759 - DNA, 601 bp, Human
cagtctgaatccagggaccctgagcggtgctctcagcccagctctaatgagcaacagtacactggcaactattcaaggtcagtagaagcctttttcttactttggtggcatgcacgtgtgtgtgagtgtgtgtgtgtgtgtgtgtgtgcttgagacagagatagaggaagtctgctttgctagaggtaaaagtgatgggaaagagtcaaatgctgactaacttgttcttgagaactaagaaaatgtcctcgtaaaaaagctttgtaagaaaagtataggtgttagtatgtgagtaaaagcrggaaatatacttagtttggtatatggtaaaaaaccagaactttcatgctaatattgatcttatgtgagtagacttgaagccagatttttttcccctgataagtttatcccaagtattaatctaaaacccgtctctaggcaaacttgaccaagtaagactctccagttcccagctgcactcctgagaaagctgtgcatgggaaagtcctgtaatgaacaaacattggaacacatcaggtggacctcaggagtgcttttaattctcattaagttctgctctttttatatcgccgttagtgta

SEQ ID NO: 25760 - DNA, 601 bp, Human
ctgtgaataaccattgcaccccagcgtgggtaacacagtaagaccctgtttctaaaaaaaaaaaaaaaaaattaaagtgttttgtgcataaatgagaattctcagggccaaaaataactattagccaacctaaattaagattaatatttcacaggtaatatctctaacagtgtactagagaatgttaattacagacaaaaccaaaccatggcctagattaccttacattatattgactttctgattgactaaatcatacctgaattggttagctctaaagcttttgttatataataatttytttttgcaatagaatttgtgataaatcactttttcttctgctttattgaatgtttctgtgctgtgttgatactacaaaggcaaaatgtcttccctagggcatgattgacactctgaaaagatactaagtttggaatctcagaaaaacttcaagctgcactgtctcactgttctgtactatttgtatgagcaaggccaaagtcagaggcattcccttcagctatattttatgtaagaaatcaaatgtgtaatgccgttagaaaatccctcaaatctacatgtaggagtgaggttatatggc

SEQ ID NO: 25761 - DNA, 601 bp, Human
ctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctstcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaaaaaaaaaaaaaaaagaaacaaaaaaatcaaaaacaaacaaaaataagtgaaaggactacttatcatttccagcagtcatgatgacaagttaaggtgggttaccaattccaatata

SEQ ID NO: 25762 - DNA, 601 bp, Human
gggaccctggttcctcgcctgtcccacctccagatttgctgtggggagggcccttgtgacagttctgcccgtagcgtgtcagcagctcttcaatagtcatggtagcctcttcatgcagcagtgcagcctcctcattgtccactgcagggaagaggctaaatcagagcccccatgccagactcctcatgggatccgtccctctcactacctcaacagcccttgcagcctctaacttccccacaacctcccactcccaaggttcctctcgctcaagtctcagaagaacatgccctagctcctyctcctccacagacttcttttggtttttgtgtttcatccccttcttaatcaaaacaacactagttactatacttcccctctgacgtctcattttttattgttaagttgtaaaaaccctattctggctgaggatccaggaagcccacaatgctactgtgaattaggatttaggcttaatgattggctattggggctaataactgctccagtcttgaggggaaaaaaaagcacataaatactagcaggaaccaggaagaccccatcacaatgacaaaagataatgtatatacaatgcttacag

SEQ ID NO: 25763 - DNA, 601 bp, Human
gaagtggtcccctggagtaaaggaatggttgatgagcagtttggatacttcccacagacttgtgtttgtggcaggtcaaaccttgccattcatttcccttctttacaaagttccataatctagtggaatggggaactgagtcctaagtcctagtttttctagtttcaaccctgccaccagactgctgaaccttaagaaagtcactcactggtctttttattttaagtcttttttgtttttttttttttgagacggagtttcactcttgtagcccaggctggagtgtaatggcacgatctcrgctcactacaacctccgcctcccggattcaagcggttctcctgcctcagcctcctgagtagctgggattacaggcttgcactaccatgcccagctaatttttgtatttttttttttttttagtagagatggggtttcaccatgttggccaggctggcctcgaactcctgacctcaggcgatccaccagcctcagcctcccaaagtgctgggattacaggcatgagccaccacgcccggcactcacaggtctttttcatcattcaaatgttacataagatgggtataatgatacctatgta

SEQ ID NO: 25764 - DNA, 601 bp, Human
acactcacatgggggctcgccacatgctacagatgggaccaagtcgggggccacggcagcagaaaaaaaaggacacgatgcgtacgattaggttttggcctttagtctgaaaaagtgttgattgaaagtgtacaacagagagcgggtgcaagcggccgagggccatggagccgccaataaaaaagaatgtccttaaataaagttcacagagtaaaaaccagaaccgccagtccttccctccaacacaacagagcacaggcacagaaccggtgatgagcccgaggagcagaggcggctgggraggacagcagaggctcccggctgcagtgtggagggagagccctctttggaatgggcggagtgaagccacccagctccccctgcacacctcatacccactgctaaggctaaaggaaaaagacaaaactcagtctcaggtccggagggctcagaaaacagtctaggtgggcaggggtctggatgactgctagtctcgcttggccttcttcttcttgtcgctgttgccattttcttcagccccctcagtagagagcacctcctctagttttcgcttgccactctctggctggagctctgctgt

SEQ ID NO: 25765 - DNA, 601 bp, Human
ctcagttctttgctacgtgggatgcttcattagacagctggtttcatcagcgagcatggaagaaggtgagagagtgcaagcaagatgaaagtcacagtcttttgtaacttaatcttggaagtgacagcccatctcactttcgcttattagaagtaagtcaccaaatatagcccatactcaagggtaggggaggattacacaggatgtgaacattgggaatcatttcatagaagctgcttataacagtaaccaatttttctaaaactgactctttctctttttaggagatattcatggacartatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgtaagtgaaaataaagacttagaaaagtaattcatggaaacattgcctaataattttctggttcagaagagttgctttgattcaga

SEQ ID NO: 25766 - DNA, 601 bp, Human
atctccttgatttatataatgatttgacaaagtttgagggtatgttatatgtgcaggcactattgtgaacacagtgcgtgaagcaatacacaatacagatgatctctgttctcatggagcttacattttttttcccaagtgtttctccagcattgattggccttccctgtccagccaaatagcaggtcatcagcctagctgggactgtatgtccttgtagtgaaaaaaggctgtatcaggcttccaatgcttaatgaaaatagcctttcttttttcttttttcttttcttttctttctttctttttttttttttttttgagacggagtctcgctcttcttgcccaggctggagtgcaatggcacgatctcagctcactgcaacctccgcctcccgggttcaagcgattctcctgcctcagcctcccgattagctgggattacaggcatgtaccacgttccctggctaattttgtatatttagtagtagagatggggtttctctgtgttgatcaggctggtcttgaactcccaacctcaggtgatccacccgcctcggcctcccagagtgctgggattacaggtgtgagccacggcgcccag

SEQ ID NO: 25767 - DNA, 601 bp, Human
aaaagacaaaaattgtttgatgtatttcataaaacacctagcacaatttttgggattttttaagtgttaaatttgattaggtttattttatttgtcagaaattctatgtatttatgatgtacaacatgatgttttgaagtatatatacattgcagaatggttaaatcccgctgatttaacatatgcattacctcaaaaagttagcattttgggagaaaacaacacttaaaatttactcttagcattttacaaagatacaatatagtgttaactgtagtcactgttatacaatcgatcttcygtatttattcctactacccaactgatactttgtattctttgaccaacatcttcccatcccacccctacccccagcacaatctttgaagtcttggtaactttactgaaggtattgaatgtttattgtagttgttgcctttttgaaagtacgtaaataacatctttgcattgtagaaaaagttcttctttatagataaacatgaagaaatgaagaaaattgaaatcattcataatcctgcggctttgagataactgatgagaacagttttagattttttaatttattctatctgttcttttt

SEQ ID NO: 25768 - DNA, 601 bp, Human
acatttatgaaacagataattgagtaataaaaggtatttaatatgtcagaacttattaagacactatgagaagtcaggaggaggaaagactgggtacatgtgtgtatggaggcatgggttttagaggataaataggctttggagaagttaaaaggacttgagacactctttgttgtctagtttagggaatgtgtaagaactggcctgactagaaggtcaagtacatgctgggaaatgatggaatcagattatggagatttgactattgagcaacggagtttgttgagtgatttaataaccrtattgggtttttgtacagggaagtaatttaatggaaatagtgtaagaaaattagtttttcatcaatatacgggaagaattaaagtggaaaaacgctgaaaagatagatgcacttgcctaggcccgaggtaataaatggtttattctctggcagaacataattcactatattaattgaaatatgttttccagtagacattaaacacgtaatgaattgtagttcttgtacattagtgtagctaaggatagaagtgtagcagtatggatatgaatgtttagcttcattccttgtgatgatact

SEQ ID NO: 25769 - DNA, 601 bp, Human
agcaacggagtttgttgagtgatttaataaccatattgggtttttgtacagggaagtaatttaatggaaatagtgtaagaaaattagtttttcatcaatatacgggaagaattaaagtggaaaaacgctgaaaagatagatgcacttgcctaggcccgaggtaataaatggtttattctctggcagaacataattcactatattaattgaaatatgttttccagtagacattaaacacgtaatgaattgtagttcttgtacattagtgtagctaaggatagaagtgtagcagtatggataygaatgtttagcttcattccttgtgatgatacttggattgcctatcagagagaaataatagcttatataccacttcaaagattgcagagtatttttatgagcttttcctgttaatccttctgatcaatagtttatgacttcatgaagataatgaacatgttggagtgggatgtgaaaagaaggtcttagggaaccaagtgaggcactttcacttagaagttaaaatgtttaagattagtggtaagaactggcaaaagtggtaggaagggttgcagttgattatgtttctatgaaggccagg

SEQ ID NO: 25770 - DNA, 601 bp, Human
taaaaggggcagggcgcggtggcccacgcctgtaatctcagcactttgggaggccaaggtggttggatcatgaggtcaagagatcgagaccagcctggccaacatggtgaaaccccgtctctactaaaaatacaaaaaattagctggatgtggtggcgcgcgtctgtagtcccagctactcgggagactgaggcaggagaatcgctcgaacccgggaggtggaggttgcagtgagctgagatcacgctactgcactccagcctgggtgacagagtaagattctgtctcgaaaaaaaaaaaagacgttaaaaggaacacttttcagtatctttaatttcacatagtgaatctattttgattaaatgctttttattcggtgactgttaaaatattaaaatttttagctgttagtactatgtctcatctttttatttataggattgtcaccagacctgcaatctatggagcagattcggagaattatgagacctactgatgtccctgatacaggtaagtgtagagagaagtttaattgttttgtgtaaagtgttttcatatttgaacttgattacatttagtggaagtaggattggcttatgta

SEQ ID NO: 25771 - DNA, 601 bp, Human
ggcctcccaaagtgctgggattataggcacgagccacctcgcccggcctgacaaatagttttttaaatcagtaaaactgtgtttatgattttgataaatatgccttctattaaataacaaggcagaattgctaagtttcctaactaaaatgacccctgataatcagtttttttcagccatagatcttcattcactggtcttttcaaaaataaatgatgatttttaaaaatcaggtttctgaactacgctagtttgcatggtcttttgttttccagaaactgccaaaatccttctattgtgyttattttcaaataattgtctctaaaattctagaaatattccctttaaaaaagaaaatttgaaagaatgaacaagtaagcaaactaaaaaaccaagaactaaaaacatggagtccatgaccagcctgggcaacacagtgaaacacgaaaccctgtctctacaaaaaaatacaaaaaactggctgggcaccgtggctcacgcctgaagtcccagcattttgggaggctgaggcgagtggatcacctgaggtcaggagttcgaggccagcctgaaaaacatggagaaaccccatctctactaa

SEQ ID NO: 25772 - DNA, 601 bp, Human
aaaaagaaaagaaatacaaaaaaattagccaggcatggtggcacacacctgtggtctcagctactcaggaggctgaggtgggaagatctcttgagccccaggaagttgtgactgcagtaagccaagattgcaccactacactccagcctaggcagcagagcgagaccctgtctccacacaagcacatacacagagaaacaactaaaaacatgagtgccatttgctatgtggagcaggggtcacagggattagataaggtggctatggtcttaggagaaaaggttcatctaaattgtaccawaaggtaatttcagcagaagcatgttcctagtactgaggtaggagttattttaataagtaaatgccttcgtaattgcttttttatattagcaagtggtgtcggataattttgctaattaaaagatacctaaaataaatttaaaagtaatcttgcccaccgtaaataaatataaaatatttacatattattgtgttcctcaaatttgtagactgagagaaaaattgtttaaattactcagaaattgacaactggttctagaaatgttaactcatcaaggccaggcacggtggctcacgcctg

SEQ ID NO: 25773 - DNA, 601 bp, Human
gtggcacacacctgtggtctcagctactcaggaggctgaggtgggaagatctcttgagccccaggaagttgtgactgcagtaagccaagattgcaccactacactccagcctaggcagcagagcgagaccctgtctccacacaagcacatacacagagaaacaactaaaaacatgagtgccatttgctatgtggagcaggggtcacagggattagataaggtggctatggtcttaggagaaaaggttcatctaaattgtaccataaggtaatttcagcagaagcatgttcctagtactgargtaggagttattttaataagtaaatgccttcgtaattgcttttttatattagcaagtggtgtcggataattttgctaattaaaagatacctaaaataaatttaaaagtaatcttgcccaccgtaaataaatataaaatatttacatattattgtgttcctcaaatttgtagactgagagaaaaattgtttaaattactcagaaattgacaactggttctagaaatgttaactcatcaaggccaggcacggtggctcacgcctgtaatcccagcactttgggaggccgaggcgggcagatg

SEQ ID NO: 25774 - DNA, 601 bp, Human
tataaaatatttacatattattgtgttcctcaaatttgtagactgagagaaaaattgtttaaattactcagaaattgacaactggttctagaaatgttaactcatcaaggccaggcacggtggctcacgcctgtaatcccagcactttgggaggccgaggcgggcagatgacctgaggtcaggagtttgagatcagcctggccaacatgacaaaacctcatctctactaaaaatacaaaaattcatcgggcttgctggtgggtgcgtgtagtcccagctatttgggaggctgaggcaggasaatggcttgatctgggaggcagaggttgtagtgagctgagatcatgccactgcactccagcctgggttgacagagcaatattccatctcaaaaaataaaaaataaaaataaaaatacagtctgttggcagttaatttaaggagcatgatccatgtaaattaaactcaacttagtaatgttttcagtgtgtagccagtagtgttttcagtgtgtagccatgtaataataatacatattttaaaatcaaagcaagaagtaagctcttcgcaaagtcgttcattggttgttgctcatttaatt

SEQ ID NO: 25775 - DNA, 601 bp, Human
gtagactgagagaaaaattgtttaaattactcagaaattgacaactggttctagaaatgttaactcatcaaggccaggcacggtggctcacgcctgtaatcccagcactttgggaggccgaggcgggcagatgacctgaggtcaggagtttgagatcagcctggccaacatgacaaaacctcatctctactaaaaatacaaaaattcatcgggcttgctggtgggtgcgtgtagtcccagctatttgggaggctgaggcaggacaatggcttgatctgggaggcagaggttgtagtgagcygagatcatgccactgcactccagcctgggttgacagagcaatattccatctcaaaaaataaaaaataaaaataaaaatacagtctgttggcagttaatttaaggagcatgatccatgtaaattaaactcaacttagtaatgttttcagtgtgtagccagtagtgttttcagtgtgtagccatgtaataataatacatattttaaaatcaaagcaagaagtaagctcttcgcaaagtcgttcattggttgttgctcatttaattaaggattctgtagttggattataatgccctcatcaaa

SEQ ID NO: 25776 - DNA, 601 bp, Human
tgggaggctgaggcaggacaatggcttgatctgggaggcagaggttgtagtgagctgagatcatgccactgcactccagcctgggttgacagagcaatattccatctcaaaaaataaaaaataaaaataaaaatacagtctgttggcagttaatttaaggagcatgatccatgtaaattaaactcaacttagtaatgttttcagtgtgtagccagtagtgttttcagtgtgtagccatgtaataataatacatattttaaaatcaaagcaagaagtaagctcttcgcaaagtcgttcatttgttgttgctcatttaattaaggattctgtagttggattataatgccctcatcaaagtaataattgatgtccctctgaaaaacacgtagattaattaaaataaaattaaatttaaaacttaaaaacaaaaaaagtacttagtgtcccagctccctgtagtcatgatgcctattagtatgttttgtttcatggggagccttgcaaatggcatgatttttaagctttcaggagtggtgaatttattattccaattaagctaaattgtttccattatagaaaaggcacaccagttttaatgttc

SEQ ID NO: 25777 - DNA, 601 bp, Human
acattttctttatccagttcactgttgatggacatctaggttgattacatgtctttgctattgtgaatagtgctgtgattaacatacaagtgcttgtctttttttgtacatacccaaagtagtgggattgctgggtcgaatggtggttgttttaagttctttgagaaatctacacactgctttccacggtggctgaactaatttacactcccaccagcaatgtttgaacattcctttttctccacaaccttgctgacatctattatcttttaactttttattaatggccattctgactggygtgagacagtatcttgtggtttgatttacattaatagtgatgatgagcattttttcatatatttgttggctgcacgtttgttttttgagaagtgtctgttcatgtcctttgcccatttttaatggggttgttttttgattgttgaattaaatgccttatagagtctggatattagacctttgttggatgcatagtttgtattttctctcattctataggttgtctgtttattctgttgatagtttattttgctgtgcagaagctctttagtttattttggtcccacttgtcaatcattgt

SEQ ID NO: 25778 - DNA, 601 bp, Human
gtcacctttctcatttcagattgtgcttatttggatcttttcttaatctagctagcagtctatcttgtttattcttttgaagaaccaacttttggtttcaacatttacatttttaaaagaggccagttttagctttagtgtgctcctacaaatcattcttgttcactgagtaaaacagcttcagtactttgcttttgcaaaggctattctatgtctttgatgtacacacactgtatttctcttaaaatgcattggggctttcccattcctctttctctttatcataatatactgtttccaycaattagtacaattgaatggtaaatggttgattgctcatttacaaattaaatatagtaaccataccttatccttccagcagttgtcatagtggtgttggattaatatattctcttcactaaggcactattatgttctaaatagtttttaaaaaatactttgtacatatttctatactgttttagttttggaaaatcatgacttttttatgtataatgtaggttaaagctctatttacatccaccagaatgagtgtagtaaaaaagccagactgtatcaagttttggcaaggatttggagg

SEQ ID NO: 25779 - DNA, 601 bp, Human
catagtagattagtagttggttagagttagaggatgtggagagcaggaatggggagtgactgctgatgggaacaagctttctttttggggtgacaaatgttctaaaattagatttatatcaataaagctgttttttaagtaaaaagatctatttatacataaataaataaggtctgaagggtttgtgacttgtaggttagttaccctcctaagttactgtatcagaattatgatgacaacatagatcttctgactcttaaaccagtgttcttttcctcacaacagagatacactaagttcaaaaagttttttacttaaatctaaggattggatagttgatagagttagtgtacttttgttattaaaatatgagtggaatgacaaagttcagacatttgcacactttaagaaatgtttatggaactttgctattctacatttttattgcatttttgcagtttatgccatttattgaaaatcacaattgtaacaattttcttaacttctgtacatgaaaaaataacattatttgttaataatttactttaagatattgaaaccatctgaaaagaaagctaaataccagtatggtggactgaat

SEQ ID NO: 25780 - DNA, 601 bp, Human
aaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaa

SEQ ID NO: 25781 - DNA, 601 bp, Human
accaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtaytacccaactagttggtaatgtgattatgtggtaccttggctttaggttttcattcgcacggaacaccttttggcatgcttaacttcctggtaacaccttcacctgcattggttttctttttcttttttctttcttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatg

SEQ ID NO: 25782 - DNA, 601 bp, Human
tcaaagtgtttttatttatttcccagaatgtaatcctttcgaaacaattttgtcacaactgaattttcaaaagaatgaatctgagtgttttgttttacatagagacaatgcagcgaaagttttaaagcagttaaataattgtgtgtggggagggaaggctaggttgttgggctttacaaataagtacacatagagaatccgggtaactcgattaaaaatattaagactgtgaagtctggttattcagggatttacatggtgactgcattaattttggtacatttctgttcgtatactgtcytattaccggtggctatctttttggttttcgtaatacattagttgtttcaaacaaaaacacagtttcactccttaggcccagttctctcatctctaccagccaaagacctgatcttagaatgattgatcatttgaatgttcttaaaatatgacaatgctttgaagcatgaaagatctgatttatgattgttcttggtggcctttaagtattatttgaaatgcagacaattctactgaagtggattttcagttcatatgattgcctgacctggagaagtggcttgtataaatctatcctaaa

SEQ ID NO: 25783 - DNA, 601 bp, Human
cagggatttacatggtgactgcattaattttggtacatttctgttcgtatactgtcttattaccggtggctatctttttggttttcgtaatacattagttgtttcaaacaaaaacacagtttcactccttaggcccagttctctcatctctaccagccaaagacctgatcttagaatgattgatcatttgaatgttcttaaaatatgacaatgctttgaagcatgaaagatctgatttatgattgttcttggtggcctttaagtattatttgaaatgcagacaattctactgaagtggatyttcagttcatatgattgcctgacctggagaagtggcttgtataaatctatcctaaagtaaatgcgcgtttttgtttttgttttgcctgtttaaagtagcagcatgattatttttccatggcttctaatttatgtgcttgtcttggagccacgaactttctaatggtctgttaattagtctacttgttgttgacctttatggtgaaagttgtcaaaacaaaatgagtaacagtgtagcactttagaatagctctttactctgttaattctttctataagttcttttaaatttacagtttca

SEQ ID NO: 25784 - DNA, 601 bp, Human
tctactcttaagtgcttagtaattaggagttggaaggaaaacagtatatgaccctgttgttaaattagtaaacttttaattctagggtaaggttagctgctcatcattatctctgtttgctttactttacataaaggtaccataattcgaatcctctaaaatccattaaatgcaatttatccattaaatgtaatccattaaatgcaatttatctattgaatcttcatgcaagtttgaaacttaagtgttttaacattctcctgtcaagatgaagaaaatattttgacaattttctgtccaratgttttacagtttatgtggtaagaattctcccctcccccaactaaggattttccttcttttaccactagtgtattatcatttaggggtggaatctggcaaacgagtctggaataaaggttgcttttaaaactcatctaattttcttgtgtgtttttaaaaattttgattatgctagtagttggctaatcagatcctcactccagtggtttgctctgtgacgttaggatactcccatgggatagaagttacgtatagggaatgtcagatattcttcattgtgctgacttgctttcgctta

SEQ ID NO: 25785 - DNA, 601 bp, Human
aaatacttagttttgcctcagaataatgaccttggtccaggtgttttgatttgtttctttagttgttaactgggaaccaagtaccagactttatatttaggcctggctgtaggcaaggggattaattagtcaatacttgttgagtagtttatggatcaaagatagtacaagtgtgttgtagtgaaacactacaaagcagtcttgtttaaataccataatgtggcttgacatttaattgaagcgcaggttgcaaacgtgaaatgtttttggtttatggaattgtcatttgaccttcagttcttttctaggttataccaaaagattacaagacaatggccgctttagccaaagccattgaaaagaatgtgctgttttcacatcttgatgataatgagagaaggtaggaacaggctctttcttaacactatttttcaagtaagggtgtgatcccaaattgttttcaacacttgttgcaagttttagagctcttagtaattgttcaccagatgacagtctggggtctttaattctaagcttaatgtttgaaattcacggaagagacatgtgaaatgtaacacgaggccttctctcttttgcagtg

SEQ ID NO: 25786 - DNA, 601 bp, Human
atgtaacacgaggccttctctcttttgcagtgatatttttgatgccatgttttcggtctcctttatcgcaggagagactgtgattcagcaaggtaagggcctctggagcatgcaatattgttacgggagaggaggcgagactagaggatttttttggttttgttttattgaagtttgttttcctctttgatcctaccacttttttttttctgttatactattggatttttctatttcttttaaattaagattttctgagatggacagaacactttgtattgggaactaatatttttgatayagttttgtttataatttaaaggaaatgcctacattgtcttaccttgaatgtcatatagaattgcagaatcatatatatctctcatgttctttatattgttaatcacttttaaagtaagaaataaatgaaacacctacattcttcattgtatagccctgtctattaaaaaggttctagggcttctatagattcttactttgcctatatagactaacatggatctaactttttgactatcttcctctttttattttcttatttattcttgacattttatgagtgggtatatattttcatttt

SEQ ID NO: 25787 - DNA, 601 bp, Human
ttcctctttgatcctaccacttttttttttctgttatactattggatttttctatttcttttaaattaagattttctgagatggacagaacactttgtattgggaactaatatttttgatatagttttgtttataatttaaaggaaatgcctacattgtcttaccttgaatgtcatatagaattgcagaatcatatatatctctcatgttctttatattgttaatcacttttaaagtaagaaataaatgaaacacctacattcttcattgtatagccctgtctattaaaaaggttctaggrcttctatagattcttactttgcctatatagactaacatggatctaactttttgactatcttcctctttttattttcttatttattcttgacattttatgagtgggtatatattttcattttgtggcagcctgataatttgttattaactatttgagttgtttctaatgtccttgttataaatgccatagcagttaataactacacatatgtagcttttaaaaatttttttcagaggtattcttcaccatgagatgactaaaaaaattttgattaattctatgacttttaaaatatgttgc

SEQ ID NO: 25788 - DNA, 601 bp, Human
tctcatgttctttatattgttaatcacttttaaagtaagaaataaatgaaacacctacattcttcattgtatagccctgtctattaaaaaggttctagggcttctatagattcttactttgcctatatagactaacatggatctaactttttgactatcttcctctttttattttcttatttattcttgacattttatgagtgggtatatattttcattttgtggcagcctgataatttgttattaactatttgagttgtttctaatgtccttgttataaatgccatagcagttaataacgacacatatgtagcttttaaaaatttttttcagaggtattcttcaccatgagatgactaaaaaaattttgattaattctatgacttttaaaatatgttgcttgattttctttcccctgaaagattgtgttagtttgtaacacactctcacagtaccactgtaaaataagtttattgttttgtaataattttgataatttctttctttaatttggaatatgcttctaacttttttaccctcttttaggtgatgaaggggataacttctatgtgattgatcaaggagagacggatgtaagatt

SEQ ID NO: 25789 - DNA, 601 bp, Human
tttgtggacaggaattaggaactgtagatatggggtgaaatatctatatagctgggtaggggaggatatggtcctttttttatagaataaagacatgtcaattgtataggtgagaagccagaactaatggaggaatctgcatttaaataccagcgttgaacaggaagaacactaggattattgggttgtaaatgacctagattacttttgtgagaaaatattttcagagataaattgggttggcagtggcacaaaatcagtttgagagtaaacatggaaattggacattggtttaaagtgygtggaaaaatatcttgagtgataggctcaggtataaaccggtatttcgactgtatttggaagttgggaaatgctttgtgaaatatgtcaacatactggttgcaaatgctaggaattgggcataatattggcggaaaataaaaatcacaagaatgtcatatcattcattacctgtaaaataaaaatgaattagttaaaattaaactttcctcattaaaagcaacaagctttgactttctggttttaaaatttatttgaaacttaatatttattattccatagcattatgtggtgataatta

SEQ ID NO: 25790 - DNA, 601 bp, Human
acttccaacaatacatttcctctgtggaaagattaggtatcatttgctggcatcctctgaaaacatgccagaagtttgttgaaatttagagtaaagcagattaattgaagatattcttttgtgcattttgttatgtggacttggagatgttagaacttgttcttcatgaaaggggaatggggatttttataaggtaacaggcttctgccattgtttattacagtgaatttttcacctcttctttgtcttttctttgaattggttacatatgctttgtgttttggatagtagtttggccttkgggaataaaagttattttctagttctttttcataaagtaaaccaagaatttaaatagattaaattatttctatgaaactttggaacgatatggatggggaaactatgacttttgagtattgtagttgtaggtttgatttgcattgatggcaatcttcaggaatacttaaggattacattttcttattcccttgccatttggtacagttggtataaattaacctagccactgggctaccgaagtaaggatctaagggctatctgcaggcagtatgagaatcctgctcagactagaggtaat

SEQ ID NO: 25791 - DNA, 601 bp, Human
tagttgtaggtttgatttgcattgatggcaatcttcaggaatacttaaggattacattttcttattcccttgccatttggtacagttggtataaattaacctagccactgggctaccgaagtaaggatctaagggctatctgcaggcagtatgagaatcctgctcagactagaggtaattgaagacaggtaccacttttaatctgagacactactagaatgttgaatgggcatggctatttggttgaatctctttatactttctttttacctttataacagcaccaaataatacagagcarttattttgattcttgtctttcagagtctctggacaagtgggaacgtcttacggtagctgatgcattggaaccagtgcagtttgaagatgggcagaagattgtggtgcagggagaaccaggggatgagttcttcattattttagaggtaaagaactcagaatttaatacttgaattttagaggtaaagaactcagaatttaatactttaaaaagttgtacgctctaagagggaaagagtgggctaattctgaactatagctttagtttttaagaatacctgaccattttattttaaaatta

SEQ ID NO: 25792 - DNA, 601 bp, Human
tagaggtaaagaactcagaatttaatactttaaaaagttgtacgctctaagagggaaagagtgggctaattctgaactatagctttagtttttaagaatacctgaccattttattttaaaattatcttttactttgaaatgctgttgtttggttttctgccaggtcactatatttttaaatgagtttgagtcagaattcttgaagggccctagacatgaaaagccaaattctaaaaaccatttaacataacaaactgtgatgattctgcactattcttgttaaaatgcaagtgtttgggcwatttggcaaataaggattaaaggtaattatttaaatttgaaaaattactgtgtttgtatatctccacattccatggaaatgtatagcagatactcttgctaagcggatccaagtggcagatttctatgaatgtggctccatagttgctaattgattttatttaaatcaggggtcaggagactgtaaagggccaggtggtaagtaagttaagctttgtggaccatagggtttcattcgcaaagtctcaactcttgtcatagtgcaaaagcagccacaaataatatgtaaatgaatgtatgt

SEQ ID NO: 25793 - DNA, 601 bp, Human
gatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttattyctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaat

SEQ ID NO: 25794 - DNA, 601 bp, Human
atttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattaygttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaa

SEQ ID NO: 25795 - DNA, 601 bp, Human
cgcttgtacctggttggaagctttgtccaaaatgcacgcagataatcacggaagtgtggatgttgattctgaagaccgccagagaagcaaacctgagtcagatggaagaactgctaaagttttgaggtcattacaatttacaaatccaggaaggcaaactgaatttgctccagaaactggtaaaagagaaaaaagaaggcttaaaaaaatgcaaccgctggttcagacagacgagtgataccagcgaagactaaggtctatgatagccagggtctcctgatttttattgggatggacctcratgcctcgatgaagattgtttaggatgtttctatgcttgtcgtgcctgtggttctaccaagtgtggagctgaatgccactgtgaccgcaagtcacaaagtatgagcaaactgaaattgaaggaggagaaataattcattataaacatgctggataatctgtggtatcaaactatggggcctttaaaggtctttatttctaaaattcggttactctaagatacattttaagcttgattgtcaaatgacaaagattttaaaagcacctcaatgtgcacgaatttttcatcttgggtgcttta

SEQ ID NO: 25796 - DNA, 601 bp, Human
ttatattaccttgagcaaaagtgtgactacgtatctccctctaccagaaaaaaatcgacgaagatagattttaacaacaggaaagaagtcactttttcttgtttgtccttggaaagtactataacactttctagcttgttataccctttctaatctcaaaaaacaaggcaagagatattacagtaaagctgtatactggatcataacttaatgaaaaagatgaatataatagcatcatttctactattattatctctacctttttttcttagtccgacaaaaatcttgtccaaagttttgrtatttttttaatttttttcagacagggtgtcactttgtcacccaggctagagtgcagtggtgcaacctcagctcactgcagccttgacctcctgggttcaaaccatcttcctgtctcagcctcacaagcacctggaactacaggcacacaccaccatgcctgggtaatttttttgtattttttgtagagacagcgtttggccatattgcccaggctgttctcgaactcctaagctcaagttatctgcccgcctcagccttccaaaatgctaggattagaggtgtgagccaccacacccgg

SEQ ID NO: 25797 - DNA, 601 bp, Human
tcctattatattaccttgagcaaaagtgtgactacgtatctccctctaccagaaaaaaatcgacgaagatagattttaacaacaggaaagaagtcactttttcttgtttgtccttggaaagtactataacactttctagcttgttataccctttctaatctcaaaaaacaaggcaagagatattacagtaaagctgtatactggatcataacttaatgaaaaagatgaatataatagcatcatttctactattattatctctacctttttttcttagtccgacaaaaatcttgtccaaagttttgatatttttttaatttttttcagacagggtgtcactttgtcacccaggctagagtgcagtggtgcaacctcagctcactgcagccttgacctcctgggttcaaaccatcttcctgtctcagcctcacaagcacctggaactacaggcacacaccaccatgcctgggtaatttttttgtattttttgtagagacagcgtttggccatattgcccaggctgttctcgaactcctaagctcaagttatctgcccgcctcagccttccaaaatgctaggattagaggtgtgagccaccaca

SEQ ID NO: 25798 - DNA, 601 bp, Human
ttcttctgggcaattctattgataaggcctatgtaattccccatggataatccttctgaagaattcgttgttgtcaataataaaggactaactgcctacaaagaaaaaaaattcctgtttaatataaatgacaacaaagatttaaccttttaaaaatcattcttctaataaaattactaaatgagcaatttgaaagacaacttggatgttatatattttcctattatattaccttgagcaaaagtgtgactacgtatctccctctaccagaaaaaaatcgacgaagatagattttaacaayaggaaagaagtcactttttcttgtttgtccttggaaagtactataacactttctagcttgttataccctttctaatctcaaaaaacaaggcaagagatattacagtaaagctgtatactggatcataacttaatgaaaaagatgaatataatagcatcatttctactattattatctctacctttttttcttagtccgacaaaaatcttgtccaaagttttgatatttttttaatttttttcagacagggtgtcactttgtcacccaggctagagtgcagtggtgcaacctcagctcact

SEQ ID NO: 25799 - DNA, 601 bp, Human
agtaactttgaaactctagttcatctgtctcatcagatccctcaaatcccggtctcctcatagtctagggctaaagctcattccttctgatacatggtatttgttcatttaatcaaatttgaaggacaaatacctggacaaagagctccctgatctgacaagggtgaagagtgattctatacatgtggcagagaggttttcagacagttaccaccatcatgtcctcaatgatgaaaagatttctgtattcttcgagcagtggcaccctgtactctcttgggtgttccacagactaaaccayccagctacttctctgaaataaaggattaccctaatttgatcaattatggtaaatgggttccatggcttcagcaattaagcattttaattacaaattataaatccaattacttatcaatcatgtaaaaccttgcatacagaatgcttaaaaggacacatatttctggaaaattagacacgaaaataaaccaactttattgcttaaatacaatgaaacagaaagaaaagccaaattatgtcttacccttctggcccatgcacccccgatgcacactgttcataatttacagttagtcttttc

SEQ ID NO: 25800 - DNA, 601 bp, Human
tcatactcatttgatttctgcttttttcagttccaatccattctttatcctatttccacacatcttagctcactggtgatgttctcagtaactttgaaactctagttcatctgtctcatcagatccctcaaatcccggtctcctcatagtctagggctaaagctcattccttctgatacatggtatttgttcatttaatcaaatttgaaggacaaatacctggacaaagagctccctgatctgacaagggtgaagagtgattctatacatgtggcagagaggttttcagacagttaccacyatcatgtcctcaatgatgaaaagatttctgtattcttcgagcagtggcaccctgtactctcttgggtgttccacagactaaaccacccagctacttctctgaaataaaggattaccctaatttgatcaattatggtaaatgggttccatggcttcagcaattaagcattttaattacaaattataaatccaattacttatcaatcatgtaaaaccttgcatacagaatgcttaaaaggacacatatttctggaaaattagacacgaaaataaaccaactttattgcttaaatacaatgaa

SEQ ID NO: 25801 - DNA, 601 bp, Human
tcagaagcgctagaagaaaagggtgtaactattagtttattaattctgtttttatcacttatttctttccctaaattctccttaaacataaaaatctgtctttcagacagaaatatgaatatgttaagtatctcaattgtttgtctacacttacagtgtgctggtcactaaagagttgctttgggactcacacgtagtagcaaaagaaccagaggacaggtagtcagatttctgaaagaaaaagtatcccttagtaggcttaaatacaactaattatttctctacagaggctcagtttctrtgtactatcacatttatttcaacacatttaccaaatccacaaccataaacaattacaagattaataacattttttggatgtttggtctggattttattttattttttattttacttttctggatcacagggcagatattttgtttgtttctttcttttcagacaggatctggctctgttgtctaggttgaagtgcagtggcacaatcttggctcactgcaacctccatctcccaggctcaggcaatcctcccgcctcagcctcctgagtagctaggactacaggtacatgccaccacacc

SEQ ID NO: 25802 - DNA, 601 bp, Human
gtggctcataatggctcctactgccatcttactgtcatttctgactatatttacatctttgcctttctcttcagttaattgacatagcatttgacctttttttaatccaagtttttatgctattttaaccttacttgtctgcaaaataatacacttctcttgaaaacacttctacagtgaaaacagcccaattccttgccagtcttgtacaaaataatgcccttaacctaattactctagcgatacccccaaagtgctttatgtttacagtgtagcatgtgcacatagtcaaagatttctsgacacatctaaaattatttgtttatagatttcaagctttctgcttctgaaactctgctcaaataagggtgtacaatactctacaagtattaagaacaataaataagtctgaaataaaacttcagatcaaaatatgttcaatgcataatgatactcacctttttgccttcctttgattatttctgagaccattctataacaaaagaaaatgagaaatagtttcagatgactaaatcagtcatcttcctttcccgttttccttcctcctgtatatctagatggctctctgaccaatttctta

SEQ ID NO: 25803 - DNA, 601 bp, Human
tctttagaagatatagcctgaagcattataagagtccaagacaaactagactcctcggctggagtagtcctccaaaacagatggggactagatctaataatggctgaaaaaagggacctctgcctctcattgggtgaggaatgttgcttttatctcaaccaattgggcctagtaagaaacgctgatgaaaaacttaaagaaagggctaaaaagctaagggagtatcaaaacaaccaactagattcttggtttgggaacaaaatcataatatgggtcatcccattcctgggccccctcttartgataagcctaagactattgttcttaccctgcgtagttaatcttattcaaatatttttaactgacaggatcatggccatttcacagacaactaccaaaaacatccaccgacagcattaccccttcttctttcttcagcacttaaaatcttacctcttgtccacagtatactttgtttctttcatgtcaggaaggtcaaatctgggtgccaaagatctaaaaattaagagttgaatgtaaaactcaaataaaattgaaatcaaatataacttatttagtgttaatgttaacctttttcttt

SEQ ID NO: 25804 - DNA, 601 bp, Human
tataatcctagcaccttgggaggccgagactggcggattgcttgagctcaggagtttgagaccagcctgggcagcatggcgaaaccccatctctactaaaaacacaaaaattagctgggtgtggtggcgcggcacctgtagtctcagctactcgggaggatgaggcacgagaatcatttgaacccagaaggcagagattgcagtaagctgagatcacgccattgtgctcccgcatgagcgatagagtaagactctgtctcaaaaaaaaaaaaagaagaggccgggcgcggtggctcacgcmtgtaatcccagcactttgggaggccgaggcgggtggatcacgaggtcaggagatcaagaccatcctggctaacacggtgaaatcccgtctctactaaaaatacaaaaaattagccgggcgtggtggcgggcgcctgtagtcccagctactcaggagactgaggcaggagaatactgtgaatccgggaggcagagcttgcagtgagccaagattgcaccactgcactccagcctgtgcgacagtgcgagacaccgtctcaaaaaaaaaaaaaaaaaaaaaaacgagaagaaaaaaaaaatg

SEQ ID NO: 25805 - DNA, 601 bp, Human
tctcactcttcacctaggctggagtgcagtggcacaatcttggctcactgcaacctccacctcccaggttcaagcgaatctcctgcctcagcctcccgagtagctgggattacaggcgcacgccaccatgcccagctaatttttgtatttttagtagagacacggtttcaccatgttggccagactggtttcgaactcatgacctcagatgatctgcctgcctcagcctcccaaagtgttgagattataggcgtgagccactgtgcccagctgagaagatatattttaaaattactatataatatatatatcaattaataaagtacattttccacttaccttaagatctctatgaattaatttttttgaatgtatataatccaccccttttgttatttgttcaaagagttccaaagccaaaactttgtctagtttctcgcctcttcttttttcaatccattgttccaaggtccctttatcacagaattccatttggatgaaaaggcacttagtctttgacctgggtataaaattcacagtatgttaaaagtaacaataaatataaatttataaaaaattttttataactttttaaagtttt

SEQ ID NO: 25806 - DNA, 601 bp, Human
gtctcactcttcacctaggctggagtgcagtggcacaatcttggctcactgcaacctccacctcccaggttcaagcgaatctcctgcctcagcctcccgagtagctgggattacaggcgcacgccaccatgcccagctaatttttgtatttttagtagagacacggtttcaccatgttggccagactggtttcgaactcatgacctcagatgatctgcctgcctcagcctcccaaagtgttgagattataggcgtgagccactgtgcccagctgagaagatatattttaaaattactatattatatatatatcaattaataaagtacattttccacttaccttaagatctctatgaattaatttttttgaatgtatataatccaccccttttgttatttgttcaaagagttccaaagccaaaactttgtctagtttctcgcctcttcttttttcaatccattgttccaaggtccctttatcacagaattccatttggatgaaaaggcacttagtctttgacctgggtataaaattcacagtatgttaaaagtaacaataaatataaatttataaaaaattttttataactttttaaagttt

SEQ ID NO: 25807 - DNA, 601 bp, Human
gtatatattaagggctattctttttgtaaactatcccatctccctacatattctttcagcagacatttattgagtgccttataagtgccagggattgtgttagatgctatatatatatataattatttgagtataaagcacactggggccgggcgcggtggctcacgcctgtaatcccagcactttgggaggccaaggcgggtgtatcacgaggtcaggagattgagaccatcctagttaacaaggtgaaaccccgcgtctactaaaaatacaaaaaattagttgggcgtggtggcgggcrcctgtagtcccagctacttgggaggctgaggcaggagaatcgcttgaacgcaggagggttgcagtgagctgagattgcaccactgcactccagcctgggcaacagaacgagactctgtctcaaaaaaagaacattaacatgtatattatatgaaataacttatagcttatagtttagtataattttagatatttattaaacaaatattgtacccctactactgtgtactagaccttgatctagatgttggggattatcagtgagtcaagatccatcctttttatgaaatttacattttag

SEQ ID NO: 25808 - DNA, 601 bp, Human
atattgtacccctactactgtgtactagaccttgatctagatgttggggattatcagtgagtcaagatccatcctttttatgaaatttacattttagtatgggagccaaacagaaatcaagtcaacaaaacaaacaaggtaatttcagatgatgtcaatgctatgaagaaaactgtgtgaaagtaatgatggggcaggttgttctgctttagcatgtgtgctgaagtgcttttaaactgaagggatggtgtgtgagttgagaaacctgaatgagccaccaagtgaaggtctggaggcagarcccccccaagcagaggggacagcagattccaagcctctgcagcatgcaggaggagttcttggtgtgtctcaggaacgtgggctggagtacagagtgtccaaggaagatggctagtgaggcaggcagagcgggactgcatagtccttcctggggagacatggggttggggtgaggggctaggtaatggattgatgtaacaatttaatgttgactttaaattttataagaagaataactttattttattttactcttatcgatttacgagtctccttaaatagtaaagatactgggtttctt

SEQ ID NO: 25809 - DNA, 601 bp, Human
ccttgatctagatgttggggattatcagtgagtcaagatccatcctttttatgaaatttacattttagtatgggagccaaacagaaatcaagtcaacaaaacaaacaaggtaatttcagatgatgtcaatgctatgaagaaaactgtgtgaaagtaatgatggggcaggttgttctgctttagcatgtgtgctgaagtgcttttaaactgaagggatggtgtgtgagttgagaaacctgaatgagccaccaagtgaaggtctggaggcagaacccccccaagcagaggggacagcagattscaagcctctgcagcatgcaggaggagttcttggtgtgtctcaggaacgtgggctggagtacagagtgtccaaggaagatggctagtgaggcaggcagagcgggactgcatagtccttcctggggagacatggggttggggtgaggggctaggtaatggattgatgtaacaatttaatgttgactttaaattttataagaagaataactttattttattttactcttatcgatttacgagtctccttaaatagtaaagatactgggtttcttctattactttttcagctttttcccccttt

SEQ ID NO: 25810 - DNA, 601 bp, Human
aaaagttaccatgctcggagtggtacagcactcaactgtttgtatatataaggggtgagaattatacatttacttatttcaagtcagaaatgtaattctctcttaaagctgtgttttaaaaagtgattaatggcagtatgtgtattatcccttgtaacatctaaagcctactgagtcttataacagtttgagttgccatattctattacattagggaataatacagatttttttgtgtattttgaaaaatttgaactatatgcctttccctctcttctttttccttttcctgccagaaacragagtacaaattcaagagtctgtgaggggaaaagatgttttcatcatccaaactgtttcgaagtgagtatccagcaaaagtgttgctttctgggtttcagtttaggcatgagtgtttaaaataatgatagatggctagccaggaagagttataatagtcttaaaattagtatatcttaccaatttagaatttagaaaactaagttttctgacataactgctgacttttacatgttctttcagtgtttttccttctttctttctttttttttttgagacaaagtcccactccttcacccag

SEQ ID NO: 25811 - DNA, 601 bp, Human
aagtgattaatggcagtatgtgtattatcccttgtaacatctaaagcctactgagtcttataacagtttgagttgccatattctattacattagggaataatacagatttttttgtgtattttgaaaaatttgaactatatgcctttccctctcttctttttccttttcctgccagaaacaagagtacaaattcaagagtctgtgaggggaaaagatgttttcatcatccaaactgtttcgaagtgagtatccagcaaaagtgttgctttctgggtttcagtttaggcatgagtgtttaawataatgatagatggctagccaggaagagttataatagtcttaaaattagtatatcttaccaatttagaatttagaaaactaagttttctgacataactgctgacttttacatgttctttcagtgtttttccttctttctttctttttttttttgagacaaagtcccactccttcacccaggctggagtgcagtggtgcaatctcagctcactgtaaccacctcctcccaggttctagtgattctcttgcctcagcctcccgagtagctggtactacagttggcgccaccacgcctggcta

SEQ ID NO: 25812 - DNA, 601 bp, Human
agcatcggggtagggaaggggcgggcacagaacaacttaaacggcttctggctccttggtttctgtgtctgtggtacttttatgtccttacagacaagtgtgattccattggataaatgcacagaggttgtgtggattacccaaggggatgggtaggcattgagggcacccctggacttagaatttaggacttcagaagggtgactgctgatccttctcattttcaagtccttctggttgtttatttttgtacatttcaatacttatcctgtgcccctgtcttttgtcagtttcatattcytctaatcagaatcactcagcacccctttcattttctctccgtgtctcattttgcattgttccatacctgacataagcttgtgttaactcgggttctcagtcttgtccatgttgcagagtctggacgtcatggtcttctttgtgaaataccatgaaataacatttagtgttgagggccagatgtggtggctcatgcctgtaatcctagcactttgggaggtcgaggtgggcatatcagttgaggccaggagtttgagaccagccaggccaacacggtgaaaccctgtctttactaaaaata

SEQ ID NO: 25813 - DNA, 601 bp, Human
ggtacttttatgtccttacagacaagtgtgattccattggataaatgcacagaggttgtgtggattacccaaggggatgggtaggcattgagggcacccctggacttagaatttaggacttcagaagggtgactgctgatccttctcattttcaagtccttctggttgtttatttttgtacatttcaatacttatcctgtgcccctgtcttttgtcagtttcatattcctctaatcagaatcactcagcacccctttcattttctctccgtgtctcattttgcattgttccatacctgacrtaagcttgtgttaactcgggttctcagtcttgtccatgttgcagagtctggacgtcatggtcttctttgtgaaataccatgaaataacatttagtgttgagggccagatgtggtggctcatgcctgtaatcctagcactttgggaggtcgaggtgggcatatcagttgaggccaggagtttgagaccagccaggccaacacggtgaaaccctgtctttactaaaaatacaaaaaattagctgggcatggtcatgagcgcctgtagtcccagctactcaggtggctgaggcacgagaattg

SEQ ID NO: 25814 - DNA, 601 bp, Human
atcacgccactggattccagcctgggtaaaagaacaaggctccatctcgaagtaaaaaaaaaaaaggctgggcgaggtggcttacacctataatcccagagctttgggaggccgaggcgggcagatcaggagttcaagaccagcctggccaacatggtgaaaccctgtctctactgaaaatacaaaaattagctgggcgtggtgatatgcgcttctaattccagctacttgggaggctgaggcatgagaatcgcttgaacccaggagacagagggtgcagtgagccaagatggcgccactrtactccaggctgggtgatagagtgagactctgtctcaaaaaaaaaaaaaaaaagcctgtaatcccaccactttgggaggccccaggcgtgcagatcacctgaggtcgggagttcaagaccagcctgaccaacatggagaaacgctctctctgctaaaaatgcaaaattagccgggcatggtggcgcatgcctgtgatctcagctactcgggaggctgagacaggagaattgcttgatcctgggaggcggaggttgcggtgagccgagatcatgccattgcactccagcctgggcaacaag

SEQ ID NO: 25815 - DNA, 601 bp, Human
ggctccatctcgaagtaaaaaaaaaaaaggctgggcgaggtggcttacacctataatcccagagctttgggaggccgaggcgggcagatcaggagttcaagaccagcctggccaacatggtgaaaccctgtctctactgaaaatacaaaaattagctgggcgtggtgatatgcgcttctaattccagctacttgggaggctgaggcatgagaatcgcttgaacccaggagacagagggtgcagtgagccaagatggcgccactatactccaggctgggtgatagagtgagactctgtctcaaaaaaaaaaaaaaaaagcctgtaatcccaccactttgggaggccccaggcgtgcagatcacctgaggtcgggagttcaagaccagcctgaccaacatggagaaacgctctctctgctaaaaatgcaaaattagccgggcatggtggcgcatgcctgtgatctcagctactcgggaggctgagacaggagaattgcttgatcctgggaggcggaggttgcggtgagccgagatcatgccattgcactccagcctgggcaacaagagcagaactccgtctcaaaaacaaacaaacaaaaaaa

SEQ ID NO: 25816 - DNA, 601 bp, Human
gtgttgtcagatacatcttatacttcattttactacagattagtgctagcactaaaaataaaagagaaatttaaaattaagaaaattccatccattaactgaagttttcctgtatttcaaacaagactgtccttatctgagttcagtaatggaaagccttgttcctccactcttatccttcccatagaatacttttctgaaaatctttttttttcctaagttaattaacagggtgaaagtctcttttaactcatcagatgtcagacttgttgtatagtgacagagaacctactcacctgartgttctgtgtttccattcactccttctttcattaacaaatacttattttgaatgtctacaatatgtgaattacagttagttacacgtatgcaggatgcctccatgattaaaacagagaaagtccttgtccttgtggagtttatattccagtggaggaagacataaagtgagcataataaagacatagattatctagaaggtgatgaatggtttggaaaaaaataagacagcatggtgagatgatagtggtgagagggcagagagaggcagacagggtaggcctcattgtggaggtgacat

SEQ ID NO: 25817 - DNA, 601 bp, Human
ttctctgtcctatccccctgcctccttccaccctagggaaccactgtcctgaagcggtgctgaatctgtcagatgctttttctgtatcagtggagatgatcattttttttccttcattctgttaatgtggtttattaccacccttgaatcctgggataaatcagatgtttaattttaatatagctacatttgtttttctttgatatgagttagcatttttgtgacttactatttaagaaagcttttaaaatgttaatttatactgtacttagctattttgcttttagctgtttttctttcttttttttttttttttggtggggggtgtgatggagtcactcccaggctggagtgtaatggcgcaatctcagcccactgaaacctccacctcccgggttcaagcaattctcgagtagctgggattacaggcatgcgccaacacagctggctaattttttgtatctttagtagagatggggtttcaccatgttggccaggctgatctcgaacgctgacctcgtgatctgcctgcctcggcctcccaaagtgctgggattacaggcatgagccaccgcacctggccttagcggtttttcttata

SEQ ID NO: 25818 - DNA, 601 bp, Human
tgaatctgtcagatgctttttctgtatcagtggagatgatcattttttttccttcattctgttaatgtggtttattaccacccttgaatcctgggataaatcagatgtttaattttaatatagctacatttgtttttctttgatatgagttagcatttttgtgacttactatttaagaaagcttttaaaatgttaatttatactgtacttagctattttgcttttagctgtttttctttcttttttttttttttttggtggggggtgtgatggagtcactcccaggctggagtgtaatggygcaatctcagcccactgaaacctccacctcccgggttcaagcaattctcgagtagctgggattacaggcatgcgccaacacagctggctaattttttgtatctttagtagagatggggtttcaccatgttggccaggctgatctcgaacgctgacctcgtgatctgcctgcctcggcctcccaaagtgctgggattacaggcatgagccaccgcacctggccttagcggtttttcttatataaattatttctctctttaataacttttctagataacttctttttacagtactgtattta

SEQ ID NO: 25819 - DNA, 601 bp, Human
attaccacccttgaatcctgggataaatcagatgtttaattttaatatagctacatttgtttttctttgatatgagttagcatttttgtgacttactatttaagaaagcttttaaaatgttaatttatactgtacttagctattttgcttttagctgtttttctttcttttttttttttttttggtggggggtgtgatggagtcactcccaggctggagtgtaatggcgcaatctcagcccactgaaacctccacctcccgggttcaagcaattctcgagtagctgggattacaggcatgygccaacacagctggctaattttttgtatctttagtagagatggggtttcaccatgttggccaggctgatctcgaacgctgacctcgtgatctgcctgcctcggcctcccaaagtgctgggattacaggcatgagccaccgcacctggccttagcggtttttcttatataaattatttctctctttaataacttttctagataacttctttttacagtactgtatttaaaagaagataacttctttttacagtactgtatttaaaagatggcagtttataggtttctgaggaacttctttc

SEQ ID NO: 25820 - DNA, 601 bp, Human
ctgaggcaggagaattgcttgaacctgggaggtggaggttacagtgagccaggattgtgccacggcactcctgcctgggtgacagagcgagactatctcaaaaaaacaaaaaagaaaacaaaaatactctaacaaattaaaaaaataatagagactttaattttacctgaaaaattttatgtttttttttgagacagggtctttctctgtcacccaggttggagtgctgtagtgccatgatagctcactgcaaccttgaactcctgggctcaagagatttctcccacctcagccttctgartagctgagactagaggtgtgccaccacacctagctaatttttaaaaaatatttccagagtcagaatcttgctgtgttacccaggctggtctcaaactcctggcctcaagcgatcctcctgcctcagcctcccaaaacagtgtgattacaggtgtgagccactgtgcctggcctaattttacctgaatattattctcagttgagagagaaggtgagataaaattggcaaatgtcttgatagggaaggatgaagaggtttaggcagagagagagtgagagggtgagcattgaacgtggttca

SEQ ID NO: 25821 - DNA, 601 bp, Human
gggtctttctctgtcacccaggttggagtgctgtagtgccatgatagctcactgcaaccttgaactcctgggctcaagagatttctcccacctcagccttctgagtagctgagactagaggtgtgccaccacacctagctaatttttaaaaaatatttccagagtcagaatcttgctgtgttacccaggctggtctcaaactcctggcctcaagcgatcctcctgcctcagcctcccaaaacagtgtgattacaggtgtgagccactgtgcctggcctaattttacctgaatattattctyagttgagagagaaggtgagataaaattggcaaatgtcttgatagggaaggatgaagaggtttaggcagagagagagtgagagggtgagcattgaacgtggttcagttagcaaccagccgcatggagaaacctgtcattttggaagaaatagagcagtcgctatagacttatgtgggttgctgtcgacatcttgttgttttaggggatgtttccattcaggacacaggcatgttgtgtgccagtgtctcaaggcacaaatggcaattgcacctcttaagggatgcccggtgggtgagccta

SEQ ID NO: 25822 - DNA, 601 bp, Human
tgggcgacagagtgagattccatctcacacaaaaaaaaaaaaaaaaaaaaaaaaaattaatatgtgggaactcagtgttaaaaaggaatttttgtgtattgcttttttcttttttttggagacagtctctctctgtcactcaggctggagtgcgattttggcttactgcagcctccgcctcctgggttcaagcaagcatatctggctaatttttgttttttgtttttttttgagatggagtttcgctcttgttgcccaggctggagtgcaatggcatgatctcggctcacagcaacctccmcctcccaggttcaagtgattgtcctgcctcagcctcccgagtagctggggttacaggcatgtgccaccacacccggctaattttgtatttttagtagagacagggtttctccttgttggtcaggctggtctcgaactcctgacctcaggtgatctgcccaccttggcctcccaaagtgctgggattacaggtgtgaaccaccgcacttggcctaatttttgtgtttttagtagagatagggtttcaccgtgttggccaggctggtcttgaacttctgaactccagtgatctgcctgcctc

SEQ ID NO: 25823 - DNA, 601 bp, Human
gtatacgtatcttgtctcttttgttttcgtgtgttagagcctcttaaagcaggggatagatattcatgtttcactgaatctaaggtgctgtcagtccaggcttacattattttacgtcaccaagaaagaagaaaacactgctaattatactgtggcactgtgccttcttgtcacttagtgatcctattctgcaggttttgatgctgacgctttctccatctcttgtgtttgtcactggaatttaagcaccttctgccagagtcagaaggaacattctggtactaggatgctcgttgccttraaatttttgccatctattcttttttttttttttgagacggagtctcactctgtcgcccaggctggagtgcggtggcgcaatctcagcttactgcaagctccgcctcccgggttcacgccattctcctaggcctcagcctccccagtagctgggactacaggcacctaccaccacgcctggctaatttttttgtagttttagtagagatggggtttcaccgtgttaaccaggatggtctcaatctcctgacctaatgatctgcccgcctcagcctcccaaagtgctgggattacaggtgtg

SEQ ID NO: 25824 - DNA, 601 bp, Human
ttttgttttcgtgtgttagagcctcttaaagcaggggatagatattcatgtttcactgaatctaaggtgctgtcagtccaggcttacattattttacgtcaccaagaaagaagaaaacactgctaattatactgtggcactgtgccttcttgtcacttagtgatcctattctgcaggttttgatgctgacgctttctccatctcttgtgtttgtcactggaatttaagcaccttctgccagagtcagaaggaacattctggtactaggatgctcgttgccttgaaatttttgccatctatwcttttttttttttttgagacggagtctcactctgtcgcccaggctggagtgcggtggcgcaatctcagcttactgcaagctccgcctcccgggttcacgccattctcctaggcctcagcctccccagtagctgggactacaggcacctaccaccacgcctggctaatttttttgtagttttagtagagatggggtttcaccgtgttaaccaggatggtctcaatctcctgacctaatgatctgcccgcctcagcctcccaaagtgctgggattacaggtgtgagccaccgcgcccagcca

SEQ ID NO: 25825 - DNA, 601 bp, Human
cactgaatctaaggtgctgtcagtccaggcttacattattttacgtcaccaagaaagaagaaaacactgctaattatactgtggcactgtgccttcttgtcacttagtgatcctattctgcaggttttgatgctgacgctttctccatctcttgtgtttgtcactggaatttaagcaccttctgccagagtcagaaggaacattctggtactaggatgctcgttgccttgaaatttttgccatctattcttttttttttttttgagacggagtctcactctgtcgcccaggctggagtgcrgtggcgcaatctcagcttactgcaagctccgcctcccgggttcacgccattctcctaggcctcagcctccccagtagctgggactacaggcacctaccaccacgcctggctaatttttttgtagttttagtagagatggggtttcaccgtgttaaccaggatggtctcaatctcctgacctaatgatctgcccgcctcagcctcccaaagtgctgggattacaggtgtgagccaccgcgcccagccaacttttgccatctcttctgagggcgtctgacagtgtctgttgccttccgctgc

SEQ ID NO: 25826 - DNA, 601 bp, Human
aatgggttcaaacaattctcctgggttcaaacaattctccggcctcaacctcctgagtaactggattacaggtgtgcaccaccacgcctggctaattttgttttgcatttttagcagcgagggggtttcaccatgctggccaggctggtcttggctcagatgttctgcccaccttggcctcccaaagtgctgggattatgggcatgagccaccgtgcctggccatctttgggaattttttttaatctgttaagtatttcatcccttctatttcttttattattttcctttgggaactattrggtcctgaaaattttggatctagtctctataacttttaaaaacttattttactttttgcatacttatatatagcattctggggaaattccttgtcttgatcttccctggtttgttcttaaagttgtgtttattctgctgttaagccagccagctactgggtttctttagaccataataacttcttccccctagatttatttttggttctttttcataataacttgttctttcttgttgtatataatttcccattttaacctccgtagagacaatagacttgtttttgttagagtcctttc

SEQ ID NO: 25827 - DNA, 601 bp, Human
agtaatttggaatttgacagtcagcttgtattcagattgaattggatatccttgtactttgaaattacatgtaattaggattcttgttgacgagatatatagaaacatctttacactgcatcattagtatttgctggcagagataagagctaatcaccaattatccctacttttttcctaaaagaagtctgtgtggctcacaagttagtaatattttttcataggcaggttcctttcttcattttccaaaggagaattttactttgaactttttctttttttggaaaactttcaactagcyaagcatttttgggtctgttggaattttcctttttgttgacatgcagtaatacctgacttcttgtctgtcacagatcccagattacaggaatgcagtaatcgtggccaagtctccagcctcggcgaagaggtaggtgggaatctcacaacctctttctggatctgcttctaaggattgtatccgtgatgagttccaggcattctaatttgaacttcagtggttcccagcgatatctcttatttttcttccatggactggtattttaagattgttctgtcaactccatttattaagtaaaca

SEQ ID NO: 25828 - DNA, 601 bp, Human
cccaaagtgttgggattacaggcgtgagccactgcacctggccaatttatttgttaattctgggcatataaaggcctaaggatagtagtatggccagataattcttattaaatttgtgccttgtgctaaatgtttgctttggcccagaaattggaaaatgctattgtttattttaaaattgctaactactggctgggcgcgttggctcatgcctgtaatcccagcactttgggacgccaaggcaggccaatcgcttgggctcaggagttcaagaccagcttggacaacatggtgaaacccygtctctacaaaaaatacaaaaattagctgaacttggtggcacatacctgcagtcccagctacttgagaggctgaggcgggaggatcacttgagcctggggctcagaggttgcagtgagccgagatcatgccactgcactccagcctgggtgacagggtgaggctgtgtctcaaaaaaaaaaaaaaaaaaagtcatcctgtcataacatgagatattgttctgtgatcaaagtaaagtacaagctgggcacagtggctcatgcctataatcccagcactttgggaggccaaggcaggcaga

SEQ ID NO: 25829 - DNA, 601 bp, Human
agcctgggcgaaagagtgagattccatctcaaaagaaaaaaaaaaagtaaactacaaagttgattataactgtttgaaacatgcatcctttcacacatcataagaccagtgcacaaaaagagtgcacttcatgcctgtatattttaaagaatagaatgaacactgggtacccgctagctcacttgaggcatagatcatcaccaggtacctagaggcctcctctgggcttaccctggtctctttgcctcagaggttgtcactgatgtgaaagctgcccatcttgatcctgtagtcagccatragggcttgtggccttaaatgctgcctttttttcttgtctttgatgtttatgtaaatgatgtctttgtgtactttgggactttcttgctcaacactgttattgaaatttacctgtgtagtggcaggaagttgtacttcattctttttcactgctatgtgttgtgtctttggtataactgctacacaactgattgaggcaatggtactgctttgaacatcctcgtgcctattttctggtgcaaaagtgtgagagtttcaaggtgcctgggagtggggttgttgggtctgaaggtatgcacat

SEQ ID NO: 25830 - DNA, 601 bp, Human
gtgcctgggagtggggttgttgggtctgaaggtatgcacatttttaactttacaaggtgctgccaaattgtttccaaagtggtcacacccatttcccaagttccatagtgggtgccccacattatccccagtgcttgataattttgtacgcacccttttcaggttagaaaatctctctggggccgggcacggtggctcacttctgtaatcccagcactttgggaggccgagacgggtgtaggtcaggagatcgagaccatcctggctaacacggtgaaacctcgtctctactaaaaatacraaaaattagccgggcgtagtggtgggctcctgtagtcccagctactcgggaggctgaggcaggagatggcatgagaggcggagcttgcagtgagccgagatcgtgccactgcactccagcccaggcgactgagcaagactctgtctcaaaaaaaaaataagaaaatctctcacgtcaccctccagggtaatagctgtccattacttattccttagttggcaaagtctatagtaacaaggtgctgtggattcagtagcacctttccccccgttctagtgccactgcattatttatttattt

SEQ ID NO: 25831 - DNA, 601 bp, Human
tgttgggtctgaaggtatgcacatttttaactttacaaggtgctgccaaattgtttccaaagtggtcacacccatttcccaagttccatagtgggtgccccacattatccccagtgcttgataattttgtacgcacccttttcaggttagaaaatctctctggggccgggcacggtggctcacttctgtaatcccagcactttgggaggccgagacgggtgtaggtcaggagatcgagaccatcctggctaacacggtgaaacctcgtctctactaaaaatacaaaaaattagccgggcgyagtggtgggctcctgtagtcccagctactcgggaggctgaggcaggagatggcatgagaggcggagcttgcagtgagccgagatcgtgccactgcactccagcccaggcgactgagcaagactctgtctcaaaaaaaaaataagaaaatctctcacgtcaccctccagggtaatagctgtccattacttattccttagttggcaaagtctatagtaacaaggtgctgtggattcagtagcacctttccccccgttctagtgccactgcattatttatttatttatttatttatttattta

SEQ ID NO: 25832 - DNA, 601 bp, Human
atccccagtgcttgataattttgtacgcacccttttcaggttagaaaatctctctggggccgggcacggtggctcacttctgtaatcccagcactttgggaggccgagacgggtgtaggtcaggagatcgagaccatcctggctaacacggtgaaacctcgtctctactaaaaatacaaaaaattagccgggcgtagtggtgggctcctgtagtcccagctactcgggaggctgaggcaggagatggcatgagaggcggagcttgcagtgagccgagatcgtgccactgcactccagcccrggcgactgagcaagactctgtctcaaaaaaaaaataagaaaatctctcacgtcaccctccagggtaatagctgtccattacttattccttagttggcaaagtctatagtaacaaggtgctgtggattcagtagcacctttccccccgttctagtgccactgcattatttatttatttatttatttatttatttatttatttctatttttttttttgagacaaagtctcgctctgtcacccaggctggagtgcagtggcgtgatctcagctcactgcaacctccacctcctgggttccagc

SEQ ID NO: 25833 - DNA, 601 bp, Human
ccacgtccggctaatttttgtattttttttgtagagacggggtttcaccatattcaccaggctggtttcgaactcctgacctcgtgatctgcccgccttggcctcccaaagtgctgggattacaggcgcaagccactgcacccagccgccagtgcattttttaaaaaaacgtttttattttgaagtaattatagatccacaggaagtagggggcaatacacagggacatcctgtgtattcattacccagcatcctccatcttgcttaactatagtacaataacacagactgaaaattctcrgtgccacagccacagaggtccttcagacagcaccagttgtgcatgtagtgagtgtgagtgtgtgtgtgtgtgtgtgtgtgtgtttgtgtttgtgaatgcagtcttaccatgggtagctttgtggaaccaccaccacagtcaggacacagaattgctccttcactgcaaggcaccctcatgcttcctttcatagctacactgacatccttcccacccaatctgcaaccccttgtgtctttgtccactttgtgctgctgtaacacctgagactaggttgtttataaagaatagaagaaattt

SEQ ID NO: 25834 - DNA, 601 bp, Human
ctcgtgatctgcccgccttggcctcccaaagtgctgggattacaggcgcaagccactgcacccagccgccagtgcattttttaaaaaaacgtttttattttgaagtaattatagatccacaggaagtagggggcaatacacagggacatcctgtgtattcattacccagcatcctccatcttgcttaactatagtacaataacacagactgaaaattctcagtgccacagccacagaggtccttcagacagcaccagttgtgcatgtagtgagtgtgagtgtgtgtgtgtgtgtgtgtgtgtgtttgtgtttgtgaatgcagtcttaccatgggtagctttgtggaaccaccaccacagtcaggacacagaattgctccttcactgcaaggcaccctcatgcttcctttcatagctacactgacatccttcccacccaatctgcaaccccttgtgtctttgtccactttgtgctgctgtaacacctgagactaggttgtttataaagaatagaagaaatttattctctaacagctctagaggctgtaagtccaaatcatggcaccagcatttggtctggtgagggccttcttgctgtgtcc

SEQ ID NO: 25835 - DNA, 601 bp, Human
tccatcttgcttaactatagtacaataacacagactgaaaattctcagtgccacagccacagaggtccttcagacagcaccagttgtgcatgtagtgagtgtgagtgtgtgtgtgtgtgtgtgtgtgtgtttgtgtttgtgaatgcagtcttaccatgggtagctttgtggaaccaccaccacagtcaggacacagaattgctccttcactgcaaggcaccctcatgcttcctttcatagctacactgacatccttcccacccaatctgcaaccccttgtgtctttgtccactttgtgctrctgtaacacctgagactaggttgtttataaagaatagaagaaatttattctctaacagctctagaggctgtaagtccaaatcatggcaccagcatttggtctggtgagggccttcttgctgtgtcctcacatggcataaggcagaaggacaaaaaggaatgaactttccttcagaaggccaggaaagaggttaacccactcccacaagcctttttatagcgacatgaattcattcctgatggtggatccctcacaacctaaacactttcccaaagaccccaccacccaacactgttgcac

SEQ ID NO: 25836 - DNA, 601 bp, Human
tcatggcaccagcatttggtctggtgagggccttcttgctgtgtcctcacatggcataaggcagaaggacaaaaaggaatgaactttccttcagaaggccaggaaagaggttaacccactcccacaagcctttttatagcgacatgaattcattcctgatggtggatccctcacaacctaaacactttcccaaagaccccaccacccaacactgttgcactggggaataagtttccaacacatgaattttggagggacaaaaacattcaagccacagcactggcaaccactgatctgtccyctgtctttctaattattatttcaagaatgtcatataaatggaatctatggtatataaccttttgagttttgtttaacctaccatgattcccctgagatccatccaggttgttttgtatattaatatgttattcctttttattgctgggcagtatcccatggtatagaggtaccagagtttatttgttgaaggacatttggatgatttccaggttggggctattatacataaaactcgctatgtacattcatgtataggtttttgtgtgaacagagttttaatttctctgggataattgca

SEQ ID NO: 25837 - DNA, 601 bp, Human
atggaatctatggtatataaccttttgagttttgtttaacctaccatgattcccctgagatccatccaggttgttttgtatattaatatgttattcctttttattgctgggcagtatcccatggtatagaggtaccagagtttatttgttgaaggacatttggatgatttccaggttggggctattatacataaaactcgctatgtacattcatgtataggtttttgtgtgaacagagttttaatttctctgggataattgcacttacaaatgcagttgttggtttgcatggtagttgcaratatactcttataagagactgtcaaactgttttccaaagtggctgtaccattttactagtaggacttttaaagtagcgtgtgtgtgtgtgtatgtattttttttgaggtatggtctgggtctgctgcccaggttggagtgcagtggcttgatcacagatcactgcaacttctacctcctggctaaagcaatcctcctgcctcagcctcccaagtagctaggactacaggtgcgtacctccatgcatggctaatttttgcttttctgtttttgtagagactgggtttcgtcatgttgctca

SEQ ID NO: 25838 - DNA, 601 bp, Human
tctctgggataattgcacttacaaatgcagttgttggtttgcatggtagttgcagatatactcttataagagactgtcaaactgttttccaaagtggctgtaccattttactagtaggacttttaaagtagcgtgtgtgtgtgtgtatgtattttttttgaggtatggtctgggtctgctgcccaggttggagtgcagtggcttgatcacagatcactgcaacttctacctcctggctaaagcaatcctcctgcctcagcctcccaagtagctaggactacaggtgcgtacctccatgcayggctaatttttgcttttctgtttttgtagagactgggtttcgtcatgttgctcaggctggtcttgaacccctgagctcaagcaatcctcccacctcagcctcccaaagtgctgggactacaggcatgagccaccacgcctggcctttatatgtatatttttgatcatagtaacatcagtatgcaattaaagagtaataatatgtatgtaaaataaagacacgaatatttattcaactctagacaacgtttgatgccataatgggtttaaaataactctgggagcctgggaatctagtctc

SEQ ID NO: 25839 - DNA, 601 bp, Human
gcccaggttggagtgcagtggcttgatcacagatcactgcaacttctacctcctggctaaagcaatcctcctgcctcagcctcccaagtagctaggactacaggtgcgtacctccatgcatggctaatttttgcttttctgtttttgtagagactgggtttcgtcatgttgctcaggctggtcttgaacccctgagctcaagcaatcctcccacctcagcctcccaaagtgctgggactacaggcatgagccaccacgcctggcctttatatgtatatttttgatcatagtaacatcagtrtgcaattaaagagtaataatatgtatgtaaaataaagacacgaatatttattcaactctagacaacgtttgatgccataatgggtttaaaataactctgggagcctgggaatctagtctctagattggaaaccactgaactgggtattttattattaaaaacaataatcattattattttttccattgtaataacatgtaaaaaaacatatttcccatatgctcagtggagaaaatttggaaataaggaaagtagcaagaagaagtggggggaaagaggcacccataattctattaccca

SEQ ID NO: 25840 - DNA, 601 bp, Human
aggcatgagccaccacgcctggcctttatatgtatatttttgatcatagtaacatcagtatgcaattaaagagtaataatatgtatgtaaaataaagacacgaatatttattcaactctagacaacgtttgatgccataatgggtttaaaataactctgggagcctgggaatctagtctctagattggaaaccactgaactgggtattttattattaaaaacaataatcattattattttttccattgtaataacatgtaaaaaaacatatttcccatatgctcagtggagaaaatttggraataaggaaagtagcaagaagaagtggggggaaagaggcacccataattctattacccagagtcaaaaacatcttttaacactttttctgtgcattaaaaacaaaaaaagaaaattatacctccatcatttctggtgtgacctgcattgtgacagcacaatgttggccagttatggtgcagaaaacagtgctacccctgggagcctggagtgtggtgggagatagctccaatagtggcaggtgctgtgcaggaagaggctcgtgtgaaagtactggagggctgccatggggcacggtgat

SEQ ID NO: 25841 - DNA, 601 bp, Human
gttttagaacattttcttcttcctagaaaggaaccccatacccattagctgtcacttcacattttctctcactgccattagtccctgggaaccactaatctgctttctgtctctctagatttgcctgttctggacatttcatataaatgagattatacaatgtgtggtcttttgtgtctggctgtcttcactcaacataatattttcaaggttcatccatgttggagcatgaatcaatacttcattttatgatcaaataatgctgtgttacatggatagtccacattttgtctctctcttygtatttcatgttgatagaaaaaattttttttctactttttaacttatgaatggtgctgcagtaaacatttgtgtacaagtttttgtgtggacatgtgttttctcttctcttggatacgtacctaggtttagaactgccaggtcatacagtaacttcatgtttaaactttcaaggagctgccagactgtttttcaaagcagctgcgccattttacattcccacagccgtgagttgggggggggctccagtttctctgcatccctccagtacttgttattatcttttttgccatacctatcc

SEQ ID NO: 25842 - DNA, 601 bp, Human
ttcttttgcttcacaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgwttcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgc

SEQ ID NO: 25843 - DNA, 601 bp, Human
cacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttktaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataacta

SEQ ID NO: 25844 - DNA, 601 bp, Human
gtggcagatagtacctggtacatccttccccactttggggtcaatcttgacctttgatctccttggggtcataaagccacacaagtgttagtaggcatttctacagtggacacaatggatgatttagcctaaaaatctcaaaaggagcccagcatcctggcacatgcatgtaatcccagctactcaggaggctgaagcagaaggatcccttgagcccaggagttcgagactagcttgggcaacaattgagaccccatctcaaaaaaaaaaaaaaaaaaaaaaagagtggggaaaaaagaayattattaaaaaaaaaaaccttaaaaagtaatccaatctaccgatggtttattttttattttattttattttttttgagatggaatcccactctgtcacccaggctggagtgcagtggcacaatcttggctcactgcaacctccacctcctgggttcaagtgaatctcttgcctcagcctctgagtagctgggattacaggtgcccaccaccaaacctggctcttttttttttttttttgtaattttagtagagacggggcttcaccatgttggccaggctggtcttgaactcctgacctc

SEQ ID NO: 25845 - DNA, 601 bp, Human
cataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaastgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattgctttctgtagtgcttattttcctttcccaagagcagctcgttgcagtc

SEQ ID NO: 25846 - DNA, 601 bp, Human
ctaagccccgtctgcagaccccaggccccgcgcgcgtgggcagttctggggggaggcccggggcagggtcgccgagggaggggtctggggctgcaccgcggcctcgggaagggccggctgtgggcggcggcgagtgtccagggcgccgaggagtgaccaccccacccccgcagaccccagcgcctggtgaacgtggtgctcggagcccacaacgtgcggacgcaggagcccacccagcagcacttctcggtggctcaggtgtttctgaacaactacgacgcggagaacaaactgaacgacrttctcctcatccaggtgggcgggcagggccgcgagggctcggaggggcacggccagcgggctccgggacccccattcctgcagccagcattcattgagcacccactgtataccgggccacgaccgaggccgctgcagcctgggtccagtggcactggccgggggagaccgctccttggacaccaggccactcctcctccccgcctctcccccgcccgcgcctctcccccgcccgcgcctctcccctgcgcgcctctcccccgcccgcgcctctcccccgcccgcgcctctcccccgcccg

SEQ ID NO: 25847 - DNA, 601 bp, Human
ccggggcagggtcgccgagggaggggtctggggctgcaccgcggcctcgggaagggccggctgtgggcggcggcgagtgtccagggcgccgaggagtgaccaccccacccccgcagaccccagcgcctggtgaacgtggtgctcggagcccacaacgtgcggacgcaggagcccacccagcagcacttctcggtggctcaggtgtttctgaacaactacgacgcggagaacaaactgaacgacattctcctcatccaggtgggcgggcagggccgcgagggctcggaggggcacggccagmgggctccgggacccccattcctgcagccagcattcattgagcacccactgtataccgggccacgaccgaggccgctgcagcctgggtccagtggcactggccgggggagaccgctccttggacaccaggccactcctcctccccgcctctcccccgcccgcgcctctcccccgcccgcgcctctcccctgcgcgcctctcccccgcccgcgcctctcccccgcccgcgcctctcccccgcccgcgcctctcccttgcccgcccctctcccctgcccgcgcctctcccctgcatgcctctc

SEQ ID NO: 25848 - DNA, 601 bp, Human
accgcgtccagcctacaaaagaaaaatttaaaaatcaaccgggcatggtagcacacgccaagccactcatgagctgagatgggaggatcacttgagcccaggaggttgaggctgcagtgagctgtgatcatgccaccacactccagcctcggcgacagagcaagaccccatctcaaaaaaaaagtgctttgaagatgaatgaatgggccaggggcggtggctgtaatcccagcactttgggaggccgaggcgggcggatcgcctgaggtcaggagtttgagaccagcctgatcgatatggsaaaccccgtgtctactaaaaatacaaaaattagctgggcgtgacggcaggtgtctgtagtcccagctacttgggaggctgaggcagcagaattgcttgaacccaggaggcagaggttgcagtgagccgagattgtgccactgcactctagcctgggcaacaagagcgaaactccatctcaaaaaaaaaaaaaagaaaagaaagaaagaaagaaaacatgaatgaatggccgggcactatggctcacacttgtaatcccagcactttcggaggctgaggaaggcagatcacttgaggttgg

SEQ ID NO: 25849 - DNA, 601 bp, Human
gatgaatgaatgggccaggggcggtggctgtaatcccagcactttgggaggccgaggcgggcggatcgcctgaggtcaggagtttgagaccagcctgatcgatatgggaaaccccgtgtctactaaaaatacaaaaattagctgggcgtgacggcaggtgtctgtagtcccagctacttgggaggctgaggcagcagaattgcttgaacccaggaggcagaggttgcagtgagccgagattgtgccactgcactctagcctgggcaacaagagcgaaactccatctcaaaaaaaaaaaaaagaaaagaaagaaagaaagaaaacatgaatgaatggccgggcactatggctcacacttgtaatcccagcactttcggaggctgaggaaggcagatcacttgaggttgggagtttgagaccaggctggccacctcacccaatgggatggctccgggaggttccagtgagccgagatcacgccactgcattccagcctgggtggcagagcaagactccatctcaaaagaaagaaagaaggaaagaaaatgaatgaatacaatagtgacaaatgggacaaagggggtcgtggggcccaggcgga

SEQ ID NO: 25850 - DNA, 601 bp, Human
attgtgccactgcactccagcctggagaacagagcgagaccctgtctcgagagaaagacagccagctactcgggaggccgaggcaggagaatcacttgaacccgggaggcagaggttgcagtgagccgagatcacggcactgcactccagcctgggtgacagagcgagactctgtcgcaaacaaaacaaaaacaaaacaaaacaaaacaaaaggagaaagaaagaaagagatagagagagaaagaaagaagaaagaaagaaaaagagagaaagaaagaaagaaagaaagaaaaagaaagaragagagagagagagagagagagaaagaaagaaagaaagttccatattggaagcattttattctgaaacagctgtggctaccccagcccccttcctggctgcctggggccagcccgggtgactggctgtccccatcctcccgggagactcaggtggcccctgatgggtgactggccgtccccatcctccagggagactcaggtggcccctgatgggtgactggccgtccctgtcctccagggagactcaggtggccccctgatctgtgatggcatcatccaaggaatagactccttcgtga

SEQ ID NO: 25851 - DNA, 601 bp, Human
ttgtgccactgcactccagcctggagaacagagcgagaccctgtctcgagagaaagacagccagctactcgggaggccgaggcaggagaatcacttgaacccgggaggcagaggttgcagtgagccgagatcacggcactgcactccagcctgggtgacagagcgagactctgtcgcaaacaaaacaaaaacaaaacaaaacaaaacaaaaggagaaagaaagaaagagatagagagagaaagaaagaagaaagaaagaaaaagagagaaagaaagaaagaaagaaagaaaaagaaagagagagagagagagagagagagagaaagaaagaaagaaagttccatattggaagcattttattctgaaacagctgtggctaccccagcccccttcctggctgcctggggccagcccgggtgactggctgtccccatcctcccgggagactcaggtggcccctgatgggtgactggccgtccccatcctccagggagactcaggtggcccctgatgggtgactggccgtccctgtcctccagggagactcaggtggccccctgatctgtgatggcatcatccaaggaatagactccttcgtgat

SEQ ID NO: 25852 - DNA, 601 bp, Human
ttgcagtgagccgagatcacggcactgcactccagcctgggtgacagagcgagactctgtcgcaaacaaaacaaaaacaaaacaaaacaaaacaaaaggagaaagaaagaaagagatagagagagaaagaaagaagaaagaaagaaaaagagagaaagaaagaaagaaagaaagaaaaagaaagagagagagagagagagagagagagaaagaaagaaagaaagttccatattggaagcattttattctgaaacagctgtggctaccccagcccccttcctggctgcctggggccagcccrggtgactggctgtccccatcctcccgggagactcaggtggcccctgatgggtgactggccgtccccatcctccagggagactcaggtggcccctgatgggtgactggccgtccctgtcctccagggagactcaggtggccccctgatctgtgatggcatcatccaaggaatagactccttcgtgatctggggatgtgccacccgccttttccctgacttcttcacgcgggtagccctctacgtggactggatccgttccacgctgcgccgtgtggaggccaagggccgcccctgaaccgc

SEQ ID NO: 25853 - DNA, 601 bp, Human
tcctcccgggagactcaggtggcccctgatgggtgactggccgtccccatcctccagggagactcaggtggcccctgatgggtgactggccgtccctgtcctccagggagactcaggtggccccctgatctgtgatggcatcatccaaggaatagactccttcgtgatctggggatgtgccacccgccttttccctgacttcttcacgcgggtagccctctacgtggactggatccgttccacgctgcgccgtgtggaggccaagggccgcccctgaaccgcccctcccacagcgctggcygggaccccgagcctggctccaaaccctcgaggcggatctttggacagaagcagctcttccccgaacactgtggcgtccgggacggccccacccgtccccccacactccctcccacggggctccgggagacaggccggccctgcacctcaccccaccgtgacctcaataaacgttgaaactccccctggctcctgtctgtccttcccatatagggaggggagggggaactgcccaccgtgacctcaataaacgttgaaactccccctggctcctgtctgtccttcccatatagggagggaa

SEQ ID NO: 25854 - DNA, 601 bp, Human
actgcactccaggatctcaatcagcagtttgcctgtttgagaggagtgaggagagaacaaaatatgaaacaggcagaaagtacctgaaaagctcagcatttactttttggagtgagtgaccaaggatagagccgcgcccatgtgcccagtggtgggaatgggcactgccaacccactggcctcttatctaaggtgagaagtgggatctgcacagaggcccagaggcagcatggggcaggcacctggagccgcaggcatgggggacctcatcctgtctgccacaagaaaccaggtagcctcrggagagtgaaaccttaacctctctgagcctccatctcctctgctgtaaaatgggtacattcaccaataggtcctgcctcccacacagagtcacagtgagaagtaaacaaaacaaggcaagaaaaagtgctctgtcaatatggcagtgagttacagctgttctaaggggacccaagaggagtgctgcggctgggactggagggcagcggcactcaccactgttggcttgttccaaacggtctgcaggcagtgcttcactgccccgcagtcggacgccgtcttcacattctggcaccacact

SEQ ID NO: 25855 - DNA, 601 bp, Human
tcagcagagcatctcctgagagggcttgggaccgtgaggaacacacccatggcttgtcgccttagaccatgccccacattaatacgctacatttagcattatttagatgaaaaatcagtgctagcttcctcagtgtggttacagctggaaaccaattttaaatggcaactgcactccaggatctcaatcagcagtttgcctgtttgagaggagtgaggagagaacaaaatatgaaacaggcagaaagtacctgaaaagctcagcatttactttttggagtgagtgaccaaggatagagccrcgcccatgtgcccagtggtgggaatgggcactgccaacccactggcctcttatctaaggtgagaagtgggatctgcacagaggcccagaggcagcatggggcaggcacctggagccgcaggcatgggggacctcatcctgtctgccacaagaaaccaggtagcctcaggagagtgaaaccttaacctctctgagcctccatctcctctgctgtaaaatgggtacattcaccaataggtcctgcctcccacacagagtcacagtgagaagtaaacaaaacaaggcaagaaaaagtgctctg

SEQ ID NO: 25856 - DNA, 601 bp, Human
aggttgaggctgcagtgagccatgattgtgccactgcactccagcctaggtgacagagccagaccctgcctccaaaaaaaagggcaagtatggccacagaaggcagttttccagtgaataattcacaaactgtttctaaaagaatggtgctaagctttcttctcttactgaaggagcagtagtggccactgacaagttttttagaacccaaagtccactcagtcaaacacagcccgtaccacatgatggccggcacagccccaagtgagcccagggcagcagctctgtgttgagctggcayggtcagcagagcatctcctgagagggcttgggaccgtgaggaacacacccatggcttgtcgccttagaccatgccccacattaatacgctacatttagcattatttagatgaaaaatcagtgctagcttcctcagtgtggttacagctggaaaccaattttaaatggcaactgcactccaggatctcaatcagcagtttgcctgtttgagaggagtgaggagagaacaaaatatgaaacaggcagaaagtacctgaaaagctcagcatttactttttggagtgagtgaccaaggatagag

SEQ ID NO: 25857 - DNA, 601 bp, Human
tggacctaggtattagtggcatgcaatacaacatctcaattaactttgggcatttagtcccggggtcagcaaagtaggcccttcagcttatttctgtacaacccagaactcaaggaatggtgtttacattctttttacatttttaaaaagagactgtgtgacagggacagtatacggctcatataccctaaaatcttttctccttgatcctttgtggaagacatttgccaccctcaggcctacaccattcctctttagacacccggaatcacagctctcttaggaaccagtgcacgtgccygtggctcaagcaccatccccactcaccgccgctcacctcagtggcattgtccttcagcatatcaccagctgcggtgacaacgtctttgcatatgtcgcagggaagggatttctaagagaaagaatacgagaaatttgtatttgcaggacacaaattcacaccccacacagctggaactccccatggccttttcgctattctctctaaccagggatatgatcatgaccgcgctcctgtcacatcctggttctccaccctgcatgagcagcgctggggcacggcagggagggaagaggtgtg

SEQ ID NO: 25858 - DNA, 601 bp, Human
tcttcagttacttaaacacctcttctttgtcaaggcctttccaaattccacaaagctagctccgtgttctttgctaaaaacccagtctgtgacacagggtttgtgtctgtgtacaatacatacttgatgaatgaaagaccccaatacattccctgaattattccttgattataagttcacagaaataaattcacagaagtgaggttttgtgcctgctcaaaggggtcagttaaagattggacatgatgtatccaactcacatctctgaaggttatgccggtttacattccttcagcagtcygaccagtccccagcagccgcaccctcgctaaccccagggcaagttacatacagagtggcctgctgtgccaaaggagctattctggatgtcaaattgtagcaaaatgctgttgaggaattccagagctaagaacagactttccattttaatcaatctactctgggccactgcctctcctgggccccagaagcaccttcaaggaaaagcctattccccatcacttaccatttctcctttaatgatgtccaggatgacagggaggtaggagtccactatctccttgcatgaagcagacatgtt

SEQ ID NO: 25859 - DNA, 601 bp, Human
tagtgggaggtaactgaatcacgggggcgggttttcccatgctgtttagtgatagtaagtctcatgatctgatggttttataaagggcagttcccctgcacatgctctcttgcctgctgccatgtaagatgtggctttgctcctccttcaccttccaccatgattttgaggcccccccagccacgtggaactgtgagtccattaaacctttttttctttttttataaattacccagtctcgggtatgtctttattagtagcatgaaaacggactaacacaggcttcctaaatgttacctcwttcccctcagctcttctttaaaggaacaggaggccaggcgcagtggctcacacctgtaatcccagcactttgtgaggccgaggcgggcggatcgcctgaggtcaggagttcaagaccaccctggccaatgtggtaaaaccccatctctacaaaaatacaaaaattagccgggcatgatggtgggtgcctgtgatcccagctacttgggaggctgagatgggagaatcacttgaacccggaaggcagaggtgctgtcagtcaagatcgcgccattgcactccaggctgggcgacagagtga

SEQ ID NO: 25860 - DNA, 601 bp, Human
tccccacgtgtcatgtgagggacctagtgggaggtaactgaatcacgggggcgggttttcccatgctgtttagtgatagtaagtctcatgatctgatggttttataaagggcagttcccctgcacatgctctcttgcctgctgccatgtaagatgtggctttgctcctccttcaccttccaccatgattttgaggcccccccagccacgtggaactgtgagtccattaaacctttttttctttttttataaattacccagtctcgggtatgtctttattagtagcatgaaaacggactaayacaggcttcctaaatgttacctctttcccctcagctcttctttaaaggaacaggaggccaggcgcagtggctcacacctgtaatcccagcactttgtgaggccgaggcgggcggatcgcctgaggtcaggagttcaagaccaccctggccaatgtggtaaaaccccatctctacaaaaatacaaaaattagccgggcatgatggtgggtgcctgtgatcccagctacttgggaggctgagatgggagaatcacttgaacccggaaggcagaggtgctgtcagtcaagatcgcgccattgc

SEQ ID NO: 25861 - DNA, 601 bp, Human
atatagttcttgcactgaggagagagaaacagattgctaaacaaatcactgcaacaatgcaccaaaacccaaccaacaaaaaccccccagcatttccaacagtgtcaactggtgactatcaagcaagtttctaaagtagaattttatgaatgtctgctctgggccagctttaataagatgaaaatgacaatttggttactctatcatttataggaaatgtgtgcaaaagacgttttgaaaatgtttcttaagggaccttaaagattccaccctcctgtctcctttatcttataacctcacstgccccaggatcacacagcaactattcagtggcaatttggagagaaggcagctaggagatacactgcttaggaactggagcttacctttcaaagccatttacacaatctcagatggcattataaagcttaaatccagtagagtcaagttataatgatttttaactgcttattttcagacaatctagatacttccagtagactccacagaattgctccttgtatttggggagcttctacagagagaggaccaaaggtaacatgatacagcctctcagagagggttcaactgggaaacctgt

SEQ ID NO: 25862 - DNA, 601 bp, Human
cgactcaggtggcaacacagccattctcaggcctggcttagttagagagcacttgacttctacagatcccagggttaaagccagacctagaaacctgatggctggcctgaacgggcagaggcaaacaaattgccaggaagccaccagggcagtcctgggatcaagatgcttcagcctgcctctcccgtaacaggggaggtactgagattgcaagtggagagtctcctagccagaggggtcgatttagcccaattcagcactctaaggtaaaaaagggaaactaaaccatataattttcaarattcctagaaatgacgaaacctgaaaaacaaagaaaaatgctaacaaggggcctccgtgccacctaccatgtgcatcatcatctggatagcaatttcagaatactggctgatatagttcttgcactgaggagagagaaacagattgctaaacaaatcactgcaacaatgcaccaaaacccaaccaacaaaaaccccccagcatttccaacagtgtcaactggtgactatcaagcaagtttctaaagtagaattttatgaatgtctgctctgggccagctttaataagatgaaaatgacaa

SEQ ID NO: 25863 - DNA, 601 bp, Human
cctcctcagcttgcttgagtggttacagcaggtcagagagtcaatctttcaggctccttggccataagatctggctgcaactactcaactgtgctgctgtagcacaaaacaggcgtcgctgtgttccaaaaaaataccctttaagtacaaaacatgatgggccagtttgctgacccctggatcagagaacaaactcaaacgctggtatgtcaatctcaagtagtcagaaagcatgacagacagggaaaaggtgccccccacccactcagccctgccaatcagatctaaggaggcagtgccygttcccaacgtgagcaggccgccctgctctgcgtggactagcgagctcatttcctgaatgggtattcttgattctaatgaaggaatgccccctgccacctgaatgcatccaaagccagctcaggagttaccagctcaagcagcagcttcagcggacgctgctgccatgcacgggacaaactccgggaggcagtattcccccgactcaggtggcaacacagccattctcaggcctggcttagttagagagcacttgacttctacagatcccagggttaaagccagacctagaaacctgatg

SEQ ID NO: 25864 - DNA, 601 bp, Human
caatctactgcaggtggccaaatggcagcctggaaggccaatttaacaatgtatccaaagcctcatgcttccattcagcagttccagctttagttctctataataaggggaaaggcaggcatatgcatatatgtatgcatttggctataaggatattcatcttcccaaaggcaaacctgaaaacaacctagatacatccggccaccggggaccaattatgtaaattctcttctatgtacacaggtgattattctgcaagcatttagtcatttgtacaagaatattcaatggccaacatatytttaggcaaaaaatgcaaactacaaagtacaaggtagtatatatgaccccgttgatatattctgaaactccaaatgatttttgtgtgggaagtattgtccatattttcaacacatttctacacagtataacttttataatgagaaaaatattttaagttagctatgaggaagtacttcacgagattaaatcccgtcaatgcttatctttacctacttcaggtgcatgtctctgtaagctgccttttaactgtttttagaacatggtagggtgtgagtaataatcccaaataaactactcc

SEQ ID NO: 25865 - DNA, 601 bp, Human
acacttgtagcaagagccccagaaaatgcttgatgaagggtctccatactcaggagcccacactggccccgggcccacaaggctttcccacaggttagtgaccagcagcaccacagaacaagacacagggctgcccaagtaaggggggtaagggatccctgaggggtaagggatcctagggcaatctactgcaggtggccaaatggcagcctggaaggccaatttaacaatgtatccaaagcctcatgcttccattcagcagttccagctttagttctctataataaggggaaaggcaggsatatgcatatatgtatgcatttggctataaggatattcatcttcccaaaggcaaacctgaaaacaacctagatacatccggccaccggggaccaattatgtaaattctcttctatgtacacaggtgattattctgcaagcatttagtcatttgtacaagaatattcaatggccaacatatttttaggcaaaaaatgcaaactacaaagtacaaggtagtatatatgaccccgttgatatattctgaaactccaaatgatttttgtgtgggaagtattgtccatattttcaacacatttct

SEQ ID NO: 25866 - DNA, 601 bp, Human
tcctgctgttgaacaaaaaaacaggaaatcggaggtgaaaataagagaaaggaaaggacacaacagttaagaaaaattaaaacaacaatcaagcagttaaccaggtgtaaggatgtcccaagaggttcaggggaaatgctcttgcaatcagatcttagcaacctaccttgttcctgctatcttgcggacaagggggccctgaaagctttcctggccctgcagggatagaccatttgggggctgtcctgctctgtgtgcaccatctccaggtcttacacactaaatcacactcaaaacactggtagcaagagccccagaaaatgcttgatgaagggtctccatactcaggagcccacactggccccgggcccacaaggctttcccacaggttagtgaccagcagcaccacagaacaagacacagggctgcccaagtaaggggggtaagggatccctgaggggtaagggatcctagggcaatctactgcaggtggccaaatggcagcctggaaggccaatttaacaatgtatccaaagcctcatgcttccattcagcagttccagctttagttctctataataaggggaaaggcaggcatatg

SEQ ID NO: 25867 - DNA, 601 bp, Human
caatgcctacttgcgttgtgacagacacaaggtgccctggggaagccagacctacactggacttcctaactggcctacgttgaaggaggctgaggcacctcctgggccacccatggttccccattgtcacactggtggcctgcatgtacgtatgctgtatgtggactgtgaccagagcacaaggctctgctggcttcattttactggaccccgaaggggagatgagacccccaaaacctcaagggctgaattacaggggagagatgcagaagccctccccagcctattaacagagagggascctgcctctcgtaaccattccttgtatctgtcagagctaatcatgccatacccaaaaaaaaaaaaagcaaagtaactagaggaagcagcagaccactactgcaagcagattccccgacacatacctgatcctgctgttgaacaaaaaaacaggaaatcggaggtgaaaataagagaaaggaaaggacacaacagttaagaaaaattaaaacaacaatcaagcagttaaccaggtgtaaggatgtcccaagaggttcaggggaaatgctcttgcaatcagatcttagcaacctaccttgtt

SEQ ID NO: 25868 - DNA, 601 bp, Human
tgcaaccagcaactagctctgagcctgagtgcatttgccttccagcaccaaaccctaaagcagcaggaacaaaagtgctaaaaacaggacctgttaagggaaaagagctagaccatgactatggctcatcttgttttaatatcaagaaggttcgagaattaataagaccgggggagtctgaaaagtatatcccaaataccctgtctctgccacaccttaagaatgaaaaataaataaataaataaataaataataagaacgcagctgaagaaacagcaagctttttagaaaaaaaaaaaakacgccaatattcaggaggtatagggctgcttctgcctcgatcagctttgttccaactccttgaggaggcctaggtaaaaattcaggtatttcaaccaaagtcctctcccattagacttcaaaataccttcaaaaaaagctccaatgctaatcctagcagatggatgccaacgctcagaggtggcagtgttcaggacggccccgaaggacactggctcagagcaagtatggactgggcatttggttcttgtagcatgccatctgatgtggctctagatcccaaaggaccctgttacccaga

SEQ ID NO: 25869 - DNA, 601 bp, Human
gtatagactctgtatattgtggaaataaatgcaaccagcaactagctctgagcctgagtgcatttgccttccagcaccaaaccctaaagcagcaggaacaaaagtgctaaaaacaggacctgttaagggaaaagagctagaccatgactatggctcatcttgttttaatatcaagaaggttcgagaattaataagaccgggggagtctgaaaagtatatcccaaataccctgtctctgccacaccttaagaatgaaaaataaataaataaataaataaataataagaacgcagctgaagawacagcaagctttttagaaaaaaaaaaaagacgccaatattcaggaggtatagggctgcttctgcctcgatcagctttgttccaactccttgaggaggcctaggtaaaaattcaggtatttcaaccaaagtcctctcccattagacttcaaaataccttcaaaaaaagctccaatgctaatcctagcagatggatgccaacgctcagaggtggcagtgttcaggacggccccgaaggacactggctcagagcaagtatggactgggcatttggttcttgtagcatgccatctgatgtggct

SEQ ID NO: 25870 - DNA, 601 bp, Human
gggtgtgctgggaacatccagtctgtcagggccacaggatggggaaggacccagacagtgcatgtgagaaggtgaggctgaagccaggcactgcaaagtcacctttgaatggcatgctgaaaatacacaggctaatgatcccacgaacattagggtttacaaccaaggaaataaaatgttttcaaaagaactcagggtcgggggctgcattagtataggggataggataaaccagtgatcacaaactcaaagacctttaggagccaggcagggaaccgaaagaaacaagtgactcgtaagwtgtgatgtgacacagcagggagtagtgtggcattgcacagccctgaccaggacacaaagtgacaccaggtaccttaatgggctccaccagttccagggcagggatgacattcttggaggccactttggcggggaccagagtctgcatgggcatctctttcacctcatcacagaacccaaccagcgcacagatctccttgggttgctgaagagagcacagaacaaccagtcagcagcaagcctacgcccactgctcctcagtcccaatccagccagaggacagggagctggacagcaccct

SEQ ID NO: 25871 - DNA, 601 bp, Human
ccgcgtgccagagcagaggtgcagcatgctgcacaccagctcagggctgacctcctccagcaggatggacaggatggagctgccgtacgtgtccaccacctcctggcactcttccgacagggacttcggcagcttcgagcacattttgtcaaaagcgtcgagtatttctttctgaaacacacgagaggatcgtgtgagaagacgggaggccggacaagggttgggggacattctgaaaatactaacatggccaggaaatgagtcaatggtgggtgccgtttccacccacaaaaaactaccwaactacaaagcagggcaatggtgtccacctccccggacccccgccagcctagaggtcccactggtgaggattgccttccacgagatggggacatggctgtacacatgtcaaggctgggccaagccctctctcctgtgggactttcccactgggacattcaggctcgggggggcaggagaggccctccctctgccaggaggacagcatacctcagtcttgttgttgtcaatcagcttggtcacctccttcaccaggaattcacacacctcacagtaaacatcagactttgctgggacctcg

SEQ ID NO: 25872 - DNA, 601 bp, Human
ttggactccatgcccggaggcagaaacagctggttttccatcaaaatgtaccccagccttggcatacttcatcaggttctgccatgctggcctaccgcagcccagcccggggcgtacctgcttctggtaagggtctggcaggaagctgcagcctttctcaagagcagccaggatctcctgcttggtgctgtttttctccaggttgcgatccaaataacccaccagcttcttgcacacttcgcagaagccaccgtcctttggctgagtcacgtgaactacataagagggcagcgggctcaaygctggcagggccctcccagacccaagaggggcaccatcctctcccgcaccacacccagcgctcaccggtcagtgcaggcagccgcgtgccagagcagaggtgcagcatgctgcacaccagctcagggctgacctcctccagcaggatggacaggatggagctgccgtacgtgtccaccacctcctggcactcttccgacagggacttcggcagcttcgagcacattttgtcaaaagcgtcgagtatttctttctgaaacacacgagaggatcgtgtgagaagacgggaggccggacaagg

SEQ ID NO: 25873 - DNA, 601 bp, Human
acagctccaccacgctctttcagaacatcagggttgctgaggaaagcgatggggcttggggggctggctccctaccttcttggctctcccacagcagaacccagagactccaccccacggccaagtctcagagcaacccttccgggtctctgcagccccccaggttacagctgcccgagaggaccacaccacccagtgaggctcaccaagcacacgaaggaaggatccatcacctccaccaggatctcgatcagcacgggctcgtactctgccacaaactgatcacactataaaggaaagyggggacacaggtccagctctgggggtgtccgagcatagtggggcacaaaaggccaggcaggccctggatacactgttccctgagagctcctggcattcccagcccactgggtcctggggcctccctttccagacaccctatctacatttggcctctctacttcaggttgcttcccccagtggctcatcttaagccaacaaatcacctccaagtaaaacttcattggactccatgcccggaggcagaaacagctggttttccatcaaaatgtaccccagccttggcatacttcatcaggtt

SEQ ID NO: 25874 - DNA, 601 bp, Human
atcaacatccatctagcagagagaaaaggggcactgaagcagctatgtctgccaggggctaggggctcccttgcagacagcaatgctacaataaaggacacagaaatgggggaggtgggggagccctatttttataacaaagtcaaacagatctgtgcgttcattcccccagacacacaagtagaaaaaaaccaatgctgtggtttctgccaagatggaatattcctcctcctagttccacacatggcgtttgcaatgctcgacagcctggtaggagagaggaagctgagtttagtcttcrgatgaaaaactccgttcccggcccatcaatgtatcagatatcaccccaaaacaggacctgttctcttgtcctaggtcagctggatggcaccagatgctgaagacccaggacaggatctcacttaaaaacagggaacacgtggccatcagagttttgggaacttctaaggcacgagtccagagcagcagatgcctgcagcagtttgcagatgagtacccacgcaggcagggctcaggaccttcatctacctgcacccggcacccagcgtcctgctagcagcctgcacactaactcccaggc

SEQ ID NO: 25875 - DNA, 601 bp, Human
aggaacaaactcttccagctgaagggtcacagaaacattaggcccagatctggctaacagaattttattgttaaatcacagaaactttagtgcaaaacaaaaatcacgaagtccatttaatagcaacttcatgtcctgctggctttgcttgctgtctcctggcaaccagaagtggacagaagcgtgggtgcccaagtgggccacagacagcttccaacccccacaccccagcatccaatccacacccagcagacccttcggcatgccgccctctaccaggaagccagaggcctaggagctygccatccatatttatttgaaaaggtcaaaaggagcatctatgagacaagggaggggtgcaggctgaagcagcgcctcaacagccagggacatgtaggcaacacgagcaggcacagcgcggccaccactgtccacacgctcacacaagccaggcccgcagggccttcggagagctagcaggttacattcaggcagatggccctcttcccacccaaacccacagaaccccaaacaaggcatcaccaggaaagacacgggaaagccaaatcacagttgaaccagggacagagaacccttggcc

SEQ ID NO: 25876 - DNA, 601 bp, Human
cgctctggtggaaagtggcacgagatctctgatgatgccttacctgccagcctgcccagtgcagggcatcaacagcttaattaacgtctgaacagcttccaaggctctcaaataggaggccctggatagcccagggcagcaaggctgctgcagttatggtgagggccctcccctgggctcaggcctggctccaatccaattagttttcttccagattagagaagccaaattcaaatctctgtctctgtagcaccagctataaataatatgtaccctcccaccagaatggcatctagaaaascagtttcttctgtagccattaaggattattaggaaatgcctttgaaagctgaaatgccaagcattgtccctggaacaagatacctctgagctgggggtaggggcagccaagtttcaagcagaactgtgagccagaactcagcttaattaccccagcagcatccatccgggaagtaaggccgtggctccaccaggaacatccagctctaactccatgtgacctttctgttcctcgagcccagtgcaacccccactggattcagggtttccacacctaatagaagtcccttcctaaactgtt

SEQ ID NO: 25877 - DNA, 601 bp, Human
ggctccaccaggaacatccagctctaactccatgtgacctttctgttcctcgagcccagtgcaacccccactggattcagggtttccacacctaatagaagtcccttcctaaactgttaccacatagggtcagggccccccaggccccaggtttagctgagaccaggttggtctcctgatagcgaaccaacagctactgccgtgtcattgaaaagtggcagcagagagtctgcatgtcaatcatccctttgaaatgaaaggccttcctggcagggacatggtgctatctttggccctaagrtgtgtaattgagaatattcaaacagggcactctgttcctttggctgaaccagggtgagtggccctgagtgggaagctgtgggcaagttagtgtggcacaaggaaccatcattcacaggctgatatttttctcccagtgagcatgagccgcaggggtgcagccactgcccagcccccaggggaggggttgacactggtacagcagccagggcaagacaaccgattggagttctgtagggcctgacacctgagctttctgactctgcctgggagaggctgggcacagcagggatgaaggagg

SEQ ID NO: 25878 - DNA, 601 bp, Human
ggtttagctgagaccaggttggtctcctgatagcgaaccaacagctactgccgtgtcattgaaaagtggcagcagagagtctgcatgtcaatcatccctttgaaatgaaaggccttcctggcagggacatggtgctatctttggccctaaggtgtgtaattgagaatattcaaacagggcactctgttcctttggctgaaccagggtgagtggccctgagtgggaagctgtgggcaagttagtgtggcacaaggaaccatcattcacaggctgatatttttctcccagtgagcatgagccrcaggggtgcagccactgcccagcccccaggggaggggttgacactggtacagcagccagggcaagacaaccgattggagttctgtagggcctgacacctgagctttctgactctgcctgggagaggctgggcacagcagggatgaaggaggcggcctaggcccaggaggtcagaggctcctcagcgccaccccatgtcacgcagcgcacgcagcctggatgcctcaggtgagtcaccatctcctgaactgcctggctggctgtgggaggggcactgggagggccctcgctgggctcctca

SEQ ID NO: 25879 - DNA, 601 bp, Human
ggctggagcctgtccttgcactctgtccatgaagagctgaaaagcgagggcccatgcgaagcagggggaggagagagtgcttttggtatgatggggacaggcccacacacaagtctggcctccctgagtggcatgtgtgactgtccttttcttctgtctccagccccttgtcactatgagcaaacagtgagcttctaccagcccagcctgtttagcaaacacctgggccctgaagggcgggccagctgtgtcaggtccccatcaggttggagccagagcccagctggaaggaaacaaaggygtgggagagggaggggctggttggctgcaggttctggctggagcttggcaacctagaggctggaacttccgggtcaaggggcttctccgtgggcctcaggagtgcccttcagtgggaatagaatgggactttttatggccgaaggcctggccggagcaaggggtacacagcacagcagcataggggtggggaagggcaggtcttctctcttcgaggctctgaggagatcagtgatgtggtttcaaatccaggcctctctgcttactgtgtgtggcttggaaagtcacttatcagtgcccc

SEQ ID NO: 25880 - DNA, 601 bp, Human
aggggtggggaagggcaggtcttctctcttcgaggctctgaggagatcagtgatgtggtttcaaatccaggcctctctgcttactgtgtgtggcttggaaagtcacttatcagtgccccagccgtgggccccagtttccttgtctgtaaacatgggatgataacatccacctaagaggaccgttgccaagtgtgaagtgaggtctcccatatgcaagtgccaccatgctagtgtgatttggacttcagtaaaagttagtttgcttccttcccgttgtcccatctcactcctgggccacccrtggggctgctggtagctggtgtgtggctgctgctggactgtgtggcagtccatccatctgtcagcagccactgcgggcctacttgctgggtgcccagcaccgcactcaccactgcaggcgtggccaggagcgtgagatccccagagcccatggccagtgagaggcggccagggataggtacccagggaatgccacaggagtttgctgggctcacggagctctttcactggtcagagaggagtgtgtgtaggagaggacttctacttggtgttgaaggacagatggggtttggctgggaga

SEQ ID NO: 25881 - DNA, 601 bp, Human
agcaaaatgttcagaccagaactgtgccttagaaaactaaccttagtagcagtgaggaagatagctggagtatgaaaagattgagcatactaaaacttctgagagcatgaaaggtggggactgatgcagtgacccaaaaatacgtcatcatctgtcgggcctggtctagacaaggcaggtggagaaggagaggacttttgaagaggtaacacggaggtcaaattcataggacttgtcagctaactggatgacgggtttttgaagagggggatggtgtgggtggcagggagggggactggttgctgggtgaggtaaacacaagtggcaaagcaggttgagagaggggtgattcagtcttggggatggtgggggaggggctgtatccagacacctgagtggaggccaccaggaagaaccaggagtctaggacaggtgaggtctgagatgcagagggttcagatggcaaatcatttggacaaagtcattggctttggcaagggagaaatgataggtttgttcattgatccctttatccactcatcatttagaagcaagattgagcaacttctttgtgacagtgccttcaacagctttttaaaca

SEQ ID NO: 25882 - DNA, 601 bp, Human
actgtgccttagaaaactaaccttagtagcagtgaggaagatagctggagtatgaaaagattgagcatactaaaacttctgagagcatgaaaggtggggactgatgcagtgacccaaaaatacgtcatcatctgtcgggcctggtctagacaaggcaggtggagaaggagaggacttttgaagaggtaacacggaggtcaaattcataggacttgtcagctaactggatgacgggtttttgaagagggggatggtgtgggtggcagggagggggactggttgctgggtgaggtaaacacargtggcaaagcaggttgagagaggggtgattcagtcttggggatggtgggggaggggctgtatccagacacctgagtggaggccaccaggaagaaccaggagtctaggacaggtgaggtctgagatgcagagggttcagatggcaaatcatttggacaaagtcattggctttggcaagggagaaatgataggtttgttcattgatccctttatccactcatcatttagaagcaagattgagcaacttctttgtgacagtgccttcaacagctttttaaacagaagagtgtcaggacctgac

SEQ ID NO: 25883 - DNA, 601 bp, Human
tgagcatactaaaacttctgagagcatgaaaggtggggactgatgcagtgacccaaaaatacgtcatcatctgtcgggcctggtctagacaaggcaggtggagaaggagaggacttttgaagaggtaacacggaggtcaaattcataggacttgtcagctaactggatgacgggtttttgaagagggggatggtgtgggtggcagggagggggactggttgctgggtgaggtaaacacaagtggcaaagcaggttgagagaggggtgattcagtcttggggatggtgggggaggggctgtrtccagacacctgagtggaggccaccaggaagaaccaggagtctaggacaggtgaggtctgagatgcagagggttcagatggcaaatcatttggacaaagtcattggctttggcaagggagaaatgataggtttgttcattgatccctttatccactcatcatttagaagcaagattgagcaacttctttgtgacagtgccttcaacagctttttaaacagaagagtgtcaggacctgacatgtgtctgtaggagagaccggggtaggagatgggggtggacagtgggcacaggagagcag

SEQ ID NO: 25884 - DNA, 601 bp, Human
gcaagggggccaagtaaggctggtcagtgtcaagccaaccaggggagggtggcaacgtgaaagcaacaaaggagagcaaccacaaaatgtggcacgaaagttgacaaatgctcgccatgggaagacaaagcaggcagtaataacatctgtaccagagagaggccaggagggcggggagagatcactggagtggctgaagagaaggtcaccaaggagcttccctagaacggcttcaactgagggttgtggggatggccagagagcagtctgaggagcaagggcagacgctgttccaggaacrttggcagcatggggacacgggaaggaaatgcggttactcgagaaggaaggagggcctctcttcatccccatcctccttcccttcccatcctttccttttttaagggttagactagaaggattcgaatctatctgtaggcctagttgggcagctgtagtagaaaagaggaatgatgagagatggctaggaagaagttcctgaagagcgtgaggcgtgggagccagaactcggaggagacattggcctgggaggtgggtgcgaagcttctgaggacagaagggaacagctgaggtgcagcag

SEQ ID NO: 25885 - DNA, 601 bp, Human
accagagagaggccaggagggcggggagagatcactggagtggctgaagagaaggtcaccaaggagcttccctagaacggcttcaactgagggttgtggggatggccagagagcagtctgaggagcaagggcagacgctgttccaggaacattggcagcatggggacacgggaaggaaatgcggttactcgagaaggaaggagggcctctcttcatccccatcctccttcccttcccatcctttccttttttaagggttagactagaaggattcgaatctatctgtaggcctagttgggcrgctgtagtagaaaagaggaatgatgagagatggctaggaagaagttcctgaagagcgtgaggcgtgggagccagaactcggaggagacattggcctgggaggtgggtgcgaagcttctgaggacagaagggaacagctgaggtgcagcagggccttcccttcagcctgcatcctggggagaggctcttggggtccctgcatccccctgggccactctggctgaccgaggttcctggtcagactccaagctgcttgtggctgctgggatcttgaggggttgcctttttaaaatttttttat

SEQ ID NO: 25886 - DNA, 601 bp, Human
gggcggggagagatcactggagtggctgaagagaaggtcaccaaggagcttccctagaacggcttcaactgagggttgtggggatggccagagagcagtctgaggagcaagggcagacgctgttccaggaacattggcagcatggggacacgggaaggaaatgcggttactcgagaaggaaggagggcctctcttcatccccatcctccttcccttcccatcctttccttttttaagggttagactagaaggattcgaatctatctgtaggcctagttgggcagctgtagtagaaaagagkaatgatgagagatggctaggaagaagttcctgaagagcgtgaggcgtgggagccagaactcggaggagacattggcctgggaggtgggtgcgaagcttctgaggacagaagggaacagctgaggtgcagcagggccttcccttcagcctgcatcctggggagaggctcttggggtccctgcatccccctgggccactctggctgaccgaggttcctggtcagactccaagctgcttgtggctgctgggatcttgaggggttgcctttttaaaatttttttattttttgagacagagtctc

SEQ ID NO: 25887 - DNA, 601 bp, Human
tgccttttggtagaagtaatgcaagcctcttttaatatgggcacctgctcagatgtgggtgacctgatggttgatgacaaaaaaatgaccatattacttttcagaggtgaaaataacagctgtagctgtgggaaagccacccatctcaaggcttcatgatgtcagtgttgttctcatatatgtagaaaccagtcaaagtgtaacctgtctgtaaataaacaagagcaccatcaccatgaataactgcagcgcaacatcaccctcgggtttcttttttgtttttaaattttatttatttttmatttttaactttttgtagagatggggcctcactgtgttgcctagggtggtcttgaactccagggttcaagtgatcctccctcctaggtctcccaaagtgctgggattacaggtgcgagccactgcacctgacctggtttattatttgtcggcaaaccaaaccccaaatagatgtatcttcaattttgttcatgaaaaagtgtcagtccataaatgccgtaacttacattatcaatacgatctcctaatcaaggaaatttatgatcattttcttaagtattaggataacataattttaata

SEQ ID NO: 25888 - DNA, 601 bp, Human
aagccacccatctcaaggcttcatgatgtcagtgttgttctcatatatgtagaaaccagtcaaagtgtaacctgtctgtaaataaacaagagcaccatcaccatgaataactgcagcgcaacatcaccctcgggtttcttttttgtttttaaattttatttatttttaatttttaactttttgtagagatggggcctcactgtgttgcctagggtggtcttgaactccagggttcaagtgatcctccctcctaggtctcccaaagtgctgggattacaggtgcgagccactgcacctgacytggtttattatttgtcggcaaaccaaaccccaaatagatgtatcttcaattttgttcatgaaaaagtgtcagtccataaatgccgtaacttacattatcaatacgatctcctaatcaaggaaatttatgatcattttcttaagtattaggataacataattttaataggccaataaaattaaataactgtaaagaacgctatttaaatatgtgtggtatgtataagtggatggttttcatccacaataaaagtttatattaatgttttgaaaagagagagtaaagcagtgagcaggagta

SEQ ID NO: 25889 - DNA, 601 bp, Human
cctttgttcctcatgtgggagagggtagcaggtggcttccagattttctgcctacaaatgtctgtaacaaacaagtcctagctgatcatggttcctagtgtttaaaaggtatgaaggagggaaggggatgctggtggtgggtgatgatggtacagttaacatgtaccagttccttgatgtatgcactaggtaccatgctaagcactttagatgtatggtcatggaatcctcacaagtcttcaaggtagatggtgtcatcctcatttcaaagatgagaacacaaaggttcggagcagttgaygcgttgcccaaggtcacacagcaagagcaaagcagaaccagtccttgaacgaggtctgccagagcccggggcctgttctcagctgccagcttgggataaggccaaacagctctatcccaaggagggagaaggaaaccagtgtttggctgttggaggcagaagtccaaggtagtgaaaagtggccccgaggctagagtcccacaggaagaagcctcttcccagcctgcaggctctcccctaggcagttcagtggccggcttccaggacaactcaactgtgttccctcctgaatcggaagag

SEQ ID NO: 25890 - DNA, 601 bp, Human
gctggagctactccagaaccaagtggcagctgatggctggtggtgggcttcctatcgcacaggtcctgctgaagagccctgtttttctggggctgactgatggtgcaagggtccatcccaccaggtgggaaggaaaagatggatggggcttctccaggttgtacctgctgctgtttcttgctaccttccctcaaaatgtttgcgggacgcagcaggatttcacatgctctatccccgggaaggccactgagagtcagaatggcatgaggaggaaaaaggagatcaaatattttgagggaamttggggggaggtggagagaaggtggtcatgcctggggcatgggggtggcccctggctctctgtatggcagagcatcaggtgcagtggccggtgctctgtatctgtcagccaggcaagcttcccagcttgcctcttttccaggaaaatgaagacagtaaggtgcatggtcttgcccatactttcccaaagaagagacagctagattaaaaacactaggccccccacttctggatcagaactcaagataggataatgcccacctcggaggactcttgccaagaaggaacaaatccatgtacc

SEQ ID NO: 25891 - DNA, 601 bp, Human
tctgtatggcagagcatcaggtgcagtggccggtgctctgtatctgtcagccaggcaagcttcccagcttgcctcttttccaggaaaatgaagacagtaaggtgcatggtcttgcccatactttcccaaagaagagacagctagattaaaaacactaggccccccacttctggatcagaactcaagataggataatgcccacctcggaggactcttgccaagaaggaacaaatccatgtaccagcaggagctgctagagggagcccagccttgtacacagtggaggccccaggtgctaagraggcctcacaaggccgctgttggtgcgcagaggctctcttaaaagtttgtgtgcaggtgctctcagagacatggccctgctgagagattgtgtttccaagtgtcagttggggttgaatccaactcacaatgactcctttgtcatctttcccaattttccatcctccagagggcctccaggggaccctggatacagcatagtctttatgtggtttggggttccacagccagaccctgtctctccagaaaacacccatgtcagcctgtgccctggtccttgctgcttctatttctcaatgac

SEQ ID NO: 25892 - DNA, 601 bp, Human
atccaactcacaatgactcctttgtcatctttcccaattttccatcctccagagggcctccaggggaccctggatacagcatagtctttatgtggtttggggttccacagccagaccctgtctctccagaaaacacccatgtcagcctgtgccctggtccttgctgcttctatttctcaatgactgtgtttccatctccctccttacacacacacgtacatcctcatggcacattttcagccctggggtatctcaaaagcaacagctcaagcaatcctgccaaggtctctcaaagtgatcyttttttttttttttttttggaagacagaatctcgctctgttgcccaggctgggagtgcagcggcacgatcttggctcactgcaacctccacctcctgggttcaagcaattctgccgcctcagcctcccgagtagctgggactacaggcgcctgccaccaagcctggctaattttttgtatttttagtagagatggggtttcaccatgttgcccagggtggtctcaaactcctcagctcaggcaatcggcctgccttggcctcccaaagtactgggattacaggcataagccactgcaccc

SEQ ID NO: 25893 - DNA, 601 bp, Human
gagagagccccagtttgggagcagggcttttcctgccaattctagggtcttggctgcctgggtcttttagcctggcattggcctgacccctgctgggagccatgggaagtgcaggagctggacctttgcgtttcaaaaccttgctgtttattcttatctccttcacggaaatcaaatataacacctgctgttattgagcattggaccagattgctgacacacgtagctgctaatccccaaaattaatgaaggtgatcaaatagcatgcccaagatcacacagctagtaagttggtagaagrgggctttgaaccaggtccgtctggctccaaagccaatgttgtttccacagtgtcccactccatgggactggagtgaaatatttgggagggagggaacattagcgacgccctagccccaccggaggaaatggggtcctttacccagatgccggtctgtctcatgtggggcatccgtgagccagctccccagcgcttccagctgcagtgccctgtctagaaagcagggatgattacgtttctccgtagtattgttgggaaggtcaaatgcagcagtttatgtaaagggcctggattgcagct

SEQ ID NO: 25894 - DNA, 601 bp, Human
gatttcacttctaagcctcagtttctccagctacaagataggagctttatatttatttatttattttgatttttgtgagacggagtttcactcttgttgcccaggctggagtgcaatggcactgtcttggctcgctgcaacctccacctcccaggttcaagcatttctccttcctcagcctcccaattagctgggattacaggcatgcaccaccatgcctggctaattttgtattttcagtagagacgtggtttcaccattttggtcaggctggtctcaaactcctgacctcaggagatcygcccacctcagcctcccataatgctgggattacagacgtgagccactgcgcccaaccaggaactttatttttattattttgagatggagtctcgctctgtcgcccaggcgggagtgcagtggcacaatcttggctcactgcaagctccacctgtcaggttcatgccattctcctgcctcagcctcctgagtagctgggactacaggcgcccgccaccacaccaggctaatttttttatatttttagtagagacggggtttcaccatgttggtaaggatggtcttgatctcctgaccttgt

SEQ ID NO: 25895 - DNA, 601 bp, Human
gtggtttcaccattttggtcaggctggtctcaaactcctgacctcaggagatccgcccacctcagcctcccataatgctgggattacagacgtgagccactgcgcccaaccaggaactttatttttattattttgagatggagtctcgctctgtcgcccaggcgggagtgcagtggcacaatcttggctcactgcaagctccacctgtcaggttcatgccattctcctgcctcagcctcctgagtagctgggactacaggcgcccgccaccacaccaggctaatttttttatatttttagkagagacggggtttcaccatgttggtaaggatggtcttgatctcctgaccttgtgatctgaccaccttggcctcccaaaatgctggaattacaggtgtgagccaccacgcccggcctgggagctttatttttaagtaaacacttatgtacctactatgtgctagtcactgttatggcattttaataacattaaccccttcagttctcagaacagcccccctgaagttggtggtattattattattgttgttattattattttgcaagtaaggaaatttggtcagggaaaggtttggtgcag

SEQ ID NO: 25896 - DNA, 601 bp, Human
ggtctcaaactcctgacctcaggagatccgcccacctcagcctcccataatgctgggattacagacgtgagccactgcgcccaaccaggaactttatttttattattttgagatggagtctcgctctgtcgcccaggcgggagtgcagtggcacaatcttggctcactgcaagctccacctgtcaggttcatgccattctcctgcctcagcctcctgagtagctgggactacaggcgcccgccaccacaccaggctaatttttttatatttttagtagagacggggtttcaccatgttggkaaggatggtcttgatctcctgaccttgtgatctgaccaccttggcctcccaaaatgctggaattacaggtgtgagccaccacgcccggcctgggagctttatttttaagtaaacacttatgtacctactatgtgctagtcactgttatggcattttaataacattaaccccttcagttctcagaacagcccccctgaagttggtggtattattattattgttgttattattattttgcaagtaaggaaatttggtcagggaaaggtttggtgcagtggggccaggattccaatgcaggca

SEQ ID NO: 25897 - DNA, 601 bp, Human
tcgctctgtcgcccaggcgggagtgcagtggcacaatcttggctcactgcaagctccacctgtcaggttcatgccattctcctgcctcagcctcctgagtagctgggactacaggcgcccgccaccacaccaggctaatttttttatatttttagtagagacggggtttcaccatgttggtaaggatggtcttgatctcctgaccttgtgatctgaccaccttggcctcccaaaatgctggaattacaggtgtgagccaccacgcccggcctgggagctttatttttaagtaaacacttaygtacctactatgtgctagtcactgttatggcattttaataacattaaccccttcagttctcagaacagcccccctgaagttggtggtattattattattgttgttattattattttgcaagtaaggaaatttggtcagggaaaggtttggtgcagtggggccaggattccaatgcaggcaactgtagtgtacggtgccgcatctcttagtctcctgagaatagctgctatttcagtgtttctctgaagataaatgaggcaatctgtgtggacactacataatacctatgcaatacaggtt

SEQ ID NO: 25898 - DNA, 601 bp, Human
gaggccaatgtggtgagaaagtttggtgtcaccgacttcccctcttgctacctgctgttccggaatggctctgtctcccgagtccccgtgtgagtatcctgtctcctggcgtcccctctcgtccctccctgtgctcatccttccttcttgcccagaggggctgcccgcctttcacagtggccaacatgttctttctgaagagccccctcaggagaagctgcagtctgctgtctgcggggccagcgcctccaccgtcaggagcctgggcctgaaacgctaaccctgttccgcagctcagagwcctcaaaggcctcagccccccgcacccagtgtcgcctgcaccctcattacgtccccaccacagccctggccctcttccccaccctcttctgttcgcaggcagactcattggcaggctacaggcctggcaagcactcgtatatgcctgaccctccctccctttggttttctaattgcagaaaagttcattagcagccagacaatagccagttccaaaatgccgagagaaaacaatcaggccagcctcagcccctctgccaggctcctgctgctgaatggcccgttaatggcaccagatggt

SEQ ID NO: 25899 - DNA, 601 bp, Human
gaaaaaagaaagaaaccaaaaagaccgtaaaaagatttagagaattctggaggctctttgtcattgttgctacctgttttttgaaaaatcccatatcaaactccctggacttcttagggggtaatgtcacttatagtacctcagggcgagcttatggatgggcagctgccatattgaatctcggggtccttggggaagggagtcacactccgccgttcctgtctgtgggcaccgggctgtcccgtgcctttccatgccctgcctggagccagagggccactgggggaattcttgggcccarttgccttaccaggtgaggtttgacatcaggctggtgtcagagaggctttccagagcatgtgcagtgattagaagggttacagcgaggcctgggtgccgtcttctggcctcacagaggacaagatggaatctcgttcacatatttaataaaccttcctgtccgatgagccacccttcttcctcttctgacattggttagctctaatcttgttctctgcacttactgcctctcctccctggttctgtgccctcacaggctcatggaatccaggtccttctataccgcttacctgcagagact

SEQ ID NO: 25900 - DNA, 601 bp, Human
cttgctcattcttcttccttgtcatatgattagtgtgtacattctgagccaggctgtcccccaccctggggtctggccatgctcagggaccttcaatgtgtgggagcggcatttagctgcggtgcctctggtgtctgttgcggggccggggctgactggggaatgaacaccttccatgcccacgctccttcagcttaactctgctcacaaatggggaatctgcgtgcaaggacactctgaggcctccagaccaacttcccacccaagcaattatttgtgcagtcaatatttttgagtactyactatgtgctaggcactgtggcagcagatatgtacaggcagatgcattctctgcttgtgcagaccctacagcatcccttctaggaaggcacccaacctcacttgaatgcctgtggtgtcagtgagttcactgccttttcaggtcacctgtgtgtgtgtccacagtcgtaagcatgagagagctgctcttctctctgaggctcgttgccttttctgttgtggttgggcagtgagacagagctgtagacctcctgcactggtaccagctgcataccaggtggaaatgtctgaccagggagct

SEQ ID NO: 25901 - DNA, 601 bp, Human
gtctggccatgctcagggaccttcaatgtgtgggagcggcatttagctgcggtgcctctggtgtctgttgcggggccggggctgactggggaatgaacaccttccatgcccacgctccttcagcttaactctgctcacaaatggggaatctgcgtgcaaggacactctgaggcctccagaccaacttcccacccaagcaattatttgtgcagtcaatatttttgagtactcactatgtgctaggcactgtggcagcagatatgtacaggcagatgcattctctgcttgtgcagaccctacrgcatcccttctaggaaggcacccaacctcacttgaatgcctgtggtgtcagtgagttcactgccttttcaggtcacctgtgtgtgtgtccacagtcgtaagcatgagagagctgctcttctctctgaggctcgttgccttttctgttgtggttgggcagtgagacagagctgtagacctcctgcactggtaccagctgcataccaggtggaaatgtctgaccagggagctcagagctggccaggacggtgcccctcacaaggggatgcacgagacagtgggggaaaggtgattgcaagaa

SEQ ID NO: 25902 - DNA, 601 bp, Human
ggctcgttgccttttctgttgtggttgggcagtgagacagagctgtagacctcctgcactggtaccagctgcataccaggtggaaatgtctgaccagggagctcagagctggccaggacggtgcccctcacaaggggatgcacgagacagtgggggaaaggtgattgcaagaaggactttgcatcctagcatgagggactttaagggtggaaagtgccaaatggagagacttttagtagatcaagggagaaggaaagagagagtgaggggtggtgtaatcattatgatcattccgtcattrtgaatgatcatcataatcattcgatcattacagttatgcaaaccattgacgttcttgtaatagcttgggctggtgtatgtgccaggctctgtgctgggcaccttccctgtgttacctcattcagtcatggggccacttctggaggcagggcacaggaatggagaggtaaactgaggcccaaggacagcaaagtggaacacagaggagaccttgccctgaggaggagcataggcagccacaatgcgtaccccattagttgaccttattggctctttccaacctcaggaggttgtcatggag

SEQ ID NO: 25903 - DNA, 601 bp, Human
tggccaggacggtgcccctcacaaggggatgcacgagacagtgggggaaaggtgattgcaagaaggactttgcatcctagcatgagggactttaagggtggaaagtgccaaatggagagacttttagtagatcaagggagaaggaaagagagagtgaggggtggtgtaatcattatgatcattccgtcattatgaatgatcatcataatcattcgatcattacagttatgcaaaccattgacgttcttgtaatagcttgggctggtgtatgtgccaggctctgtgctgggcaccttccctrtgttacctcattcagtcatggggccacttctggaggcagggcacaggaatggagaggtaaactgaggcccaaggacagcaaagtggaacacagaggagaccttgccctgaggaggagcataggcagccacaatgcgtaccccattagttgaccttattggctctttccaacctcaggaggttgtcatggaggggtcaggagcaagtcatgtgttttacaggtgagctgactgaggcccaggaaagtcaactgagttgcccaagctcacaaactagctcacagtcaaactgaggtcagaac

SEQ ID NO: 25904 - DNA, 601 bp, Human
gtcaactgagttgcccaagctcacaaactagctcacagtcaaactgaggtcagaacccaggtctcaagagacaggggaagaggcacccaactttcctggcccctgccatcagaaccctgagcctggaccccagcatgatgggcctggggccagcatggagcctccggcccttccatgagggctgcggagaggtgtgagatgggcccacctaagatgtgaggtccggcagctgtgagcacatcagccctgaaagaaatacaggccctgcttcccctcctgcccccagtcgccatttcccagmcttggtgggcagctaaaccctggtctttcagagagggcccagtttttccagagccatgtcgtgtgtatgaacctgctggtctgattatgtctagtggtcttggctcggagctggcctgattagtgagttgcaggaggggtggctgtgggcctggagagagaaaactcctactccctgccaggagctgctgagagttttttacatttgtgcttttatttgatcctctcagcaacttacctgtgagcaatgtgttattcatatcttacagatgaggaattgaggctcagagaaattaggtaa

SEQ ID NO: 25905 - DNA, 601 bp, Human
tctcaagagacaggggaagaggcacccaactttcctggcccctgccatcagaaccctgagcctggaccccagcatgatgggcctggggccagcatggagcctccggcccttccatgagggctgcggagaggtgtgagatgggcccacctaagatgtgaggtccggcagctgtgagcacatcagccctgaaagaaatacaggccctgcttcccctcctgcccccagtcgccatttcccagacttggtgggcagctaaaccctggtctttcagagagggcccagtttttccagagccatgtcrtgtgtatgaacctgctggtctgattatgtctagtggtcttggctcggagctggcctgattagtgagttgcaggaggggtggctgtgggcctggagagagaaaactcctactccctgccaggagctgctgagagttttttacatttgtgcttttatttgatcctctcagcaacttacctgtgagcaatgtgttattcatatcttacagatgaggaattgaggctcagagaaattaggtaatttacccaaggtcacacagcacatttctggcagaagccagtggtaacttacaagactctgt

SEQ ID NO: 25906 - DNA, 601 bp, Human
tgaccatcagcagtgccccttctcttctctccctttagccctggatgctccttgcagcccctgcaccatggttaatacttctttctctctctatctccctctgggtcctcagctccaagatctacatggctgacctggaatctgcactgcactacatcctgcggatagaagtgggcaggttcccggtcctggaagggcagcgcctggtggccctgaaaaagtttgtggcagtgctggccaaggtgagcagggccatggcttcccttgtctgtgcaattctacggatggtcagtgtgcgttsctgtaagctgggcaccccgtcagcccctccctccagaagcccatggtctggctggacacctggacccacagctctccctgtccaccataggtgataccctccagcctcagccataccccacaccagccccacactgccagggacaaccctgccccatgcagcagtgtgggtgggacacagggcccgtgccccccacctggggatatttccagctgattcagtgactgtggctctgcctgcctgagtcctcagtcagagccccagtgtggcttcccacccctttctgtggtcactgggaaa

SEQ ID NO: 25907 - DNA, 601 bp, Human
cctttggttccagatcctggccattgcgtccctgctggaaaccctggactctgctgctcagtactgctgagtcagatgtggctctgggcgcttcgggtttggccgctggctcagcctcccttggccctggggcccggatctgagcccaccctcctcagtgtgggtctgcaggaagctggggctgccctcgggtgatttgtgcctctccttgggaacttcctgccagcctgatccctccttcccacctccctgtcctggccccctggcttggtcacatgaatgcgtggtgacactgagaggrcctgacagggacatttcagcctaaggcaggacagtcgttggcccctcactgaagtcccatgcaaaatgagcccttgttcttcagtccattgccataatagagacctttcctccaaggctgagagctgtttggtcctcacagtgcagaggcctggggttgacaacctagagacttagaggggaaaaatccagaactgacccacgtacagtccctcctcctgacccatgagggagagcacccagcatgctttcccggcatgcctcagacaccccaccaccctagtccagtactctccaaagg

SEQ ID NO: 25908 - DNA, 601 bp, Human
tttgtgcctctccttgggaacttcctgccagcctgatccctccttcccacctccctgtcctggccccctggcttggtcacatgaatgcgtggtgacactgagagggcctgacagggacatttcagcctaaggcaggacagtcgttggcccctcactgaagtcccatgcaaaatgagcccttgttcttcagtccattgccataatagagacctttcctccaaggctgagagctgtttggtcctcacagtgcagaggcctggggttgacaacctagagacttagaggggaaaaatccagaackgacccacgtacagtccctcctcctgacccatgagggagagcacccagcatgctttcccggcatgcctcagacaccccaccaccctagtccagtactctccaaaggagtcaccccaggaagatcggcttgtgtgtcactcgcatctctcagctgtgctcaaacctgctattttctttgtccccagtggggctgtttgcagccggtatgggggaaaagaatgagatacagaaaagtccctgagctgggcagaggcatcaccccctctgtgcctgctgagtctctgccttcagcaagggctgg

SEQ ID NO: 25909 - DNA, 601 bp, Human
agcctaaggcaggacagtcgttggcccctcactgaagtcccatgcaaaatgagcccttgttcttcagtccattgccataatagagacctttcctccaaggctgagagctgtttggtcctcacagtgcagaggcctggggttgacaacctagagacttagaggggaaaaatccagaactgacccacgtacagtccctcctcctgacccatgagggagagcacccagcatgctttcccggcatgcctcagacaccccaccaccctagtccagtactctccaaaggagtcaccccaggaagatyggcttgtgtgtcactcgcatctctcagctgtgctcaaacctgctattttctttgtccccagtggggctgtttgcagccggtatgggggaaaagaatgagatacagaaaagtccctgagctgggcagaggcatcaccccctctgtgcctgctgagtctctgccttcagcaagggctgggaatgagcttgagatgaaggtgcctgccctgccagagccagggccctcggggtagggctggcagtggggtggaggacagagggaagccaggtatgccccgcagtagcagcagaggcatcgggg

SEQ ID NO: 25910 - DNA, 601 bp, Human
gggcagaggcatcaccccctctgtgcctgctgagtctctgccttcagcaagggctgggaatgagcttgagatgaaggtgcctgccctgccagagccagggccctcggggtagggctggcagtggggtggaggacagagggaagccaggtatgccccgcagtagcagcagaggcatcgggggcatgggcctggagaccctctgtttgggttttgcccgcacatcccctggggtctgtagagtattctggcccttgccttgcttgggtagcttcttcctgaatagtagtatcctagcagctaycatttcttcagccctgccggtgcctgcagtgttctttgtatattagctcctcattctgtttctcagagaagattccacagcatggcttctagtatgatctccgtttcatagaaggtgaaacaaagccccagagaactaaagcaccttgccagggtcttccagctagtgaggggctgggcagggagccacacccactcgcatccagcccatgcccattaccaccaagtgcatggtgctcacaggcccgaacccctaagggtgccagtggacactgctggctccccctggctagctgccagc

SEQ ID NO: 25911 - DNA, 601 bp, Human
ttgccttgcttgggtagcttcttcctgaatagtagtatcctagcagctatcatttcttcagccctgccggtgcctgcagtgttctttgtatattagctcctcattctgtttctcagagaagattccacagcatggcttctagtatgatctccgtttcatagaaggtgaaacaaagccccagagaactaaagcaccttgccagggtcttccagctagtgaggggctgggcagggagccacacccactcgcatccagcccatgcccattaccaccaagtgcatggtgctcacaggcccgaacscctaagggtgccagtggacactgctggctccccctggctagctgccagccctgcaggtgcccggtcagtcaggaggccctctgcatgtcctgccggtgccttcccacccggcctctcccagcctgtgctccctcctgtgagcagctggtaggagtggccactgggtggcgtgtgggcaccagggtttccttgctcccagttgtccagagctccttaattcatccatccttctggcactgtcgccttagaaggcggaagtttctaagtcaggatgatggcaaaggtcagtgagaaatgctg

SEQ ID NO: 25912 - DNA, 601 bp, Human
cagggagccacacccactcgcatccagcccatgcccattaccaccaagtgcatggtgctcacaggcccgaacccctaagggtgccagtggacactgctggctccccctggctagctgccagccctgcaggtgcccggtcagtcaggaggccctctgcatgtcctgccggtgccttcccacccggcctctcccagcctgtgctccctcctgtgagcagctggtaggagtggccactgggtggcgtgtgggcaccagggtttccttgctcccagttgtccagagctccttaattcatccatcyttctggcactgtcgccttagaaggcggaagtttctaagtcaggatgatggcaaaggtcagtgagaaatgctgacttcaagctgtaaatttgtgtgtgagttccagaggcccgtgtgggctcaccaggagggcacgtgtcaaagcgtggtcttttccggccatttctcactctgggggaaggtgtccagcccaacgtttgataggaatatttaatggctttctcagaggaatggatctgttagcaggttttcctgttcagttaccattcgtgtctccagtatccttctcctctcaaatgtt

SEQ ID NO: 25913 - DNA, 601 bp, Human
ttcaagctgtaaatttgtgtgtgagttccagaggcccgtgtgggctcaccaggagggcacgtgtcaaagcgtggtcttttccggccatttctcactctgggggaaggtgtccagcccaacgtttgataggaatatttaatggctttctcagaggaatggatctgttagcaggttttcctgttcagttaccattcgtgtctccagtatccttctcctctcaaatgtttgtctttgctttctttgctgtgattttctcagggtcctcatcccctcggccagcctctttgtggttttatctgaycagcctgctgctgtgcccctctttctcctgccctccgccccttgtgctgtgcacgtgcacacacgcacacacacacacatacacacatatgtcctcctccctggagtccttgtggttttaaagtgctgatactaatcggatttgagttgacttattgtcagagtagcttttcatgctcctcagataccactgggagttaccatcaagatctggatcttggctgtgagcccctggcctggctggtcctcactggcagcccatggaatccaaatgaaaggtctcgtgcccacctaacccagc

SEQ ID NO: 25914 - DNA, 601 bp, Human
tgaggctggaacgggatgcagcttgatctgggtcacagctttttaggtctgctgctgcttcagtgggtggaactggtgaaagggaaatgccaccttcgaggtgatagactgagggacctcatttgtcttagggctgtctcctagaagcttctgtctctgcctctcccatccttttccttctccatatgtgcactcacactcatgtgtccctcagggtgccgttcttgccaagaaggtgaactggattggctgccaggggagtgagccgcatttccggggctttccctgctccctgtgggtyctcttccacttcttgactgtgcaggcagctcggcaaaatgtagaccactcacaggaagcaggtacgtccaggacccgttcaccccactgtgcctccaaccctgctctgttcggccctccaaggggagagggggcagggaagctcccttgaattgccccactggctcccagctgccagaagatggggagagtcagccttggggctctggctggattgctctatctgcaggtagccccacacggccagaatagaaccaatcccaggagggagcagactttaggaattcaaccagtcctgttt

SEQ ID NO: 25915 - DNA, 601 bp, Human
ggctggaacgggatgcagcttgatctgggtcacagctttttaggtctgctgctgcttcagtgggtggaactggtgaaagggaaatgccaccttcgaggtgatagactgagggacctcatttgtcttagggctgtctcctagaagcttctgtctctgcctctcccatccttttccttctccatatgtgcactcacactcatgtgtccctcagggtgccgttcttgccaagaaggtgaactggattggctgccaggggagtgagccgcatttccggggctttccctgctccctgtgggtcctyttccacttcttgactgtgcaggcagctcggcaaaatgtagaccactcacaggaagcaggtacgtccaggacccgttcaccccactgtgcctccaaccctgctctgttcggccctccaaggggagagggggcagggaagctcccttgaattgccccactggctcccagctgccagaagatggggagagtcagccttggggctctggctggattgctctatctgcaggtagccccacacggccagaatagaaccaatcccaggagggagcagactttaggaattcaaccagtcctgttttcg

SEQ ID NO: 25916 - DNA, 601 bp, Human
gcttctgtctctgcctctcccatccttttccttctccatatgtgcactcacactcatgtgtccctcagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcaggtacgtccaggacccgttcaccccactgtgcctccaaccctgctctgttcggccctccaaggggagagggggcagggaagctcccttgaattgccccactggctcccagctgccagaagatggggagagtcagccttggggctctggctggattgctctatctgcaggtagccccacacggccagaatagaaccaatcccaggagggagcagactttaggaattcaaccagtcctgttttcggccccgggagctctggggctgaggcttctccctgtctttctccgggcttatagtttgctttgctttcagtcttcatgaaaaaattgtgattctatttttttatactcttaacaaagaaaaaaacgtgtattttacagtttaca

SEQ ID NO: 25917 - DNA, 601 bp, Human
aggggagtgagccgcatttccggggctttccctgctccctgtgggtcctcttccacttcttgactgtgcaggcagctcggcaaaatgtagaccactcacaggaagcaggtacgtccaggacccgttcaccccactgtgcctccaaccctgctctgttcggccctccaaggggagagggggcagggaagctcccttgaattgccccactggctcccagctgccagaagatggggagagtcagccttggggctctggctggattgctctatctgcaggtagccccacacggccagaatagaaycaatcccaggagggagcagactttaggaattcaaccagtcctgttttcggccccgggagctctggggctgaggcttctccctgtctttctccgggcttatagtttgctttgctttcagtcttcatgaaaaaattgtgattctatttttttatactcttaacaaagaaaaaaacgtgtattttacagtttacatagctgatacatagcaggtgctttgagcaattttattgcacttcccactgaaaaacaatttcctgggggaagttggggaaacacgtttcccctgctgcctcggattgt

SEQ ID NO: 25918 - DNA, 601 bp, Human
cgtttcccctgctgcctcggattgtccacaaactgcaccaccatgttctccggccacgctgccccacacctgcttttgaagactgaaaggatgcgcatccaattcagtccacactgattgaggaaccaggtttataccaggctgcggcttggcttggaggatagatacatgggtgaaaagggcgacagtgcccgctcttggtggacctctagtgtgaggcagggggacagagaggcctgcagtgcatcagggctagggccgtggtggagagaaagatgtggggtgaagagagggcaggctsgacgccattgggaaggggcccgaggccttacggggtgagttgaggggtgatgggtgagtagggattccgccaggagaggagcatcccagcagagggagcagcctgtgtggagccccgtgaatcagaggaactgccaggcagtggtgtgggaagccagtgtgtatggagcatctccaccatgccatgtggcgctgcaggtgccggggacacagcagcatatgagacaggtccctgcccccacagggccagtatctgagtggcaggagacagacacagagggatggcttcagccatgatgac

SEQ ID NO: 25919 - DNA, 601 bp, Human
tgatttcaagggggccccagagtccagtgtttcaagatagaggtgtagtcactggggccagtgcagctggaggtggcgcaagatgaggacatctctagcaagggctgtgtcggtggagtagtggaggtaatggccttgttggattcggctgaagagagaccaggaggcaagattctggagataatgagcaggaactggggcatgactgggttagagggaacttctttatgatcatccttttccccagttggaatgatcccttatcaggggataaatggatgacgcagtaaagaaaaaacaytaacgggagtgaaatcctggaggtgaggagtggggtaacccgagcagcagcggagacagaggctgagcaacgccagggccgtgtggtgaggccttgtggtggggaggtgggcacctgtgctgggtgcagaagaacaagctgagaaggcagaggagagagagagaggcaggtgtgggctgctgcgggtctcaccttgccaggagtgaggagagtagggtgccaacgtcctgctgcgtggaggggtaaaagcaggagattggcttctaaaggcctgggaggtttgcggtaggaaggagcgag

SEQ ID NO: 25920 - DNA, 601 bp, Human
actcaaactgctagggcagagggagctggggttctctctccctgggaagggtctgatgagagaaggggctggaggagaccaggtcgttcctggaaataccaggcaccggctcccaggagggagccttgccctctgcgttccctcattatggtgcttccttttcctcatcaggagtctgatggctctaacaggcaaacacattaaactccagggagctgggtcgggagggagccatctgtggacaggaggcggtttgtgtgtcgggagggagcggtgcacgtggctgtgacagcctcccggkggggggagaccagggcggagccgaggttaaaggagctgaatggagcaggtggtggtgcaggcgcctgcacttggtcgtggtctcctggggcctcctatcgaactttgaaaggaagacatgtgcctgtcttctccttcccccaccccgcccctgccaccaaatgctccatttgacccttcagccccttgacctcggcaggctcccagctgctgctggagggccaggagcctgggcctgtccctgagaggccagaagcagggtggttccctcccctctctggtggggtcctttcagaagaaa

SEQ ID NO: 25921 - DNA, 601 bp, Human
tcaaactgctagggcagagggagctggggttctctctccctgggaagggtctgatgagagaaggggctggaggagaccaggtcgttcctggaaataccaggcaccggctcccaggagggagccttgccctctgcgttccctcattatggtgcttccttttcctcatcaggagtctgatggctctaacaggcaaacacattaaactccagggagctgggtcgggagggagccatctgtggacaggaggcggtttgtgtgtcgggagggagcggtgcacgtggctgtgacagcctcccggggkggggagaccagggcggagccgaggttaaaggagctgaatggagcaggtggtggtgcaggcgcctgcacttggtcgtggtctcctggggcctcctatcgaactttgaaaggaagacatgtgcctgtcttctccttcccccaccccgcccctgccaccaaatgctccatttgacccttcagccccttgacctcggcaggctcccagctgctgctggagggccaggagcctgggcctgtccctgagaggccagaagcagggtggttccctcccctctctggtggggtcctttcagaagaaact

SEQ ID NO: 25922 - DNA, 601 bp, Human
gtacccctcaggtctccccccaactatcccttggagcccacccctaccccagagggctgctgctgggtaaaagcaaggattgccatgagcagctgcctcttgcttgaaaacgcattttcccttgaattgacaaagtaacctatttgtgcagtttgtataatttggaaaatgtcagaaaaatgcaaaaaaagacaaacacgagcagaccgaccaaagactgcaaaacagatcaaaatgagtattcttgccctttcccatgtctggtactggggtaaaggctggttgtaaagtccacatagcrggacagtgggtctggccaacaccgggaaatgactgagatggcgctcttcacgcttccctggaaaaccacggagggccggggctgaggggtaggtggatctgcctcctcctccatgctgccatctgttgagctcccactgtgggctagtgtttgtaatctgtattttctaattacccatcctctggaagggcagtggcgagccctttctgcagacaaggaagctggcgttctgagtggaggagtgtggtctgggtttttgggtgggactgatgtcaccaccagcctgtgtatgcttccctc

SEQ ID NO: 25923 - DNA, 601 bp, Human
attttcccttgaattgacaaagtaacctatttgtgcagtttgtataatttggaaaatgtcagaaaaatgcaaaaaaagacaaacacgagcagaccgaccaaagactgcaaaacagatcaaaatgagtattcttgccctttcccatgtctggtactggggtaaaggctggttgtaaagtccacatagcaggacagtgggtctggccaacaccgggaaatgactgagatggcgctcttcacgcttccctggaaaaccacggagggccggggctgaggggtaggtggatctgcctcctcctccwtgctgccatctgttgagctcccactgtgggctagtgtttgtaatctgtattttctaattacccatcctctggaagggcagtggcgagccctttctgcagacaaggaagctggcgttctgagtggaggagtgtggtctgggtttttgggtgggactgatgtcaccaccagcctgtgtatgcttccctctgtaggtgcccccagcgaggacccccagttccccaaggtgcagtggccaccccgtgaactttgttctgcctgccacaatgaacgcctggatgtgcccgtgtgggacgtggaag

SEQ ID NO: 25924 - DNA, 601 bp, Human
gcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacamacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctg

SEQ ID NO: 25925 - DNA, 601 bp, Human
ttttcttacaagtattactgttataaggcacctctgagggggccgctctttatctttcctttaacctggtagcccagtaaatttagggtttgggcccctgctgtgtgccctctttttttttttttttttgagagagaggaggtctcactatattgcctaggccggtctctaattcctggactcaggagatcctctcacctcagcctcccaaagtgctgggattttgggcatgagctaccatgcctggctcagccctctccctttgtcagccagaacagggcagccttgaactcaactgctycttccagctgcctgcctcttcccactcccagccaggccctgtggctccgacatgcatccagcaccaagaaggctgtgggccttgcctggaatttagggagcaggctcatggttgatatgaaactctgtgctccagacatgcaaaagacatgcaaatgagcactactggtttcctttccaaattggagtcaacaactgagggccctctggaccctgctgtcagagctggaggggcagatggaaggaagggaggagcggaatgggggctcagggctcggaagacccctcccccagggaagat

SEQ ID NO: 25926 - DNA, 601 bp, Human
tcatgccagcctggtcatggacagaaggtaccctggggaccaggggaatctcaggcaaaggaatttttcccttttctggtggctgcagggctgattagaattaggccaagaacaagggctactcctccccctggcctggaatagcgctaatagcaccttgatccgcccatgcaggcagaggacactccaggagggttagcaggagacagggcccgggtgctcactgagctaaagcctcaagctgggagtagcttccctgtagggagagcaggggagggagggagaggctccggggcctcaygcctgcctccgaaaaatagaaggtgcttgctccgggtctgccagtttgcagggtcaccccctcctagcacagtgtcctccctccccgcctccactgctctcttgctggccgttgccctgtctccatctgactttctcaaagccatctctctgggagccctcctggtggtgcttccttcactgcaagccttggctgggcatttcccatgcaagaggaagacagggaaaggggcttggtgcaagtagctaagttgaatatcttaggtaagatattcaacttctctgtgccttagtttcctca

SEQ ID NO: 25927 - DNA, 601 bp, Human
aagggggaaggatttctctaaatgaaacccaaacatggatgaagaagctggcttgtgaggaaaggagaagagactctcgctctgctcatgccagcctggtcatggacagaaggtaccctggggaccaggggaatctcaggcaaaggaatttttcccttttctggtggctgcagggctgattagaattaggccaagaacaagggctactcctccccctggcctggaatagcgctaatagcaccttgatccgcccatgcaggcagaggacactccaggagggttagcaggagacagggcccgrgtgctcactgagctaaagcctcaagctgggagtagcttccctgtagggagagcaggggagggagggagaggctccggggcctcatgcctgcctccgaaaaatagaaggtgcttgctccgggtctgccagtttgcagggtcaccccctcctagcacagtgtcctccctccccgcctccactgctctcttgctggccgttgccctgtctccatctgactttctcaaagccatctctctgggagccctcctggtggtgcttccttcactgcaagccttggctgggcatttcccatgcaagagg

SEQ ID NO: 25928 - DNA, 601 bp, Human
ccacacctggccttccacatctcctttaacctcctctccttcccttggccctgctcctggatcctgcctgtccccgcctgaccatttacacagatgggtgagtacttcccggtagtcctatttggcttattggctctgccctattagactagaggctgaggacagtgctcaagtttctctttctgctatagatgtgggtttaagatggtttagaagagcaaacccttggctcctagtgaagagccagcctgagtcccagagatgctgtgggcggcccaacttcccactgggcctggctccrggggggtggtacctggatggtgagctgccgcacagtgtattctgggcactctttcatgtcctggatgcggatctggaagggtccataggtttcctcttctgtgggccagtagtggacacatttctaggagggagggagctgggagtcagaagagggtcagctggagcaggtgacagggcagcagagaggggctggtatctcctccccatcctccacccctactggatgggaggtcagcaacagggagcctggctcttctgagcttgatacctgcaagcagagtgctcaccctatcccgta

SEQ ID NO: 25929 - DNA, 601 bp, Human
ctcaagtgatccgcccccctcagcctcccaaagtgttgggattacaggcatgagccgccacacctggccttccacatctcctttaacctcctctccttcccttggccctgctcctggatcctgcctgtccccgcctgaccatttacacagatgggtgagtacttcccggtagtcctatttggcttattggctctgccctattagactagaggctgaggacagtgctcaagtttctctttctgctatagatgtgggtttaagatggtttagaagagcaaacccttggctcctagtgaagagmcagcctgagtcccagagatgctgtgggcggcccaacttcccactgggcctggctccgggggggtggtacctggatggtgagctgccgcacagtgtattctgggcactctttcatgtcctggatgcggatctggaagggtccataggtttcctcttctgtgggccagtagtggacacatttctaggagggagggagctgggagtcagaagagggtcagctggagcaggtgacagggcagcagagaggggctggtatctcctccccatcctccacccctactggatgggaggtcagcaacag

SEQ ID NO: 25930 - DNA, 601 bp, Human
tctctcatcattaccccacacacaacctctgggcctaacctgtaaccctgctcccagcagtgtatccattttcacatttcttctctgggccttagcatgtgctcttccacttgcctggaacgtgttcccttccctctcttcacttggctaattcacctttcaggtcttagcttggcttagatggcctttctcttggaaaactttctctggtcaaagtctggtttaggagacttggttctatggtccccataatatccccatcacagctctcatcacattgcgtggtatttaatttttttttgagacagagttttgctcttgttgcccaacctggaatgccatggtgcgatctcagctcaccacaacctccacctcctgggttcaagcaattctcctgcctcagcctcccgagtaactgggattacaggcatgcgccaccatgtgtggctaattttgtatttttagtagagacagggtttctccatgttggtcaggctggtcttgaactcccgacctcaggtgatcctcccgcctcagcctcccaaagtgctgagattataagcatgagccactgcacccagcctaatctgccttctttccc

SEQ ID NO: 25931 - DNA, 601 bp, Human
gtccccttgggggccctgctggaggcaggttttaattggcatgggaggagtttacatttcttaccagccttactgtaagcctgttgcaggccaccttttggtccctgtggacattttgacgatctcccttctgctgagtctacagtggtttccaacagacagtttcccacttgtgggtgtgctgaccctcgagccctccttatctaaccttgacttcctctcagctcagactcatcttccacgcagcccacgcccggcccctctgtttcccaccttggcgccctcccacagtcttctctcyactctgttctgctttctctatcgtgccctctctttatttcaaaaccccctaggcctccccttcctcttgcgtgagcccctaatgacctccctgcacatgtcccagtgctacctgtgggtgggctgggaggcccctgtgtcatgccttttgcctctgtgctctgttttatttaggatatgcactcccaaatggtccctttctttagtcttgtcccctacgacaccccctcactctggcccaatccatttttcactctatagccaaagtgttcttttaaaatggcaaatccaagtgtcttag

SEQ ID NO: 25932 - DNA, 601 bp, Human
ggaatcctgaggtgtggcgttcagtcctgaggtagacctgaggtcccctggaaattgtgttgatgctgagatggatgaggggtgctcattctctcaggtagacagtgaggagtcctggttcagccgagcctccatgtctgcatggatggttatgaccctgattgtttttggaaacagccaagctctctaggtgtactcagcaaatgcaaggtatagtgggtcctgcatacccagggtattatttgagccatggaagcaaaacagagactgcttagcctccctaagagtagttggtgggagwggccagcaaccatggaggcaggagcagctcctctttgcctctgagtagtccccacatgttccctcttccagagatttcaactgccaggcctggtcacctctgtagcctactcttatgacacatgggtggaggcaagggtaaccagagtccttgttctttcttttgattggggtcatccagcccttccgatgtgtggtcagggagcagagtcactgataggatgttgagacttggagatcaggaccagacttttccccattcttgcatctggcctgtgcttgggcaggacctcgggtgaag

SEQ ID NO: 25933 - DNA, 601 bp, Human
ctgcctgggtaggctatgagggtccaccctgtctcacttcctaaattgactttggtttcaccttactttatgtccttggaagtgctagaaaagtgcatatcccaagggcaaagatttgcagcctgcctgtccctggtctgcagtctttctctcttgctacaaagaggccccagagggccaagaagaagatggaaagaaggaatgagtcagtcatccaagaagtctttattttcccacttggttactgttctggagcttgtaccctctgagctctgagatggggttggggggacagtgccarggagggcctgtggggctgtgcagttgcttccctctgggctggctctgagcccagggcaggatcaggcacttgagagccccccaccgagcctcattggcatagacagtcgtgcctctcacagggctcaggggaggtggaggtgtgggcaagtccatccccaaggctgtaaggaaggagcagctcctccataaggccaagcagaagcattagggaaatcatcctcagttttagcactgcgtgttcttcaggagagaagtcctgagtgaggaggcccagctgttctccagatccaactcctcg

SEQ ID NO: 25934 - DNA, 601 bp, Human
ctcctattccttgaataaagtataacttgaaaagtatcctattaactactcagctataaaataaacaggtcttacctgttgatccattggtataaactgaaaaagaacgttttcctccagaaacagctgtgatggcaatattgtatttactaccagcagtgagattgaaaaaagtgtattcattccatgaagtactttcttgaatttgaaccccctgtatcttttggttattttcatcaaataattgcacctcatatgaggtgacttttccggaagaaggagtccaccaaacatgcaagcyggttgaagtcgtcttctctttactgactccaaacctagcaggaggtaaaggatctgcaaggcaaatacacacacacacacaaaaaaaaaaaaagaaagaaaaagaaaaaaaaagaacatggcttgaagacttttgcaaataactgcttattttactgcagtccaggttcatttttctcaaaaatctgttatttgtgaaataaattgccattttgcttcacttccaaacctaccctttcactttcttaaaaaaaaaaaaacccatttagctactagtcatatgaattcctttttctactga

SEQ ID NO: 25935 - DNA, 601 bp, Human
cactgtatcccacaagctccttttaaaaatttaactaattgctaattaattaactttgctctggagtagcaatcttactcctattccttgaataaagtataacttgaaaagtatcctattaactactcagctataaaataaacaggtcttacctgttgatccattggtataaactgaaaaagaacgttttcctccagaaacagctgtgatggcaatattgtatttactaccagcagtgagattgaaaaaagtgtattcattccatgaagtactttcttgaatttgaaccccctgtatcttytggttattttcatcaaataattgcacctcatatgaggtgacttttccggaagaaggagtccaccaaacatgcaagctggttgaagtcgtcttctctttactgactccaaacctagcaggaggtaaaggatctgcaaggcaaatacacacacacacacaaaaaaaaaaaaagaaagaaaaagaaaaaaaaagaacatggcttgaagacttttgcaaataactgcttattttactgcagtccaggttcatttttctcaaaaatctgttatttgtgaaataaattgccattttgcttcacttc

SEQ ID NO: 25936 - DNA, 601 bp, Human
tttgtctctcttggatattatatcagcaatgcccagcatctagcttacattcaataactattggctgaatgaatgaaagtttgtataaattactcattaatacttagcatagattcatttattagtctagggtaggctgtgggagtaggtcctgtggtattgggtcccaggtcatatggttagatagaaaattttggaaatgactgtcacacaggagtagggtatgtatagcatggagaaagtaactctggttcactgtgagtgatgtcataaagacagcagttgcctgtttaagaaaagkaagtaggaatccttagcaaggagatagagtattaaaaagagaagaagagaagctaggtccatatcagtaattaactttgcctacttcaaaatgttgccaagggctagcctaaactttagaataaaagagaatccttctttttctgagtagaaaagtggatatgggtcttctataccttataagaatttcaatttgtcctatattacagttattcatataataaacttgacttattaaacattcccttgatttcactttattcttcttcagctagctagggggaacttacctgtcctgact

SEQ ID NO: 25937 - DNA, 601 bp, Human
cagtggctcatgcctgtaatcccaacactttgggaggccaaggcgggtgaatcacctgaagtcaggagttcaagaccagcctggccaacatggtgaaaccccatctctacgaaaaatacaaaaattagctgtgcgtggtggcaggtgcctgcaatcttagctactcgggaggctgaagcaagagaatcacttgaacctgggaggctgaggttgcagtgagctgagatcgcaccattgcactccagcccagccaacaagagcaaaactctgtctcaaaaaaaaaaaaaaaaaaaaaaaaaaagaatgggcacagcactctgattttgcacaaggcagtcaggaatgcaatttgctcttgatgtacataaataacttttaagatatatagaacatttttggccaggaatatctacatatatttgaggtgtgttataaaaggtatgtaaatgtaccggtgtcctcaaatatctttcccaccagcctcccatagttccagaaactaatgtctaaggcactacatatattagagtttctcttaaaattagataacttaccaagagaggagatttaattcacacattagacttgctagaagcattag

SEQ ID NO: 25938 - DNA, 601 bp, Human
ctgaaacatgagtcttggtattcttgctgtcacgattatattgcaaagctttgggcaagttataacctctttgagcctgttttctcatttcagtatccttattcttcccttccctaaaatccaaatatatccctctccactttaatcactcttcattggtacctgaaatccccacattagtcaacatgaggtcaaggcaatggttccctaatgctgatcactagcaaaaggttcttcttttgtgggaagggtcagtgtttgttttcagaatgtatgcatcttactcttttggtgtttgaaatggctttctttcatgaaataatggagttactagtggaagtgattttaaatgttctaatttgacaaattaggtgttagaaaccccatgttagccttaaagtccttaatatctcaaattcagaaaacaccagggtatgatattagcagttacggcagttacctgggttacctgggagagggaacaaattactcttccattggtattaacatcttcatatttgcctacctgtcctgccttggcaacgctcagaattcttcaaatttccactctcaacaatgacttccacctcatactgtcttc

SEQ ID NO: 25939 - DNA, 601 bp, Human
tactgaaacatgagtcttggtattcttgctgtcacgattatattgcaaagctttgggcaagttataacctctttgagcctgttttctcatttcagtatccttattcttcccttccctaaaatccaaatatatccctctccactttaatcactcttcattggtacctgaaatccccacattagtcaacatgaggtcaaggcaatggttccctaatgctgatcactagcaaaaggttcttcttttgtgggaagggtcagtgtttgttttcagaatgtatgcatcttactcttttggtgtttgtaatggctttctttcatgaaataatggagttactagtggaagtgattttaaatgttctaatttgacaaattaggtgttagaaaccccatgttagccttaaagtccttaatatctcaaattcagaaaacaccagggtatgatattagcagttacggcagttacctgggttacctgggagagggaacaaattactcttccattggtattaacatcttcatatttgcctacctgtcctgccttggcaacgctcagaattcttcaaatttccactctcaacaatgacttccacctcatactgtct

SEQ ID NO: 25940 - DNA, 601 bp, Human
atactgaaacatgagtcttggtattcttgctgtcacgattatattgcaaagctttgggcaagttataacctctttgagcctgttttctcatttcagtatccttattcttcccttccctaaaatccaaatatatccctctccactttaatcactcttcattggtacctgaaatccccacattagtcaacatgaggtcaaggcaatggttccctaatgctgatcactagcaaaaggttcttcttttgtgggaagggtcagtgtttgttttcagaatgtatgcatcttactcttttggtgtttcaaatggctttctttcatgaaataatggagttactagtggaagtgattttaaatgttctaatttgacaaattaggtgttagaaaccccatgttagccttaaagtccttaatatctcaaattcagaaaacaccagggtatgatattagcagttacggcagttacctgggttacctgggagagggaacaaattactcttccattggtattaacatcttcatatttgcctacctgtcctgccttggcaacgctcagaattcttcaaatttccactctcaacaatgacttccacctcatactgtc

SEQ ID NO: 25941 - DNA, 601 bp, Human
ggatactgaaacatgagtcttggtattcttgctgtcacgattatattgcaaagctttgggcaagttataacctctttgagcctgttttctcatttcagtatccttattcttcccttccctaaaatccaaatatatccctctccactttaatcactcttcattggtacctgaaatccccacattagtcaacatgaggtcaaggcaatggttccctaatgctgatcactagcaaaaggttcttcttttgtgggaagggtcagtgtttgttttcagaatgtatgcatcttactcttttggtgtatgaaatggctttctttcatgaaataatggagttactagtggaagtgattttaaatgttctaatttgacaaattaggtgttagaaaccccatgttagccttaaagtccttaatatctcaaattcagaaaacaccagggtatgatattagcagttacggcagttacctgggttacctgggagagggaacaaattactcttccattggtattaacatcttcatatttgcctacctgtcctgccttggcaacgctcagaattcttcaaatttccactctcaacaatgacttccacctcatactg

SEQ ID NO: 25942 - DNA, 601 bp, Human
aggatactgaaacatgagtcttggtattcttgctgtcacgattatattgcaaagctttgggcaagttataacctctttgagcctgttttctcatttcagtatccttattcttcccttccctaaaatccaaatatatccctctccactttaatcactcttcattggtacctgaaatccccacattagtcaacatgaggtcaaggcaatggttccctaatgctgatcactagcaaaaggttcttcttttgtgggaagggtcagtgtttgttttcagaatgtatgcatcttactcttttggtggttgaaatggctttctttcatgaaataatggagttactagtggaagtgattttaaatgttctaatttgacaaattaggtgttagaaaccccatgttagccttaaagtccttaatatctcaaattcagaaaacaccagggtatgatattagcagttacggcagttacctgggttacctgggagagggaacaaattactcttccattggtattaacatcttcatatttgcctacctgtcctgccttggcaacgctcagaattcttcaaatttccactctcaacaatgacttccacctcatact

SEQ ID NO: 25943 - DNA, 601 bp, Human
tccacctcctgggtttaagtgattcttatgcctcagcctcccgagtatctgggattacaggtatgtgccaccactcccagctaatttttgtgtttttagtagagacagtgtcttgccatgttggccaggctggtcttgaattcctggcctcaagatccacccatctcggcctcccaaagtgctgggattacagatgtgagccacggcgtccaactaaaaagggaaatcttgatgactttgcttccaattacactgaaaaaaatgaaagcaattagaagataactgctcaccctacaacgayccacctattggcatctgcacccacatattctctctttcctagctgatacggtttggctctgtgtccccacccaaatctcatcttgaattgtaatccccatgtgtccaaggagggaggtgactggatcatgggagtggtttcccccatgctgttcttgtgttagtgagtgatttctcacaagatctgatggttttataaggggctctttcccctttcatctccatcacttcccctcctgccaccttgtgaagaaggtgcctgcttccccttcaccttccaccatgatttttaaaaattaat

SEQ ID NO: 25944 - DNA, 601 bp, Human
gagctatataaaaatatgcccagcaaaaacaaaatttgagagagtttgtccctagaaactctcaatgaagaaatttgaataacgttctccaggataaaggaaaataatcccagataaaacatctcagatgcagggggaaaaaatgagaaaaaaggtagtaaattggtaggtaaatctaaacagatgttgactatataaagcaataattatatttttgtgggatcaaaagaggagagaaaaataagatacaggacaatagtatatacattgaaaaaagaaatttctttttttttttttttttgaggcaggttctcgctctatcacccaggctagtgtgcagtggcaggatctcgactcatgcaacctccacctcctgggtttaagtgattcttatgcctcagcctcccgagtatctgggattacaggtatgtgccaccactcccagctaatttttgtgtttttagtagagacagtgtcttgccatgttggccaggctggtcttgaattcctggcctcaagatccacccatctcggcctcccaaagtgctgggattacagatgtgagccacggcgtccaactaaaaagggaaatcttgatgac

SEQ ID NO: 25945 - DNA, 601 bp, Human
aaacagactcatagagaaataaaaatcagactgacagctgactcagcgcaacaataaatcccagaaagactagaataatatcttttatgtgctgagagaaagtaactttaaacacagagttggaacttaaggaaaatatctttcaagaccgagagctatataaaaatgagagctatataaaaatatgcccagcaaaaacaaaatttgagagagtttgtccctagaaactctcaatgaagaaatttgaataacgttctccaggataaaggaaaataatcccagataaaacatctcagatgcrgggggaaaaaatgagaaaaaaggtagtaaattggtaggtaaatctaaacagatgttgactatataaagcaataattatatttttgtgggatcaaaagaggagagaaaaataagatacaggacaatagtatatacattgaaaaaagaaatttctttttttttttttttttgaggcaggttctcgctctatcacccaggctagtgtgcagtggcaggatctcgactcatgcaacctccacctcctgggtttaagtgattcttatgcctcagcctcccgagtatctgggattacaggtatgtg

SEQ ID NO: 25946 - DNA, 601 bp, Human
caccttgatcattattgtgaaacaactgaaccccaaaggcaaaaaagcagtcatagcaaacagactcatagagaaataaaaatcagactgacagctgactcagcgcaacaataaatcccagaaagactagaataatatcttttatgtgctgagagaaagtaactttaaacacagagttggaacttaaggaaaatatctttcaagaccgagagctatataaaaatgagagctatataaaaatatgcccagcaaaaacaaaatttgagagagtttgtccctagaaactctcaatgaagaaatytgaataacgttctccaggataaaggaaaataatcccagataaaacatctcagatgcagggggaaaaaatgagaaaaaaggtagtaaattggtaggtaaatctaaacagatgttgactatataaagcaataattatatttttgtgggatcaaaagaggagagaaaaataagatacaggacaatagtatatacattgaaaaaagaaatttctttttttttttttttttgaggcaggttctcgctctatcacccaggctagtgtgcagtggcaggatctcgactcatgcaacctccacctcct

SEQ ID NO: 25947 - DNA, 601 bp, Human
gctaaattttaaaacaaactgctaataccatgtactacatgctgagaacacggaggaagtggaaatttcatacattgctggtgggaatgtaaaattttacaatactttggaaagcagtttggcagttttctacaaagttaaacatgcatttaccatatgacccagcaatatgggtggtggggatgataaaaatgaccttaggtctaaaacaatgtcttggacttccctttctggcagtatgataggctagataccatgaaaatccttctaataaacacaactatacatattggataaaatrtgaaaatgtaaatgaatgacttgtcaggaatgtaagagattctcaaaggccaaaaagtaaaggatagagaggtaattggatcataaagcgaactgttgtgttgagagcacctttcaaatgcaaatgtaagctttgattttatagcactgcaggatattggagaaaggaggtaaagtgtagatttttccaggctgaagaaactcatagctgaccttgcataacattggaaaggctacattctaagtataagtgaaataaatagtctctctttactccccatacaacttcagccttcttaat

SEQ ID NO: 25948 - DNA, 601 bp, Human
acgcctgtaatcccagaactttgggaggccgaggcgggtggatcacctgaggtcaggagttcgagagcagcctgaccaacgtggagaaaccctgtctctactaaaaatacaaagttagcagggcgtggtggcacacgcctgtaatcccagctactcgggagactgaggcaggagaattgctgaacccaggaggcggaggttgcggtgagccgagatcacgccatcgcactccagcctgagcaaccagagcgaaattccgtctcaaaaaaaaaaaaaaaaatcagaatttattctctcttgmcatcacccatcgcccaatttccattccatataccttctggatggctagcttttgtgaaacttagcttttgtaaaggccagggatgagtctgattttaggatatttctataatattctgattaggggtctcatgtactcagatcttagttaagtcacagacacatatctctacttcttacctgttcttccctccacaaccacttgtcgggaagagatccctccactcactgttgttaccaccacggagtacaggctgccggacttgagagagtggaagctgtatctgctggtctcactgga

SEQ ID NO: 25949 - DNA, 601 bp, Human
atgtcctctgggttcattaagtagatgagattcatgattttggaaagagatgcatctatgatgcctgcagctgataaacagaatttgagtgttgaggatgcagaaggagaagcctgaaatccaacttaaaataattatataaaattaagtagacaaggtcccactaataattatcaaagcttctattgggtttatgtaatttttttctaagaaatgaacatacattttatatatcatatatattaattttttatgttctttcattgtattacatagaaaattctatgtaatttcttcctcrgtgccatggctccctgacatacatgaccataatgacacttatttgtttacttagctttctaacagggagctattaaggtcaagaaaaattgtttagatagcatattaagcacttgtttaacgttgcttatgaaaatatatgagacctgaaaattagatcaactccacctctaaccatattaattggagatcattttctttttatgtcttgcaaaccaagaatatataagagtgaaagatgctttctttgggaggtttgttttgttttttatccattattgtttaccttaactggaacata

SEQ ID NO: 25950 - DNA, 601 bp, Human
agactatgaaacatcttctcagtgacttcattgttcttctgggagagttaatgaagttaatgtcctctgggttcattaagtagatgagattcatgattttggaaagagatgcatctatgatgcctgcagctgataaacagaatttgagtgttgaggatgcagaaggagaagcctgaaatccaacttaaaataattatataaaattaagtagacaaggtcccactaataattatcaaagcttctattgggtttatgtaatttttttctaagaaatgaacatacattttatatatcatatattttaattttttatgttctttcattgtattacatagaaaattctatgtaatttcttcctcagtgccatggctccctgacatacatgaccataatgacacttatttgtttacttagctttctaacagggagctattaaggtcaagaaaaattgtttagatagcatattaagcacttgtttaacgttgcttatgaaaatatatgagacctgaaaattagatcaactccacctctaaccatattaattggagatcattttctttttatgtcttgcaaaccaagaatatataagagtgaaagatgc

SEQ ID NO: 25951 - DNA, 601 bp, Human
ctgaaaccctgtttctactaaaagtacaaaaattagctgggcgtggtggtgcgtgcctgtaatcccagctactcgggagactgagacaggagaatcgcttgaaccagggagtcggaggttgcagtgagccaagatcgtgccactgcactccagcctggcgacaaaatgagactccatctcaaaaaaaaaaaaaaaaaaaagaaacatgcaagtgacaatgtcagctgtcatagaatgagggaaatgggcatacaccagtgaatttctaccaagactatgaaacatcttctcagtgacttcrttgttcttctgggagagttaatgaagttaatgtcctctgggttcattaagtagatgagattcatgattttggaaagagatgcatctatgatgcctgcagctgataaacagaatttgagtgttgaggatgcagaaggagaagcctgaaatccaacttaaaataattatataaaattaagtagacaaggtcccactaataattatcaaagcttctattgggtttatgtaatttttttctaagaaatgaacatacattttatatatcatatatattaattttttatgttctttcattgtatta

SEQ ID NO: 25952 - DNA, 601 bp, Human
ccagattagaattagatttgttaagtatatctaatatctttaattttaaatattctgccatcttatctgggctgggagggtttatttatatgtttcaactcagtggaaacaggtgaaatataagaatacctttcaaaattatttcaatattgactaatgtttcagcaatttgaggagatgataaggattatcaaggccttacccactgaattctttacaattgactgtgtacaaaatttactaaaagaggcacctttcaaaatccctattattgtgctttacaggagtctcccattttcctcctttatcgtgataatgtgcactcttcatatgtttgagtaaaataactcgtgctcaatttattcatatttgattctctcctcaaaactttatgaccattcttcaaataatttcttgtccctttttcccttttttgaatgcttctattatataatatgggtcaaatacttgtacctttattctaattaaaatataaataaaaatataaattaaaaaataaaaataattttaagtcccacttacttaaagtacacagttatttcaagagatagcacagactagactattttagtagctcaca

SEQ ID NO: 25953 - DNA, 601 bp, Human
acatttcctagatataaagttgaactttttagccagaagatttatatattggtacatctcttccttccttttctttccttcttttcttcctttttgctttctttccttcctttcttctgccatccaaccatctatacatcctttagttgctctcaaaagcaactcattatgcttgtttttaaaaactgctggaaatatttgcaactactaacattttattagaaaagacacaattatcaaaagttttcacagaaatatgattcacatgtttaagaaaaaatagatacaaaatttgtttttsctttaggatgagcattttcccagattagaattagatttgttaagtatatctaatatctttaattttaaatattctgccatcttatctgggctgggagggtttatttatatgtttcaactcagtggaaacaggtgaaatataagaatacctttcaaaattatttcaatattgactaatgtttcagcaatttgaggagatgataaggattatcaaggccttacccactgaattctttacaattgactgtgtacaaaatttactaaaagaggcacctttcaaaatccctattattgtgcttta

SEQ ID NO: 25954 - DNA, 601 bp, Human
cacttatccatcactaaaaattataaactgcattctagtgaacaactctggtaatgttgatccacatatatggacatttcctagatataaagttgaactttttagccagaagatttatatattggtacatctcttccttccttttctttccttcttttcttcctttttgctttctttccttcctttcttctgccatccaaccatctatacatcctttagttgctctcaaaagcaactcattatgcttgtttttaaaaactgctggaaatatttgcaactactaacattttattagaaaagrcacaattatcaaaagttttcacagaaatatgattcacatgtttaagaaaaaatagatacaaaatttgtttttcctttaggatgagcattttcccagattagaattagatttgttaagtatatctaatatctttaattttaaatattctgccatcttatctgggctgggagggtttatttatatgtttcaactcagtggaaacaggtgaaatataagaatacctttcaaaattatttcaatattgactaatgtttcagcaatttgaggagatgataaggattatcaaggccttacccactg

SEQ ID NO: 25955 - DNA, 601 bp, Human
aaactaatcaaaataaaaatgtccggaggcctttgggatgcctcgtaaatacaaggatgccactactgcatttttatggggttgctgtttgtaaagcatttcaagtggagacatccttatacaatgttttagaaggttccctgtaagaaagggaacaaatatttcaacaatctaaatgaatcaacttgaaccaaacttaccaataaagcaaaaatgtttgagtggaaaggggaagaatacgatagcttttctaaagaccttaaactgggatagcttcaatttttttgtgatgaagttattyattcctgggaagtaatagctaacacaaccagagggaccgttttccctttgcaaggcatttcctgccctctagtggtaagaaataagcctaaaaacctatcttggaagtaagaagtctggaagctggaccaaccaagggcagagagaactgttatggcgataatgggttttctgatgtcaactataatcatttgcttatatgaattggggattagtgtcacaaacgtttactgagaacctactatttgccaggtatacaaaaatgaaaaacgcatgaatgtcttcaagaagttctctggtt

SEQ ID NO: 25956 - DNA, 601 bp, Human
gtgggacccctgatctaagtgatttctgattattcctttgccaagtatttactgagtgcctactaagccccaggtcctgcgctaggtaacaggataaggacaattgtctcagaacctcatggaaaaactgacattttaaaatacagaaatcaacccatagcttagtaggaaacatttgacaatgtattgatgccaaccttaagcagaaatctcaggtataaaccccagaaagcataaatatattgggaaaatggtagctatttaaatttaattctttccagcacattggactgaacattcrtttcctttgctaagatttttgctccctagtcccagaaccataaaggttcacattttcaccttgtgtgaaaaaggatgaatagtggttttgaccaacagacatttcaggatggattttaggatggagagctttgtaggcactggagtcattcagaactgggtttaaaaccaggatctgaaacacactggctgtttaacaaggtaaacagttgggcgagttacttgacctccctgaaccttggtttcctgatctgtaaaatgggaataataacaatgactacctcaataaggagttcataag

SEQ ID NO: 25957 - DNA, 601 bp, Human
aatgtcagcatcctgtaacaatataaatcagaggttcttagctttttggaggtcacagaaaccataagaatctgataaaagccatggactgtttcttctcaaagaaatgcatatacctttcctatccccagcaacctcataaacaatttcaggggttactacattcctaaagtctcccatgaaccatggactcccaggtgggacccctgatctaagtgatttctgattattcctttgccaagtatttactgagtgcctactaagccccaggtcctgcgctaggtaacaggataaggacaaytgtctcagaacctcatggaaaaactgacattttaaaatacagaaatcaacccatagcttagtaggaaacatttgacaatgtattgatgccaaccttaagcagaaatctcaggtataaaccccagaaagcataaatatattgggaaaatggtagctatttaaatttaattctttccagcacattggactgaacattcatttcctttgctaagatttttgctccctagtcccagaaccataaaggttcacattttcaccttgtgtgaaaaaggatgaatagtggttttgaccaacagacatt

SEQ ID NO: 25958 - DNA, 601 bp, Human
tcggatacagcatgatggaatggacagcactggagctagactgaactccactaccagtcagccctgcaaccctggagaagccacactccttctctgggacttcctttatatccaaatgaggaaacaggattagatcattctaaggaccccttcaatgtcagcatcctgtaacaatataaatcagaggttcttagctttttggaggtcacagaaaccataagaatctgataaaagccatggactgtttcttctcaaagaaatgcatatacctttcctatccccagcaacctcataaacaatytcaggggttactacattcctaaagtctcccatgaaccatggactcccaggtgggacccctgatctaagtgatttctgattattcctttgccaagtatttactgagtgcctactaagccccaggtcctgcgctaggtaacaggataaggacaattgtctcagaacctcatggaaaaactgacattttaaaatacagaaatcaacccatagcttagtaggaaacatttgacaatgtattgatgccaaccttaagcagaaatctcaggtataaaccccagaaagcataaatatattgggaaaa

SEQ ID NO: 25959 - DNA, 601 bp, Human
tgccactacacctagctaattttttgtatttttagtagagatgggatttcaccatgttggccaggctggtctcaaactcctgacctcatgattctcccgcctcggcctcccaaagtgctggggatgcatggtttcttgaaccaagaattatgattaatacaattttgtgcatgtgaggttctttctaatatatgaacgaaaccattctgtatatctgtggtcccctccccaaccagtaaataaatatatgcatgttacttaggaacactgtggaataaggcaattctgtatttagagcatkatattaaggagatttcatttttccatttggggctgaattttaattcaacagtaggccacagattcattactatttcacggtaactggacattatacatattaatgaggaggagcattgaaaagaggcatgaactcggatccagggtactaaactcttgtcctaatactagcatgtcctctgtatttggtatatattaggggtttctgatctgaccacatgccaaggctgtgtccaatttttcacctctactttttctcaaatcatgaaatgatccagaaatttcagtattttggcatgga

SEQ ID NO: 25960 - DNA, 601 bp, Human
gggctggagtgcagtggtgcgatcttggctcactggaacctctgccttctggttcaagcgattctcctgcctcagcctcccaagtagctgggattacaggtgcctgccactacacctagctaattttttgtatttttagtagagatgggatttcaccatgttggccaggctggtctcaaactcctgacctcatgattctcccgcctcggcctcccaaagtgctggggatgcatggtttcttgaaccaagaattatgattaatacaattttgtgcatgtgaggttctttctaatatatgaaygaaaccattctgtatatctgtggtcccctccccaaccagtaaataaatatatgcatgttacttaggaacactgtggaataaggcaattctgtatttagagcatgatattaaggagatttcatttttccatttggggctgaattttaattcaacagtaggccacagattcattactatttcacggtaactggacattatacatattaatgaggaggagcattgaaaagaggcatgaactcggatccagggtactaaactcttgtcctaatactagcatgtcctctgtatttggtatatatt

SEQ ID NO: 25961 - DNA, 601 bp, Human
gaggctgagatggaagaatcacttgaacccaggaggcacaggttgcagtgaaccaagatcacatcatgcccctgcactccagcctgggtgatggagcaagactccatctcataaaaaaaaaaaaaaaaagaaaagaaaaggaaaaagaaaaatggaagaagaaacacatatggttatttgcataataaatgaagagattttccacatcactggtgatcaaggaaatgcaagtcaaaaccacagtgaaatactgttttacatccatttgactggcaaaattaaaaaactatataaaaaccaygtgtagaagaatatatacaggagactggataatgaatacatacatatacacacatacacacacacagtgaaatattatataatagttataattaattccttaactcaaaacacaaaaatatggatttcttgtccttaacatcaaaatacaaaatatggatgaatcttacctgtataataagtaaaacatctaagtccctaagatattaaatactacattaaaaatacctttttaaataatgttaaaaacaacaaaaaattttgaaacccataattttaggcctgtatataaatgcaataa

SEQ ID NO: 25962 - DNA, 601 bp, Human
gcctggccaacatggtgaaaccccgtctctactaaaaaatacaaaaattagctgggcatggtggtgcacacctgtagttccagctactcgggaggctgagatggaagaatcacttgaacccaggaggcacaggttgcagtgaaccaagatcacatcatgcccctgcactccagcctgggtgatggagcaagactccatctcataaaaaaaaaaaaaaaaagaaaagaaaaggaaaaagaaaaatggaagaagaaacacatatggttatttgcataataaatgaagagattttccacatcaytggtgatcaaggaaatgcaagtcaaaaccacagtgaaatactgttttacatccatttgactggcaaaattaaaaaactatataaaaaccacgtgtagaagaatatatacaggagactggataatgaatacatacatatacacacatacacacacacagtgaaatattatataatagttataattaattccttaactcaaaacacaaaaatatggatttcttgtccttaacatcaaaatacaaaatatggatgaatcttacctgtataataagtaaaacatctaagtccctaagatattaa

SEQ ID NO: 25963 - DNA, 601 bp, Human
aaaaaaatgaggctatgcatggtggctcacacctgtaatcctaacactttgggaggctgaggagggcagatcacttgaggtcagaagtttgagaacagcctggccaacatggtgaaaccccgtctctactaaaaaatacaaaaattagctgggcatggtggtgcacacctgtagttccagctactcgggaggctgagatggaagaatcacttgaacccaggaggcacaggttgcagtgaaccaagatcacatcatgcccctgcactccagcctgggtgatggagcaagactccatctcatmaaaaaaaaaaaaaaaagaaaagaaaaggaaaaagaaaaatggaagaagaaacacatatggttatttgcataataaatgaagagattttccacatcactggtgatcaaggaaatgcaagtcaaaaccacagtgaaatactgttttacatccatttgactggcaaaattaaaaaactatataaaaaccacgtgtagaagaatatatacaggagactggataatgaatacatacatatacacacatacacacacacagtgaaatattatataatagttataattaattccttaactcaaaaca

SEQ ID NO: 25964 - DNA, 601 bp, Human
aaatcttagaccttaggttacaaatttctggaggggaaagattgttacactatgtggagtgattaaacggatcttttaacagaagctgatgaactcattctaagcctgctgtttgcctgcacaaagtgtcatgtataagatggaacattaaacatgatggctgatgattaatatgagtgatggtaaacgatatagataattccaacataccttgctgactcaaaagttactaagaagaatataagcaatcccccaacccgcccccctcaaaaaaatgaggctatgcatggtggctcacacytgtaatcctaacactttgggaggctgaggagggcagatcacttgaggtcagaagtttgagaacagcctggccaacatggtgaaaccccgtctctactaaaaaatacaaaaattagctgggcatggtggtgcacacctgtagttccagctactcgggaggctgagatggaagaatcacttgaacccaggaggcacaggttgcagtgaaccaagatcacatcatgcccctgcactccagcctgggtgatggagcaagactccatctcataaaaaaaaaaaaaaaaagaaaagaaaaggaaaa

SEQ ID NO: 25965 - DNA, 601 bp, Human
ctgaatgatgttagcaccaagtgagacttactgggaatgtaatgtactaatgaataagcagaaaaaattcaaggttcagataaattactagagactttcaagtccaaccaactgtcagattttgcaatcgttccacttacttgttctcccattcccttgttcattggcttcatattgtccactttttgtagtaacagtgacactgtacaaccgtccagggactagctgaacaaatacacattcgttttctgacttgggaatgcttttagtttgaatgaagttgtttttgtttttaatggtracttcatagtgatcaaagtctccagtggcatgcacccaggatacccttaaatagtcactcctggctgagttgctaacactgactccctggactttgtcaggcactgaaaaggaaacagagagtaactaaatatttatgaattctgagtgagtaattgatcacagatgacaagctgggacaataaaaagagagagtagattattattgtgtgcatttaaaagaaaaatcttagaccttaggttacaaatttctggaggggaaagattgttacactatgtggagtgattaaacggatctttt

SEQ ID NO: 25966 - DNA, 601 bp, Human
ggtgaactgtcagtacatgttaactactatggcaacactcctaaaagagttctaaagaagtgatacccaagtaacacttaattcttaatctgtgtgcctcagaagcaccagctgatcacatcagttcattgctatttctctgaaagcaccctccaaccccgccactctctgctgacatcatactttattttcattcatccaggttggacaacatcattgtcactatcaacatgactttgtcccttcttgctgtctcccttttatccctccaaatgctcaatcgaaatacctgaactacccraaagttaaatgcaccactgcatctattcaggttcaagaacagtatttcacattacctgtgaagccctcaatgaaggctgactgctgtacatccccgctaatcgtcaagacaagaattttgtattggcggcctggtgttagggaagtaaatcgatactcggttgcggtatttacaaggtgaaaaggaggaaatactttcatgtcattgaagagcagctggatctcatattggtcgacatccccattagctcctgaccaagtcacatgcaagtcctcagtgctcctgttgcgcaatgttaga

SEQ ID NO: 25967 - DNA, 601 bp, Human
tgtagacataaaatgctttgctgtgggtctggttcatggtgaactgtcagtacatgttaactactatggcaacactcctaaaagagttctaaagaagtgatacccaagtaacacttaattcttaatctgtgtgcctcagaagcaccagctgatcacatcagttcattgctatttctctgaaagcaccctccaaccccgccactctctgctgacatcatactttattttcattcatccaggttggacaacatcattgtcactatcaacatgactttgtcccttcttgctgtctcccttttayccctccaaatgctcaatcgaaatacctgaactacccgaaagttaaatgcaccactgcatctattcaggttcaagaacagtatttcacattacctgtgaagccctcaatgaaggctgactgctgtacatccccgctaatcgtcaagacaagaattttgtattggcggcctggtgttagggaagtaaatcgatactcggttgcggtatttacaaggtgaaaaggaggaaatactttcatgtcattgaagagcagctggatctcatattggtcgacatccccattagctcctgaccaagtcac

SEQ ID NO: 25968 - DNA, 601 bp, Human
aaaagaaagtaacaatttgccacttttctctgatttttctgtgtgaactaaagttgatgggggaaagcttagggggaagtcaaagccggtgagtggaaatgaggaatgctaattatatagcgaggggctagttagggtgtcttggtccaagttttggttttctcactcactagctgtgggactacaggcaaattacttgacctctgtaagttttagtttcttcattaggaaaaatggcagtgatgataatactaaccagcccatagagttgtgaagattgattcttttttaatttaatttwattttatttttgaggtagggtctctgtctgttgtccaggctggagtgcaatggcatgattatggctcactgcatcctatacctcctgggctcaagtgattctcccacctcagcctccccagtagctgggactacaggcacgtaacaccgtgcccggctaatttttttgtattttttgtagagacagggttttgtcatgttgcccaggctgtgcttgaactcctgggctcaagctatcctcctgccttggcttccaaagcattgtgaagactgaacaagatgtagacataaaatgctttgc

SEQ ID NO: 25969 - DNA, 601 bp, Human
cgtgagctaccgcgcctggcccgaatgcccacttctaacacaggatttgtcatagggttaaagatatgcagatatagatataaatatagatatgaaatagaggcatagtagggcatggtatagaagccccagaccccacaactaaataagtggtcatgagaatgggagacatctaagaagtattgtgtcacagtggagagggcacgaggtttggggccagacagacctagacttgaattatagctttaggtcttgttatatacgtatccttgatactgttttacaagctttctgaactgtwctttcctcatctgtaagagaactatagtatggctagagatctttcaaaaataatacatgaatagtgatattgatataaacagatatattattcatacatttgatacttgtttttttagctctaccaggtaaagtagatggcacagatgtgtactctttcttaaaaggtagaacttttgaaaaatgcataattatggaagtctccttattaaaatttatttatttatttatttacttatttattgggacagggtctcactccggttgcccaggctggagtgcagtggcacgatcacgactc

SEQ ID NO: 25970 - DNA, 601 bp, Human
cctcccaaagtgctgggattacaggcgtgagctaccgcgcctggcccgaatgcccacttctaacacaggatttgtcatagggttaaagatatgcagatatagatataaatatagatatgaaatagaggcatagtagggcatggtatagaagccccagaccccacaactaaataagtggtcatgagaatgggagacatctaagaagtattgtgtcacagtggagagggcacgaggtttggggccagacagacctagacttgaattatagctttaggtcttgttatatacgtatccttgataytgttttacaagctttctgaactgttctttcctcatctgtaagagaactatagtatggctagagatctttcaaaaataatacatgaatagtgatattgatataaacagatatattattcatacatttgatacttgtttttttagctctaccaggtaaagtagatggcacagatgtgtactctttcttaaaaggtagaacttttgaaaaatgcataattatggaagtctccttattaaaatttatttatttatttatttacttatttattgggacagggtctcactccggttgcccaggctg

SEQ ID NO: 25971 - DNA, 601 bp, Human
tgctactgaatgcccactttctttttttggagacagagtctcactctgtcaccaagctggagtgcagtggcatgatctcagctcactgcaagctccgcctcctgggttcatgccattctcctgcctcagcctcccgagtagctgggactacaggcgtctgccatcacacccagctaattttttgtatttttagtagagacggggtttcaccatgttagccaggatggtctcaatctcctgaccttgtgatccacccaccttggcctcccaaagtgctgggattacaggcgtgagctaccgygcctggcccgaatgcccacttctaacacaggatttgtcatagggttaaagatatgcagatatagatataaatatagatatgaaatagaggcatagtagggcatggtatagaagccccagaccccacaactaaataagtggtcatgagaatgggagacatctaagaagtattgtgtcacagtggagagggcacgaggtttggggccagacagacctagacttgaattatagctttaggtcttgttatatacgtatccttgatactgttttacaagctttctgaactgttctttcctcatct

SEQ ID NO: 25972 - DNA, 601 bp, Human
gtaattgcctttttacttttctatctccttcactagattataaggttcttgaggtcaggggctttgccttgctactgaatgcccactttctttttttggagacagagtctcactctgtcaccaagctggagtgcagtggcatgatctcagctcactgcaagctccgcctcctgggttcatgccattctcctgcctcagcctcccgagtagctgggactacaggcgtctgccatcacacccagctaattttttgtatttttagtagagacggggtttcaccatgttagccaggatggtctcratctcctgaccttgtgatccacccaccttggcctcccaaagtgctgggattacaggcgtgagctaccgcgcctggcccgaatgcccacttctaacacaggatttgtcatagggttaaagatatgcagatatagatataaatatagatatgaaatagaggcatagtagggcatggtatagaagccccagaccccacaactaaataagtggtcatgagaatgggagacatctaagaagtattgtgtcacagtggagagggcacgaggtttggggccagacagacctagacttgaattatagc

SEQ ID NO: 25973 - DNA, 601 bp, Human
tgactcttcttgtttgctcctctaacatctcataaccacttttttcttagcacgtaccatgttttactgtaattgcctttttacttttctatctccttcactagattataaggttcttgaggtcaggggctttgccttgctactgaatgcccactttctttttttggagacagagtctcactctgtcaccaagctggagtgcagtggcatgatctcagctcactgcaagctccgcctcctgggttcatgccattctcctgcctcagcctcccgagtagctgggactacaggcgtctgccaycacacccagctaattttttgtatttttagtagagacggggtttcaccatgttagccaggatggtctcaatctcctgaccttgtgatccacccaccttggcctcccaaagtgctgggattacaggcgtgagctaccgcgcctggcccgaatgcccacttctaacacaggatttgtcatagggttaaagatatgcagatatagatataaatatagatatgaaatagaggcatagtagggcatggtatagaagccccagaccccacaactaaataagtggtcatgagaatgggagacatctaa

SEQ ID NO: 25974 - DNA, 601 bp, Human
caaattggactcctcatctccctcccccaatattctcattgtttttttgtttctatctcttggttcaagtcagaaacttcagttatcactctcacccttgtatatataatcaaatacgagttttatttctgtatcctaaatcttctatctcttgaatctagccactccctctttgtgtactgctactacctcaggaccacatcataccctttagcaagtataaatgagaccatacattattgcaactgcctattgaccagtcacttgtgtccttacctcctactctttcaatctgcagacyctatctagcatattttcatagcactcccatgctaatggccctatagtggctctccataattccaaaacaccttcacaggcaaacaaagctctttgtgatttggtctctctacttacctggccacatgcctcacattttttattctagtatacttttgctttttatacttttagtagagatggggttttgccacgttgcccaggctggtctcgaactcctggacttaggctatccactcacctcagcttcccaaaatgtgggattacaggcatgagccaccgtgcccggcctttattctag

SEQ ID NO: 25975 - DNA, 601 bp, Human
ttaactaaggtcaaaacttcaagacttgacttcagcagtagtggatactagtatttgttctatagctcctgaggtgaaaggcaaaatagtattattgttattataataatattttctgtactaggttcatttcttttctcattctacataatcttcctagatttcgtctatgtccatggtttgaagtgtcatccataaggtgacaactcccaaatttaaactttcagtttagatgtttctcctgcttttgcaaattacatctctccctgaatgtaccacagacatccaacactcaagacgyccaaattggactcctcatctccctcccccaatattctcattgtttttttgtttctatctcttggttcaagtcagaaacttcagttatcactctcacccttgtatatataatcaaatacgagttttatttctgtatcctaaatcttctatctcttgaatctagccactccctctttgtgtactgctactacctcaggaccacatcataccctttagcaagtataaatgagaccatacattattgcaactgcctattgaccagtcacttgtgtccttacctcctactctttcaatctgcaga

SEQ ID NO: 25976 - DNA, 601 bp, Human
cattaactaaggtcaaaacttcaagacttgacttcagcagtagtggatactagtatttgttctatagctcctgaggtgaaaggcaaaatagtattattgttattataataatattttctgtactaggttcatttcttttctcattctacataatcttcctagatttcgtctatgtccatggtttgaagtgtcatccataaggtgacaactcccaaatttaaactttcagtttagatgtttctcctgcttttgcaaattacatctctccctgaatgtaccacagacatccaacactcaagaygtccaaattggactcctcatctccctcccccaatattctcattgtttttttgtttctatctcttggttcaagtcagaaacttcagttatcactctcacccttgtatatataatcaaatacgagttttatttctgtatcctaaatcttctatctcttgaatctagccactccctctttgtgtactgctactacctcaggaccacatcataccctttagcaagtataaatgagaccatacattattgcaactgcctattgaccagtcacttgtgtccttacctcctactctttcaatctgca

SEQ ID NO: 25977 - DNA, 601 bp, Human
cttgtttagacttttattactaacattaactaaggtcaaaacttcaagacttgacttcagcagtagtggatactagtatttgttctatagctcctgaggtgaaaggcaaaatagtattattgttattataataatattttctgtactaggttcatttcttttctcattctacataatcttcctagatttcgtctatgtccatggtttgaagtgtcatccataaggtgacaactcccaaatttaaactttcagtttagatgtttctcctgcttttgcaaattacatctctccctgaatgtaycacagacatccaacactcaagacgtccaaattggactcctcatctccctcccccaatattctcattgtttttttgtttctatctcttggttcaagtcagaaacttcagttatcactctcacccttgtatatataatcaaatacgagttttatttctgtatcctaaatcttctatctcttgaatctagccactccctctttgtgtactgctactacctcaggaccacatcataccctttagcaagtataaatgagaccatacattattgcaactgcctattgaccagtcacttgtgtcctt

SEQ ID NO: 25978 - DNA, 601 bp, Human
tgacagctgaattatgtctcttgtttagacttttattactaacattaactaaggtcaaaacttcaagacttgacttcagcagtagtggatactagtatttgttctatagctcctgaggtgaaaggcaaaatagtattattgttattataataatattttctgtactaggttcatttcttttctcattctacataatcttcctagatttcgtctatgtccatggtttgaagtgtcatccataaggtgacaactcccaaatttaaactttcagtttagatgtttctcctgcttttgcaaattrcatctctccctgaatgtaccacagacatccaacactcaagacgtccaaattggactcctcatctccctcccccaatattctcattgtttttttgtttctatctcttggttcaagtcagaaacttcagttatcactctcacccttgtatatataatcaaatacgagttttatttctgtatcctaaatcttctatctcttgaatctagccactccctctttgtgtactgctactacctcaggaccacatcataccctttagcaagtataaatgagaccatacattattgcaactgcctattg

SEQ ID NO: 25979 - DNA, 601 bp, Human
caagttcatgttcagtgaatgtgggtttgacagctgaattatgtctcttgtttagacttttattactaacattaactaaggtcaaaacttcaagacttgacttcagcagtagtggatactagtatttgttctatagctcctgaggtgaaaggcaaaatagtattattgttattataataatattttctgtactaggttcatttcttttctcattctacataatcttcctagatttcgtctatgtccatggtttgaagtgtcatccataaggtgacaactcccaaatttaaactttcagttyagatgtttctcctgcttttgcaaattacatctctccctgaatgtaccacagacatccaacactcaagacgtccaaattggactcctcatctccctcccccaatattctcattgtttttttgtttctatctcttggttcaagtcagaaacttcagttatcactctcacccttgtatatataatcaaatacgagttttatttctgtatcctaaatcttctatctcttgaatctagccactccctctttgtgtactgctactacctcaggaccacatcataccctttagcaagtataaatgag

SEQ ID NO: 25980 - DNA, 601 bp, Human
aagtcatcaattgagaaaaactcctgaatcaactgcaggtagaagatgatgcatttgctttatttgtgtgtcattgacactttctgtgtgcccttatggagaaaagaggagaaaggatttgttggcttaacctgtctgtacaactactttgattctccattttttctctgattttaaataggatctcagatagaaaagttagtgaaaatggccctgataaatatgcagagtggtgcatacctatgaatctagaaagtgaagaatgctgagcaagttcatgttcagtgaatgtgggtttgayagctgaattatgtctcttgtttagacttttattactaacattaactaaggtcaaaacttcaagacttgacttcagcagtagtggatactagtatttgttctatagctcctgaggtgaaaggcaaaatagtattattgttattataataatattttctgtactaggttcatttcttttctcattctacataatcttcctagatttcgtctatgtccatggtttgaagtgtcatccataaggtgacaactcccaaatttaaactttcagtttagatgtttctcctgcttttgcaaattacat

SEQ ID NO: 25981 - DNA, 601 bp, Human
cagattttatcacttagggtaaagtcatcaattgagaaaaactcctgaatcaactgcaggtagaagatgatgcatttgctttatttgtgtgtcattgacactttctgtgtgcccttatggagaaaagaggagaaaggatttgttggcttaacctgtctgtacaactactttgattctccattttttctctgattttaaataggatctcagatagaaaagttagtgaaaatggccctgataaatatgcagagtggtgcatacctatgaatctagaaagtgaagaatgctgagcaagttcatrttcagtgaatgtgggtttgacagctgaattatgtctcttgtttagacttttattactaacattaactaaggtcaaaacttcaagacttgacttcagcagtagtggatactagtatttgttctatagctcctgaggtgaaaggcaaaatagtattattgttattataataatattttctgtactaggttcatttcttttctcattctacataatcttcctagatttcgtctatgtccatggtttgaagtgtcatccataaggtgacaactcccaaatttaaactttcagtttagatgtttc

SEQ ID NO: 25982 - DNA, 601 bp, Human
cagctttttgccaacttactattaaggaataactgctgtatgcattgtctgcaattactccttggacagatgctggaactgcagagagacaagtggagcaacaaaatacagattttatcacttagggtaaagtcatcaattgagaaaaactcctgaatcaactgcaggtagaagatgatgcatttgctttatttgtgtgtcattgacactttctgtgtgcccttatggagaaaagaggagaaaggatttgttggcttaacctgtctgtacaactactttgattctccattttttctctgawtttaaataggatctcagatagaaaagttagtgaaaatggccctgataaatatgcagagtggtgcatacctatgaatctagaaagtgaagaatgctgagcaagttcatgttcagtgaatgtgggtttgacagctgaattatgtctcttgtttagacttttattactaacattaactaaggtcaaaacttcaagacttgacttcagcagtagtggatactagtatttgttctatagctcctgaggtgaaaggcaaaatagtattattgttattataataatattttctgtactaggttcatt

SEQ ID NO: 25983 - DNA, 601 bp, Human
agactataaacataatgaccatgggagtttttttattcacttctgtatatccagcagttagaacagtgcctagcctatagtaggtactcaataataaatgaattgataggtggatctcctcacttctggttcatttccattcaatccattcccccattgctatctgatttatctttttaaagatacatcttttattacaaaacaattactctctggctaaaagttttgtattgctttaagataaaattcctgaggaaggctaccaggcaccctctaatttggctccaatctggctttcagyctcacctttccatcatgcaacacacatttcagccacccacaacttctcctttctcctgttcatacctcttggcctttgcacaggacagactgtctgtacaaagtattctaccttctctccataaggagaatttcttcatccttcaaggcaatactgaaatgtcacttttatgaagatgtctcaattctacctgacctccatgcttccctgaatgccagacatccctctcttatatgtactctttatcacaatgcattgccattatttgtccatgtgtctgtctcgtcagtcagctcttta

SEQ ID NO: 25984 - DNA, 601 bp, Human
tttattttatttattgactttcttccccactagactataaacataatgaccatgggagtttttttattcacttctgtatatccagcagttagaacagtgcctagcctatagtaggtactcaataataaatgaattgataggtggatctcctcacttctggttcatttccattcaatccattcccccattgctatctgatttatctttttaaagatacatcttttattacaaaacaattactctctggctaaaagttttgtattgctttaagataaaattcctgaggaaggctaccaggcaycctctaatttggctccaatctggctttcagcctcacctttccatcatgcaacacacatttcagccacccacaacttctcctttctcctgttcatacctcttggcctttgcacaggacagactgtctgtacaaagtattctaccttctctccataaggagaatttcttcatccttcaaggcaatactgaaatgtcacttttatgaagatgtctcaattctacctgacctccatgcttccctgaatgccagacatccctctcttatatgtactctttatcacaatgcattgccattatttgt

SEQ ID NO: 25985 - DNA, 601 bp, Human
actttgggaggttgaggcaggtggatttcttgagcccaggagtgcgagaccagcctaggcaatgtggagaaaccctgtgtctacaagaaaatacaaaaattagctgggtgtggtggcacatgcctgaagtcccaactacttgggaggttgagatgggaggattgtttgagcccaggaggcagaggttgcagtgaattgagattgtgccactgcactccatcctgggtgccagagcgaggttctgtctccaaaaataataaataataataataataataataataataataataataataaatagatagataaaattgtaagccccaactcttgctatcccaccttcctaacttaatttccttcttggtctttattaccacccaacctcctacatcttttacttatttattttatttattgactttcttccccactagactataaacataatgaccatgggagtttttttattcacttctgtatatccagcagttagaacagtgcctagcctatagtaggtactcaataataaatgaattgataggtggatctcctcacttctggttcatttccattcaatccattcccccattgctatctg

SEQ ID NO: 25986 - DNA, 601 bp, Human
caacactttgggaggttgaggcaggtggatttcttgagcccaggagtgcgagaccagcctaggcaatgtggagaaaccctgtgtctacaagaaaatacaaaaattagctgggtgtggtggcacatgcctgaagtcccaactacttgggaggttgagatgggaggattgtttgagcccaggaggcagaggttgcagtgaattgagattgtgccactgcactccatcctgggtgccagagcgaggttctgtctccaaaaataataaataataataataataataataataataataataataataaatagatagataaaattgtaagccccaactcttgctatcccaccttcctaacttaatttccttcttggtctttattaccacccaacctcctacatcttttacttatttattttatttattgactttcttccccactagactataaacataatgaccatgggagtttttttattcacttctgtatatccagcagttagaacagtgcctagcctatagtaggtactcaataataaatgaattgataggtggatctcctcacttctggttcatttccattcaatccattcccccattgcta

SEQ ID NO: 25987 - DNA, 601 bp, Human
cccaacactttgggaggttgaggcaggtggatttcttgagcccaggagtgcgagaccagcctaggcaatgtggagaaaccctgtgtctacaagaaaatacaaaaattagctgggtgtggtggcacatgcctgaagtcccaactacttgggaggttgagatgggaggattgtttgagcccaggaggcagaggttgcagtgaattgagattgtgccactgcactccatcctgggtgccagagcgaggttctgtctccaaaaataataaataataataataataataataataataataataataataaatagatagataaaattgtaagccccaactcttgctatcccaccttcctaacttaatttccttcttggtctttattaccacccaacctcctacatcttttacttatttattttatttattgactttcttccccactagactataaacataatgaccatgggagtttttttattcacttctgtatatccagcagttagaacagtgcctagcctatagtaggtactcaataataaatgaattgataggtggatctcctcacttctggttcatttccattcaatccattcccccattgc

SEQ ID NO: 25988 - DNA, 601 bp, Human
tgtaatcccaacactttgggaggttgaggcaggtggatttcttgagcccaggagtgcgagaccagcctaggcaatgtggagaaaccctgtgtctacaagaaaatacaaaaattagctgggtgtggtggcacatgcctgaagtcccaactacttgggaggttgagatgggaggattgtttgagcccaggaggcagaggttgcagtgaattgagattgtgccactgcactccatcctgggtgccagagcgaggttctgtctccaaaaataataaataataataataataataataataataayaataataataaatagatagataaaattgtaagccccaactcttgctatcccaccttcctaacttaatttccttcttggtctttattaccacccaacctcctacatcttttacttatttattttatttattgactttcttccccactagactataaacataatgaccatgggagtttttttattcacttctgtatatccagcagttagaacagtgcctagcctatagtaggtactcaataataaatgaattgataggtggatctcctcacttctggttcatttccattcaatccattcccc

SEQ ID NO: 25989 - DNA, 601 bp, Human
ggtggctcgtgcctgtaatcccaacactttgggaggttgaggcaggtggatttcttgagcccaggagtgcgagaccagcctaggcaatgtggagaaaccctgtgtctacaagaaaatacaaaaattagctgggtgtggtggcacatgcctgaagtcccaactacttgggaggttgagatgggaggattgtttgagcccaggaggcagaggttgcagtgaattgagattgtgccactgcactccatcctgggtgccagagcgaggttctgtctccaaaaataataaataataataataataataataataataataataataataaatagatagataaaattgtaagccccaactcttgctatcccaccttcctaacttaatttccttcttggtctttattaccacccaacctcctacatcttttacttatttattttatttattgactttcttccccactagactataaacataatgaccatgggagtttttttattcacttctgtatatccagcagttagaacagtgcctagcctatagtaggtactcaataataaatgaattgataggtggatctcctcacttctggttcatttccatt

SEQ ID NO: 25990 - DNA, 601 bp, Human
cccttgaccaggcgtggtggctcgtgcctgtaatcccaacactttgggaggttgaggcaggtggatttcttgagcccaggagtgcgagaccagcctaggcaatgtggagaaaccctgtgtctacaagaaaatacaaaaattagctgggtgtggtggcacatgcctgaagtcccaactacttgggaggttgagatgggaggattgtttgagcccaggaggcagaggttgcagtgaattgagattgtgccactgcactccatcctgggtgccagagcgaggttctgtctccaaaaataataaataataataataataataataataataataataataataaatagatagataaaattgtaagccccaactcttgctatcccaccttcctaacttaatttccttcttggtctttattaccacccaacctcctacatcttttacttatttattttatttattgactttcttccccactagactataaacataatgaccatgggagtttttttattcacttctgtatatccagcagttagaacagtgcctagcctatagtaggtactcaataataaatgaattgataggtggatctcctcacttc

SEQ ID NO: 25991 - DNA, 601 bp, Human
aggtggaggttgtggtgagctaagatcgcaccactgcactccagcttgggcaacagagggagactccatctcaaaaaaaaaaaaaaaaaattgtaagccccttgaccaggcgtggtggctcgtgcctgtaatcccaacactttgggaggttgaggcaggtggatttcttgagcccaggagtgcgagaccagcctaggcaatgtggagaaaccctgtgtctacaagaaaatacaaaaattagctgggtgtggtggcacatgcctgaagtcccaactacttgggaggttgagatgggaggatygtttgagcccaggaggcagaggttgcagtgaattgagattgtgccactgcactccatcctgggtgccagagcgaggttctgtctccaaaaataataaataataataataataataataataataataataataataaatagatagataaaattgtaagccccaactcttgctatcccaccttcctaacttaatttccttcttggtctttattaccacccaacctcctacatcttttacttatttattttatttattgactttcttccccactagactataaacataatgaccatgggagt

SEQ ID NO: 25992 - DNA, 601 bp, Human
ggggactgtactatctaaaattgtaagtcccgaccaggtgcagtggctcatgcctgtaatcccagcactttgggaggctgaggagggtggatcacctgaggtcaggagttcaagaccagcctggccaacatggtgaaaccctgtctctactaaaaatataaaaattagccgggtgtagtggtgcatacctgtagtcccactcggtatgcactcgggaggctgaggcaggataattgcttgaacccaggaggtggaggttgtggtgagctaagatcgcaccactgcactccagcttgggcarcagagggagactccatctcaaaaaaaaaaaaaaaaaattgtaagccccttgaccaggcgtggtggctcgtgcctgtaatcccaacactttgggaggttgaggcaggtggatttcttgagcccaggagtgcgagaccagcctaggcaatgtggagaaaccctgtgtctacaagaaaatacaaaaattagctgggtgtggtggcacatgcctgaagtcccaactacttgggaggttgagatgggaggattgtttgagcccaggaggcagaggttgcagtgaattgagattgtgccactgcac

SEQ ID NO: 25993 - DNA, 601 bp, Human
gcattcattcagctattggtccttatcatcctatgactgcagtcatgtcatgacccccattacctgtccatctgcatccccaccactcatcctcgctcactctgttccagccatatgggcctctttactgttcctccaacaggtcagacacacacccactcaaggtctttgtgttggcattggctctgcttataaatacccaaatatttgcatgactttctcatttctttcagatttttactcaaatgtcactgcctcaatgaagtctttggggactgtactatctaaaattgtaagtccygaccaggtgcagtggctcatgcctgtaatcccagcactttgggaggctgaggagggtggatcacctgaggtcaggagttcaagaccagcctggccaacatggtgaaaccctgtctctactaaaaatataaaaattagccgggtgtagtggtgcatacctgtagtcccactcggtatgcactcgggaggctgaggcaggataattgcttgaacccaggaggtggaggttgtggtgagctaagatcgcaccactgcactccagcttgggcaacagagggagactccatctcaaaaaaaaaaa

SEQ ID NO: 25994 - DNA, 601 bp, Human
gcccttgactgtcttgttcaccgtcacattacagcagtgggccatgtgcctggcacagaagagcacctaaaactattgtcaaatgagaaaaaagaattgaataggtgggctgaccgtggtggctcacgcctctaattccagcactttgggaggtcgaggcaagaggattgctttagcccaggagttcaagaccagcctgggcaatacagggaggcccccatctctacaaaaaataaaaattaaaaagttaaaagtttgccatgcatggtgtcgtgtgcctgtagtcccagctactcgggargctgaagcaagaggatcacttgagcccaggtggtcgaggctgcagggagccatgatggcatcactgcactccagcctgggcaacagagtgagaactcgtccccccccaaaacatttttttttgaacaggagataaaggactcaaattatgggaaaagggtagattctgttttttgtttgcagcccagagagatgtctctcactttcctggaactctgtgttttcacttcatctagcgctgtgtttctaattcgcagcagtcactgcctgtttgttatatttgtggttgcccttctctgct

SEQ ID NO: 25995 - DNA, 601 bp, Human
ttagcttatgaaaaaggcccagaaaatgtatatacgaggttccagctcctcccagtgtggcctatctcattgcagccaccatcccataacaaccctctctgggtctctttacatcctctgtaccctcctttaggttctcagttctcttgtgctcttttttataaaatctgtattggtacaacttcatttagggagagaagtgttaacagtcactcctatcactgtatagattagtcatgctgccacctatcccaatagctttgctattttttggagaatgaagactgttgccacattgggrgacctttaagcattaatgagcaggtaaggaaagatgtgcaaagggtgggttgcctcagaaatgatgacatctaggcaattctatttgtggttgaagcttatcgctgctctttttcactcctttcaaaagacaaacagaacttctgttgggtgcccttggaatatgttcccacgtggctcccctcacctttaggtctctgctgaaatgccttctcctatctaaagcagttgcttgtcctgccaagtcactatcatgacacatcatttttttcatagaatttaaggcattcccagatcatct

SEQ ID NO: 25996 - DNA, 601 bp, Human
gaggctgggacttaaacagaagaaaaattgttactgagaacaaaacagaaacacaggcattttggcccacaggtgagagtatatgctatgttgggcatgtgggtgagtcgtacatattgtagtcagatcttgcctacatttcaggccatttaactttaagggcatatggactagagatatggtataaattaaaacaaaacaaaccaggtggtgacttctagatgcttgccacatggaccctgataggcatgtaaaatgaaatcttcataaatgatgaataaatcgttgtcatttagcttaygaaaaaggcccagaaaatgtatatacgaggttccagctcctcccagtgtggcctatctcattgcagccaccatcccataacaaccctctctgggtctctttacatcctctgtaccctcctttaggttctcagttctcttgtgctcttttttataaaatctgtattggtacaacttcatttagggagagaagtgttaacagtcactcctatcactgtatagattagtcatgctgccacctatcccaatagctttgctattttttggagaatgaagactgttgccacattgggagaccttta

SEQ ID NO: 25997 - DNA, 601 bp, Human
cgtacttccttccaggaacaaggccttgaaaccgccactccgtcaggtccttgtctttccagttttccttctttgtgccattgggattatagagaatcagctcataaaagtcaaagtccccagaggctggactccagttgaaccaaaggctgtctgtcgtgttccgattggaccccctgagatgactcacagaggctgggacttaaacagaagaaaaattgttactgagaacaaaacagaaacacaggcattttggcccacaggtgagagtatatgctatgttgggcatgtgggtgagtcrtacatattgtagtcagatcttgcctacatttcaggccatttaactttaagggcatatggactagagatatggtataaattaaaacaaaacaaaccaggtggtgacttctagatgcttgccacatggaccctgataggcatgtaaaatgaaatcttcataaatgatgaataaatcgttgtcatttagcttatgaaaaaggcccagaaaatgtatatacgaggttccagctcctcccagtgtggcctatctcattgcagccaccatcccataacaaccctctctgggtctctttacatcctc

SEQ ID NO: 25998 - DNA, 601 bp, Human
gaagatattaattccatcagattttggggtacagggctgacgtccacagacaattatgttcagttgcagatagccttgttgattaactccagggtggcacacagacctctgtgtgtgcccatgacataaaaacagttaggaagcactggtgatagccacacagtgatgatgtatatgattattcccactttgcagataagaaaactgaggcctagagatgctcaatgacttgcccagattcatagagctaagctaaggacatatttcttttggaccaaagccttgtcctttatctgttgtmccacagtcccttcccaaattcaggggctagctcagggtatatcattattggctttatctcttgtcattaaaatcagaatcaaaatgtgtctctggaagctacttcccaccatcccttggccattggcacctgggcttctcacctgttctgctctccgctgtgactttattgctgagatctccactgtgagttaccacccacagcacgtacttccttccaggaacaaggccttgaaaccgccactccgtcaggtccttgtctttccagttttccttctttgtgccattgggattatagaga

SEQ ID NO: 25999 - DNA, 601 bp, Human
cgttgaccaggctggtctcgaactccagacctcaagtgatccacccacctcggcctcccaaagtactgggattataggcatgagccacggtgcccagcctcatataccttttcttaaatattcatagccagatcttccttaccatggtgctgtggagcatgagtgtgccctgaatgggttacaagtgtgtgaagatattaattccatcagattttggggtacagggctgacgtccacagacaattatgttcagttgcagatagccttgttgattaactccagggtggcacacagacctctrtgtgtgcccatgacataaaaacagttaggaagcactggtgatagccacacagtgatgatgtatatgattattcccactttgcagataagaaaactgaggcctagagatgctcaatgacttgcccagattcatagagctaagctaaggacatatttcttttggaccaaagccttgtcctttatctgttgtcccacagtcccttcccaaattcaggggctagctcagggtatatcattattggctttatctcttgtcattaaaatcagaatcaaaatgtgtctctggaagctacttcccacc

SEQ ID NO: 26000 - DNA, 601 bp, Human
ctctcgttgaccaggctggtctcgaactccagacctcaagtgatccacccacctcggcctcccaaagtactgggattataggcatgagccacggtgcccagcctcatataccttttcttaaatattcatagccagatcttccttaccatggtgctgtggagcatgagtgtgccctgaatgggttacaagtgtgtgaagatattaattccatcagattttggggtacagggctgacgtccacagacaattatgttcagttgcagatagccttgttgattaactccagggtggcacacagacmtctgtgtgtgcccatgacataaaaacagttaggaagcactggtgatagccacacagtgatgatgtatatgattattcccactttgcagataagaaaactgaggcctagagatgctcaatgacttgcccagattcatagagctaagctaaggacatatttcttttggaccaaagccttgtcctttatctgttgtcccacagtcccttcccaaattcaggggctagctcagggtatatcattattggctttatctcttgtcattaaaatcagaatcaaaatgtgtctctggaagctacttcc

SEQ ID NO: 26001 - DNA, 601 bp, Human
gagcaacatcagacacacttttaatgtactttgtaggaagagataatatgataataatatagtagcaggagctttcattaatagtgtttattatgtgtaaggcactgtcttcgagcattttatgtactttttttttttttttttcacttttttttttttgagacagagttttgctcttgctgcccaggctgaagtgcagtggagtgatcttggctcactgcaacctccgcttcccaggtagctgggattacaggcacctcagcctcccaagtagctgggattacaggtgcccaccactacrcctggctaattgttgtatttttagtagagacagggtttcctctcgttgaccaggctggtctcgaactccagacctcaagtgatccacccacctcggcctcccaaagtactgggattataggcatgagccacggtgcccagcctcatataccttttcttaaatattcatagccagatcttccttaccatggtgctgtggagcatgagtgtgccctgaatgggttacaagtgtgtgaagatattaattccatcagattttggggtacagggctgacgtccacagacaattatgttcagttgc

SEQ ID NO: 26002 - DNA, 601 bp, Human
atacaaataagatagctgagcaacatcagacacacttttaatgtactttgtaggaagagataatatgataataatatagtagcaggagctttcattaatagtgtttattatgtgtaaggcactgtcttcgagcattttatgtactttttttttttttttttcacttttttttttttgagacagagttttgctcttgctgcccaggctgaagtgcagtggagtgatcttggctcactgcaacctccgcttcccaggtagctgggattacaggcacctcagcctcccaagtagctgggattayaggtgcccaccactacacctggctaattgttgtatttttagtagagacagggtttcctctcgttgaccaggctggtctcgaactccagacctcaagtgatccacccacctcggcctcccaaagtactgggattataggcatgagccacggtgcccagcctcatataccttttcttaaatattcatagccagatcttccttaccatggtgctgtggagcatgagtgtgccctgaatgggttacaagtgtgtgaagatattaattccatcagattttggggtacagggctgacgtccacaga

SEQ ID NO: 26003 - DNA, 601 bp, Human
gctgaatgtaggagaaagtgaaaaatcacataatcacagctatgccataacatatacaaataagatagctgagcaacatcagacacacttttaatgtactttgtaggaagagataatatgataataatatagtagcaggagctttcattaatagtgtttattatgtgtaaggcactgtcttcgagcattttatgtactttttttttttttttttcacttttttttttttgagacagagttttgctcttgctgcccaggctgaagtgcagtggagtgatcttggctcactgcaacctccgcytcccaggtagctgggattacaggcacctcagcctcccaagtagctgggattacaggtgcccaccactacacctggctaattgttgtatttttagtagagacagggtttcctctcgttgaccaggctggtctcgaactccagacctcaagtgatccacccacctcggcctcccaaagtactgggattataggcatgagccacggtgcccagcctcatataccttttcttaaatattcatagccagatcttccttaccatggtgctgtggagcatgagtgtgccctgaatgggttacaagtg

SEQ ID NO: 26004 - DNA, 601 bp, Human
tgacagtcttgacgttgaattgataggatctccctggacgaagaccatacacaatgcgtccttctgattttctgttgttgtaggggttgaagacagtaagtgcatctctgggcaaccactgcagctcaaagtcgttgtagtctgtccagtctgggggccctttccacgtgatggccaaggatgtgtttgcaatgtcagcaaatgacataagactgggaggacttggagctgaatgtaggagaaagtgaaaaatcacataatcacagctatgccataacatatacaaataagatagctgagyaacatcagacacacttttaatgtactttgtaggaagagataatatgataataatatagtagcaggagctttcattaatagtgtttattatgtgtaaggcactgtcttcgagcattttatgtactttttttttttttttttcacttttttttttttgagacagagttttgctcttgctgcccaggctgaagtgcagtggagtgatcttggctcactgcaacctccgcttcccaggtagctgggattacaggcacctcagcctcccaagtagctgggattacaggtgcccaccactacacct

SEQ ID NO: 26005 - DNA, 601 bp, Human
aagttttccaggaatcaccactgacagtcttgacgttgaattgataggatctccctggacgaagaccatacacaatgcgtccttctgattttctgttgttgtaggggttgaagacagtaagtgcatctctgggcaaccactgcagctcaaagtcgttgtagtctgtccagtctgggggccctttccacgtgatggccaaggatgtgtttgcaatgtcagcaaatgacataagactgggaggacttggagctgaatgtaggagaaagtgaaaaatcacataatcacagctatgccataacayatacaaataagatagctgagcaacatcagacacacttttaatgtactttgtaggaagagataatatgataataatatagtagcaggagctttcattaatagtgtttattatgtgtaaggcactgtcttcgagcattttatgtactttttttttttttttttcacttttttttttttgagacagagttttgctcttgctgcccaggctgaagtgcagtggagtgatcttggctcactgcaacctccgcttcccaggtagctgggattacaggcacctcagcctcccaagtagctgggatta

SEQ ID NO: 26006 - DNA, 601 bp, Human
aatctacagagacttctgcctgaattcaaatccagaccaatcccatgtaaaaatatggatttaatccaagccctatttgagtaagatgttgaacatatacttcctctactccatttgagaaataagagtagcaaaacatgtcatacttgtcctcacagatccaaaaattggtttgctgtaagttttccaggaatcaccactgacagtcttgacgttgaattgataggatctccctggacgaagaccatacacaatgcgtccttctgattttctgttgttgtaggggttgaagacagtaagygcatctctgggcaaccactgcagctcaaagtcgttgtagtctgtccagtctgggggccctttccacgtgatggccaaggatgtgtttgcaatgtcagcaaatgacataagactgggaggacttggagctgaatgtaggagaaagtgaaaaatcacataatcacagctatgccataacatatacaaataagatagctgagcaacatcagacacacttttaatgtactttgtaggaagagataatatgataataatatagtagcaggagctttcattaatagtgtttattatgtgtaaggca

SEQ ID NO: 26007 - DNA, 601 bp, Human
tgtggcataaaagttatacttgttatagtattaatgcttattaaaaaaataaaacaactacttgcttaaatttctaactttcaactatgtattttatcaacaaccaataactatctgatctgatcccagaagctacttatactgggtattattgaaacacaaatatttggattaaagtccctacactgaatacctgtctttctttgagggtgatagtatctatcccaaaatgcctttgggaagaaactggtatatgcttcgtcgtcgaagtatttttatctcagggacatacagcagtatrtgctaactatgatccctctgcttctagttttgcctctttcaatctattctctacactgtacccagagtaactttctaaagtgtaaataatgattatgatatctctgctgaaattgagtggctccagttggttcaaaataaagttcaaagtagttaccatggaatacaaaatattttattatctgattcccttaatcctcaccttttatgctatggccaaataaacttctttctgttcccctattggtagatcttgtactctccctcctctctcatcttggaatattttattctctctacc

SEQ ID NO: 26008 - DNA, 601 bp, Human
ggagagcctacacaccctgtgctgggctcattgccttgtgtgggagtatcattccctgttgcaagctcaatgtatgctcttttgttctgcttaagcatgtgtgtcacatggtagatggcgaacaccaatgctatagttgtcctctgaggagacaggacagggtccttctactgtggcccgagaggggtgcacttagccaactgccctccattggctgctggaagagaccacagacaatgcgcccttctgttttctgttgtcagggttgaagatagcaagtgcatctctgggcaactactgyagctggctgtgggggactgatgcatactgttgaggctgatcttactctgtctcctctctatgtaagtaaagctttgttccatccagtgtttgcattgtgtttccctggctactctaataccagatgcaatggtcagaagtgtttagagttctgccctgggtttggtaaccagtgcagggtgttctgcttagcagatttcatgaacacagcccacagtcagccacggaaaactcatcctgagctcgccataaactaaaactcttagttctttttcacatatttctcttgacacacaaataa

SEQ ID NO: 26009 - DNA, 601 bp, Human
atcattcctcatgaaacagcactgagtctctctttcatggcagtttttgtcctcttgggcactcccccttttggtaaatgcctcccttaaattctagcacccgggactgaatacaacagtccagttgtgacttataagcctagcctctaacagagttgtatgagctcttaaactgagcacctgcgaggctgttgggaaaggcagtctcatgtgcatagtctatcaacccccatttggctgtgtaagaaatggcccttgagcttaagatactttcttaccaagagatggagagcctacacascctgtgctgggctcattgccttgtgtgggagtatcattccctgttgcaagctcaatgtatgctcttttgttctgcttaagcatgtgtgtcacatggtagatggcgaacaccaatgctatagttgtcctctgaggagacaggacagggtccttctactgtggcccgagaggggtgcacttagccaactgccctccattggctgctggaagagaccacagacaatgcgcccttctgttttctgttgtcagggttgaagatagcaagtgcatctctgggcaactactgcagctggctgtgggg

SEQ ID NO: 26010 - DNA, 601 bp, Human
caagttccaccataatcattcctcatgaaacagcactgagtctctctttcatggcagtttttgtcctcttgggcactcccccttttggtaaatgcctcccttaaattctagcacccgggactgaatacaacagtccagttgtgacttataagcctagcctctaacagagttgtatgagctcttaaactgagcacctgcgaggctgttgggaaaggcagtctcatgtgcatagtctatcaacccccatttggctgtgtaagaaatggcccttgagcttaagatactttcttaccaagagatsgagagcctacacaccctgtgctgggctcattgccttgtgtgggagtatcattccctgttgcaagctcaatgtatgctcttttgttctgcttaagcatgtgtgtcacatggtagatggcgaacaccaatgctatagttgtcctctgaggagacaggacagggtccttctactgtggcccgagaggggtgcacttagccaactgccctccattggctgctggaagagaccacagacaatgcgcccttctgttttctgttgtcagggttgaagatagcaagtgcatctctgggcaactactgc

SEQ ID NO: 26011 - DNA, 601 bp, Human
cacttctttcacgtgttgagagaaacaagtacctactatgtgccaggtgctcttctggggattatgaacagtacagaggtaaataagacgttagctctaacctctacaaatggaaatgagtccaaaatagccataacacaaggtagaaaggaaaacataccagaagaaatggtgagagaaggtgctatgtggtgtgacacacaacttttagctgctggctattagtgatcagcaggagttagtaaaagctgtaaggcagaggtgacactctgccaaggtatcacgaaagaggcattctacrtagagaaaaaccagaaacccaggtaccaaaggaggaggtgccggagtgggatggtagaaaattgagaactgcaaatcattcattatggttgaagcatatttgtgagaaattgagtactggaatgattttacatgaaaattataaacttctattctatttaaacttctgctattttggattttctgttacccatagcctcacccgatcctaataaatacaagcctcgaagaaaacaaaacaaaacataacaaaacaaaaacaagttccaccataatcattcctcatgaaacagcactgagt

SEQ ID NO: 26012 - DNA, 601 bp, Human
cagaaaacaccaaggaggatatatgccaaaaaaactatggctaggcatatcgttttcacactacagaaaatcaaagataaagaaaaattcctgaaagaagccagagggggaaaaacaacttacatatagagaagcaaagttaagaattatgtcctcctctgaagccatgcaaacaaaaagagagtggagtgaacacttctttcacgtgttgagagaaacaagtacctactatgtgccaggtgctcttctggggattatgaacagtacagaggtaaataagacgttagctctaacctctacraatggaaatgagtccaaaatagccataacacaaggtagaaaggaaaacataccagaagaaatggtgagagaaggtgctatgtggtgtgacacacaacttttagctgctggctattagtgatcagcaggagttagtaaaagctgtaaggcagaggtgacactctgccaaggtatcacgaaagaggcattctacgtagagaaaaaccagaaacccaggtaccaaaggaggaggtgccggagtgggatggtagaaaattgagaactgcaaatcattcattatggttgaagcatatttgtgaga

SEQ ID NO: 26013 - DNA, 601 bp, Human
cagagtgtcgtggctcaccctagcagagacacatgagcataaatctcccagggaaccaaggttggggtaggaaaagctggaggacaggtgtggacaagtctgagtaacagttaaagaatgccttgatgggcttattaatagttagacgtggctgaggacagtctctgagcctgaggatatatcaatagagaccttccaaatggaaaaagcaaagaaaacaaagactgaaaagcagaacagaagatcgaaggaccatggaacaaccacaaaaggtgtatcctacacaaaatgggaataccaraagaagaaagaaaggaacagaagaaatatctgaaacaagaatgactaagaatttcccacaaataaatgttagacaccaaccacagatccaggaagctcagaaaacaccaaggaggatatatgccaaaaaaactatggctaggcatatcgttttcacactacagaaaatcaaagataaagaaaaattcctgaaagaagccagagggggaaaaacaacttacatatagagaagcaaagttaagaattatgtcctcctctgaagccatgcaaacaaaaagagagtggagtgaacacttctttc

SEQ ID NO: 26014 - DNA, 601 bp, Human
ggtgtccattttccggcattcaatactataaccatcaaagtcagaatcaggagggatccaagaacaggcaatggccgtggagttctgaggccggcaatgcaggttttgtatcttgtcaggctctaaaggaaacagaggaggcaacacttttcagaactcagggagaatttttttttttcagctcctttgggtccaactagctctgagatctaggtataggagggacagacaggcaaatacagagtgtcgtggctcaccctagcagagacacatgagcataaatctcccagggaaccaaggytggggtaggaaaagctggaggacaggtgtggacaagtctgagtaacagttaaagaatgccttgatgggcttattaatagttagacgtggctgaggacagtctctgagcctgaggatatatcaatagagaccttccaaatggaaaaagcaaagaaaacaaagactgaaaagcagaacagaagatcgaaggaccatggaacaaccacaaaaggtgtatcctacacaaaatgggaataccagaagaagaaagaaaggaacagaagaaatatctgaaacaagaatgactaagaatttcccacaa

SEQ ID NO: 26015 - DNA, 601 bp, Human
ctcgctggtcatgccggccgactgcactttgatggacaccaggtacctcttatggggcactagcatcatgatgttgagcagagatttttctttctccagctttctggaaaactcaacttcttgggtgtccattttccggcattcaatactataaccatcaaagtcagaatcaggagggatccaagaacaggcaatggccgtggagttctgaggccggcaatgcaggttttgtatcttgtcaggctctaaaggaaacagaggaggcaacacttttcagaactcagggagaatttttttttttcagctcctttgggtccaactagctctgagatctaggtataggagggacagacaggcaaatacagagtgtcgtggctcaccctagcagagacacatgagcataaatctcccagggaaccaaggttggggtaggaaaagctggaggacaggtgtggacaagtctgagtaacagttaaagaatgccttgatgggcttattaatagttagacgtggctgaggacagtctctgagcctgaggatatatcaatagagaccttccaaatggaaaaagcaaagaaaacaaagactgaaaagcagaaca

SEQ ID NO: 26016 - DNA, 601 bp, Human
ttcagcagaatttcctgaagttgtagcttcaaattgcttaagagctccattatagctctaactatatgaggcaaagtgatatatttaaatactaactcattcaggtactttaagaccatctaacttgtttgctgtcagggtactttacccagagaaatgtttccatttctggagacttttaggtcctcctctccaggtggcaatcagacaggcttatgcaaaagtgaagtgtatgcaagtgaatagcagtgatggatatgatagagaaaggtgcacagccccttcactccagtgacaggargctctgtgcgcacctccagggacacttacggtctatcattgtgatagtgctgtcttcaaccacctcgctggtcatgccggccgactgcactttgatggacaccaggtacctcttatggggcactagcatcatgatgttgagcagagatttttctttctccagctttctggaaaactcaacttcttgggtgtccattttccggcattcaatactataaccatcaaagtcagaatcaggagggatccaagaacaggcaatggccgtggagttctgaggccggcaatgcaggttttgtatctt

SEQ ID NO: 26017 - DNA, 601 bp, Human
agttgaggcatattaatgtttaatggtagaacaaaagagtagtgaacaagactgacccaataatgaagaggactgaataaggcattacatgcaatgcacttccaatagtgcacagcacgtagtaagggctcaataaatgatggttattgttattatcgttgtggttgctattatcattactcttctatttaataattaaacccagaggataacaggctttattgcccaaagagcctttgagcagctttttcttacatctccctgtatccagcagagagaggggtgaatgatacaaaaattmcattttctacttaagtttcttaaactttgtcacagaaagatctcccacatgacctctgaggaagcaattctgtgtctcagagtggagttaactcatgataacttaccatcagcctctctcaccaccactgtgaagtatttcacagctccattggtgtcgctgaaccagctgcagttgacagtaaagttgatggaagacttgctaattagcacatccttttcattcacacgaatgtgtgggggtggaggaggggggcctggaaaaagaggtggggaaggaaccaagaggggtcacaactct

SEQ ID NO: 26018 - DNA, 601 bp, Human
agggccaggcatggtggctcacacctgtaatcccagcactttgggaggccaaggcaggcagatcacttgaggccaggagttggagaccagcctggccaacatggtgaaaccccatctctactaaaaatacaaaacttagccgggtgtggtggcgtgcacttgtaatcccagctacttgggaggctgaggcaagagaattgcttgaaccagggaggcagaggttgcagtgagccgagatggcaccactgcactccagtctgggcaacagagtaagactctgtctcaaaaaaaaaaaaaaaawaataatgaaagttgtagaagaaagaacaatctattaagaaccttcagttcttcccttaatgaactggagcttttgcatagtgctgaagtcccttttgacacattacctgcaagtggaggcaggaatccaacgtttataaattacccagtaaaatgcacagtactcttgtaacgtaggttattaatctatggaagctcgcatgcatcagttgctcagacagctgagtgcttagtaatgtagcatgtcccttctagcaaaacagtggtaatatatctaacctgtaggcagtgtgtggcttca

SEQ ID NO: 26019 - DNA, 601 bp, Human
ggggctcttccaaagacctccgcagttactatgggtgctgggagattggtgggctctggtccagacacaaattttttatagcttcttactctctttgaaatttagtaatgagttatcttcacccctcccctttccataagtaaacaaactaaatcagcttcagttttccaactcaaaaagaaaatagcccttaggtgacttttgctcgagtttccttgagcccaggtaaccaaggagatgaggaatctcttgaatctttttttttttcttttttattttttagatggagtcttgctctgtygcccaggctggagtacagtggcatgatctcagcttactgcaacctccacctctagggttcaagcaattctcctgcctcagcttcccaagtagctgggattacaggcgtgcaccaccgtgcctggccaacttttgtgtttttagtagagacggagttttaccatgttggccaggctagtcttgaactcctgacctcaagtgattcgcccacctcggcctcccaaagtgctgggattacaggcgtgagcctccacgcccagccgcatctcttgattcttacaggaactgataaatcctggtt

SEQ ID NO: 26020 - DNA, 601 bp, Human
atgaagccataacacgaatgtgttacatccttagagcatcttggctcattcccgtatttgttcataaacatttcacaagcacatcctttgtgccaggaacttgccatattgttttgtaaccaatgacacatctgtctcccctgttggactgtgagttcttgcagtctagtaaagagggcaggtaattcgataaagggttaaaagccactgtaaatgtaggattagaggaatgtaggcagacggtgatggggacgtggacatggggctgatggagcacccaactgcccagctgtgggctgayaggatagtgtgggtggttgagggttgagctggcttttgaagtgtacagagaattcgccagccagataagagcggaaagcatctgagagtgaaaagattatgcaaaggctcaggcgtataaaagaaccatgtcacattcaggaactctgaggagtgaggagtagcaagagagcagtgggtacttggagcaaatacgattggagacaaggctggtgaggcaggcgggagaaagcagggctcagtgtgccctgtactggaatctgctcttgctctggtaagtgaatgggaactatgggaaaac

SEQ ID NO: 26021 - DNA, 601 bp, Human
agcaatgggaataaagcatgtgggactgcttcattcagaatggtagtgatgaaggcagtgagtgagaagtgttggatatatcaaaggaagaactaaaagatttgctgatgaatatagagtatggatgattccacatgttctggatggggaacaactggaagaatggaggtgtcacctactaacatgagggaaaactattgagaagtagactggggggtttgggaagatccagacagatcagttgtggaggaagtaattctgagatgcccattagagaagtcaagtggcccaaatatcaatrttattgttgttgttattttaacttacatatcttttggcactattttctaaagatcattttatctaaaaatattctaatatcatatttattgtcaacaggaaatatttgttaaagcactgctttataaattgctgaagttaaaaagagatgtatggtcactagtcttggaaacttgaaagacaaaatacaaaggaatcaggcaaatagcaaaataagaaagcatatatacaatggcaaatgaggaatggtagaatatggaggaaacagtgtgtgtgggcataggaggtgaggtggctggag

SEQ ID NO: 26022 - DNA, 601 bp, Human
caaggaacaaaacaaagtccctgccattccagaggttacattctcatggaggaagtcagacaataaacacacaaatataataaatcagatgagatgtgtgctatgaaaaagaaaagagcagggtaaggaagatggaaagcaatgggaataaagcatgtgggactgcttcattcagaatggtagtgatgaaggcagtgagtgagaagtgttggatatatcaaaggaagaactaaaagatttgctgatgaatatagagtatggatgattccacatgttctggatggggaacaactggaagaakggaggtgtcacctactaacatgagggaaaactattgagaagtagactggggggtttgggaagatccagacagatcagttgtggaggaagtaattctgagatgcccattagagaagtcaagtggcccaaatatcaatattattgttgttgttattttaacttacatatcttttggcactattttctaaagatcattttatctaaaaatattctaatatcatatttattgtcaacaggaaatatttgttaaagcactgctttataaattgctgaagttaaaaagagatgtatggtcactagt

SEQ ID NO: 26023 - DNA, 601 bp, Human
taataagcaaaaggaagaaaaatcacctgtatttccattactttgagatacacatcattaatactttggtgtttttttcttttagtctttttttcctgagcatttctgtgtatatgcatatatacattctcacttttaactgaaagtgttttgtagtaacttatattttggcctgtgaaaactcttgattttaatggttttcactcactatttagaaaataattcatttttaatagaaaaaaatactgtacttccaccttctttttagattaaccccctttcaatccattcttctagagargttgtacaatccctttgatccacatcaatttttggtcacataaagattaagttccaaatgaaaataaatgttccccccaccatcagccaatatctccccattagaggctcttgtaggtgacatggcagttggtagaacatgatgtaaaggttagccttacctgattcagtagtgatgggtaaagaaaaaaatgtgtctgaatagagtggctttgtgaattccttcaggtcctcatcaaagagctgtgtaaaagctcgaatgctgattctgaaaagaaaaccgatttatttaaatataaat

SEQ ID NO: 26024 - DNA, 601 bp, Human
tgggaggtggaggttgcattgagccaaggtggcatcaccgcactacagcctgggtgacagagcaagactccgtcttgaaaaaaaaaaaaatatatatatatatatggcctggcgtggtggcttacgcctgtaatcccagcactttgggaggccgagacaggtggatcacaaggtcaggagatcgagaacatcctggccaacacgtgaaaccctgtctctactaaaaatataaaaaaattagccgggcgtggtggcgggcgcctgtagtccctgctacttaggaggctgaggcaggagaatrgcgtgaacctgggaggcggagcttgcagcgagccgagatcgcaccactgcactccagcctgggcgacagagcgagactttctcaaaaaaaagaaaaaaaaaaaaggaaaaaaatatatatattacactatatatatagtgtaatttgtgtttttattattaaattgtgaggtaagagttctttatatgctattcagcccttatcagatatgtgatttggaaaataaatattttcttcctattctgtaggttgtctttttactttgctgatagtgtcctttgaagcacaagtttttaattt

SEQ ID NO: 26025 - DNA, 601 bp, Human
ctttttgattatagccatgctactgggtgtgaagtggtatcttcttgtgattttgatttgcatttccctaatgattcatgatgttgagcatcttttcatgtgcttattagtcaactgtatatcttctttggagacatgtctattcagagcctttgcccatttaaatattgtgtaatttggctgggcacggtggctcatacctgtaatcccagcattttgggaggctgaggcaggcagatcacgaagccaggagttcgagaccagcctggccaacatggtgaaaccttgtctctactaaaaatacaaaaattagccgggtgtggtggcgcatgcctgtagtcccagctactggggaggctgaggcaggagaattgcttgaatttgggaggtggaggttgcattgagccaaggtggcatcaccgcactacagcctgggtgacagagcaagactccgtcttgaaaaaaaaaaaaatatatatatatatatggcctggcgtggtggcttacgcctgtaatcccagcactttgggaggccgagacaggtggatcacaaggtcaggagatcgagaacatcctggccaacacgtgaaaccctgtctct

SEQ ID NO: 26026 - DNA, 601 bp, Human
tactgtctttttgattatagccatgctactgggtgtgaagtggtatcttcttgtgattttgatttgcatttccctaatgattcatgatgttgagcatcttttcatgtgcttattagtcaactgtatatcttctttggagacatgtctattcagagcctttgcccatttaaatattgtgtaatttggctgggcacggtggctcatacctgtaatcccagcattttgggaggctgaggcaggcagatcacgaagccaggagttcgagaccagcctggccaacatggtgaaaccttgtctctamtaaaaatacaaaaattagccgggtgtggtggcgcatgcctgtagtcccagctactggggaggctgaggcaggagaattgcttgaatttgggaggtggaggttgcattgagccaaggtggcatcaccgcactacagcctgggtgacagagcaagactccgtcttgaaaaaaaaaaaaatatatatatatatatggcctggcgtggtggcttacgcctgtaatcccagcactttgggaggccgagacaggtggatcacaaggtcaggagatcgagaacatcctggccaacacgtgaaaccct

SEQ ID NO: 26027 - DNA, 601 bp, Human
ggtaagagtggcctcatttttaaaatagctttattgaaatatcattcatatagcatgcaactcacccatctaagttgtacaattcagtggtctttagtatagtcaaagttttgcaaatgtcaccacaatcaattttaaaacattttcatcaccctcaaaagaaaccgcatacctattagcagtcagtcccactcctccctccccgcgatccctggcaaccactaatctactttctgtgtctgtggatttgcctattctggatgtttcatagaaatgaaatcataaatctgtgatcttttgkgactggctcctttcatttagcataatgttttcaaggttcatccatgttatagcatataccaagatttcattcctttttatggttgaataatcgtccattgtatggatatatcacatttttgtttatccattgatggacatttaaattgcttctactttttggcgattatgaataatgctgctatgaacattcatgtacaagtttctatgtggacatatgttttcatttctcctgggtatatactgaggagtgaaattgctgggtcgtatggtaactctaggtttaatatttctataaact

SEQ ID NO: 26028 - DNA, 601 bp, Human
caagtgatgcccacgatgaggcatttactttccaaaggctctgagtatgcacctaagaagatgatgaaaggctggctcccaccctgtagcagtgaggccaggtgtcactgcatacttttgaagttaatgttgcatagcttatagaggaattttggactttgcacttgtatataaagcttggggcacctgagataaaggccataagtttgccaccaagataaaaatgccatttcatttatataaaacatgttacacagcatctggggctttggaaaatccagtggattgcttggagctattytaagaagtcttatttttattatctggtatggtaacgctactgggagtttatgaagaggtaagagtggcctcatttttaaaatagctttattgaaatatcattcatatagcatgcaactcacccatctaagttgtacaattcagtggtctttagtatagtcaaagttttgcaaatgtcaccacaatcaattttaaaacattttcatcaccctcaaaagaaaccgcatacctattagcagtcagtcccactcctccctccccgcgatccctggcaaccactaatctactttctgtgtctgtg

SEQ ID NO: 26029 - DNA, 601 bp, Human
taaggcaacaacagccactagcatgccaattaaaaacagaccagcactcacaccttcaatagctccaaacaagggctctacaataatccagatagaaacaacaaacgcaggtgggaaaattagtgctagggaaccagtaagaaagctattgaagccatatctcccaagtaatgttattacaaatagaattcaagtgatgcccacgatgaggcatttactttccaaaggctctgagtatgcacctaagaagatgatgaaaggctggctcccaccctgtagcagtgaggccaggtgtcactgyatacttttgaagttaatgttgcatagcttatagaggaattttggactttgcacttgtatataaagcttggggcacctgagataaaggccataagtttgccaccaagataaaaatgccatttcatttatataaaacatgttacacagcatctggggctttggaaaatccagtggattgcttggagctattttaagaagtcttatttttattatctggtatggtaacgctactgggagtttatgaagaggtaagagtggcctcatttttaaaatagctttattgaaatatcattcatatagc

SEQ ID NO: 26030 - DNA, 601 bp, Human
attctgcctgagttgtacctcgtattccttggatagaaggtagttggagtcagcctgtagcttcatgaaatgcccttcaaactgatttatttttattggactgtaattaaaaatgaaacaaacagaaaagagttactgcagaaaagggaaagtgccataactattctgactcatatttcaaaggcagataatatagtaattaatgtgttctctctcttaccaagaagttttccggttactgtgaagagaagccaaaagaggaagactttgttagcaaatttcacataataccatctttcarcaaattatacgaaggcaaatgtggtgcttaccctttctggcccaggtttaagtggacagataatggtcgatccctacgaatgctcagacgggcagagggtctttctcgaccatggctgaaacataagggagataacttttattctgattatgatacttggcttgaacaaatttttccatttatggtaaggctgtggatgtttgtgcaaatatggatttttcagtattcatatagatttgcactcagccaacatctctgagggagggaaaggaaagagaataaagtagatcattcccaccc

SEQ ID NO: 26031 - DNA, 601 bp, Human
agctccctttcactgctggaatgaatacaatccagaaaacctaccttctattgctttacctaatggggtaaggaaatttaagtagaaattgctaaccgaagactttgctaagcaaacccaggtctgcttgatgtcagagcccttgctgttaaccccatttactgcttagcctccaaagagaagcaatagcatcacatggggaaatgtcaacagcataagaggactttcataatcagaatttaaactggctattatccctctggagggaagtgcaggaatatacaagctatttcttattaaaggcattcagagcttgagattgtccatatcgagctatattatatttctttagcctcatttcatttttggagaaaaatgcagaaatggctagaggaagacagtattacaaattttgacacaaaacttacagggcaatatattgttgtatcgatttttccctctattctccggcaagagtgcaatgtcacatgactggtttcggcccacgtcttttaactcctgttaggtcaaatatgagtttgtaagtggagaatatgaaatagaataaagcaaatcatacagtcctggagataacataata

SEQ ID NO: 26032 - DNA, 601 bp, Human
ggccagctccctttcactgctggaatgaatacaatccagaaaacctaccttctattgctttacctaatggggtaaggaaatttaagtagaaattgctaaccgaagactttgctaagcaaacccaggtctgcttgatgtcagagcccttgctgttaaccccatttactgcttagcctccaaagagaagcaatagcatcacatggggaaatgtcaacagcataagaggactttcataatcagaatttaaactggctattatccctctggagggaagtgcaggaatatacaagctatttcttaytaaaggcattcagagcttgagattgtccatatcgagctatattatatttctttagcctcatttcatttttggagaaaaatgcagaaatggctagaggaagacagtattacaaattttgacacaaaacttacagggcaatatattgttgtatcgatttttccctctattctccggcaagagtgcaatgtcacatgactggtttcggcccacgtcttttaactcctgttaggtcaaatatgagtttgtaagtggagaatatgaaatagaataaagcaaatcatacagtcctggagataacat

SEQ ID NO: 26033 - DNA, 601 bp, Human
ggaagagaaactgttgactgagcgtctaccatctaatgtgtcgcaggtcaggacttatttaatccaaaccacagtccaagagcgggatattttcatctactccttctgcactccggcaatgacagcaattccttgtcaattctagtcgaagctctttctctttgcctttcctcagggtctccacattatgtcacctctgccatcgccacccccgcccacccaaacactgcttctcatctgaccaatccttacttatcctcagcatggtgcctgcttggctgagccttcttttatctttctstctgctgggggatattctccaagatgccccatggcaatctctagcctctcgctactgagtgccgttctcagaccagcagcactgaaatcaccaagaggcttgtcagaaatgcagactcggccgggcgcagtggctcacccctgtaatcccagcactttgggaggccaaggcgggcggatcatgaggtcaggagatggagatcttcctggctaacacggtgaaaccccgtctctactaaaaatacaaaaaaatattagccaggcgtggtggcaggtgcctgtagtctcagctactcgggcg

SEQ ID NO: 26034 - DNA, 601 bp, Human
tggcagaaagcaaagctttgatgccaggaaggctgtttactcactcggcccttctcaacacactgggtcaccatgacgatgttgtgaacgttttgttcccacaccattttccagaagtcatccttggtgccaggaagcggtccctgagtgacaatgtattctcttctgaagttgttgccctgcaatgaatttacaatatggagagtcagaaacaatgggcctcttcagaactataaacaaagagttcttcagattagatgatagggaggtctctgccaagtctctgacttcagaaaaagakactaacacaagtgtcaatgcttgggagcaggaaggacaaaggtcagaacattgaactagtgttaagagccacattcccttttacttgcctgggtctattctgaaagcaaatgggggacttaggcaatgatctagaaaacacttcaccctcaattatatgtgtgtgttggggggtatttgtgtagactgttggagggactgtaatcaggctctttccctatttaatgtagaagagtgttagtcattttggataatcaatgtcagaataatttggtaagatatatcatccacaggaagcatc

SEQ ID NO: 26035 - DNA, 601 bp, Human
atggtcacactttacctagaacaggacagacagaaaaaacatgagtccggaaaagtgactccttggtgaacctggggtttccctcctctaaatgtcttccaaagttaggaatctgggatcagctgctaaagcaatttgaccatctactttatattaaccttctcatggccagtgctgaagctgaggtgctgctccaagtgaaggggagagcctgtacaaggagcacccctgactccaacctttgggttcactcattttttaggcccagtaatatatggcttgagttttttttttttttttktttttttcccctcagcatttcagttccactagcaggtaaactgtggttcacaacgtattgttctttctaaagaaagaaatatctagttgggtagaggaaggcactgtcttcctggcccttcttcgttcatatttttatgtcactgtcctaacgtgggccgtgtgccaagagatctttgagaagttagaacgtttagctaagctcgcctttacatgtatacagacaaggggaagaggaatgtaagcatatgtttactgagcgcagatactaggcactttatacgtaatctctcttttaatc

SEQ ID NO: 26036 - DNA, 601 bp, Human
ctggccagtaatggtcacactttacctagaacaggacagacagaaaaaacatgagtccggaaaagtgactccttggtgaacctggggtttccctcctctaaatgtcttccaaagttaggaatctgggatcagctgctaaagcaatttgaccatctactttatattaaccttctcatggccagtgctgaagctgaggtgctgctccaagtgaaggggagagcctgtacaaggagcacccctgactccaacctttgggttcactcattttttaggcccagtaatatatggcttgagttttttktttttttttttttttttcccctcagcatttcagttccactagcaggtaaactgtggttcacaacgtattgttctttctaaagaaagaaatatctagttgggtagaggaaggcactgtcttcctggcccttcttcgttcatatttttatgtcactgtcctaacgtgggccgtgtgccaagagatctttgagaagttagaacgtttagctaagctcgcctttacatgtatacagacaaggggaagaggaatgtaagcatatgtttactgagcgcagatactaggcactttatacgtaatctc

SEQ ID NO: 26037 - DNA, 601 bp, Human
gagcaggataaaagaggaactgtccaatgcaaaccttcaaacttgacagctgagccatggagcaactcctatgggctgaaactacaagagaggaaccagcgaaagtggggttcacagatctcattcatctccccaagctcggttgttaagtcaagcaagctaacatacaccgcatatcttaaactcccggatggtccactcaggcaggacggactctgagagcatctgcaggatgaggtccccatagtagagggaatcctggtccgctggccagtaatggtcacactttacctagaacagracagacagaaaaaacatgagtccggaaaagtgactccttggtgaacctggggtttccctcctctaaatgtcttccaaagttaggaatctgggatcagctgctaaagcaatttgaccatctactttatattaaccttctcatggccagtgctgaagctgaggtgctgctccaagtgaaggggagagcctgtacaaggagcacccctgactccaacctttgggttcactcattttttaggcccagtaatatatggcttgagttttttttttttttttttttttttcccctcagcatttcagt

SEQ ID NO: 26038 - DNA, 601 bp, Human
aagccacctcagccacttcatggctgtgggctttgtgcaaagcccttaagcttttggaccttcattttctagtctggaagtagaatataatatgtctcgcttggttattgtgaaaatttaatgagataacatgttcaaaaatgccctgcaaatgtcaaagtgctgcacaaatggaagcacgtggtctttaccatctacatacactcccttggggtctcctgaaatgggggtgtaggtggagggagtggggctgggggagagaagagattgggatcttcttctttcctaagtgaagttcttatgctcatctgccagcctatcttaaaatgatccccaagatggtcaccttcaagaccagtgagatttgttttaaaataacaagtcttagaaaatatctacatgcagttctttttttctcttcctaatgtgtcatagttatttccccttgtcagattaaggtcctggatatttttttgtgggaatacagtggggaggagggtggcctgtaactttcagtctataactcttacctcagtctggaccatgtgaaccctgtgaagtcttaggtcgtgcactgctccataaatgtccacagagtctt

SEQ ID NO: 26039 - DNA, 601 bp, Human
cttatagcacaatcaagggcccaggtttctctagaatagtggccaagccacctcagccacttcatggctgtgggctttgtgcaaagcccttaagcttttggaccttcattttctagtctggaagtagaatataatatgtctcgcttggttattgtgaaaatttaatgagataacatgttcaaaaatgccctgcaaatgtcaaagtgctgcacaaatggaagcacgtggtctttaccatctacatacactcccttggggtctcctgaaatgggggtgtaggtggagggagtggggctgggggagagaagagattgggatcttcttctttcctaagtgaagttcttatgctcatctgccagcctatcttaaaatgatccccaagatggtcaccttcaagaccagtgagatttgttttaaaataacaagtcttagaaaatatctacatgcagttctttttttctcttcctaatgtgtcatagttatttccccttgtcagattaaggtcctggatatttttttgtgggaatacagtggggaggagggtggcctgtaactttcagtctataactcttacctcagtctggaccatgtgaaccctgtg

SEQ ID NO: 26040 - DNA, 601 bp, Human
atttttattttcatttctctggttcaattgttactggcttgaatgcaggatattaatatgtgctgcacaagaaaagaattcaggggtcaaggtggttttgggattagtgggttcaataaagctcaaagggggccttggctgcaggaagctctctttttatggagcattgctgtctgtgcattgtccttgggtactgtggctctaagaggggacacagaagcatgtagaactttttacttttccaaccatggattttttttttttaatacagaggattttgcttagttacttggagaaaaayttgtgaaacacgagggtaagagaatttgagccttagaaggcattgatgcagaggagtgaatgcttggtctctattgaggaagagatctgaccctgaggctagtacgcttatagcacaatcaagggcccaggtttctctagaatagtggccaagccacctcagccacttcatggctgtgggctttgtgcaaagcccttaagcttttggaccttcattttctagtctggaagtagaatataatatgtctcgcttggttattgtgaaaatttaatgagataacatgttcaaaaatgccctgca

SEQ ID NO: 26041 - DNA, 601 bp, Human
ttgttttgtcaaatgtgagttctgcagaatatttttaatttttattttcatttctctggttcaattgttactggcttgaatgcaggatattaatatgtgctgcacaagaaaagaattcaggggtcaaggtggttttgggattagtgggttcaataaagctcaaagggggccttggctgcaggaagctctctttttatggagcattgctgtctgtgcattgtccttgggtactgtggctctaagaggggacacagaagcatgtagaactttttacttttccaaccatggattttttttttttaatacagaggattttgcttagttacttggagaaaaacttgtgaaacacgagggtaagagaatttgagccttagaaggcattgatgcagaggagtgaatgcttggtctctattgaggaagagatctgaccctgaggctagtacgcttatagcacaatcaagggcccaggtttctctagaatagtggccaagccacctcagccacttcatggctgtgggctttgtgcaaagcccttaagcttttggaccttcattttctagtctggaagtagaatataatatgtctcgcttggttattgtga

SEQ ID NO: 26042 - DNA, 601 bp, Human
cctggcctcaagtgatctgcccctctccaggcctcccaaagcaccaggattacaggcatgagccactgtacccagccatgttttgtatattttttcaaaacaatttcataataaaacattcaaaatatggtagaatcattgttataatgaaagtactcccagcccaggacaatagtggtggcagaggttcctgcctgcaggaggcaatgatgccattgttttgtcaaatgtgagttctgcagaatatttttaatttttattttcatttctctggttcaattgttactggcttgaatgcagkatattaatatgtgctgcacaagaaaagaattcaggggtcaaggtggttttgggattagtgggttcaataaagctcaaagggggccttggctgcaggaagctctctttttatggagcattgctgtctgtgcattgtccttgggtactgtggctctaagaggggacacagaagcatgtagaactttttacttttccaaccatggattttttttttttaatacagaggattttgcttagttacttggagaaaaacttgtgaaacacgagggtaagagaatttgagccttagaaggcattgatg

SEQ ID NO: 26043 - DNA, 601 bp, Human
tatacatatacacatgcacatatacacatgtacacatatatgcaatatgacatgtattacacacatacatatatacatacacacgtgtacacatacatatgtgtatataagtatatgtgtatttaaggatgagataatatgataagtgggatttgctttaaaatatttcagtgggataaggtcatggggtaggggaacattaaatgtgggatacagatgggaaaagaacacagaatactgataattgtagaagcaggggtttgggtacatggaaactcactatactatttttcctagtttygtgtattttctttttaaaaattttttgtggagatgggctcttgctatgtggcctaggctggtgtcaaactcctggcctcaagtgatctgcccctctccaggcctcccaaagcaccaggattacaggcatgagccactgtacccagccatgttttgtatattttttcaaaacaatttcataataaaacattcaaaatatggtagaatcattgttataatgaaagtactcccagcccaggacaatagtggtggcagaggttcctgcctgcaggaggcaatgatgccattgttttgtcaaatg

SEQ ID NO: 26044 - DNA, 601 bp, Human
tctgctcacagacctttgtcatttattatgaatgttacatgcaatctcaatcttgaaaatctgagaaaggtacaatctgagaatggttgttagtataaagcagtctctttttgctaccttaaaaaggatccaccaaattataggctgacacctccctgtttcctcccacccaaagcataattcatcttttcagttctactgggatattacattactttgggactttagaggtaagctgtgaatgaactctagtgcatctgtgctatggcctattaataaattctttaacaatgattcaccrtgggctttgaaacaagttaatatctattaatttgccttgccttaaatacaaattcttcctttcccaatagaacgtccctttgaaaatgattactactaaaacggtgagattgttaatgtgcttctcactttattcttaatgaaaagtagacaaaatatatgaatctcagatcacaaaagataattttttgttaactggtgaaggcttggcttagtgttcacacattcagttccattcaatttcatcaatatttggagtattagatattatttatagtattacagtctctttgtgatccct

SEQ ID NO: 26045 - DNA, 601 bp, Human
atcgcttcactaatggtctctggtaaataaaagagtgactgtcttttattaccactgaaaagagaacaatggtaatgggcagagaggtggcatttttcattctttttatatatatatgtgtgtgtgcatatatgtgtgtatatatgtgtgtatatgtgtgtatatatgtgtgtatatatgtatatatgtgtatatatgtgtatatatgtatgtatatatgtgtgtatatgtatgtatatatatgtgtatatatgtatgtgtatatatgtgtgtgtgtgtgtgtgtatatatatatataaaatattctgtgagagcctacaactgtgtctagtacgtagtaggtcctttacaaattgagtagatgaacaaatgccggacactcctatgtagcttacgtaaattacctcatttaatgatttcaaaaaccttgtgaagtaaatacaattatcagtacaaagtgagactcaaaagtaacttctccaaggtcacacagctaagaaatggggccctagggtttgatcttggagatgtgacctcaaagttcatgtctttttcactacaccagttttcttagatgaatcccaatttcattgcattactg

SEQ ID NO: 26046 - DNA, 601 bp, Human
aacatcgcttcactaatggtctctggtaaataaaagagtgactgtcttttattaccactgaaaagagaacaatggtaatgggcagagaggtggcatttttcattctttttatatatatatgtgtgtgtgcatatatgtgtgtatatatgtgtgtatatgtgtgtatatatgtgtgtatatatgtatatatgtgtatatatgtgtatatatgtatgtatatatgtgtgtatatgtatgtatatatatgtgtatatatgtatgtgtatatatgtgtgtgtgtgtgtgtgtatatatatatattaaatattctgtgagagcctacaactgtgtctagtacgtagtaggtcctttacaaattgagtagatgaacaaatgccggacactcctatgtagcttacgtaaattacctcatttaatgatttcaaaaaccttgtgaagtaaatacaattatcagtacaaagtgagactcaaaagtaacttctccaaggtcacacagctaagaaatggggccctagggtttgatcttggagatgtgacctcaaagttcatgtctttttcactacaccagttttcttagatgaatcccaatttcattgcatta

SEQ ID NO: 26047 - DNA, 601 bp, Human
gtgctggtattacaggcatgagccactgcactcagctagaatcttttctttctttcttttttcttagaggcaggatcttgctttgtcacccaggctggagtgcagtggtacgatctcagctcactgtagccttgacctcccaagcccaagtgatcctccccctcagcctcccaagtaattgggactacgggcatgcaccatgatgtctggctattttttttttttttagttttttgtagagataggatctccctatgttgcccaggctggtttcaaactcttaggctcaagtgatcctcckgcctcagcctcccaaagtgctgggattacaggtgtaagcctctatgcctggccagattgaccatatcttgatgaagaaacttggggaagtaagtgaagtaagtgcccacctctgtgatactctggattcacattttcatagattggaaacaaggggttttcttgttcactccgtagctttcttgctctgaggacatctcttacacactgatgtaggtagacatactgacactgtggaaaagcagaaacatgtcagaggagggcctgttctcatgcataagaaagatgagaaactcacaaa

SEQ ID NO: 26048 - DNA, 601 bp, Human
aggaccctgataccttgattgacaaattattttccaaagggattttacaatttgaactagttgtgatttcaaagaatcctccccaagtagtaaagcttattgcttggaaaagaaaggttaagcagagtccttcatagcaggcatcctcagctaggctggaagagataccttgtgaaactgctgctcagctgcaggaaccccctccctaccctccctctcttccccgttgccactctttatgggtaggagaagaaatgggtggtgtacattggaagagctttaggttattaatggtttccakaatctttttcttttttctcttttcttctcccctcccctctcctcttcttttcttttcttttttttgagacagagtctcgctcttgttgcccagtctggagtgcagtggtgggatctcggcccactgcaacttctacctcccaggttcaagcagttctgcctcagcctcccgagtagctgggattacaggcgtgagccaccatgcctggctcttttgtacttttagtagagatggggtttcatcatgttggccaggctggtctcgaggtgatctgcccgccttggcctcccaaagtgctgg

SEQ ID NO: 26049 - DNA, 601 bp, Human
tagtgtggtaggagaaatacagggtcacaagataagaacatatgaaggaccctgataccttgattgacaaattattttccaaagggattttacaatttgaactagttgtgatttcaaagaatcctccccaagtagtaaagcttattgcttggaaaagaaaggttaagcagagtccttcatagcaggcatcctcagctaggctggaagagataccttgtgaaactgctgctcagctgcaggaaccccctccctaccctccctctcttccccgttgccactctttatgggtaggagaagaaaygggtggtgtacattggaagagctttaggttattaatggtttccagaatctttttcttttttctcttttcttctcccctcccctctcctcttcttttcttttcttttttttgagacagagtctcgctcttgttgcccagtctggagtgcagtggtgggatctcggcccactgcaacttctacctcccaggttcaagcagttctgcctcagcctcccgagtagctgggattacaggcgtgagccaccatgcctggctcttttgtacttttagtagagatggggtttcatcatgttggccagg

SEQ ID NO: 26050 - DNA, 601 bp, Human
ttctttttttttttttttttttgagatggactcttgctttgtggcccatgctggagtgcagtggcatgatcttggctcactgcaaccttcgcctctcgggttcaagcagttctcctgcctcagcctcccaagtagctggaactacaggcacacgtcaccatgcccggctaatttttgtatttttagtagagatggggtttcgtcatgttggccaggctggtcttgagctcctgacctcagctgatcacccaccttggcctcccaaagtgctgggattacagtcttgagccactatgcccamcctgtttgttttttgagatacaatcttgctctatcacccaggtggagtgcagtggcacaattacagctcactgtagccttcaactcctgggctcaagtgattctcctgcctcagcctcccaagtagctgggactacaggtgcacaccatgcctggttaatttttaaatttattgtagagaaggggtctcactttgctgcccaggcttgtcaaacttttagctacaaaaagcttcatgcataattttttttttgttttgtatatagtgtggtaggagaaatacagggtcacaagataagaa

SEQ ID NO: 26051 - DNA, 601 bp, Human
ccccagtctaagtcttgactgcaacctcctgaaagactctgggccagagccaccagtgagacaataaatgctgatttaaactgctaaatgttggggtaatttgttaggcagtaatagataactaatacaatcctccttcacatttgcagtttgcctatgtgataacttaggtcttcacgatggcccagagtaagacgacgcaggaggacccttctagtcatttaattattgcttgaccagaactgtgccttgtaaggtttgtgttttttttctattgaatttcccacttgaaaagtgttaygtgcttattctagaacatttataaaatacaaaaaaatagaaggaaaaataataatttttctaatgttcagggaaatttatattttctccagtctttttccttatgcgttgtttttgttttacatcctgcttttctttatttagctattataacatcctcaaaaatagcattcttttgtttgttttttctttttttttttttttttttgagatggactcttgctttgtggcccatgctggagtgcagtggcatgatcttggctcactgcaaccttcgcctctcgggttcaagcagttctcc

SEQ ID NO: 26052 - DNA, 601 bp, Human
gattaaacaaaaatacacttttaactgctaaactgcgctgactacgggagagctaagggccctattactatgcagttataatagaagacacacaattaaagtcagatcatgattcctgacaacatccgtggggtgggggctcccctgaggcccctgaggctgccgctcactggggaagggccttgaggatggcgttcacctcctcagccacggctgtcagcgcgaactcaaactgctcctgcagggcgagaaacgagagaagtgccaatgagagcggcgtccccccgactcctgccacagygtcggctccctgcagatgaaagcggcgtccccccttcccaacgcagcatcagctccccgggccatttcgcagaaagaaattgtttagcaaaaaaaagcaaaaggctcagatttccttagaaaggacagtgtacccttcggtttgggagacacaacagtgacacatgtttgagcttctctcgcactagaaaagcctcatctttccccctgcggggagaagctgcccacagaagcagcgagaaggcaacggttcctgcgtactgccctgtccttctgaccctacgactccacgattcctcct

SEQ ID NO: 26053 - DNA, 601 bp, Human
gggcttagcgccggagagcgtatctgcctcctctcccacagatgaggtggataaatgctcatttcctcttgctcttcagtttccacctcaaaacactgctatggaaaactccaaagcaggccagcagcactccagctacagctgagaacgcgtggacggaaacaacactgttacccagctaacaacttctggaaggaaagccctgttgacagctccaatacttgatcatttaaggaacagggcagccccaagccaaaaacgatgattaatttccagttttgaatgtttagtgcataacagmaagatggaaaatagcttgaaccgagacatcagaaagtcaaaataacgtgatgctcattctgagacaaaagacagtttctcctttcatattcttccgccctgatgctgacggaatggtctgctggactctacctgcctttggtagtgtggccacgcggcctcttagtgtacgtgttagaacctattattaaaggagtcaactgagcctggcggccacctcagggtgggacccggggagatgtgtctgcctgcgccccgtctctctcccctctgcactgccagagggcacctttctgctcct

SEQ ID NO: 26054 - DNA, 601 bp, Human
gaaaactccaaagcaggccagcagcactccagctacagctgagaacgcgtggacggaaacaacactgttacccagctaacaacttctggaaggaaagccctgttgacagctccaatacttgatcatttaaggaacagggcagccccaagccaaaaacgatgattaatttccagttttgaatgtttagtgcataacagcaagatggaaaatagcttgaaccgagacatcagaaagtcaaaataacgtgatgctcattctgagacaaaagacagtttctcctttcatattcttccgccctgaygctgacggaatggtctgctggactctacctgcctttggtagtgtggccacgcggcctcttagtgtacgtgttagaacctattattaaaggagtcaactgagcctggcggccacctcagggtgggacccggggagatgtgtctgcctgcgccccgtctctctcccctctgcactgccagagggcacctttctgctcctcgaaattacgtgggagctgcccctgtgggggcaggggctcaggtcgggctgtgccgggaaggtccgcaaacgttctgtctaaatgctgactcctgcccctccc

SEQ ID NO: 26055 - DNA, 601 bp, Human
gaaggtgctgtttaggggatccaggctaaatacacaacagccattcagaccatttcttccccagtgctgggctgccagtgccctgaggctctgtgagggcttggagatgccaaaaattaagcgtggctttttgggaagcgaaatgcaagtgtcatctatctatttacatcttccgacacactggaaatctagcctgagaaatgatctttaaagggaagaatagagaagcgctgccgccccgcagccccatcatgcagtggaggctggaaagcgctccacccccagggccagtgctaatccygcagagctgcccagcggcctctcaggcagccacttgcggcatccaacaggaaagcccaatatccatgctatgggggaggggacgggcagggggaactccaccagggtctggatcataactgtttccaacactgcacagtcaccggacagagcagcaggaagggaaccgggccacagagacaggtgctctactcactggccatgtttggcaattgttaccgcactgtttagctcaaaggagaagctccaccgggcgtgtgggctggtgtgtgccgtgcaccttactcagagcccactgggc

SEQ ID NO: 26056 - DNA, 601 bp, Human
cactgtttagctcaaaggagaagctccaccgggcgtgtgggctggtgtgtgccgtgcaccttactcagagcccactgggccctgtgggcgtcggctggcaggaggagggggtgcttcccggaggggtgctgtgagcctcagagctggcgtttgaggggacaggggcttgtggatcatcttgtcctttatcgtgaagtgtcagctgcatgcggcgccgggatgtagcacccaagccctgtgggtcctcgaaggtctgtggccacgttctgagcagaatccgctgagcaagtatcacctagamccatgctctagatcccgggtaggctgggaaaaccccagcatttggataacttttatgataggagtttatttcaaaggagtaaaatacaacagcaacagatgaccagatgaccatcttagcctaaactgcatctgagtgccagcagtctgaacaggaggggtgcaaagcctcctgggtttgcaaagacaggacattcgagaggccgagtcaggacattctaagcaagaaagcatttttgaacacatactacaataaaatttgaggcctgttggagaaagatcccacggcttcttccagtag

SEQ ID NO: 26057 - DNA, 601 bp, Human
tgtggggggtgtgcctgggtgtgtgcatggggatgcgcagtgtgtggctgagtgtgggtgtgcactgcgtgagtgggtgtgtaggtgtgtgtggatgtatgcatgggtgtgtgcaggtgtgtgggtgtgcagtgtccctggctgcatgtgggtgtgcgcagtgtgcaggtgtgtgggtgtacgcagtgtgtgtggctgagtgtgccgcctctctggcggctcgtgtggtgtcaaagcccgcactgccgttcagcccctgggtgcctggacttctcttctaagatgatggagtttgtggtckgggactgagttgccaaatgctcaggtgggcgctggtgaaatattttctattcgacccaaattccagggaggaaacagctctcctgaggggcatcttttttaccacaacgatgatgttttgctgtcagggcctgcggtcatcctggtcatggtctccgggtgctcaccctcgacggctcgctctttccttgtcttcagttccaaaccaggcgacgtgacttcctccgttcaaaggagctgcaggcgcctcctcttggcttcgtagaagcaagcattcagattggacagcagcattttgccc

SEQ ID NO: 26058 - DNA, 601 bp, Human
ccctgaggaagagggtgaactcctccggacgcccagtccaagaaggaagcagctaggaagctgactctgttatctggagtgcagaaaacggagcttcgggtcaccaagtgatctgggcaacagggctggggtgtgtatgtgttatcatcttgctatttatttatttatttatatttaagttctgggatacatgtgcaggacgggcagctttgttacataggtaaacgtatgccatggtggtttgccgcacccatgaatccatcaccgaggaattaagctccgcatgcattagctatcatcstgatgctccccatcccccttccccactgacaggccccagtgtgtgctattcccctcccagtgtccatgtgttctcattgttcagctgtcatttataagtgggaacaggcagtgtttggttttctgttcctgtgtttgtttgctgaggatgatggcttccagccccatccatgtcgctgtaaaggacatgatctcattcctttttatggctgcatagtcttccatggtgtatatgtgccacattttctttatccagtctatcattgatgggcatttgcgttggttccatgtctttgctgcc

SEQ ID NO: 26059 - DNA, 601 bp, Human
gaggctgcctgagaggcaggcagaggtgtggggaggaaactactttgaatttagatttcctggggcttatcccagagtgggcctcactgtggagtcacgaacacacctgcctgaggtggctctcgctgaccattcctggtaatgtgtgccccgttctcccagcctccatggcctcctctgtccagttcagagccacctgaagctcacgggatgcagggccagccagaaggtggtatgtgccagccttgacaaggccacctcttttactgctaggcagccagtacaggaggatggtcagtgmggcaagatggacccttccaaggttggacccttccatggcacaaaacctggaactccttggtacagagaggccagacacacgtcaacctcacgtccagttcctgttgagccaaagctcatgagaacttttttgttttgatggctgttgctgctggaacagcagctgtcccgtgtcacctcctctctcgacagcctcgcaacacatgccgaatgctgttgtgaacaagcagaaggaaagacagacatgtgcacagtcccagcttctccccgcgggacactgagtaaccacacagggaaaaat

SEQ ID NO: 26060 - DNA, 601 bp, Human
ataatacttcaacagtagcaaaggaaaaaaaatttccctttttttctggaagaagagtagcctcaggatcatccttttcttatgaggaatgtgtgaagccatttcctgcccccgtgcagacgctgtcactgggttgcatgagtttgagagaccttcttaaaagtacatagggctcgtgttcacacccatgactggcttttaaacagaggaccttttacatttataatcctagcaaaatcaattgtgactttccggaaaacgaataaatgtttccatttcaagacttcaagaaagatgtgamtacccagcagatatcacactttcggttctgctttctatgccgtctgtgatcccaagaaatgactggaatcctataggtgatcttttgatggtaaagaatcagcgcattttggctttaacatgtttcctcaaacaaatggttgaaaaaagctgcagttgggatggtaaatgtttaaaaaacggcacgttcacatcctcacaccctcactgcatcaccaaggaggagaggcggtcggcctgggccgccacgtaaccctcactgctcatttcaaagggccacggtgagcattctggttgctga

SEQ ID NO: 26061 - DNA, 601 bp, Human
atgcaacaggctgaaaccattgtctcgatgtttctgtgtcatgggaccacagggtttaagaacaagcaaggtggcaggacatgctcacgggtgagtagaaggcaggacactgcaccgtgggctgctagaaaatattccatgtgaggcctcgcgcggtggctcacgcctgtaatcccagcacgttgggaggccgaggtcggtggatcatttgaggtcaggagttcgagaccagcctgaccaaatggtgaaacctcgtctctactaaaaatacaaaaaaaattagccgggcgtggtggcgggygcaatcgcttgatcccgggaggtggaggttgcagtgagcctgacgagaccacgccattgcactgcagcgtgggcaacagagtttaaaaaaaaaaaaaaaaaaaaagcaagccatgtgcagtttatacagacataatacaagcaacgcccaattgtatttacccaaatggcatagaaaagtaagtttatatttttggtttcctttagaagtgccagttagttatatttattaagcaattagaaagttaagcttctgtatttaattgcatagattagtttttgaggtagccaaaacttctta

SEQ ID NO: 26062 - DNA, 601 bp, Human
ccgggcgagagcgcaccgtcatgcaaagcaccagcaagcaaggtcagaggtcgttagaggctcagaaaaggggctttccacatcgcccctgcagtacagtcacagtttccaatgatcacttttgtgactatgcaactgggctcatattactagctgcaacatcacaaaaatgacactggccaccgctaattagctggcaaggtaagggtttgtccgttttaccgtgagcagcgttagtgagcaccattgcacacagcaagaagggagagagtaataatgagagagagagagagagagagaatttttaaagcaaagccctcacatgtgatgctaattatctcttagcagtttctctttaaagtgtaaatgcgctccctctgggctccagaaatatttaatcacacatctcggtgcctggcgaacgcgccaggccagagtgagaacgcgtcgtctattgttcaaagataagaaacgctgcagcatgaagatggccggtgtcttcagaaggggtctcacctttcctgtcgctgaaatcggggtggctattttatacagaaaaccagccaccggcaatgcttgtctaagtgtgaagcttcctgag

SEQ ID NO: 26063 - DNA, 601 bp, Human
tcaagtgtctccttgcagaggctcttgattgatttctattgattcaaattacaaaaaactgcattttgcttttcaatgtagactaaaaggcaaaataaattgaatcataataagcttcagaatctgtaatacacaaattcaagaattccacagagaattcaaaaatcgcttctttatgacaatctttgtctcgttaacctccctccagttacataactgtagactcgagaatgagtaactgttaagaatcaagtcactttatgatagtggggcatggcattggattcaaatgcattttttsttcttattctccttgtttggatatttgtctcttttcctcaataggtagacttctgatcagttaaatgtaagacatattctatacaatttagagcttcgtcactgatgcttttgacaatttcattttccttgtggtggtttattcactaagcaccaccacctagccaatgcggaccgactgtttaccacaatcaaagctgtggtcttaaatgctgcttttttttcattgtcaatttcttcctgtaagacagagtctagcattcacttcaacagttcagtaaatacactctcaaaccagaca

SEQ ID NO: 26064 - DNA, 601 bp, Human
actaaaaggcaaaataaattgaatcataataagcttcagaatctgtaatacacaaattcaagaattccacagagaattcaaaaatcgcttctttatgacaatctttgtctcgttaacctccctccagttacataactgtagactcgagaatgagtaactgttaagaatcaagtcactttatgatagtggggcatggcattggattcaaatgcattttttcttcttattctccttgtttggatatttgtctcttttcctcaataggtagacttctgatcagttaaatgtaagacatattctrtacaatttagagcttcgtcactgatgcttttgacaatttcattttccttgtggtggtttattcactaagcaccaccacctagccaatgcggaccgactgtttaccacaatcaaagctgtggtcttaaatgctgcttttttttcattgtcaatttcttcctgtaagacagagtctagcattcacttcaacagttcagtaaatacactctcaaaccagacaacgtattgggtgactggctgactggagcaatgaacaaaaaactgaattttttaaagagggtcagtttcaaaatagccctaa

SEQ ID NO: 26065 - DNA, 601 bp, Human
gagggcacattttacagcgcaggtgggttccctcggcttcgcggccccctcccaccttcccagtgttaacgcactgaagttagctccgtgcgggtgtgtgtgcttagtgttatttaggggcttgagcgtcaaataattttttaaaaggttacaatccaaaactatcctactttctgtcttttgcatgtccatgttacataaaccctcaaaaaaaggaaccagagaaaaattacacttttcaacaaaagcagcgacacgactacatgttctgctcagtggttccactctaagtgagactccrtcgcagctgcgcacacccgggtctagagcaggaaaagcaaaaggctcacggagtcgcgctgatgtgaaccccagcgcaggcacttccgggcctaagcatttctgcaggaaccccaaggccacagctgtgtggtttaaggttcacacttgagcctctaactcgcttcctactgtggagctttggcattctcactcatttaatgccaaacagaatcaaagcatgcattctagtgctggcttaatcacccacgtttatttacttcattcttgatgggggcagaaaatccagccagataaataa

SEQ ID NO: 26066 - DNA, 601 bp, Human
tgtgcttagtgttatttaggggcttgagcgtcaaataattttttaaaaggttacaatccaaaactatcctactttctgtcttttgcatgtccatgttacataaaccctcaaaaaaaggaaccagagaaaaattacacttttcaacaaaagcagcgacacgactacatgttctgctcagtggttccactctaagtgagactccatcgcagctgcgcacacccgggtctagagcaggaaaagcaaaaggctcacggagtcgcgctgatgtgaaccccagcgcaggcacttccgggcctaagcrtttctgcaggaaccccaaggccacagctgtgtggtttaaggttcacacttgagcctctaactcgcttcctactgtggagctttggcattctcactcatttaatgccaaacagaatcaaagcatgcattctagtgctggcttaatcacccacgtttatttacttcattcttgatgggggcagaaaatccagccagataaataaactggtgagcaggttatcctcaaataaaaaggtcacatgatccagccacgaaactccaagcagagccacggggaggccacacggctcaggcactggca

SEQ ID NO: 26067 - DNA, 601 bp, Human
cagcgacacgactacatgttctgctcagtggttccactctaagtgagactccatcgcagctgcgcacacccgggtctagagcaggaaaagcaaaaggctcacggagtcgcgctgatgtgaaccccagcgcaggcacttccgggcctaagcatttctgcaggaaccccaaggccacagctgtgtggtttaaggttcacacttgagcctctaactcgcttcctactgtggagctttggcattctcactcatttaatgccaaacagaatcaaagcatgcattctagtgctggcttaatcacccmcgtttatttacttcattcttgatgggggcagaaaatccagccagataaataaactggtgagcaggttatcctcaaataaaaaggtcacatgatccagccacgaaactccaagcagagccacggggaggccacacggctcaggcactggcatcaaggatgggcgccaggttttcttaaaaacggaccccacttaaaggcttgttatatgggaccgggaccacgctgtgaggcgaatgttttttctactctgttatcatttggatttagaaaaatctaaaagataaaaaccacaccacactc

SEQ ID NO: 26068 - DNA, 601 bp, Human
ctggtgagcaggttatcctcaaataaaaaggtcacatgatccagccacgaaactccaagcagagccacggggaggccacacggctcaggcactggcatcaaggatgggcgccaggttttcttaaaaacggaccccacttaaaggcttgttatatgggaccgggaccacgctgtgaggcgaatgttttttctactctgttatcatttggatttagaaaaatctaaaagataaaaaccacaccacactcccagggtctggttcatgagcacacagccgtgtgaaccatccacacgggcatgcrgccctcgggggtgactcagcctccgtcccctgaacatggggtgcgctgagcctccctgcatgcggccctcgggggtggctcagcctccatcccctgaacatggggtgcgctgagcctccctgcatgcggccctggggggccctaacgaatcccattcggaggaggagcagggcccgtcctcgtccggctggtgggtcctggcctgggtggctctggtcggagtacctcatagatgtggtagagattggagccttcatccggccagtagtggtagcactgccggacgccgttctccgcgag

SEQ ID NO: 26069 - DNA, 601 bp, Human
ctacatttaaggttttcgggcaggataagtggctgtggaggaaatcaagtgagtttctactaacattgctttttccaatgagggcatctgcgtgacaaccggacatggtgggtgtgtgtccctctgtcttccccacccagcgatcacacggcacctactctggcttcctccggtcttcattcttacccttcgcctcctactcatgactttccatttcattgcaacatactttttatttgtatgactgttatgttcccgacacaaactgcccggctgtgggaaaaggcctgtcatatctccrggcctcagtctccgtatctgtatggtgggtgagctcagggagtgaggagcttggacgtcggcgtctccgggcctcagtctccatatctgtatggtgggtgagctcagggagtgaggagcttggacgtcggcgtctccgggcctcagtctccatatctgtatggtgggtgagctcagggagtgaggagcttggatgatgcggtttctaagtgtcctttagctctggattccagtgcacgtgcatgtgcagactcgtctgtgtgtatgtgtgtgtcctggtgttggtcatcccgaaactgtc

SEQ ID NO: 26070 - DNA, 601 bp, Human
tccccacccagcgatcacacggcacctactctggcttcctccggtcttcattcttacccttcgcctcctactcatgactttccatttcattgcaacatactttttatttgtatgactgttatgttcccgacacaaactgcccggctgtgggaaaaggcctgtcatatctccaggcctcagtctccgtatctgtatggtgggtgagctcagggagtgaggagcttggacgtcggcgtctccgggcctcagtctccatatctgtatggtgggtgagctcagggagtgaggagcttggacgtcrgcgtctccgggcctcagtctccatatctgtatggtgggtgagctcagggagtgaggagcttggatgatgcggtttctaagtgtcctttagctctggattccagtgcacgtgcatgtgcagactcgtctgtgtgtatgtgtgtgtcctggtgttggtcatcccgaaactgtccgtgaaaacctgtaaatttattaggtgaacgccaagctgtcaggcggtctgcggcccgtgaacacgcgtccatgctgtcctcagtgaaccacagaaggaaggaaggatgctgcttcctcaagcacagag

SEQ ID NO: 26071 - DNA, 601 bp, Human
cgacacaaactgcccggctgtgggaaaaggcctgtcatatctccaggcctcagtctccgtatctgtatggtgggtgagctcagggagtgaggagcttggacgtcggcgtctccgggcctcagtctccatatctgtatggtgggtgagctcagggagtgaggagcttggacgtcggcgtctccgggcctcagtctccatatctgtatggtgggtgagctcagggagtgaggagcttggatgatgcggtttctaagtgtcctttagctctggattccagtgcacgtgcatgtgcagactcgtctgtgtgtatgtgtgtgtcctggtgttggtcatcccgaaactgtccgtgaaaacctgtaaatttattaggtgaacgccaagctgtcaggcggtctgcggcccgtgaacacgcgtccatgctgtcctcagtgaaccacagaaggaaggaaggatgctgcttcctcaagcacagagctgctgtgtcctccagtggtgtgcggggccaagcatctgaatggcgaggtgcggtcatttctgagcgctttctccccagacaggggcttctgcagcaacacatcccgcctagagaggccggtaccac

SEQ ID NO: 26072 - DNA, 601 bp, Human
cgggcctcagtctccatatctgtatggtgggtgagctcagggagtgaggagcttggacgtcggcgtctccgggcctcagtctccatatctgtatggtgggtgagctcagggagtgaggagcttggatgatgcggtttctaagtgtcctttagctctggattccagtgcacgtgcatgtgcagactcgtctgtgtgtatgtgtgtgtcctggtgttggtcatcccgaaactgtccgtgaaaacctgtaaatttattaggtgaacgccaagctgtcaggcggtctgcggcccgtgaacacgcrtccatgctgtcctcagtgaaccacagaaggaaggaaggatgctgcttcctcaagcacagagctgctgtgtcctccagtggtgtgcggggccaagcatctgaatggcgaggtgcggtcatttctgagcgctttctccccagacaggggcttctgcagcaacacatcccgcctagagaggccggtaccacagagaatccagtgtgactcactccaagtgacttcatgaaaatcaacagccagaaggcaagtacaattaacagtataattctgtttttacttttttttttttttgagatggag

SEQ ID NO: 26073 - DNA, 601 bp, Human
ccacctgcccacatctccacctgcccctctccacctgcccacctctccacctgcccacctctccacctgcccacatctccacctgcctacctctccacctgcccacctctccacctgcccacctctccacctgcccacctctccacctgcccacctctccacctgcctacctctccacctgcccacatctccacctgcccacatctccacctgcctttcctaacatttaaagcaaattgcatgaaacgctttcttgaaaaccaccatttgacttctcaagtctcttttccaaatactaagkcttaatatgggaatttattgggaaattgtagcttcagtaatcaatgggagattgacttgttttttttgagacagggtcttgttctttaccccaggctggagtgtggtggcatgatctcggctcactgcaacctctccctcctgggttcaaatgtttcttctgcctcagctgggattacaggtatgcaccaccatgcctggctagtttctgtgtttttagtagagatggggtttcaccatattggccaggctggtcttaaacttctgaactcaagtgattcgcctgccttggcctcccaaa

SEQ ID NO: 26074 - DNA, 601 bp, Human
gaagtgattccttcttaagaatgaacacataaacagaaacctgggttcaggtggtgtagaccaagtacactaggccagttcttcactttgaattcagtctctcaaagctgaacatgctcactgtgtgggccacgaattgcgggaaaacgggactggctcaggcatgtggacatcttcccagcgtgctttatcccacaggtgtgctgagaccagcagagccgagagctgagcaccctccaccatcagtggccgctgagaccagcagagccgagagctgagcaccgtccgccatcagtggccrctgagaccagcagagccgagagctgagcaccgtctgccatcagtggccgccgagaccagcagagccgagagctgagcactgtctgccatcagtggccactgagaccagcagagctgagagctgagcaccctccaccatcagtgaccgctgagaccagcagagctgagagctgagcgccatctgccatcagtggccactgagaccagcagagctgagagctgagcaccgtccgtcatcagtggccgctgagaccagcagagccgagagctgagcaccctccaccatcagtggctgctgaga

SEQ ID NO: 26075 - DNA, 601 bp, Human
aggagagtgtgggaggaaggcgaagtgtgtgcagtctatatttagaatgatgtctagccgagcatgaggtgtgagggcgctgagtatccgaatcacttacgtgctgttttctcctccctcccgctccctctcacacacatgctcacacacacacctctctgaagaatcagattttgtagagtttgtgtaggtctttggcattgatatttttaaaaataaactgtgtgatatcaagatcccaccccagccctctagaagcaatgaacactaaataataataataataataacaaatttgcawcgactgagctcttccagcacacaaaggcactgtactaaatgcgttatctgcatgaacacactgagtcctcacgtaagcctgtgggtggggcaccctcagtaaccccagttcacagaaggggagacggaggcacaaagcgattaacccacaagtgggcacatcacagggatgtgtaattgattctaacgatacctgagggatctgtggtcctcacacgggctacagtctcccagccggatccccttttcctggacaagccatccctcggaaccccctggcacctctgctgactatgcaccg

SEQ ID NO: 26076 - DNA, 601 bp, Human
acacctctctgaagaatcagattttgtagagtttgtgtaggtctttggcattgatatttttaaaaataaactgtgtgatatcaagatcccaccccagccctctagaagcaatgaacactaaataataataataataataacaaatttgcaacgactgagctcttccagcacacaaaggcactgtactaaatgcgttatctgcatgaacacactgagtcctcacgtaagcctgtgggtggggcaccctcagtaaccccagttcacagaaggggagacggaggcacaaagcgattaacccacragtgggcacatcacagggatgtgtaattgattctaacgatacctgagggatctgtggtcctcacacgggctacagtctcccagccggatccccttttcctggacaagccatccctcggaaccccctggcacctctgctgactatgcaccgggtacagatttgctttgtgtgggttctcatgtaattactactccaaccccataaataaagggtgagtttcacctttaatttgtagactctggagtttacagaggttaaatatcaaattattggtaccagatcacaaaagtcgtgattatc

SEQ ID NO: 26077 - DNA, 601 bp, Human
acgtaagcctgtgggtggggcaccctcagtaaccccagttcacagaaggggagacggaggcacaaagcgattaacccacaagtgggcacatcacagggatgtgtaattgattctaacgatacctgagggatctgtggtcctcacacgggctacagtctcccagccggatccccttttcctggacaagccatccctcggaaccccctggcacctctgctgactatgcaccgggtacagatttgctttgtgtgggttctcatgtaattactactccaaccccataaataaagggtgagtttcrcctttaatttgtagactctggagtttacagaggttaaatatcaaattattggtaccagatcacaaaagtcgtgattatcagatccagaattggaactcaggtctaagggccatcaaagacatgatctccacccctgggccgcactgccctcccaggcaccctacactgcttcctaggaaagaccgggtctgctcctgccactggcacataccaggcaacccacggacacctcctggtgcatgtgatgccaaaagtcttatgtctacttggcagggtttttttccaaccatgaaattatat

SEQ ID NO: 26078 - DNA, 601 bp, Human
ctcatgtaattactactccaaccccataaataaagggtgagtttcacctttaatttgtagactctggagtttacagaggttaaatatcaaattattggtaccagatcacaaaagtcgtgattatcagatccagaattggaactcaggtctaagggccatcaaagacatgatctccacccctgggccgcactgccctcccaggcaccctacactgcttcctaggaaagaccgggtctgctcctgccactggcacataccaggcaacccacggacacctcctggtgcatgtgatgccaaaagycttatgtctacttggcagggtttttttccaaccatgaaattatatcttcaatattatattagatgtaaacaggaaaatctgattcactttacaactcactttgccaaaacacacttttaagaaaattaaggaaggactatagaggcaattattcccattttggctacaaattacaacttttccttttgtattttttaaaatttaaacaaaatagtagtgtgataaaaacactgctcaaatttggatcctcaatgacaataggatgtagccgttgacgttactaaacagagctaggaaaaa

SEQ ID NO: 26079 - DNA, 601 bp, Human
gagtttacagaggttaaatatcaaattattggtaccagatcacaaaagtcgtgattatcagatccagaattggaactcaggtctaagggccatcaaagacatgatctccacccctgggccgcactgccctcccaggcaccctacactgcttcctaggaaagaccgggtctgctcctgccactggcacataccaggcaacccacggacacctcctggtgcatgtgatgccaaaagtcttatgtctacttggcagggtttttttccaaccatgaaattatatcttcaatattatattagatgkaaacaggaaaatctgattcactttacaactcactttgccaaaacacacttttaagaaaattaaggaaggactatagaggcaattattcccattttggctacaaattacaacttttccttttgtattttttaaaatttaaacaaaatagtagtgtgataaaaacactgctcaaatttggatcctcaatgacaataggatgtagccgttgacgttactaaacagagctaggaaaaagcataatattgtcacttaaattgtgtttcatgtgagaagaaaaagaaagatgtttttaaataaata

SEQ ID NO: 26080 - DNA, 601 bp, Human
cccattttggctacaaattacaacttttccttttgtattttttaaaatttaaacaaaatagtagtgtgataaaaacactgctcaaatttggatcctcaatgacaataggatgtagccgttgacgttactaaacagagctaggaaaaagcataatattgtcacttaaattgtgtttcatgtgagaagaaaaagaaagatgtttttaaataaataagaagtcagaaaatacaacactcacataccctttttgagaaacagaattgcttgaaaatacaccccaaacaacagagaactgagtcaraattccacgcatggaggatgaaaagcctgtggtctaaaagtcagggagtcttaggctaacggcagccccccagagcgctccctgcccctcaggtgggagggctgggtctccccgactccctaaattaggaaatgtgtttctcagccccacttctccctccacagctcagacagcaggtcccatcatttctgatggatattcaaaaccagaactgctgatgttttcttcctgcacttgccaacaggcatggaaccactaaccagtaagagaatctgaggagagaatgactaaccaaagact

SEQ ID NO: 26081 - DNA, 601 bp, Human
ttccttttgtattttttaaaatttaaacaaaatagtagtgtgataaaaacactgctcaaatttggatcctcaatgacaataggatgtagccgttgacgttactaaacagagctaggaaaaagcataatattgtcacttaaattgtgtttcatgtgagaagaaaaagaaagatgtttttaaataaataagaagtcagaaaatacaacactcacataccctttttgagaaacagaattgcttgaaaatacaccccaaacaacagagaactgagtcagaattccacgcatggaggatgaaaagsctgtggtctaaaagtcagggagtcttaggctaacggcagccccccagagcgctccctgcccctcaggtgggagggctgggtctccccgactccctaaattaggaaatgtgtttctcagccccacttctccctccacagctcagacagcaggtcccatcatttctgatggatattcaaaaccagaactgctgatgttttcttcctgcacttgccaacaggcatggaaccactaaccagtaagagaatctgaggagagaatgactaaccaaagactcttctttctccacccccaaaactggg

SEQ ID NO: 26082 - DNA, 601 bp, Human
gaagtcagaaaatacaacactcacataccctttttgagaaacagaattgcttgaaaatacaccccaaacaacagagaactgagtcagaattccacgcatggaggatgaaaagcctgtggtctaaaagtcagggagtcttaggctaacggcagccccccagagcgctccctgcccctcaggtgggagggctgggtctccccgactccctaaattaggaaatgtgtttctcagccccacttctccctccacagctcagacagcaggtcccatcatttctgatggatattcaaaaccagaactsctgatgttttcttcctgcacttgccaacaggcatggaaccactaaccagtaagagaatctgaggagagaatgactaaccaaagactcttctttctccacccccaaaactgggtttcccagaaccatgcaatgtcactgctgttgcttagaacggttcttcatccttcggccttgtattcacgaccaaaggttcttaaagggagagaaactaagaggctaaaagacttaacagggaaggccagtgtctagctcgtggacatcgcctgcgactgggcccttcttctgactgcctccggagca

SEQ ID NO: 26083 - DNA, 601 bp, Human
gaattgcttgaaaatacaccccaaacaacagagaactgagtcagaattccacgcatggaggatgaaaagcctgtggtctaaaagtcagggagtcttaggctaacggcagccccccagagcgctccctgcccctcaggtgggagggctgggtctccccgactccctaaattaggaaatgtgtttctcagccccacttctccctccacagctcagacagcaggtcccatcatttctgatggatattcaaaaccagaactgctgatgttttcttcctgcacttgccaacaggcatggaaccacwaaccagtaagagaatctgaggagagaatgactaaccaaagactcttctttctccacccccaaaactgggtttcccagaaccatgcaatgtcactgctgttgcttagaacggttcttcatccttcggccttgtattcacgaccaaaggttcttaaagggagagaaactaagaggctaaaagacttaacagggaaggccagtgtctagctcgtggacatcgcctgcgactgggcccttcttctgactgcctccggagcagcagtgcccacgggggctctgggatggtggaccgtcctcttcc

SEQ ID NO: 26084 - DNA, 601 bp, Human
cctgtggtctaaaagtcagggagtcttaggctaacggcagccccccagagcgctccctgcccctcaggtgggagggctgggtctccccgactccctaaattaggaaatgtgtttctcagccccacttctccctccacagctcagacagcaggtcccatcatttctgatggatattcaaaaccagaactgctgatgttttcttcctgcacttgccaacaggcatggaaccactaaccagtaagagaatctgaggagagaatgactaaccaaagactcttctttctccacccccaaaactggrtttcccagaaccatgcaatgtcactgctgttgcttagaacggttcttcatccttcggccttgtattcacgaccaaaggttcttaaagggagagaaactaagaggctaaaagacttaacagggaaggccagtgtctagctcgtggacatcgcctgcgactgggcccttcttctgactgcctccggagcagcagtgcccacgggggctctgggatggtggaccgtcctcttcctgtggcatccagcgccttggccctgagccacatgcgactaacgtgccgccgacctgaacccagtgcggc

SEQ ID NO: 26085 - DNA, 601 bp, Human
ggagggctgggtctccccgactccctaaattaggaaatgtgtttctcagccccacttctccctccacagctcagacagcaggtcccatcatttctgatggatattcaaaaccagaactgctgatgttttcttcctgcacttgccaacaggcatggaaccactaaccagtaagagaatctgaggagagaatgactaaccaaagactcttctttctccacccccaaaactgggtttcccagaaccatgcaatgtcactgctgttgcttagaacggttcttcatccttcggccttgtattcacraccaaaggttcttaaagggagagaaactaagaggctaaaagacttaacagggaaggccagtgtctagctcgtggacatcgcctgcgactgggcccttcttctgactgcctccggagcagcagtgcccacgggggctctgggatggtggaccgtcctcttcctgtggcatccagcgccttggccctgagccacatgcgactaacgtgccgccgacctgaacccagtgcggccaaggcactgcatctttcatttatttaattttattcaatttaaatataggtttagatggccacatgtggc

SEQ ID NO: 26086 - DNA, 601 bp, Human
atctgaggagagaatgactaaccaaagactcttctttctccacccccaaaactgggtttcccagaaccatgcaatgtcactgctgttgcttagaacggttcttcatccttcggccttgtattcacgaccaaaggttcttaaagggagagaaactaagaggctaaaagacttaacagggaaggccagtgtctagctcgtggacatcgcctgcgactgggcccttcttctgactgcctccggagcagcagtgcccacgggggctctgggatggtggaccgtcctcttcctgtggcatccagcrccttggccctgagccacatgcgactaacgtgccgccgacctgaacccagtgcggccaaggcactgcatctttcatttatttaattttattcaatttaaatataggtttagatggccacatgtggccagaggtgccacacgggacagccaggtgtgagtgagctgaacccctcaggaatccgcacatgcaggaggcatcaaatgtgcaaagtgggcacaggctgccgtgtgataatcctggctgggaaattccaggaaaaattaattttcttctttgcatttaccacgactttcatatttc

SEQ ID NO: 26087 - DNA, 601 bp, Human
gctaaaagacttaacagggaaggccagtgtctagctcgtggacatcgcctgcgactgggcccttcttctgactgcctccggagcagcagtgcccacgggggctctgggatggtggaccgtcctcttcctgtggcatccagcgccttggccctgagccacatgcgactaacgtgccgccgacctgaacccagtgcggccaaggcactgcatctttcatttatttaattttattcaatttaaatataggtttagatggccacatgtggccagaggtgccacacgggacagccaggtgtgagtragctgaacccctcaggaatccgcacatgcaggaggcatcaaatgtgcaaagtgggcacaggctgccgtgtgataatcctggctgggaaattccaggaaaaattaattttcttctttgcatttaccacgactttcatatttctaccatggataaattaggttataatttgaaaagagatatttcgtatccaaatatacacacttttgtatgttctctttatactgtttttcaatttggagattatgaggggtttctccataattttctgggaaaaaaacttttgtatttcataaatgttcc

SEQ ID NO: 26088 - DNA, 601 bp, Human
gccagtgtctagctcgtggacatcgcctgcgactgggcccttcttctgactgcctccggagcagcagtgcccacgggggctctgggatggtggaccgtcctcttcctgtggcatccagcgccttggccctgagccacatgcgactaacgtgccgccgacctgaacccagtgcggccaaggcactgcatctttcatttatttaattttattcaatttaaatataggtttagatggccacatgtggccagaggtgccacacgggacagccaggtgtgagtgagctgaacccctcaggaatccrcacatgcaggaggcatcaaatgtgcaaagtgggcacaggctgccgtgtgataatcctggctgggaaattccaggaaaaattaattttcttctttgcatttaccacgactttcatatttctaccatggataaattaggttataatttgaaaagagatatttcgtatccaaatatacacacttttgtatgttctctttatactgtttttcaatttggagattatgaggggtttctccataattttctgggaaaaaaacttttgtatttcataaatgttcccacaccatgaacaaaaagatca

SEQ ID NO: 26089 - DNA, 601 bp, Human
gctctgggatggtggaccgtcctcttcctgtggcatccagcgccttggccctgagccacatgcgactaacgtgccgccgacctgaacccagtgcggccaaggcactgcatctttcatttatttaattttattcaatttaaatataggtttagatggccacatgtggccagaggtgccacacgggacagccaggtgtgagtgagctgaacccctcaggaatccgcacatgcaggaggcatcaaatgtgcaaagtgggcacaggctgccgtgtgataatcctggctgggaaattccaggaaawattaattttcttctttgcatttaccacgactttcatatttctaccatggataaattaggttataatttgaaaagagatatttcgtatccaaatatacacacttttgtatgttctctttatactgtttttcaatttggagattatgaggggtttctccataattttctgggaaaaaaacttttgtatttcataaatgttcccacaccatgaacaaaaagatcaccaacttccacatttaacatgaaacaaacaccagagacgtcatcttacctcttggtaaagtctatcatcgtcgtcctg

SEQ ID NO: 26090 - DNA, 601 bp, Human
tttagatggccacatgtggccagaggtgccacacgggacagccaggtgtgagtgagctgaacccctcaggaatccgcacatgcaggaggcatcaaatgtgcaaagtgggcacaggctgccgtgtgataatcctggctgggaaattccaggaaaaattaattttcttctttgcatttaccacgactttcatatttctaccatggataaattaggttataatttgaaaagagatatttcgtatccaaatatacacacttttgtatgttctctttatactgtttttcaatttggagattatgargggtttctccataattttctgggaaaaaaacttttgtatttcataaatgttcccacaccatgaacaaaaagatcaccaacttccacatttaacatgaaacaaacaccagagacgtcatcttacctcttggtaaagtctatcatcgtcgtcctgcactccgtcatctgtaaaagacaccagtgttaccaagaccctcatcaagaatgtcatcacagggtgccacagacataaaaagggtgaccctgcagacccctccatacgaaaggtgaggtgtgatgacgctggcctaagtcctgccat

SEQ ID NO: 26091 - DNA, 601 bp, Human
tcacagggtgccacagacataaaaagggtgaccctgcagacccctccatacgaaaggtgaggtgtgatgacgctggcctaagtcctgccatagagtaaaccttttctgtttatagcacaaaatggcattctgtaaacttcgcgagagcggaggggactgaggagctaaatggtagacgtgaaggcagccacaatgacctcacccagctctgggggtctcacgtgatcgacaaagttaactcacggcaaaaaaaaaccccatcgtaccgagcagttcacgtcatgaaaaagcaaagtgaagscttcgccaaaaccacctcacaattaagatggcttcagaatccactgacttaggttatttcactgtggtcagcgtttctctctaaataggtaccccggctgggcgcggtggctcacgcctgtaatcccagcactttgggaggccaaggtgggcggatcatgaggtcaggagttggagatcagcctggccaacaggcgaaaccccgtctctactaaaaatacaaaaaattagctgggcgtggtagtgcacacctgtaatcccagctacttgggaggctgaggcatgagaatcacttgaaccc

SEQ ID NO: 26092 - DNA, 601 bp, Human
gcggtggctcacgcctgtaatcccagcactttgggaggccaaggtgggcggatcatgaggtcaggagttggagatcagcctggccaacaggcgaaaccccgtctctactaaaaatacaaaaaattagctgggcgtggtagtgcacacctgtaatcccagctacttgggaggctgaggcatgagaatcacttgaacccggcaggcaaagtttgcagtgagccgagatcacgtcaccgcactccagcctgggtgacagagagagactccatctcaaaaaataaaataaaataataaataaatwaattaatatcctactttcagtgcccaaaggtgcgtgactcatggcacctgaacagtgcccctggagacagcacgcacaccagggcctcctgcatccctcctagccatggtgcgggtcccgattccttcaaccactgggcgaccacctaacacaggccctcccggggtgcagttccactactcccctgcaccctgcctgtcagccaagtcaggcttccagcttccagcaaggccccctctgcacccgtgcagagagaggggcacgtctgtcatttggttttcagcacgtacttgtggggct

SEQ ID NO: 26093 - DNA, 601 bp, Human
actaaaaatacaaaaaattagctgggcgtggtagtgcacacctgtaatcccagctacttgggaggctgaggcatgagaatcacttgaacccggcaggcaaagtttgcagtgagccgagatcacgtcaccgcactccagcctgggtgacagagagagactccatctcaaaaaataaaataaaataataaataaattaattaatatcctactttcagtgcccaaaggtgcgtgactcatggcacctgaacagtgcccctggagacagcacgcacaccagggcctcctgcatccctcctagccmtggtgcgggtcccgattccttcaaccactgggcgaccacctaacacaggccctcccggggtgcagttccactactcccctgcaccctgcctgtcagccaagtcaggcttccagcttccagcaaggccccctctgcacccgtgcagagagaggggcacgtctgtcatttggttttcagcacgtacttgtggggctgccatgtgtggggagctgagctaggtgctttcttgcagctccacgctgtgagaagccatcaggctgcagaagtcctggctgacccatggggcctccacagggctcc

SEQ ID NO: 26094 - DNA, 601 bp, Human
cccctgcaccctgcctgtcagccaagtcaggcttccagcttccagcaaggccccctctgcacccgtgcagagagaggggcacgtctgtcatttggttttcagcacgtacttgtggggctgccatgtgtggggagctgagctaggtgctttcttgcagctccacgctgtgagaagccatcaggctgcagaagtcctggctgacccatggggcctccacagggctccggatgcctgccggggtagtggtgctgaggggctgccttctgcttccccagcagcctcagaggaccaatgcacgccmcaagcagacatttgaatgatcccctctcactctgctattcaaatatttgacaatattcaccggtacacagtccaaacacaacacttcccatcacgcctgttttcctgactcagcctcagcatggaggagtgaaacctcctcgcagagagcaatttgccattcaacataattgctctggtaggcttagtctgttaagaaagcttttagaggcaaaagttcaaacagataaaaatcattaatacagatccccatctccccagcagaaagcccacattgcacttggtgagccagcagtctctg

SEQ ID NO: 26095 - DNA, 601 bp, Human
gtgagaagccatcaggctgcagaagtcctggctgacccatggggcctccacagggctccggatgcctgccggggtagtggtgctgaggggctgccttctgcttccccagcagcctcagaggaccaatgcacgccccaagcagacatttgaatgatcccctctcactctgctattcaaatatttgacaatattcaccggtacacagtccaaacacaacacttcccatcacgcctgttttcctgactcagcctcagcatggaggagtgaaacctcctcgcagagagcaatttgccattcaacrtaattgctctggtaggcttagtctgttaagaaagcttttagaggcaaaagttcaaacagataaaaatcattaatacagatccccatctccccagcagaaagcccacattgcacttggtgagccagcagtctctgcacagccctgaggcctcccctccccgcagcacccctgggtgtgggcacccatggcgctgcagtcacctggaaagctgtctccacggagggtggccttggggccatccgcctgttctccagactctcccagggccgctctcccagggctgcctcgagctactccatg

SEQ ID NO: 26096 - DNA, 601 bp, Human
attcaccggtacacagtccaaacacaacacttcccatcacgcctgttttcctgactcagcctcagcatggaggagtgaaacctcctcgcagagagcaatttgccattcaacataattgctctggtaggcttagtctgttaagaaagcttttagaggcaaaagttcaaacagataaaaatcattaatacagatccccatctccccagcagaaagcccacattgcacttggtgagccagcagtctctgcacagccctgaggcctcccctccccgcagcacccctgggtgtgggcacccatggygctgcagtcacctggaaagctgtctccacggagggtggccttggggccatccgcctgttctccagactctcccagggccgctctcccagggctgcctcgagctactccatggtccacgccttgcatcaggccagccatcagctcagccatgccgtccagctccaggccactcaggcccctcacctcagccggctgcctctgcaggtccttcaggagggtatgaatccgtgctcctaggggcacacacacaaacacaaggacgttgtgggtggacgaatgcaaaggtgagggcctccagac

SEQ ID NO: 26097 - DNA, 601 bp, Human
ccggtacacagtccaaacacaacacttcccatcacgcctgttttcctgactcagcctcagcatggaggagtgaaacctcctcgcagagagcaatttgccattcaacataattgctctggtaggcttagtctgttaagaaagcttttagaggcaaaagttcaaacagataaaaatcattaatacagatccccatctccccagcagaaagcccacattgcacttggtgagccagcagtctctgcacagccctgaggcctcccctccccgcagcacccctgggtgtgggcacccatggcgctgsagtcacctggaaagctgtctccacggagggtggccttggggccatccgcctgttctccagactctcccagggccgctctcccagggctgcctcgagctactccatggtccacgccttgcatcaggccagccatcagctcagccatgccgtccagctccaggccactcaggcccctcacctcagccggctgcctctgcaggtccttcaggagggtatgaatccgtgctcctaggggcacacacacaaacacaaggacgttgtgggtggacgaatgcaaaggtgagggcctccagaccatag

SEQ ID NO: 26098 - DNA, 601 bp, Human
gcttttagaggcaaaagttcaaacagataaaaatcattaatacagatccccatctccccagcagaaagcccacattgcacttggtgagccagcagtctctgcacagccctgaggcctcccctccccgcagcacccctgggtgtgggcacccatggcgctgcagtcacctggaaagctgtctccacggagggtggccttggggccatccgcctgttctccagactctcccagggccgctctcccagggctgcctcgagctactccatggtccacgccttgcatcaggccagccatcagctcrgccatgccgtccagctccaggccactcaggcccctcacctcagccggctgcctctgcaggtccttcaggagggtatgaatccgtgctcctaggggcacacacacaaacacaaggacgttgtgggtggacgaatgcaaaggtgagggcctccagaccataggggtgtggtgggcgtctgcggcgtcccaaggcagtggccacctagggccaggcgcaggccagtgctcagagaagattgggatattggacttgaatctcaaatccacctgaccctgtaaccatcactagttcagttcccca

SEQ ID NO: 26099 - DNA, 601 bp, Human
gataaaaatcattaatacagatccccatctccccagcagaaagcccacattgcacttggtgagccagcagtctctgcacagccctgaggcctcccctccccgcagcacccctgggtgtgggcacccatggcgctgcagtcacctggaaagctgtctccacggagggtggccttggggccatccgcctgttctccagactctcccagggccgctctcccagggctgcctcgagctactccatggtccacgccttgcatcaggccagccatcagctcagccatgccgtccagctccaggccaytcaggcccctcacctcagccggctgcctctgcaggtccttcaggagggtatgaatccgtgctcctaggggcacacacacaaacacaaggacgttgtgggtggacgaatgcaaaggtgagggcctccagaccataggggtgtggtgggcgtctgcggcgtcccaaggcagtggccacctagggccaggcgcaggccagtgctcagagaagattgggatattggacttgaatctcaaatccacctgaccctgtaaccatcactagttcagttccccagaggtggaaaacccacagaatggaa

SEQ ID NO: 26100 - DNA, 601 bp, Human
gaggacagtcagcaaacaagaaacaccaagcggggctggctcaccatcgcctgtgctggaggggtcttcggaatctcccagaggtgaaggccacttctggggggcggctggtgccagcaaaggcctgggcattcttgagggtgcacgcagaaggtactgtggctccaggctgccctccccggggggagctgggggcctctgggcagcataggcactgagggccgccatcagatggtgtctgtccacaccactgtccaccttagggctgagctcatctggctggagctggccgagggtccgyggcaggaggtcctcgcggagctgggtccggggcccgggagggtaggtcagcgcagacgtgtgggccacataggtcaggatgctctcggagaagcggtcatcaccctgaaggaaaggagagcaaaacagagcaagagtcacatttccatcgtcagctgggggcaccaagatgcccttcagtctcagttttcaaggtcctaaacagccctgggggtacaaagatgcccttcggtctcaggttcaaggtcctaaacagccctggacatctctgaaatgtaaagccaaaacaggactctcattt

SEQ ID NO: 26101 - DNA, 601 bp, Human
tgcagctcagccctggatggctgcccttcctggaaaccttaggatacctctgctggctccagctgccccctccctgtgagtcagctccttcaagccacagcccgccagatggcttccaaggcaccaaggatgcagctcctgacctgatgcctctcagctccaggacttcccaggacccctcagctgccctggaccctgctgctactgccgtcacctctgcaccttgtccccagctgggctgctgactcagatatgccaggctcctatgctatcatttcaactcccaggctcagctcactcyaggagcctagttggagaatggatttccccagctgaaggacgcttcagctataccagtggagaaacggaggcacagagtccgtgaatggtctaaggacacatggtaaagcaatagcagagcagggtacacccctggactcactcgtgtggagttcagtgactctctgggtgatcctccctggtgcctgggacccagctctatcaggtcccatacatctcagccacacactggctcctggtgagcccctaagcagctaccctgtggcaaaggctgcagcctcaacaggggcccactcttctt

SEQ ID NO: 26102 - DNA, 601 bp, Human
cccagctaggtgaccttgggcaaatgtcttgtcctctccaagacagttccctgatttccccatctggaggacaggggaggaggaaggcgggcagcttagcgctgaagtcccgggcagctgggagaggtgagactgccagttcccctcccctgcccgcctaaggaggctggaggtttgaggcactgaggatgccccgtgcgggcttaggcagagctgtgcgccggctccagaaggtcacctcgcccgcaggtccgttgctgaatctcagtaaaggaactaggacagtcagggggccaacaamggctaccgcctggcgggaaaagtcctgtccagaatgagggtccaggaaaggggtctcttggagaggaggatgccccctgcagtcccctctaagtgccttaaagaggacgtccagagagctcgtacaaggaccctggaggtctctcctccgaccctggtcttcgcccttggtcccggaccctgagtcctcccagccaccgggccttcagcaccctcaagtttctgtaacttaggcggggcgccctcttccccgcccgctccccgcgccaagcctcgcccggacagagtttgggaactgcca

SEQ ID NO: 26103 - DNA, 601 bp, Human
tgttaggaggctcccgagaaacacccagttaagtttcttcccacatgggcttgaggtgaagggagagggttatcccaggaccctgggagggtggcttcccagagaggttcttgtgcccaggggagggggtgcaaagcagaaaggaaatgggggtccttttctacctgcaattttctgtatcttggggtcctgttttagaacacctggggaagggtacaatgttagatcatgtattttgtgtgtgtgtgtgtgtgtgtgtgtgtgtagggaatggctgttgaagtcatgttctcttcccctyagcacagggctagagacaaggaaagttgccctgtccacctccgacactaggctgggcaacccagttctaataccccttctgcccagctaggtgaccttgggcaaatgtcttgtcctctccaagacagttccctgatttccccatctggaggacaggggaggaggaaggcgggcagcttagcgctgaagtcccgggcagctgggagaggtgagactgccagttcccctcccctgcccgcctaaggaggctggaggtttgaggcactgaggatgccccgtgcgggcttaggcagagctgtgc

SEQ ID NO: 26104 - DNA, 601 bp, Human
gaggggcaaacccggaagtcctggctctgcgcagaaatccacttcggaggcagtgggaagggggtgttaggaggctcccgagaaacacccagttaagtttcttcccacatgggcttgaggtgaagggagagggttatcccaggaccctgggagggtggcttcccagagaggttcttgtgcccaggggagggggtgcaaagcagaaaggaaatgggggtccttttctacctgcaattttctgtatcttggggtcctgttttagaacacctggggaagggtacaatgttagatcatgtattttgtgtgtgtgtgtgtgtgtgtgtgtgtgtagggaatggctgttgaagtcatgttctcttcccctcagcacagggctagagacaaggaaagttgccctgtccacctccgacactaggctgggcaacccagttctaataccccttctgcccagctaggtgaccttgggcaaatgtcttgtcctctccaagacagttccctgatttccccatctggaggacaggggaggaggaaggcgggcagcttagcgctgaagtcccgggcagctgggagaggtgagactgccagttcccctcccctgccc

SEQ ID NO: 26105 - DNA, 601 bp, Human
ggaggggcaaacccggaagtcctggctctgcgcagaaatccacttcggaggcagtgggaagggggtgttaggaggctcccgagaaacacccagttaagtttcttcccacatgggcttgaggtgaagggagagggttatcccaggaccctgggagggtggcttcccagagaggttcttgtgcccaggggagggggtgcaaagcagaaaggaaatgggggtccttttctacctgcaattttctgtatcttggggtcctgttttagaacacctggggaagggtacaatgttagatcatgtattktgtgtgtgtgtgtgtgtgtgtgtgtgtgtagggaatggctgttgaagtcatgttctcttcccctcagcacagggctagagacaaggaaagttgccctgtccacctccgacactaggctgggcaacccagttctaataccccttctgcccagctaggtgaccttgggcaaatgtcttgtcctctccaagacagttccctgatttccccatctggaggacaggggaggaggaaggcgggcagcttagcgctgaagtcccgggcagctgggagaggtgagactgccagttcccctcccctgcc

SEQ ID NO: 26106 - DNA, 601 bp, Human
ctgtgaagcaggcagagtgaaaggcaggtctgatggacacttggaagctagagtcccagcccccactccctctcgtgcagccgtgggctgggcagcccctgcaggcctccgcttaccccagctcatcctcctcgatgaagccacttttgtccttgtccagcatgtgaaacaccttcttcacatcatccgcactctttttcttcaggccgaccatttggaagaactttttgtggtcgaaggagtcggtagctgtggggggaagagcagggtcaaacaaggaccagaaaggctggtagggaarcctgggagaatggggggcatcaaggcatttgttgatggattcccacatgccagtcatggggaatgagaggtacccacctccattggagggctgagggagcccgggcaagggaggataacctgtccaaggtcacaaggctgggagtggaagaggtgtgctcaaacccagacctccctggctctcaagcccgcccccacaccccacctccactgcacccattgctgatgatgggagcagcacctaagaaccaaaggcttttgttcttctgagaaccttgtgcccaggaagacttttgagtgc

SEQ ID NO: 26107 - DNA, 601 bp, Human
agaacagaaaagagactgttcccttccattccctcctatcacaacttttctaactgttgaaatccagcccccacctcctgcccagatgcatctggaaagccaatgcctgaccaggcctgggtcttcctgagcaagcagagtctgactggtacaacctttattgcttctccagcattttccagaagaatggtgtcattagagggccacaggggatgggggagtaaaaaataacataaacgaactgaacagaaatgcaggagggtggcaagaggggccgagattgggtgttcagggcagagasgtggaagaccaggggcagtcagtgcttcttagctttcagccaccagagtggagaattctgcagaaaaaaatgacaaggaaagtgagtcagaggcggggatgcaagagagactgtccacacctgactgcggggccctgggtggtgctctctctgggttcttgcttctgctgcagcagccccagagcgtaagtgtgaaaatgaatgaatgaataaatgaatgaatgagcagatgagtgaagtgaggtgggaaatgatgggcctaccacatcttttggttcatcatgccatgccacacccaaa

SEQ ID NO: 26108 - DNA, 601 bp, Human
acgaaaaataaaaaattagctgggtgtggtggcccgtgcctataatcccagatactcaggaggctgagtcaggagaatcgcttgaacccaggaggcagaggttgcagtgagccgagattgtgccaccactgcactctagtctgggtgacagagcaagactcggtctaaaaaaaaaaaaagtattgaggttgggtgtggtggctcacgactataatccaagcactttgggaggctgaggcaggtagattgcttgagcccatggtggtgcgcagatgtggtcccagctacttgggaggctgaggtgggaggatcgcttgagaccaggaatttgaggctgcggtgagctgtgatcatgccactacactctagcctgggtgacagagtgaggccctatctctaataaataaataaaagagtaagtcaggcagttaaaggggccatggaagttggagagggccaagttgcaattctagctaaggaggtctggggatatttaggcagaaactaggagaggaggagccctctgggtatctaagggaagagcgttccaggcagacggaatggcaagtacaaaggccctgagacaggaatacctggagta

SEQ ID NO: 26109 - DNA, 601 bp, Human
tgcccatggattgagggggaagcaggatcagagaggagtcccaggcctggtgcggtggctcacgcctgtaatcccagcactttaggaggccaaggtgggcagatcgctttgaggtcaggagtttcagaccactctgggcaacatggtgaggccccatctctacaagaaaaaaaaaaattagctgggcatggtagcacacacctgtagtcccagctacccaagaggctgaggtgggaggatcgcttgggcctgggaagcagagattgcaagtgagccaagattgcaccactgcactccagcrcgagaccctgtctcaaaaaaaaaaaaaaaaaaataggactcccagcgggaaggtgactgatacttggcaaaaatagagaaggcagggaagattttttttgaaggatgcttttttttctttttcttttcctttttctttttttttttttttctttttttgagacaaagtctcactacattgtccaggctagactcgaactcctgggctcaggggatcctcctacctccgcctcctgcatagctgggattacaggcatgagtcaccacatccagctacgaatgctctttctttaaatcttga

SEQ ID NO: 26110 - DNA, 601 bp, Human
ggagtttcagaccactctgggcaacatggtgaggccccatctctacaagaaaaaaaaaaattagctgggcatggtagcacacacctgtagtcccagctacccaagaggctgaggtgggaggatcgcttgggcctgggaagcagagattgcaagtgagccaagattgcaccactgcactccagcacgagaccctgtctcaaaaaaaaaaaaaaaaaaataggactcccagcgggaaggtgactgatacttggcaaaaatagagaaggcagggaagattttttttgaaggatgcttttttttctttttcttttcctttttctttttttttttttttctttttttgagacaaagtctcactacattgtccaggctagactcgaactcctgggctcaggggatcctcctacctccgcctcctgcatagctgggattacaggcatgagtcaccacatccagctacgaatgctctttctttaaatcttgaggctgggcgtggtggctcactcctgtaatcccagcactttgggaggccgaggcgggcggatcacgaggtcaggaaatcgagaccatcctggctaacacggtgaaaccccatctctac

SEQ ID NO: 26111 - DNA, 601 bp, Human
ctgagaggcaacaagagcaaaactctgtctcaaaataaataaataaataatgagactcagaaaatatgattaagggccaggcgcagtggctcacgcctgtaatcccagcactttgggaggccgaggcaggcggatcacgaggtcaggagattgagaccatcctggctaacacggtgaaaccctgtctctactaaaaatacaaaaaaattagccgggcgtggtggcgggtgcctgtagtcccagctacttgggaggctgaggcaggagaatggcatgaacccaggaggcggagcttgcagtragccgagatcgcatcactgcactccagcctgggcgacagagcgagactccatctcaaaaaaaaaaaaaaaaagaaaagaaaatatgattaagtgtagggtttaatcaagcccaaagcttgaggatgaccacctgggagcatagattgaagttgccctgaatatacacttcaagcaggggccaaggcaagcagctcttgcaagtgagcttttgtttgtttgtttgtttcttggagagagggtctccaaaactacaaataaaaattagctaggaatggtggcgcacacctgtaatcccagct

SEQ ID NO: 26112 - DNA, 601 bp, Human
gggccaggcgcagtggctcacgcctgtaatcccagcactttgggaggccgaggcaggcggatcacgaggtcaggagattgagaccatcctggctaacacggtgaaaccctgtctctactaaaaatacaaaaaaattagccgggcgtggtggcgggtgcctgtagtcccagctacttgggaggctgaggcaggagaatggcatgaacccaggaggcggagcttgcagtaagccgagatcgcatcactgcactccagcctgggcgacagagcgagactccatctcaaaaaaaaaaaaaaaaaraaaagaaaatatgattaagtgtagggtttaatcaagcccaaagcttgaggatgaccacctgggagcatagattgaagttgccctgaatatacacttcaagcaggggccaaggcaagcagctcttgcaagtgagcttttgtttgtttgtttgtttcttggagagagggtctccaaaactacaaataaaaattagctaggaatggtggcgcacacctgtaatcccagctactcaggaggctaaggcaggcgaattgctgaaaccagcaagggcaggttgcagtaagctgagattgcaccact

SEQ ID NO: 26113 - DNA, 601 bp, Human
aaggcaagcagctcttgcaagtgagcttttgtttgtttgtttgtttcttggagagagggtctccaaaactacaaataaaaattagctaggaatggtggcgcacacctgtaatcccagctactcaggaggctaaggcaggcgaattgctgaaaccagcaagggcaggttgcagtaagctgagattgcaccactgcactgcatcctgggtgacagcaagactctgtctcaaattaataaaaaaaaaagagagagagagagataacctcaagagcttccgtatacacactggtgcagaagtaargaacaaaacagccaaagcctctgtcttcatgatgcgtgagccaccaaggaatagttggccagagtcggcggtcaggaaagtgcccttgacgaagtggggcttggagtggggtctggagaaggaggccaaagcaatccaggcacaaaatcaccaaccaaaaccccaaagtgggtggaggcagagactgaggagggcgtggatggggagcatgtggagtggccaggggaggtggccatggggaagtggtgggctcgggccctgagtcactattctaacagcttggagggcggccaggaggat

SEQ ID NO: 26114 - DNA, 601 bp, Human
ctcaagagcttccgtatacacactggtgcagaagtaaggaacaaaacagccaaagcctctgtcttcatgatgcgtgagccaccaaggaatagttggccagagtcggcggtcaggaaagtgcccttgacgaagtggggcttggagtggggtctggagaaggaggccaaagcaatccaggcacaaaatcaccaaccaaaaccccaaagtgggtggaggcagagactgaggagggcgtggatggggagcatgtggagtggccaggggaggtggccatggggaagtggtgggctcgggccctgastcactattctaacagcttggagggcggccaggaggatgtggggaggcttgttggatgctccacgatggtcaggggagaaggcggtgggaagggagagctgggaagaagaggagagtcagaccgtgttgagaagttcagaggtggatacccaggtccagaaagcaacagaagatgtgagtctgggtgggggacacacatcataagcatgagctgctattcttcctggagttttgtttttgtgatttttttccatgttttccaagagaatgaggtggaaagggtataaaaaaaagaaacggc

SEQ ID NO: 26115 - DNA, 601 bp, Human
tgcagaagtaaggaacaaaacagccaaagcctctgtcttcatgatgcgtgagccaccaaggaatagttggccagagtcggcggtcaggaaagtgcccttgacgaagtggggcttggagtggggtctggagaaggaggccaaagcaatccaggcacaaaatcaccaaccaaaaccccaaagtgggtggaggcagagactgaggagggcgtggatggggagcatgtggagtggccaggggaggtggccatggggaagtggtgggctcgggccctgagtcactattctaacagcttggagggcrgccaggaggatgtggggaggcttgttggatgctccacgatggtcaggggagaaggcggtgggaagggagagctgggaagaagaggagagtcagaccgtgttgagaagttcagaggtggatacccaggtccagaaagcaacagaagatgtgagtctgggtgggggacacacatcataagcatgagctgctattcttcctggagttttgtttttgtgatttttttccatgttttccaagagaatgaggtggaaagggtataaaaaaaagaaacggctttgagattttctgcctttatcacac

SEQ ID NO: 26116 - DNA, 601 bp, Human
ccaaagtgggtggaggcagagactgaggagggcgtggatggggagcatgtggagtggccaggggaggtggccatggggaagtggtgggctcgggccctgagtcactattctaacagcttggagggcggccaggaggatgtggggaggcttgttggatgctccacgatggtcaggggagaaggcggtgggaagggagagctgggaagaagaggagagtcagaccgtgttgagaagttcagaggtggatacccaggtccagaaagcaacagaagatgtgagtctgggtgggggacacacatcrtaagcatgagctgctattcttcctggagttttgtttttgtgatttttttccatgttttccaagagaatgaggtggaaagggtataaaaaaaagaaacggctttgagattttctgcctttatcacacttccagtcattcaatcatctaatggtgattacaggaaaaggaacagggggcctttccagctggacctttgaaccacagtactcagttactcgctcggccttgatttgctttttttttttccttttttttttttttcttttggagacagagtctcactgtcacccaggctggagt

SEQ ID NO: 26117 - DNA, 601 bp, Human
agcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctgtgagtrtatcgggggtgacccctcccccatcaaaactgcctacactggcttctctaaagcactgtctacattgtctctgaatgttgtctacgtgggttccctgaagccaaattctgcactaccttcctgccattgtctacactggctcccatgggcaaatctacatacttccccctcattgtctacattggctttactgggttcctgcatgctgtgcctagtctgtggtaacctgggatgggcttgcaagagccagtttgatacatttctttccaattccacatccaatgaagtcttctcggtagc

SEQ ID NO: 26118 - DNA, 601 bp, Human
ttattattgttatttaatataatataattacattatattatatattacattacaggctccaccccccgggccctgttgatcctgacccctcccactgggttttttgctagctcttccagaaactgcctatactcacacctcgtaatgttacccagagaggccaccctggcactcttcacacagaatccctcaaatactggcttaaccacctcttccaccactgtccaaaatgaccacatatcccaactcaatgttgtctacactagctccccaggcaatgcctccacttacacagattccytaagccaagtctacaccagctcccccaggcaacatgcatcacgtgcgcccataagtgcaacagctcccctgagcctcgtctgtgccactttcctcccgggacctacactggttgcccaaaccctgttttgacatcctccctccatgccaaaaacacacacacaggccgggtgcggtggctcacacctgcaatcccagcactttgggaggccaaggcgggcagatcacttgaggtcaggagttcgggactagcctgggcaacatggtgaaaccctgtctgtactaaaaataccaaaattag

SEQ ID NO: 26119 - DNA, 601 bp, Human
ggatggcttgagcccaggacgtggagtttgcagtaaaccaggatcaccccactgctctccatcctgggcaacagagcaagatcctgtctcaaaaacacacacacacacacacacacacattatttgtagtggctcccttaggcactgccagcactgaacaataactcccacaaaattatccacagtggtttccctgaacagtgtctacactgacatcagcacacaacagcctggactgatttgccccagacagttttgactgctgtacctcctgccaacccgccccgtttctttagcattmctgtctatctgctaacttgtccacccgctctgggattctcctccttgctgatccagtccccccatttcccccagaccctcctgaagtgtccatctccggctatgatgacaactggtacctcggccgtactgatgccaccctgagctgtgacgtccgcagcaacccagagcccacgggctatgactggagcacgtgagtcacgtggtctcagaaccctgggtctgagggaggcgggactgggggcctggactcctggatctaagggaggaggggctgggggcctggactcctggatctgag

SEQ ID NO: 26120 - DNA, 601 bp, Human
tgatttgccccagacagttttgactgctgtacctcctgccaacccgccccgtttctttagcattcctgtctatctgctaacttgtccacccgctctgggattctcctccttgctgatccagtccccccatttcccccagaccctcctgaagtgtccatctccggctatgatgacaactggtacctcggccgtactgatgccaccctgagctgtgacgtccgcagcaacccagagcccacgggctatgactggagcacgtgagtcacgtggtctcagaaccctgggtctgagggaggcgggrctgggggcctggactcctggatctaagggaggaggggctgggggcctggactcctggatctgagggaggaggggctgggcctaaattcctaagtcctccaggatgaagggagcttgcattttggcaatttggggtctccgggagtacttaggtccctggagcttggctcctggtgggtgtatctttagggatgaggcctgtgctcccctctcgaccttggtatccctctcacctgaccccacacccctccaggacctcaggcaccttcccgacctccgcagtggcccagggctcccagct

SEQ ID NO: 26121 - DNA, 601 bp, Human
gggatgcagacctgcctggctgaggggagatgagggttggccttcccctcgtggcctcagactggggtctggatttggggtgtcggggtaggtgaaggcagcagagttggggggttgaggactttgctcggggttcctagaaagtagaggcctgggtagggtcctcacgaatagacccgaggaagctgccctgggctccagctcctgagaaagacgcacacctagagtcaggcatgcaaacttcaaagagacagaaaccaagagctcccacccccagaaacacaatccggccccaaggcayggagccaaagaggaaaagcacaaagccagaccatcacccagtgatggaaactgggtcaaactcacaactgcagggccacacacctagagcgcggccgggactgttaacagagccatgcttcctgggacagagagacccctgggtcctggagatagggccagagacccctcctgtcagagccacagctggcaggatccacagccacagacactccctgtgctgagaaattctgttgcagagatgcatcagaatccagacactcacctggatggtaaccctgcacgctcaaacccattgtca

SEQ ID NO: 26122 - DNA, 601 bp, Human
tgatccacccgcctcggcctcacgaagtgctgggattatatgcatgagccactgcgcctggccagaaaaagacattcttagaaacacgccagggcgacggtccatgcagcacacctgtgcaaacacgcaatgtgcaggccccccagaaacatgactgaaggtgtagggacaaactcccagacaggggctgtccctgtcatgcagacagactagccacggagggacagaagcagacccccttactgagtcataatcttagaatgcacacacacttgcagggacacccgagggaaaacagacmcctcttcaggaatccagatacagccagggagataggacacccctacgggaaacactgtcacagacagcaaacccagagagacagctgtcccgctctgggctcgcctggcgcgtgaggatgcacataagtccccggaggaagacgtcacacagacacgctgggggcaaaactaatccaggacagcaacggctgcacacggaggaatgtcatccctcactcacagaccctcagacggaaaatcaaagacatcctgggaggagcttcttcccaggaactctcccgaaactccccgaaactcct

SEQ ID NO: 26123 - DNA, 601 bp, Human
agggacacccgagggaaaacagacccctcttcaggaatccagatacagccagggagataggacacccctacgggaaacactgtcacagacagcaaacccagagagacagctgtcccgctctgggctcgcctggcgcgtgaggatgcacataagtccccggaggaagacgtcacacagacacgctgggggcaaaactaatccaggacagcaacggctgcacacggaggaatgtcatccctcactcacagaccctcagacggaaaatcaaagacatcctgggaggagcttcttcccaggaacyctcccgaaactccccgaaactcctccgaaattatccagaaagtccgttagggagattctcattcaacaaatatgtgtttcctgtttgctaggcactcttgctgaggttgggaatacaatggtgaatgagccacagtccctgccctcagtagcacacccaggggagggtcagctccacccgcccagacagacaccgaactggaaatacacccctaacctctaccccagatacacctgacaagctgatcccctgcccacacacccagcaggtggctccaaggtcagagcctgcagaacacag

SEQ ID NO: 26124 - DNA, 601 bp, Human
cgctgggggcaaaactaatccaggacagcaacggctgcacacggaggaatgtcatccctcactcacagaccctcagacggaaaatcaaagacatcctgggaggagcttcttcccaggaactctcccgaaactccccgaaactcctccgaaattatccagaaagtccgttagggagattctcattcaacaaatatgtgtttcctgtttgctaggcactcttgctgaggttgggaatacaatggtgaatgagccacagtccctgccctcagtagcacacccaggggagggtcagctccacccrcccagacagacaccgaactggaaatacacccctaacctctaccccagatacacctgacaagctgatcccctgcccacacacccagcaggtggctccaaggtcagagcctgcagaacacagacgcaatagagaaagactcagcgctgtggaaagacacccccacctacccacgacagtggccacagggccacccccagccaataacaccattacaaagacacgtgccttcagataatgcctgcagaaacgtgcatgctccaagcactctagaaatcccgtctcaagcagtgagtgccccga

SEQ ID NO: 26125 - DNA, 601 bp, Human
tcccgaaactccccgaaactcctccgaaattatccagaaagtccgttagggagattctcattcaacaaatatgtgtttcctgtttgctaggcactcttgctgaggttgggaatacaatggtgaatgagccacagtccctgccctcagtagcacacccaggggagggtcagctccacccgcccagacagacaccgaactggaaatacacccctaacctctaccccagatacacctgacaagctgatcccctgcccacacacccagcaggtggctccaaggtcagagcctgcagaacacagaygcaatagagaaagactcagcgctgtggaaagacacccccacctacccacgacagtggccacagggccacccccagccaataacaccattacaaagacacgtgccttcagataatgcctgcagaaacgtgcatgctccaagcactctagaaatcccgtctcaagcagtgagtgccccgacagccacagccagaggagacacactcaaagctcctggggtcactctcagagggtctctgagccacgaacccacatccaggcacacacagagtcgtcacagagacacagtatggagtccacag

SEQ ID NO: 26126 - DNA, 601 bp, Human
gttagggagattctcattcaacaaatatgtgtttcctgtttgctaggcactcttgctgaggttgggaatacaatggtgaatgagccacagtccctgccctcagtagcacacccaggggagggtcagctccacccgcccagacagacaccgaactggaaatacacccctaacctctaccccagatacacctgacaagctgatcccctgcccacacacccagcaggtggctccaaggtcagagcctgcagaacacagacgcaatagagaaagactcagcgctgtggaaagacacccccacctmcccacgacagtggccacagggccacccccagccaataacaccattacaaagacacgtgccttcagataatgcctgcagaaacgtgcatgctccaagcactctagaaatcccgtctcaagcagtgagtgccccgacagccacagccagaggagacacactcaaagctcctggggtcactctcagagggtctctgagccacgaacccacatccaggcacacacagagtcgtcacagagacacagtatggagtccacagcagcacgaacataggatacgaacgccgcaccacaggacagatct

SEQ ID NO: 26127 - DNA, 601 bp, Human
acccaggggagggtcagctccacccgcccagacagacaccgaactggaaatacacccctaacctctaccccagatacacctgacaagctgatcccctgcccacacacccagcaggtggctccaaggtcagagcctgcagaacacagacgcaatagagaaagactcagcgctgtggaaagacacccccacctacccacgacagtggccacagggccacccccagccaataacaccattacaaagacacgtgccttcagataatgcctgcagaaacgtgcatgctccaagcactctagaaatyccgtctcaagcagtgagtgccccgacagccacagccagaggagacacactcaaagctcctggggtcactctcagagggtctctgagccacgaacccacatccaggcacacacagagtcgtcacagagacacagtatggagtccacagcagcacgaacataggatacgaacgccgcaccacaggacagatctatctttagggagactcagagaactttttatttttaatagagacagggtctcgctatgttggccaggctggtcttgaactcctggcctcaaagcattcctccagctttgg

SEQ ID NO: 26128 - DNA, 601 bp, Human
ccagaggagacacactcaaagctcctggggtcactctcagagggtctctgagccacgaacccacatccaggcacacacagagtcgtcacagagacacagtatggagtccacagcagcacgaacataggatacgaacgccgcaccacaggacagatctatctttagggagactcagagaactttttatttttaatagagacagggtctcgctatgttggccaggctggtcttgaactcctggcctcaaagcattcctccagctttggcctcccaaagtgctgggattacaggtatgagccascacactaagcctgattcagagctttgaaccctagacatatgaacagactcagcttcgagttccaaaacaccaatgccacctccagaaacagagacaagcctcccaagataggctcaacctggtccagttagtgaccagcacaggagaaaaatctgtttcactcctcaacccagtgtatagttagagacatatataccaccctaccccctaccaaaaaagattttatcctcctttttttaatgctatttgtgagtcactaagctgatttgacagcccgctgggtcatgaccccctgtttga

SEQ ID NO: 26129 - DNA, 601 bp, Human
ctggtccagttagtgaccagcacaggagaaaaatctgtttcactcctcaacccagtgtatagttagagacatatataccaccctaccccctaccaaaaaagattttatcctcctttttttaatgctatttgtgagtcactaagctgatttgacagcccgctgggtcatgaccccctgtttgaaaacaacagaaacagatgtccttcctgggtctcagcccctcctgtgtgtcgaggtgtagaggtggggtcaggtgtgggtgaaccccccacccccgtctgtcccagttatgccttgcatkcagggatgggggaagtggatgtgggtaggttctggttacattgacttctgtccctggcttggggcccaggagccccatccctccctgctcacactgccctcctcagcacttcatggcttcctctctctctccgcctccccactacctcccatcccccatccccacctgctcagcccctgcagggagcactaaggaagtcccactgtcccggtctgtgagaaccccattttacacactggggataagtggcctagagatgaggcagccacggcacttggaataaatgctcccagccactca

SEQ ID NO: 26130 - DNA, 601 bp, Human
gcttcctctctctctccgcctccccactacctcccatcccccatccccacctgctcagcccctgcagggagcactaaggaagtcccactgtcccggtctgtgagaaccccattttacacactggggataagtggcctagagatgaggcagccacggcacttggaataaatgctcccagccactcaagagggcagaattatcaggaatctgtggccctctgcagagagctttgggatcagacagcctcccactgaaacccagctgtcctcccccgagggggtgtggcccccaagctcatagmtttgtgaggaccccacagcacattcagggagggctgcgaagtcagatggcaccagggtcctggccagtgaccgggcggccagatctattgcatccaaatagccagcttccactcggctacggcgatcgccagacatgggagtttggtgttgctagatctgatttgtccccctaagagaaacctggatttttaagtgaaatcgcctgatttttgaaaggttggctagcaatttaaattttgcaaaacactaacacctggggaccaccggttggcatccccctccttgtacaaagtggtgct

SEQ ID NO: 26131 - DNA, 601 bp, Human
ctctctccgcctccccactacctcccatcccccatccccacctgctcagcccctgcagggagcactaaggaagtcccactgtcccggtctgtgagaaccccattttacacactggggataagtggcctagagatgaggcagccacggcacttggaataaatgctcccagccactcaagagggcagaattatcaggaatctgtggccctctgcagagagctttgggatcagacagcctcccactgaaacccagctgtcctcccccgagggggtgtggcccccaagctcatagctttgtgagkaccccacagcacattcagggagggctgcgaagtcagatggcaccagggtcctggccagtgaccgggcggccagatctattgcatccaaatagccagcttccactcggctacggcgatcgccagacatgggagtttggtgttgctagatctgatttgtccccctaagagaaacctggatttttaagtgaaatcgcctgatttttgaaaggttggctagcaatttaaattttgcaaaacactaacacctggggaccaccggttggcatccccctccttgtacaaagtggtgctcaggctgta

SEQ ID NO: 26132 - DNA, 601 bp, Human
cctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtgacctggacacagacagagacagagccaggcccggccctccygcccccgacctgaccacgccggcctagggttccagactggttggacttgttcgtctggacgacactggagtggaacactgcctcccactttcttgggacttggagggaggtggaacagcacactggacttctcccgtctctagggctgcatggggagcccggggagctgagtagtggggatccagagaggacccccgcccccagagacttggttttggctccagccttcccctggccccgtgacactcaggagttaataaatgccttggaggaaaacatcaggggtgtcttgtaatacat

SEQ ID NO: 26133 - DNA, 601 bp, Human
ccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtgacctggacacagacagagacagagccaggcccggccctcccgcccccgacctgaccacgccggcctagggttccagactggttggacttgttcgtctggacgacactggagtggaacactgcctcccactttcttgggacttggagggaggtggaacrgcacactggacttctcccgtctctagggctgcatggggagcccggggagctgagtagtggggatccagagaggacccccgcccccagagacttggttttggctccagccttcccctggccccgtgacactcaggagttaataaatgccttggaggaaaacatcaggggtgtcttgtaatacatcagaccccctccttgcatgttggggaaagagagggtgggacagggactcctaggtcccagggctgggaagagctgatccacgcccccggggaacgagagcctggcaggggttagact

SEQ ID NO: 26134 - DNA, 601 bp, Human
tcctggggacccatcactgggtcagaagaaagggcagttcaatggcaccaggaagtgccaggaagactcctctagcccccagcccaagtgaaagctggcctgcgaaacaagcccaagcgccctgtgtttcctccacaacactggacatggaggtgaggctactgcagtaacacgacggcactggtaagagctcgcgtgttgggcactcaccatgtgtgccacgcactacacaccagaaaccattccaagcgctttacatggattactggttctcacccttactgaggtaggtggtcttatyccagtgatcccataagttcttgtcccattttacagatgggaaaactaaggcttgagagctgacagtaactgtcagagccaagatgtgaaccccactgtgtggccccaaagcctgtgctaagagctgctaagctccaggcgccctcagcctgcacaacgtctgtcctttctgactggcagtgactggctgaaggcagggatggtgtccatgtgactcaccactatccccccagtgcctggcaaatggcagacacgggagggagtgggtgataccagggctaaggggacagacactggaccc

SEQ ID NO: 26135 - DNA, 601 bp, Human
gtagagacagggtttcactgtgttgcctaggctggtctcaaactcctgggctcaagcgatcctcttgcctcagcctcccaaagtgctaggattacaggtataagctactgtgccagggtgaggcataaagttttttgttgttgttgttgttttgtttttgttttttgagaccaagtttcactcttgttgcccaggctggagtgcaatggtatgatcttggctcaccgcaacctctgcgtcctgggttcaagtgattctcctgcctcagcctcctgagtagctgggattacaggcatgcgcsaccatgcccagctaatctttttgtatctttagtagagatggggtttctccatgttggtcaggctggcctcgaactcccaacctcaggtgatccgcccgcctcggcctcccaaagtgctgggattacaggcgtgagccaccacacctggcccggcataaagttttaatttaagcaaaaagcaagtaataaaagtactgtcagccacggcctattgagggaccacatgctgtgttctaaacactttccaggaattatctcatttaggtctccggacaatcttgatggaaattctccccactt

SEQ ID NO: 26136 - DNA, 601 bp, Human
gagacctctgacccagcattcacctctaagttggccactgaccttgggcaagacacttaattgccatgggcctcagcttccccttccttaaaatggaaccacaagattttcttggcttaccgcacagggtttgcacaagaattattccagaggatgtaagtgcatgcccttgacaaggcatacggctttttcttttttcttttttttaatttataatagaaaaagtgtttccttccaggaacttttttttggggggggacagagtctcgctctgtcgcccaggctggaatgcagtggcgcratctggtctcactgcaacctccgcctcctgggttcaagagattctcctgcctcagcctcctgagtagctgggattaaaggcatgcaccaccacgcctggctaatttttgttgttgttgttttttgtttttttttttagtagagatggggtttcatcatgttggttcggctggtctcaaactcctgacctcgtgatctgcctgcctcggcctcccaaagtgctgggaatacaggtgtgagccaccgtgctcagctagccaggaacttttttaactagttttttttttcttatttatattat

SEQ ID NO: 26137 - DNA, 601 bp, Human
ttctggagtggcttctttcctcgatgggagcccggggcagtactgaggaccagtcgaggaaggagcagacatgggtggacccacagaaaagcaagagggcagcggaccttctgagtgggggaagaccggggtcaaggtttacggcaggactgtggttactgtgctggggcttgtagatggagggatggagggtatctgtgtatgtgtgtgtgcacgtgtgtgtgtgcagagtgggggatggctcaggcattaggacaggggacagaaagggaggggctcctttaaggcctgcctgcatcgsggggaagagcgggtcctcatcagtctggcagcccacggacctcatggtgtggggtgcaggaatgggaagggcagggccctgcaccccctcatcatggggctcttcccctgcactctggaccccagaagaaccacaggtataagctgagggccccaggggggaggaggcgagcaggctgggcaggggagaagagctgctggccgcggcgtctgtgcgatgctggagcaaagggacagaaggagaagccaggacagagatggttcttctcaggggaatgggagagccaggagggaagacaac

SEQ ID NO: 26138 - DNA, 601 bp, Human
cccaataatcacagaacaaagacaattaggtcgggggaggaataaggataaaaagagaccccaacagaccctgcctgcccttccctgccccccggctgcactgctgaaatatgaggaagagatggctccagtgtggggtgctggccaggccagttcgtggggacgtacatgggctggggtggagcccccagcctctacccctggggaggatggagagtgggcagcctagggagagctacaggagggaggagggggcccagaggctctggcaggggtgaagacaagcagggggacccctcayggccctctgtccatcccgcaccagcggaggacaagggttccagtttcagtcgggtttaccccttcacccccgggtgaagtctctaggtcacagtcgcagttggggatgctggctggggaaggggggcagagacaggggcagggcacctagcagaagagcttgaggaagcagttctgacagtaaggcttgtcgttctgctccttgaaggtgcccttgttgagctgcttgaggcagaaggcacagacgaagtgctcggggtggaacttcttggccatggcggtgatgcagcggccggtgatg

SEQ ID NO: 26139 - DNA, 601 bp, Human
ctcctcatcaggagcccaaggcctggctcctctttcatccttggtaaagagctctggggggtttccccagaggagcctgtccctctgccccaaatcctatcatgctcccttatgaccttctttccagaccccctgagtgccgatcccacctgtgaaaggggaggagcagatctggggaagggatatgcccagaggaaatcaacaagaccaaagagacgtcagagtcctgatggccaaaatcagacaccagctttcctgagaaggcagaagagagagccccatagaagcagtgggggctcakaaggttcagtgggttcacaggggagcagaggctcctgagggcttactcagacaggaagcagccccccaaaacatacttccccttctcctcccacagaaacagaacagataaagttcagaattctaggcccaaaagggtgcaacacccttcaaccagtttcagtgaagagcttgctggcctgggaagtaaagaaggggtttccaaatacagcagtttataaaacagtcctggtgagctatgaagtgaaagagggggagtcacagagctgctcccagttcacctgcttgtgctaagaaacaa

SEQ ID NO: 26140 - DNA, 601 bp, Human
gctgcatctggggtgggtttggtctctgctgggaccatgaggttcagaccaccaagaaatagcactagcacaggtgaaaatcatgggcaaactttattggcataaatcacaggaattgaaatgggaaaagccagcttggaagtttacagagaaaaaataaaatcaaaatcaaattttcaaataaccactgactcagagaatggaccccagaaaccccagtccctcttggggaagatctagggtgggtcactataaacagagcggtaaggcctgcgggtgaaagtggagacatcagaccttkggaggggctgggctgaccttcccccaaaaaggagggaccctcttcggagaccccagcacactcggcttctgccaggaggccagtggagtggtttggactgtcaccattagaccccggtggggcccctttctcctcatcaggagcccaaggcctggctcctctttcatccttggtaaagagctctggggggtttccccagaggagcctgtccctctgccccaaatcctatcatgctcccttatgaccttctttccagaccccctgagtgccgatcccacctgtgaaaggggaggagcagat

SEQ ID NO: 26141 - DNA, 601 bp, Human
gtggcgcaatcttggcttactgcaacctctgtctcccaggttcgagcgattctcatgcctcagcctcccgagtaactgggattacaggtgcacaccgtggcacctgtctaatttttgtatttttagtggagagggggtttcaccatcatgttggccaggttggtctcaaactcctgacctcaggtgatctgcctgcctcggcctcccaaagtgctgggattacaggcgtgagtcaccacgccgggccggtaaggcttttgaaaagagatataagacctgattatggagctggccctcttartcccattcttttccccagaaatggaaaccctttataaaaacagaggccggtcccagtggcccaccactttgggaggccaagatgggcggatcacctgaggtcaggagttcgagaccagcctgcccaacatggcgaaatcctgtctctactaaaaatacaaaaaattagccaggcgtggtggcaggcgcctgtaatcccagctactcgggaggctaaggcaggagaatcacttgaacccagggggcagaggttgtagtgagccgagattgcgccactgcactccaccctgggcgacaagag

SEQ ID NO: 26142 - DNA, 601 bp, Human
gatgacacaacagtgaagtttgagatctgggacacagctgggcaggagcgatatcacagcttagcccccatgtactacaggggtgcccaagctgcaatcgtggtttacgacattactaatcaggtaagtgagctaagaagactgtccttgttggctggacatggtggcttacgcctataatcccaacactttaggatgccaaggcgggaggatcatgaggtcaagagattgagaccatcctggccaacatggtgaaaccccgtctctactaaaattacaaaaattagttgggcgtggtggygcgcgcctgtagtcccagctactcgggaggctgaggcaggagaatcgcttgaacccaggaggcggaggttgcagtgagccgagatcgagccactgcactctagcctcggcgacagagcaaaactccgcctcaaaaaaaaaagaaaaaagactgtccttgcttatatttagaggagttagtttggggcagggggtaagggggcagaaaacgggttcttgaaatagcaaataagagtacaaattatgcttccaagtgctaagaagacagataatgaattatcagagacctgtggtttcactg

SEQ ID NO: 26143 - DNA, 601 bp, Human
tgacacaacagtgaagtttgagatctgggacacagctgggcaggagcgatatcacagcttagcccccatgtactacaggggtgcccaagctgcaatcgtggtttacgacattactaatcaggtaagtgagctaagaagactgtccttgttggctggacatggtggcttacgcctataatcccaacactttaggatgccaaggcgggaggatcatgaggtcaagagattgagaccatcctggccaacatggtgaaaccccgtctctactaaaattacaaaaattagttgggcgtggtggtgsgcgcctgtagtcccagctactcgggaggctgaggcaggagaatcgcttgaacccaggaggcggaggttgcagtgagccgagatcgagccactgcactctagcctcggcgacagagcaaaactccgcctcaaaaaaaaaagaaaaaagactgtccttgcttatatttagaggagttagtttggggcagggggtaagggggcagaaaacgggttcttgaaatagcaaataagagtacaaattatgcttccaagtgctaagaagacagataatgaattatcagagacctgtggtttcactgag

SEQ ID NO: 26144 - DNA, 601 bp, Human
ttttgagactcattttaaaaggtgatggatatggattggcagtcattccagcctactcattctcttcatgttttcctaggaaacctttgcccgagcaaagacatgggtgaaggaactacagcgacaggccagtcctagcatcgttattgccctggcagggaacaaagctgacctggccaacaaacgtatggtggagtatgaagtaaggtggcccgtggagttcctctctaacacttcctctgttcctgggacctctttttttccaaaccagccctctctgaaaacgtcaacagaggacatycattgtctcattccccagttctacaccaagttaaatacagcaacactgtgaccctaatgacagccaggagattttcaaaggagtcaggagaaaactccagagcagagggttagggaagtaccagctgtgggggtaccagtgtgaaaacaggaaggagggagcaattaaatttgtggtaagggactattcaagtgtcacaacccaaaagcccccaactaacttaccctctcccctataattaagctttctgacatttgtgtgttggactgagtggacatggggtcatcttgagggagttgt

SEQ ID NO: 26145 - DNA, 601 bp, Human
acagcgacaggccagtcctagcatcgttattgccctggcagggaacaaagctgacctggccaacaaacgtatggtggagtatgaagtaaggtggcccgtggagttcctctctaacacttcctctgttcctgggacctctttttttccaaaccagccctctctgaaaacgtcaacagaggacattcattgtctcattccccagttctacaccaagttaaatacagcaacactgtgaccctaatgacagccaggagattttcaaaggagtcaggagaaaactccagagcagagggttagggargtaccagctgtgggggtaccagtgtgaaaacaggaaggagggagcaattaaatttgtggtaagggactattcaagtgtcacaacccaaaagcccccaactaacttaccctctcccctataattaagctttctgacatttgtgtgttggactgagtggacatggggtcatcttgagggagttgtcattaaattatgcatctaggctagctggctcaaaggggtattaattaaggggagggaacctaggattttgcctagctgttgtgctgcatgggagtggaaaggcaatactcgttccca

SEQ ID NO: 26146 - DNA, 601 bp, Human
tataggcaaaattatagctaacccaaatcaaggataggtgcgagtatctccttttgcaaaaactttaggtatggaaataccttaactttctgttatgacctccatccttggctgcagctttagctcccttgtcttcaatgtgtaagtttgccggccaggtgtggtggctaacacctgtaatcccagcattttgggaggccgaggcgggcggatcacgaggtcaagagatcaagaccatcctggccaatgtggtgaaaccccgtctctactaaaaatacaaaaattagctgggcgtggtggygcacacctgtagtcccagctacttgggaggctgagccaggataatcacttgaacccgggaggtggaggttgcagtgagccgagattgtgccactgcactccatcctggcaacagagcgagactccatctcaaaaaaaaaaaaaaagtttgcaaatagtgaaccctcccatcttcagaacattcttttaatctctcaaattctcccttttccccaattcagtagccgtttttggcgggtggaggcagaggggtagggaagtaaagtctaccatactttgttctcttctctttttatctcta

SEQ ID NO: 26147 - DNA, 601 bp, Human
aattctcccttttccccaattcagtagccgtttttggcgggtggaggcagaggggtagggaagtaaagtctaccatactttgttctcttctctttttatctctagctaagaagttgccaaagagtgaaccccagaatctgggaggtgcagcaggccgaagccggggtgtggatctccatgaacagtcccagcagaacaagagccagtgttgtagcaactgagggggtggctagcagcaaacaagtatggagctagcacaagagctaagaaataacctccatccctacccctcagcacacarcccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttt

SEQ ID NO: 26148 - DNA, 601 bp, Human
tgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttaygtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggc

SEQ ID NO: 26149 - DNA, 601 bp, Human
cacacagacacctacaggaagaaaaaaaattaatattcagattatgtaaagaattcttagaaatcagtaaggaaaggatgaccaataaagcaacaaaggataagagtaggaattatacatttgactagcctcactaataaccaggaaaatgtatattaaaaatacatttgatatccaaatttttagagaaaatgctttcattgtagatgttagtaaggtgggtgtttgatcacccatggattcttctctttttctgaatagtgtttcctaaagtgagacagcctggaggaaatgctaaccyggtgattcagtcccattatttttataggtcagaattcagaagcctaaagaagcggacataaaattcaaatttccagtttcttgttttggcctgttttctcattcctatccatattcctttctgacttaatgttagcagcttttgattcaatagctttttaaaggtggaaaactaaattcatgtagcaagaaacactagagagtcctagctacctaatagtgaccttcagcacgaccacagttttgtgtacttcgtgcatttctaagttctgtagcatcttgccctttcttgtgtatcatg

SEQ ID NO: 26150 - DNA, 601 bp, Human
tgtgccacaatgcctggctaattttgaatttttttttttcataaacagggtcttgctatgttggccatgctggtttcaaactcctggcctcaagctatatttcctcctcagcctaccaaagtgttgggattacaggtgtgagccaccatgccctgccacttaggagttgttttatttttatcttgattgattggtttttctttgggaaaagtattaactgatagaatttatgttggtgattcatattttaatatttctgaaatattcatatttcgagtagaaagttgttttaactgaagtrtaagagaaagattatgccttaaatgatttttttttctcttaatgtattaggcaaaatcctcaatgatgatactgctctcaaagaatataaaattgatgagaaaaactttgtggtggttatggtgaccaaagtaagtttcaacctcattctgtatatctttatgcatgtaggtctttttaaaaatgatgatcacaagtccacacaatggacacagtttatacacatccatagtggtgtacacttaactactatgaaaggtttttaagaatttaccttaagtgaaacataaagttattaatg

SEQ ID NO: 26151 - DNA, 601 bp, Human
aattgaaaaataaaatgtcatgttaaaattatttttgctacagtagtgaaatcattatataattcttttaaaatgtctttataagtggaataaatgtttattctgtagtttttgtaagcttgccttaaatagacctgctaaattacgtactagtcctaacagattcctcaagacagaaaaggcatgaaagcttattattacagtgatagttcttagtgaaagaatatgtttttagaaactaaaaaaagggaaaagataactaaagaaatgatggaatgatttttatgaggaagttttttttgtttttgttttgtttttttttttttgagacggagtctcgctctgttgcccaggctggagcgcagtgacgctgtcttggctcactacaagctctgtctcccgggttcatgccattctcctgcctcagcctccctagtagctgggactacaggcgcatgccaccacgcccggctaatttttttgtatttttagtagagacagggtttcaccgtgttagccaggatggtctcgatttcctgacctcgtgatccgcccgcctcggcctcccaaagtgctgggattacaggcgtgagccaccgcg

SEQ ID NO: 26152 - DNA, 601 bp, Human
aaattatttttgctacagtagtgaaatcattatataattcttttaaaatgtctttataagtggaataaatgtttattctgtagtttttgtaagcttgccttaaatagacctgctaaattacgtactagtcctaacagattcctcaagacagaaaaggcatgaaagcttattattacagtgatagttcttagtgaaagaatatgtttttagaaactaaaaaaagggaaaagataactaaagaaatgatggaatgatttttatgaggaagttttttttgtttttgttttgtttttttttttttgagacggagtctcgctctgttgcccaggctggagcgcagtgacgctgtcttggctcactacaagctctgtctcccgggttcatgccattctcctgcctcagcctccctagtagctgggactacaggcgcatgccaccacgcccggctaatttttttgtatttttagtagagacagggtttcaccgtgttagccaggatggtctcgatttcctgacctcgtgatccgcccgcctcggcctcccaaagtgctgggattacaggcgtgagccaccgcgcccagcctggaagttttaaacagat

SEQ ID NO: 26153 - DNA, 601 bp, Human
ttttagaaactaaaaaaagggaaaagataactaaagaaatgatggaatgatttttatgaggaagttttttttgtttttgttttgtttttttttttttgagacggagtctcgctctgttgcccaggctggagcgcagtgacgctgtcttggctcactacaagctctgtctcccgggttcatgccattctcctgcctcagcctccctagtagctgggactacaggcgcatgccaccacgcccggctaatttttttgtatttttagtagagacagggtttcaccgtgttagccaggatggtctygatttcctgacctcgtgatccgcccgcctcggcctcccaaagtgctgggattacaggcgtgagccaccgcgcccagcctggaagttttaaacagatacttttttgtgatttagtaggctggaatgtatttggaacaatttataaaattaaattttttttaaagcagagaatgaacatggatttttttaagagactatttatatacttgtttatttaaagatatataatgcagtgtagaattaagagacaaatggagaagtggtactcatgacattcatttttaggattggattgtcataa

SEQ ID NO: 26154 - DNA, 601 bp, Human
atcattttaagtgtacagttcaataacattatagttacattgttttgcagctatcaccatcatataagtggaatcctatggtatttgtctttttgtgactggcttatttcacttagcataatgtcatcgaggttcatctgtctatgttatagcttgtgccagaatttgctgaacttttaagactgaatactatcctattttcctatctagttttagcatacatagtacataatgggaaatgtgatagccacacatttaaatatgttttgttactggtcttagtttcttttaatattacagwgatcctgactgtttagaacacaagaattaagcagaaaaagtctcaataggtgcgtgtgtttgaggaatagatacttgaagcctatcattatattgcatacagtccttttgtttttccttaaagtcttttattcctaatattacataggattctaatgatatttatgattgttttatttgaagttaatagaggacaactatgaaaagggagggaatgctgctacagtaaggcattatggaagcactgagaaatgaccttattaatacaaagaagggaaaggaaaaagctattaagatcaaa

SEQ ID NO: 26155 - DNA, 601 bp, Human
ctgggtaacatggcgaaaccttgtctctacaaaaaaaaaaaatacaaaaatttagcagggagtggtagtgtgagcccgtagtcccagctacctggtgttgggggcgggggcagtggctgaggcaggagccttgggaggttgaggctgcagtgagctgtgatcataccactgcactccagtctgggcgatagagtgagaacctctctcaaaaagaaacaaaagaaaatcacgagagagaatatttttagtgttcattaagtgtaagtggatcatcataaaggtcttcatccttgtcttcacrctgaataggctgagaaagagaaagggttggtattgcggtctcaaggtggcagagatggaggaggtagaaggagaggcaggcacactcagtgtaacttatattgaaaaaaattatcatgtaagtggacccagtgcagttcaaacccttgttgttcaagggtcaactaattgtttttttgctctgtgggaagctttatggctctatttccagttcagaaagtgctgagcgtgtggaggtaacttaatttggcctttatttttctgcttaattacatatatgtctgaaagtattgtgaacctt

SEQ ID NO: 26156 - DNA, 601 bp, Human
atccagtcttatctgtggtgtttaaagagaactttttaaaaacaatgtgtgggccgggcgtggtggctcacgcctgtaatcccagcactttgggaggcagaggcaggcggatcacaaggtcaggagattgagaccatcctggctaacacagtgaaaccccgtctctactaaaaatacaaaaaattagctgggcgtggtggcgggcgcctgtagtcccaggtactcaggaggctgaggcaggagaatggcgtgaacccgggaggtggagcttgcagtgagccgagattgcgccgctgcactscagcctgggcgacagagtgagactccatctcaaaaaaaaaaaaaaaaaaaaccaatgtgtgataatagtgtaaattattctaagggagatgtgtcttaccggattttaaaatgtattatacagtaatgattaaaacagtttggaatggctcatattagaaagattggtcagcgaaatcaacaatagctttgaaatagacccagatagatacaggaacttaatataaaggtacagtttcagaacaatgtggggaaaatgctattgagatctcaccatctagaatgaaaaaagaatgacccc

SEQ ID NO: 26157 - DNA, 601 bp, Human
atgggtatgaaatttttctaagatctgcctcacacttcatgtgtattcaccattagacttaattcaacttgatggcactatacattcccatctacatcttgttgcttgcattggcttgcagcaaaaatgcctttttatcccaacttttaattttacctactgaataatgcctttccatctcccatcaccccaatctgtcaaaatgaagcagcattttttttctcccattgtagcatctctgatacagttcctgctaattactggtttattggctggcaactccattcctagtttgttactyttaaatggcagggagggagaaagcgaggaataggtagaaacagcagctttggtgcagtacaggcttctggattcctgcttagcttctacagcagcagggttccagcagcagtaccacctcctagcatctgagttggttctctgagctagttggactggaactccgtgatgcccttgttgctgtggaaaatggcatgtacatttagtggcaaaacggcagtttaaattatctaagatcgcctgggtgtgacaaccccagattttcatctttgaggagcagtgtcctaaaaccactctgcta

SEQ ID NO: 26158 - DNA, 601 bp, Human
tcctgaccttgtgatctgcccgcctcggcctccaaagtgctggggttacaggcgtgaaccacagtgcccggccagttaattcgttttattttacctgactattaaatgtatgagttttctatggttccattctaggtcatagttcaaagtttaaattatgggaatgaccaataccatccatatactatatagattccccaaattacagctgcagtacagatctccctctgaactcccaaactcgtatcttcacattgtcaactagaaaactttagaacctccatgacttcaggtttcaaaytgactcattttttattccccagtctgattcttttcttgttcacttcttacttgtaccatcattcattcatccaccctctgcctcttttggcccagtgagtctgtttcttttcttttcctttctcctctctcctctgtcctctctcctttctcctttcctttctccttccttcctccttccttcctttctccttccttcctccttccctttcttcccctcattccacagttactaatgactctgtttcttaaagtctctggaatatttgttttcactgtcatttagttgccttagttcagg

SEQ ID NO: 26159 - DNA, 601 bp, Human
gtatatatacatagtagtgggatttctggattaaatgatagttctgtttttaagttctttcagaaatttccgtactgttttccataaaggatgtactaatggacatttccgccagcagtgtataagcattctattttctccacatccttgcccaacatctggtataagatggggcatctcattgtggttttaatttgcatttctctgatgattggtgatgttgagcattttttcatgtttgttggccacttgtctgtcttcttttgaagaatgttttttgccagtcatgttttttgcccastttttaatggggttatttgtttttttcttgatgttttaaagttctggataatagcactttgttagattgcctaagccagtgtccagaagagtttttctaggttttcttctaggtttttttgtagtttcaggtcttaatatttaggctttaatctgttttgagttgacttttgtgtttgatgagaagtctgggtctagtttcgttcttctaaatatggctatccaatttcccagcaccatttgttgaatagggtgtcctttccccggtgtatgtttttgttgactttgttgaagatcattt

SEQ ID NO: 26160 - DNA, 601 bp, Human
gacttttgtgtttgatgagaagtctgggtctagtttcgttcttctaaatatggctatccaatttcccagcaccatttgttgaatagggtgtcctttccccggtgtatgtttttgttgactttgttgaagatcattttggttgtaggtatgcagctttatttctgggttctctattctgttccattgattgatgtgtctgtttttataccagtaccatgctgttttggttacaatagcctggtagtattatttgaagtcaggcaatattgatcaaagcttattctgaatgacatatataagrttcttcatcaccacctcttttgcctcattactctgtttcttggccagtctctctcgtttttgttttttttgttttgttttgttttgtttttgagactctctctctttgtcacccaggctggagtgcagtggcacagtctcagctcactgcaacctccgcctcttaggttcaagaaattctcctgcctcagccttccaagtagctgggattacaggcgcctgccaccatgcccagataatttttgtatttttagtagatacggggtttcaccatgttggccaggctggtctcgaactcctg

SEQ ID NO: 26161 - DNA, 601 bp, Human
atctaaaaagtatcacattgcttatgggtatttttttgagattgtataatttaactaggaaacatgattttaggagtcatagtgtaatgattaggtgtggagactcttgactgtcagcctgtgtttgtatctctgcaccatgacttaatacttttacgaattttttttttttttggagacagtcttgctctgtcgccagactggagtgcagtggcgtgatcttggctcactgcaatctccgcctccggggttcaagcaattctcctgcctcagcctcctgagtaggtgggactacaggcaygtgccaccatgcccagctaattttttttgtatttttagtagaggcggggtttcaccatgttggccaggatggtctcgatctcctgatctcgtgatctgcccgcctcggcctcccaagtgctgggattacaggcgtgagccaccacacctagtctttaccaaattattaatctctccaagctgtaccctcctcatcttttaaaggagttgaaattaaacctttcttatgaagtagtgagagagaactaaatgagaaacaccatgttaaaatagtgcagttctgattttttgtagctcgtaa

SEQ ID NO: 26162 - DNA, 601 bp, Human
aggccctggggcaggaaaaggtgtggcctgctgaagtaacaccgggaagatgagtgtggtgggtggaggattgttgagggctgggagccagaaataaaatgaggggttttgcgcacacgcgtgcgtgtgtgtgtgtgtgtgtgtttacttgacttttgcaactggctgaagaacagattatagatatggagacaagagttggaaacagggtgtaatcccatctagagactgttgtgggcttgtcttcagtgatgacagtagagaatgaagagatgggtttggggtgtaatttagagatagracctaccaggtatgctggtaagtgaggtgtggaaggaagaggaaaaggaactgaaatcaccagggtttttgtccaagtgcttaggtaaatagaggtgccatttgtttaaagagagcagacagacaatggtgggacacatttgagagggaaatctgaattgcaattagttgaggaatgagtggaatgtgagaaagtggacacatgttcaatagctatggctgtgatgagaagacagcagatggttcctcaaagaggaattaggatgaagtcaaaggtgggaggtgtgtttttgttttagag

SEQ ID NO: 26163 - DNA, 601 bp, Human
ggctgaagaacagattatagatatggagacaagagttggaaacagggtgtaatcccatctagagactgttgtgggcttgtcttcagtgatgacagtagagaatgaagagatgggtttggggtgtaatttagagataggacctaccaggtatgctggtaagtgaggtgtggaaggaagaggaaaaggaactgaaatcaccagggtttttgtccaagtgcttaggtaaatagaggtgccatttgtttaaagagagcagacagacaatggtgggacacatttgagagggaaatctgaattgcarttagttgaggaatgagtggaatgtgagaaagtggacacatgttcaatagctatggctgtgatgagaagacagcagatggttcctcaaagaggaattaggatgaagtcaaaggtgggaggtgtgtttttgttttagagtgaaatataggacatagttaactactgacccaggataattacacagaggggtaaagatgttggtggagaagagggaggataaccaaatccagtttggtttgagtgtgaggcaacaataaaggtaatggtccccagaacacaagcagaagaaaggatagtttta

SEQ ID NO: 26164 - DNA, 601 bp, Human
accctctcatctgcctcctcctactactattaaggattcatgtcattacactggacccacctggataatccagaatgaggtctctgtcttaaagtcagctgattagcaaccttaattttatctataaccgcaatttccctttgccttgtaacctatttataggttccagggatcaaaccagagggcatctttgggggaccattacctactacatatatgttgtaatttatactgttactcatctttgtattcccagcatagtagttcctgaaatgttgtatacatgaatcagtaaatgtawagagaatgcttatttattaaatgttcctttttttcccctccaccctccctttttagtgacgggtcagtcttacgagaatatggtaactgagatcatgtcaatgggctatgaacgagagcaagtaattgcagccctgagagccagtttcaacaaccctgacagagcagtggagtatcttttaatggtgagaaatatgttttactttactccattctgttgtttaagattaaaatctcaaagaaacagattttaaaggaccagttcacttgtcactgatatatgctagatgatatacataat

SEQ ID NO: 26165 - DNA, 601 bp, Human
ctgagagccagtttcaacaaccctgacagagcagtggagtatcttttaatggtgagaaatatgttttactttactccattctgttgtttaagattaaaatctcaaagaaacagattttaaaggaccagttcacttgtcactgatatatgctagatgatatacataatgcttttttttttctagtatgtttgtattttgtgttaataaaatgtaaccttttttaatctaatggtccaacattgtagtagctttttaggtgccactatgcgtgaattattcagaacaaaaatttcttttttcyttttttttttttttttttgagacggagtctcgctctgtcgcccagactggagtgcagtggcatgatctctgctcaccacaagctccacctcccaggttcacgcctttctcctgcctcagcctcctaagtagctgggaccacaggcgcctgccaccatgctcggctaatttttttgtatttttagtaagatgggatttcaccatgttagccaggatggtcttgatctcctgacctcgtgatccgcccgcctcagcctcccaaagtgctgggattacaggtgtgagccaccgtgcctggcca

SEQ ID NO: 26166 - DNA, 601 bp, Human
agggattaaggaaaatattttagatcgtggaatctaattcattatcctctgattcactctgttaccaacgtaacatcatgcatttaatgaatgatgttactacctggttccgttggcatttgaatttgtttttatagtcagtaggagttgagggactttttgaataaagtattcttttttttactggtaatgggagtttttgagaaataggttgttgtggacatcaactgaaacccttggtattaagatgaaagtctgctagttttacagatgtgacacaggctaaagtaattgaattaasttttttaaaatctcagacttctataattgtctggtgttttggagtattatcaaagtctgaattgccctaaatatcatcttaaagttgcctgattctaacccttttgggaattacatccacagtttaacccattcctttgtgtctaggttgtacttctgttaaaaactcctttcaggtagctagctagtttcagaagagtcagttataagcctcataactgtactctgcctccaccatttatttgcctatgcctttgcatgtgaagttcacaaaacctttttcttagcatattattttatc

SEQ ID NO: 26167 - DNA, 601 bp, Human
atgaaagtctgctagttttacagatgtgacacaggctaaagtaattgaattaacttttttaaaatctcagacttctataattgtctggtgttttggagtattatcaaagtctgaattgccctaaatatcatcttaaagttgcctgattctaacccttttgggaattacatccacagtttaacccattcctttgtgtctaggttgtacttctgttaaaaactcctttcaggtagctagctagtttcagaagagtcagttataagcctcataactgtactctgcctccaccatttatttgccyatgcctttgcatgtgaagttcacaaaacctttttcttagcatattattttatctttttaaattcactttttcattatcttcttgagtagtgtctttaaatgctggcagtttatccagtttgtttggaattgtggaattaataattgttgtgaatttgtttggtgaggagtgtgtaccctaaacagattgtataaaagtattagcttttatggagtggctttcatttacacctgatttagaattctgtataagttcaacagtatcagttattttgatctaatagatgtggagttttgaggt

SEQ ID NO: 26168 - DNA, 601 bp, Human
atgcctttgcatgtgaagttcacaaaacctttttcttagcatattattttatctttttaaattcactttttcattatcttcttgagtagtgtctttaaatgctggcagtttatccagtttgtttggaattgtggaattaataattgttgtgaatttgtttggtgaggagtgtgtaccctaaacagattgtataaaagtattagcttttatggagtggctttcatttacacctgatttagaattctgtataagttcaacagtatcagttattttgatctaatagatgtggagttttgaggtataaaaatacagaatcattgttaccaaatgctaaaactgctgtagagcatcaaatgcaaataaatagatgatacatgagttcatcaaaaacaatttataactaaaatgttttttatatatttgctctttgtttcatagactgaaggggaaaagttgcttttaactgttactagttaagagataggttaaggtgaacggatggaaagaagaaatgttgagcatttatataagaggctatgtaatgtgtgagaatagaggtcgatctatagcaataaagatgaactttttagtttaataaaag

SEQ ID NO: 26169 - DNA, 601 bp, Human
tagatgtggagttttgaggtataaaaatacagaatcattgttaccaaatgctaaaactgctgtagagcatcaaatgcaaataaatagatgatacatgagttcatcaaaaacaatttataactaaaatgttttttatatatttgctctttgtttcatagactgaaggggaaaagttgcttttaactgttactagttaagagataggttaaggtgaacggatggaaagaagaaatgttgagcatttatataagaggctatgtaatgtgtgagaatagaggtcgatctatagcaataaagatgractttttagtttaataaaagagaatttgatggacgccctggatcctaaatttgtatgtagtttgttagcacttaaataactgcccatctgagttaagggtttgcgttggttaactcattcaaaaacattggttttaatgcctggagtgacatctaatccatgcagccattttcctgctgtgttactcttcatcctttatatgttgttgcttttggcttctggtttattagggaatggaagcatttatcatcttattcaattgtaatacttggttctttattctcttcaaaatctataaga

SEQ ID NO: 26170 - DNA, 601 bp, Human
ttatgagatactttctgagtgacactttctcagtaccatggatcagtaggggagatcctcctgcctggccactgtgtacctggtctgtatccattagatattttttcccccaggagtcatttcagaactgtcaagtgtgcatcaaaacctctttttggattatcttaagctagagttgcaaactcaatcctttttatcactgagtaacagctgataaagatttctaagaagttaaaaagtcaactgaactaataggtagcacaaaaacctttggttgtgttcagttttaagaaggtacatrtatcaatatttttcaaatttgatgctaattacgtgtgcctggtaggtgtcttattgaacaacacagagaatatttccatcatcatggtaagttctgttggacagtgctgctttgcattattatagcaatgtgggtttttctataatgcacccaggtcatttctaatctaatttgaatccatgcagcttaataatcctttacttttaattgaagcagacatctgtttgatgcttttgaaaatcaaacaagatgttaaatagactataaatcttttactctgtataatatttaattttgcat

SEQ ID NO: 26171 - DNA, 601 bp, Human
gcatattctgttttatttgttttaaggaaaagatgctttccagtttgtatttagtgttactttctgatgccattcagagtggtttgctcactttgtctcttactctctccataaatgttacaaagtgtatgtaatttcaaagccagcaggattttagtaattatacagccaaggaaatgaaaccgtgagaggtttaaaaccttgtatctagaggagaaagcaaagcttgaattgaagtctctttactggggtgctgaccataccccacacattgctataggtctgactacagagcaaagcctggaacctgcggtcagcttaggaattacgcagtgttctccttcgttcgttcttctgtatattaataaagtaatttaaactgttgatcttgaaaaggccattcttccatgcatttcctagctctgataatgatagtcacctctggttgacaaaggtcactcagtgctttgtgtacagtctcccaaggacaggccctttgtttgttgtgattcagcatatgggagtggaaagagatgaccacagctctgctttggatttggggtcctgttcctttcagcacttattaggtgacatagtctct

SEQ ID NO: 26172 - DNA, 601 bp, Human
gcagtgttctccttcgttcgttcttctgtatattaataaagtaatttaaactgttgatcttgaaaaggccattcttccatgcatttcctagctctgataatgatagtcacctctggttgacaaaggtcactcagtgctttgtgtacagtctcccaaggacaggccctttgtttgttgtgattcagcatatgggagtggaaagagatgaccacagctctgctttggatttggggtcctgttcctttcagcacttattaggtgacatagtctctaagtctcgttgccttcacctgtaaagctrgtattatatatggaagaacaaaaaacccatgtgctgtggtcatttcaattggaatgattgtcttcctgaataggaaattacaacatacatctaaaaattctcttttattcattagtaacctcaaaaacaattcctgtatgtacgatttttggtttcctatagcataaccagacaagtaccagcaccctgaaaaagccagaagttctgtattttatattttatttggcattattaacatttattattgtgaatggattttagactgaagagtttagatatattagtactagattgccatac

SEQ ID NO: 26173 - DNA, 601 bp, Human
gggtcctgttcctttcagcacttattaggtgacatagtctctaagtctcgttgccttcacctgtaaagctggtattatatatggaagaacaaaaaacccatgtgctgtggtcatttcaattggaatgattgtcttcctgaataggaaattacaacatacatctaaaaattctcttttattcattagtaacctcaaaaacaattcctgtatgtacgatttttggtttcctatagcataaccagacaagtaccagcaccctgaaaaagccagaagttctgtattttatattttatttggcatwattaacatttattattgtgaatggattttagactgaagagtttagatatattagtactagattgccatacagcttatttatccgagtttttgtagttcacaaatgtttgaaaattaatggtaataaccggaagtcttccttaatgtaagtttggattaaagtttctcctgatttgcaaaacctgacctcagactttaaatatctttttcttctttggtttcttgaattcctaggaattcaagctcagattgtgttcttttaggggttttcattgtttataaagtaagtgagtttttgttt

SEQ ID NO: 26174 - DNA, 601 bp, Human
aaaatttcttgatcattgaatgtgagacccttctaacatgatttgagaagctgtacaagtataggcagagttattttcctgtttacattttttttttgttttggggaaaaaattggtaggtgtctaattactgtttacttcattgttatattgcagtaaaagttttaaaacaaccattgcatgtttgcttttgatgtatccctttgtgaaattagcacttttggggccaatggagaaatgcagcattcactctccctgtcttttccccttccctcagcagaaacgtgtttatcagcaagtygtgagtcaaactgctgccttttaaaaaacccacaaaatgctgattcagttcaaaattaatgcaaatgtttcaaaactgggtttctgatatttgtaaatgtgtttctttattagataagagtgtattaccattaaagtcattagtataatattgctttcaaaaagaaatggtagacaaaactataatccagcatcttttattgcattggaaagactggcaaagtcttttggatgggttgggagatgtggctggaaagtactttggaaaatatacaatcaagatatctcatggcatattaaa

SEQ ID NO: 26175 - DNA, 601 bp, Human
gcccttacctgttcctcctcatcctgggttttagcctgaagcagctggaggaggcgggaagctgtcagccctccattggaatctacatataggacgttttgctgcaggccatgggccacatttgctgccatacagagacatacctgggggtgggggcattggatgaacttgacacttcagagagggtccagatgggagctccccaccaaaccttgcccagattccagcaacacaaatgggctgagtcccgaccccattccttattacccatcttctctctgttgggctctgaacccattartacgctgaagctcccccagggaccctgggctatgcatctaccaccctcacccctaaatcctcctgactgctggcctcacatgtacctgagttttgccgctacctgggcctcctacaatttcagtcacttctccagtatagagaccagcatcaagcagtttatcaagactgatggcagaagagaagaaaatcaacacaagaggttaggaggaagacaggggaaaaggtaccaagaagaaaagtaagacatttctttcaagcactggttctgtctttgaacatcactggccaggaggcttct

SEQ ID NO: 26176 - DNA, 601 bp, Human
aagcaaggactttggataagagggagtaggggggtcaaggtaaggctgagaaggaagaggcacctggatgcaaggactcaggtccagggtggcaaatgagctttgtctaatggtcagttgtcacagtggtggctgcctgggtgctgagctgtaaagtactcagaactcagcaggaaagagggatatgactgattagtgatgtctctcacaggtgagaaatggactggaaacacaaagcttggtgtttgccagccctggtttagggcatgcaaagagttgggagggtttcctggaagaatcrgtgtgagtagcatcccaaatgggatgatggcatcaacaggggtggcttaaggaatacgagatgtattaatagaacagcaagtttgaaggcaaggaatgactattcaacccaaattcttacaatgttaagggataatggggttttcctgtgtcagaatctcaatggaacccagcatcctgcccttacctgttcctcctcatcctgggttttagcctgaagcagctggaggaggcgggaagctgtcagccctccattggaatctacatataggacgttttgctgcaggccatgggccacatt

SEQ ID NO: 26177 - DNA, 601 bp, Human
tcagcaagaggaaaggaggaataaactgttctttgggcctcactgggggaaactgaaaaacagccttctaaggggaaatcaggtggctctagggctcggggaattgcctttttatatttttaagagcaaaacagagatgaagaagagtatttcatttataagcttatttccacccagtaactcagagacagagctaaggaagagtgggcccccatctaacaaatggaaaggcagagacaaaagaaaaaaaaggcagcagcagcaaaggcaagttagaggctttcccggcttggccactgcrctaggagggagcacaggacacaatggtgatgcacaggattatccatccagtcgccagcatgcctcatcagagatgctcccagccagggtgaacttggtttccaccagaaacatacacgttagaaataagggaaggaaacgtggcaccagtatgaatttctgggtcctcgcaatgcagcatcctctttcgcctgtggtttatatgcttacagagagtgaggccaaggaacccaagatgtctcttctggccagcctgagaacgtctgtagtcaccagtgccaggtggcagtaaacagcaggc

SEQ ID NO: 26178 - DNA, 601 bp, Human
cagtgagctgagatgacaccactggtcggactccagcctaggtgacagagcaagaccctgtctttaaaaataaaaaaaaaaaaagatgatgtaaaaatcttaagacggcggttatgcgagtgtcaagaccatgcccaggccccttcggatgagaatgaagtctggaacccatcccctcccaggggcactgggagacctccaggaacagttaacagcagacttccgaatccctgaggacccagagagggaactggcaagaccatcggagtctgcggtatggatgcctgctttccaggcacaygaattctcctaccttctggcctccgccagccatgcggctacttatgtattctgggcccagcctctgcctcagggccttctggatggcctggtactcttctgctgtgtactggcactgcaaccccaaaaaagaaaattaaattcacacttccaccattcctcacatcattgagtctccatcctttatggagactttatactcttaaaaagaccccccagaacctttgtttatgtgggttctatgtatcctattaggaatcaaaactgagaaacttttaaggcatgcatgccattaggcatc

SEQ ID NO: 26179 - DNA, 601 bp, Human
gcccagcagttcgagatcagcctgggcaacatggcgagatgtcgtctctacagaacattaaaaaattaaccaggtgtggtggcgtgtgcctgtagtcccagctagtcaggaagctgaggcaggaggatcgcttgagcctgggaggtggaggctgcagtgagctgagatgacaccactggtcggactccagcctaggtgacagagcaagaccctgtctttaaaaataaaaaaaaaaaaagatgatgtaaaaatcttaagacggcggttatgcgagtgtcaagaccatgcccaggccccttcrgatgagaatgaagtctggaacccatcccctcccaggggcactgggagacctccaggaacagttaacagcagacttccgaatccctgaggacccagagagggaactggcaagaccatcggagtctgcggtatggatgcctgctttccaggcacacgaattctcctaccttctggcctccgccagccatgcggctacttatgtattctgggcccagcctctgcctcagggccttctggatggcctggtactcttctgctgtgtactggcactgcaaccccaaaaaagaaaattaaattcaca

SEQ ID NO: 26180 - DNA, 601 bp, Human
ggagtgtgcccagccattgtaaccaaacatctcattggccagattaattacccgatgaccctcaatgtagcacacctagaaaaacaaatgtttttaaggaaaagctgtgttaattccttaccacacttaaatgtgaatcaaaattgacataatttattcctcatctacttttttcgataaactgtccttaaacattcttctcgggaggctgaggtgggaggatcacttgagcccaggagctcaaggctgcagtaagctaggatcgtgccactgcactccagcctaagtgacagagtgagamccagtctgttaaaaaaaatttttttttcaagaaaattctcaatgaatttatttcaaaaatcttctagatggagcccgcgagaacgaatggtctgttgggaggaggaactcacccagcagttgctaaaattcagtttgcaaaaagtacaaatctgtttgacatattttatggaagaccaaaaatatacacagaagttaaaattagaagcaaatgatatgcaattattatgtgtcaatcataagttctttaaaaagtgtttaattaaaaaaaaaaagcaaatggcaaaaggaacattttttt

SEQ ID NO: 26181 - DNA, 601 bp, Human
tggagtgtgcccagccattgtaaccaaacatctcattggccagattaattacccgatgaccctcaatgtagcacacctagaaaaacaaatgtttttaaggaaaagctgtgttaattccttaccacacttaaatgtgaatcaaaattgacataatttattcctcatctacttttttcgataaactgtccttaaacattcttctcgggaggctgaggtgggaggatcacttgagcccaggagctcaaggctgcagtaagctaggatcgtgccactgcactccagcctaagtgacagagtgagraccagtctgttaaaaaaaatttttttttcaagaaaattctcaatgaatttatttcaaaaatcttctagatggagcccgcgagaacgaatggtctgttgggaggaggaactcacccagcagttgctaaaattcagtttgcaaaaagtacaaatctgtttgacatattttatggaagaccaaaaatatacacagaagttaaaattagaagcaaatgatatgcaattattatgtgtcaatcataagttctttaaaaagtgtttaattaaaaaaaaaaagcaaatggcaaaaggaacatttttt

SEQ ID NO: 26182 - DNA, 601 bp, Human
acaccttaaataactgtgacttgaagtgaaacaacttattaacaaaacatatttttgttttcatcaatgttataacaaaaggacctgctttgcctaaagttgagtttccaaacacttatcagtgatggtaaaattattgtattttaaaatgtcagattttaccatatgccaaaaaatacatcctttgcaacaatttttatatatggtgaaaacttttaggtgtcagcttgaacatgtgcaagagaacagtttttccattcttttagggagcacatgagcaagagtatttgaattccaccaytctagggaacgctggctgagacacaactctggagcctgggtccccgtccagctacctacttccctacctgctcaccttctcctaccacccactgatccttccgggcagcaggtctactccatcccctcaccttcagctggaccctcacaaatgcacagactcccacgtagaacttgccattgttgaggtcaacaaaatctaggagtgggaaagagagcaagttgaagaggacactgaccgctgggccacaaccattcctcctgctggcagctgagtccacctaccttacctcctcaccca

SEQ ID NO: 26183 - DNA, 601 bp, Human
ataaatgatagatcttatcctctatagtatttagagtccactggaatatttaacaagattcaacagatttacggtaagtgctcacttaacaccttaaataactgtgacttgaagtgaaacaacttattaacaaaacatatttttgttttcatcaatgttataacaaaaggacctgctttgcctaaagttgagtttccaaacacttatcagtgatggtaaaattattgtattttaaaatgtcagattttaccatatgccaaaaaatacatcctttgcaacaatttttatatatggtgaaaasttttaggtgtcagcttgaacatgtgcaagagaacagtttttccattcttttagggagcacatgagcaagagtatttgaattccaccactctagggaacgctggctgagacacaactctggagcctgggtccccgtccagctacctacttccctacctgctcaccttctcctaccacccactgatccttccgggcagcaggtctactccatcccctcaccttcagctggaccctcacaaatgcacagactcccacgtagaacttgccattgttgaggtcaacaaaatctaggagtgggaaa

SEQ ID NO: 26184 - DNA, 601 bp, Human
gttacacgaatgagccaccccgcctagccaaactttcaaccataaatatgtattaggattaaaaccagtggggaaatagaatagaaatatgagttcagataaagaaagaacaatgtaaaatttctaatgattaaaaaaaagcttgttcattgtatttcttcaaataaatgatagatcttatcctctatagtatttagagtccactggaatatttaacaagattcaacagatttacggtaagtgctcacttaacaccttaaataactgtgacttgaagtgaaacaacttattaacaaaacatatttttgttttcatcaatgttataacaaaaggacctgctttgcctaaagttgagtttccaaacacttatcagtgatggtaaaattattgtattttaaaatgtcagattttaccatatgccaaaaaatacatcctttgcaacaatttttatatatggtgaaaacttttaggtgtcagcttgaacatgtgcaagagaacagtttttccattcttttagggagcacatgagcaagagtatttgaattccaccactctagggaacgctggctgagacacaactctggagcctgggtccccgtcc

SEQ ID NO: 26185 - DNA, 601 bp, Human
gggttacacgaatgagccaccccgcctagccaaactttcaaccataaatatgtattaggattaaaaccagtggggaaatagaatagaaatatgagttcagataaagaaagaacaatgtaaaatttctaatgattaaaaaaaagcttgttcattgtatttcttcaaataaatgatagatcttatcctctatagtatttagagtccactggaatatttaacaagattcaacagatttacggtaagtgctcacttaacaccttaaataactgtgacttgaagtgaaacaacttattaacaaaacatatttttgttttcatcaatgttataacaaaaggacctgctttgcctaaagttgagtttccaaacacttatcagtgatggtaaaattattgtattttaaaatgtcagattttaccatatgccaaaaaatacatcctttgcaacaatttttatatatggtgaaaacttttaggtgtcagcttgaacatgtgcaagagaacagtttttccattcttttagggagcacatgagcaagagtatttgaattccaccactctagggaacgctggctgagacacaactctggagcctgggtccccgt

SEQ ID NO: 26186 - DNA, 601 bp, Human
aagcaagagctgaaatgacgcaggttagactcccagccccgcgctcacctgagggctcgcttcagcccgtctgtcaccgcctccttccttgccttctccaaagataaagccttggacttgaggccctcactaacaccataaccaacatcttcatgatatgaaccatcctgggggcagaaaaggagtttgaactcaaacacgagagcggcaggcgtgccacaactcccctgttcctcaagcagcagggttcaaagccggactctcccacctggcggccttgctacaggggcacgggcagaaggctgggtgagaatccatcgcgagtgctgcttcctagacctgggctgcctggacatgtgcctgtggtcaaggtgtcaagacgatcctcccttcccaacttcccaacacacaaagggcacattagaaactcaccccaaatcctatcagtgtgcatcaccctaaggtaaaaaaaacctctgggatggccgggccgggcgtggtggctcacgctgtaatcccagccctttgggaggtcaagggaggtggatcacttgaggtcaggagttcaagaccagcctggtcaacatggtgaaaccctatc

SEQ ID NO: 26187 - DNA, 601 bp, Human
tctccacgttccctcttcaccttctgccatgattagaagcttcctgaggcctcagcagaagtggatgctggcaccaggcttccagtacagtccacagaatcataagccaatcaaacctcctttatttataaattacccagcctctggtattcctgtatagcaacataaatggactaacacggacatctgcgtgactgtgtaactaagttaactatgctacctgtgcgtagcggaggactgctgaggagcacggagaggagggtgctgtctgtgcactcgcagtaggagtgggaaggcctcyggcacacatgactgagtgcacggagaagagagagtacaggattctaccacttactcccagcaagggaagcctgaaacagaaacattgaaaaaatactaacgaaagtgggaaaacggcagacaggaaccagggcaggggtgagaattaccttccacgctgcttggatttttgaaccatgtggatgtgttacctcttccaaaaaaaatcgaaatctgctctgaagcaagagctgaaatgacgcaggttagactcccagccccgcgctcacctgagggctcgcttcagcccgtctgtcaccgc

SEQ ID NO: 26188 - DNA, 601 bp, Human
ggatgacttgagcccaggagtttgagaccagcctaggcaacaaagggagaccctgtctctccaaaaaaaaaaaaatttttttttaattaactgggggtggtgtcatgtgcctgtgatcccagctactcgggaggctgaggcgggaagatcacttcagcccaggagttcaaggctgcactgagcgatgacggcaccactgcaccccagcctgtgcaacagagcaagaccctgtctcaaaaaatgaaaaacaacaataaaataaataaataagcctgggactccttccttctctctcttgctycctctctctccacgttccctcttcaccttctgccatgattagaagcttcctgaggcctcagcagaagtggatgctggcaccaggcttccagtacagtccacagaatcataagccaatcaaacctcctttatttataaattacccagcctctggtattcctgtatagcaacataaatggactaacacggacatctgcgtgactgtgtaactaagttaactatgctacctgtgcgtagcggaggactgctgaggagcacggagaggagggtgctgtctgtgcactcgcagtaggagtgggaa

SEQ ID NO: 26189 - DNA, 601 bp, Human
caggtagtctttgtccagaatacagtttccaagtgcattcccaaaactcctaagggcaagagaaaaaaaggtgaaacagggttaagaattgttacacatgaatatcagagaatagaattacaacttttgtacaggttgcttctcaggagcagcagaggaagtggaccctaacatgcattccccattgatgtctggtaagcatctagcatgttcctgcactgtgttagtttctgagaatactgcagtgaggacaagacacaagtccctgccctcacagagaagatgagtatgaaaagattayggcgccattcacaaaacccaccagccacctcctgacatggagaacaaactgcagagagtttttcttttttttccccccaaaggctgctccaatttcccagcaggagtaggcaacacacacttggggaccgggggctcaagggcacaacctcccatgaccagagttcttaacttgggatctacggactcccccacagaactcataggtttttctggttcaattcacttcaattctcaaagacacggatatggtttggatgtttatcccctccaaatttcatgttgaaacgtgacctccaat

SEQ ID NO: 26190 - DNA, 601 bp, Human
catgaccagccctgagaaattctgtctctacaaaaaaaatagtaataattgtttaaaaaataaattagctaggtgcactggcacatacctgtagtcccagccacctgagaggctgaggcaggaggatccaggaggatcccttgggcccaggagtgcaaggatgcagtgaattatgatggcactcctgcattccagcctggctgacagagcaagacctcatctttcataaaataaattaaaaaaaaaaaaaaaggaaagaaagtggaagtagttacaagggtctgggaaagggggaaatgcrgagttcttgttttacgggtgcagggtcttagttctgcagatcaatttcacaacaatgggaatacacttaacactactcgaccacacactaaaaatagttaaaatgtgatgtgttttactacaatttaaaaaaagaaaaggccgggtgcggtggctcacgcctgtcatcccaaaactttcggaggccgaggcaggcggattacttgaggtcaggagttcaagaccagcctggccaacaggacgaaaccccatctactaaaaataaaaaaattagctgggcatggtggtggctggcacctgt

SEQ ID NO: 26191 - DNA, 601 bp, Human
tcatgaccagccctgagaaattctgtctctacaaaaaaaatagtaataattgtttaaaaaataaattagctaggtgcactggcacatacctgtagtcccagccacctgagaggctgaggcaggaggatccaggaggatcccttgggcccaggagtgcaaggatgcagtgaattatgatggcactcctgcattccagcctggctgacagagcaagacctcatctttcataaaataaattaaaaaaaaaaaaaaaggaaagaaagtggaagtagttacaagggtctgggaaagggggaaatgsggagttcttgttttacgggtgcagggtcttagttctgcagatcaatttcacaacaatgggaatacacttaacactactcgaccacacactaaaaatagttaaaatgtgatgtgttttactacaatttaaaaaaagaaaaggccgggtgcggtggctcacgcctgtcatcccaaaactttcggaggccgaggcaggcggattacttgaggtcaggagttcaagaccagcctggccaacaggacgaaaccccatctactaaaaataaaaaaattagctgggcatggtggtggctggcacctg

SEQ ID NO: 26192 - DNA, 601 bp, Human
agccacagcgcctaacctaattttttaaaaaagaaaaaaagatcaagaccagcctcagcaacatagcaagaactcacctcttaaaaaaaaaagcccccaaaaaaagttaattagctggctccaggtacagtggcccacgctgcaatcccagcgctttgggaggccgaggcaggaggatcacatgagcccagcagttcatgaccagccctgagaaattctgtctctacaaaaaaaatagtaataattgtttaaaaaataaattagctaggtgcactggcacatacctgtagtcccagccacytgagaggctgaggcaggaggatccaggaggatcccttgggcccaggagtgcaaggatgcagtgaattatgatggcactcctgcattccagcctggctgacagagcaagacctcatctttcataaaataaattaaaaaaaaaaaaaaaggaaagaaagtggaagtagttacaagggtctgggaaagggggaaatgcggagttcttgttttacgggtgcagggtcttagttctgcagatcaatttcacaacaatgggaatacacttaacactactcgaccacacactaaaaatagttaaaat

SEQ ID NO: 26193 - DNA, 601 bp, Human
accaccatgcccagctgatttttgtattttttagtagagacagggtttcaccatgttggccagggtggtctcaaactcctaggctcaagtgatctaaccacctcggcctcccaaagtgctaggattataggcaggagccacagcgcctaacctaattttttaaaaaagaaaaaaagatcaagaccagcctcagcaacatagcaagaactcacctcttaaaaaaaaaagcccccaaaaaaagttaattagctggctccaggtacagtggcccacgctgcaatcccagcgctttgggaggccraggcaggaggatcacatgagcccagcagttcatgaccagccctgagaaattctgtctctacaaaaaaaatagtaataattgtttaaaaaataaattagctaggtgcactggcacatacctgtagtcccagccacctgagaggctgaggcaggaggatccaggaggatcccttgggcccaggagtgcaaggatgcagtgaattatgatggcactcctgcattccagcctggctgacagagcaagacctcatctttcataaaataaattaaaaaaaaaaaaaaaggaaagaaagtggaagta

SEQ ID NO: 26194 - DNA, 601 bp, Human
acctcccaggttcaagcgattctcatgcctcagcctccagaagagctgggattacaggcaggctgaccaccgggattacaggcaggctgaccaccatgcccagctgatttttgtattttttagtagagacagggtttcaccatgttggccagggtggtctcaaactcctaggctcaagtgatctaaccacctcggcctcccaaagtgctaggattataggcaggagccacagcgcctaacctaattttttaaaaaagaaaaaaagatcaagaccagcctcagcaacatagcaagaactcayctcttaaaaaaaaaagcccccaaaaaaagttaattagctggctccaggtacagtggcccacgctgcaatcccagcgctttgggaggccgaggcaggaggatcacatgagcccagcagttcatgaccagccctgagaaattctgtctctacaaaaaaaatagtaataattgtttaaaaaataaattagctaggtgcactggcacatacctgtagtcccagccacctgagaggctgaggcaggaggatccaggaggatcccttgggcccaggagtgcaaggatgcagtgaattatgatggca

SEQ ID NO: 26195 - DNA, 601 bp, Human
ttattattattattttgagacagaatctcactctgtctcccaggctggagtgcagtagtgcaatcttggctcactgcagcctccacctcccaggttcaagcgattctcatgcctcagcctccagaagagctgggattacaggcaggctgaccaccgggattacaggcaggctgaccaccatgcccagctgatttttgtattttttagtagagacagggtttcaccatgttggccagggtggtctcaaactcctaggctcaagtgatctaaccacctcggcctcccaaagtgctaggattayaggcaggagccacagcgcctaacctaattttttaaaaaagaaaaaaagatcaagaccagcctcagcaacatagcaagaactcacctcttaaaaaaaaaagcccccaaaaaaagttaattagctggctccaggtacagtggcccacgctgcaatcccagcgctttgggaggccgaggcaggaggatcacatgagcccagcagttcatgaccagccctgagaaattctgtctctacaaaaaaaatagtaataattgtttaaaaaataaattagctaggtgcactggcacatacctgtagtcc

SEQ ID NO: 26196 - DNA, 601 bp, Human
agctacttgggaggctgagacaggagaattgtttgaacccagaggcagaggttgcagtgaaccaagattgtgccactgcactccagcctgggtaacagagtgagattctgtctcaaaaaagaaaatatggtcaacatcactaatcatcagggggtatgcaaatcataaccccaataaaatatcacgcccattaggttggcttaaaaaaaaaaaaaaaaaaaaaaaaccaaaaactcagaaaataacaagtgctggttaggatttagaaaaatctgaactcatgtgccctgttggtggaatrgtaaaatggggcaactgtatgaaaatcagtgtggcagctcctcgaaaaattaaaaataggattaccatgacccagcaatccccttcagaatatgtctaaaagaattgaaagcaagatctcaaagagagttacacaccctcgttcatagcagcattattcacaatagccaagaggttgaaagcaacccaaatccccatcaccaaatgaatgcataaacaaaatgtggtctatatatacaacagaatattcagccacaaaaagaagggaattctgatacacactactacatggatgaatctt

SEQ ID NO: 26197 - DNA, 601 bp, Human
caggagttcgagaccagcctgaccaacatggtgaaaccccatctctactaaaaatacaaaaattagcccggcatggtggcaggcgcctatagtcccagctacttgggaggctgagacaggagaattgtttgaacccagaggcagaggttgcagtgaaccaagattgtgccactgcactccagcctgggtaacagagtgagattctgtctcaaaaaagaaaatatggtcaacatcactaatcatcagggggtatgcaaatcataaccccaataaaatatcacgcccattaggttggcttaaaaaaaaaaaaaaaaaaaaaaaaccaaaaactcagaaaataacaagtgctggttaggatttagaaaaatctgaactcatgtgccctgttggtggaatggtaaaatggggcaactgtatgaaaatcagtgtggcagctcctcgaaaaattaaaaataggattaccatgacccagcaatccccttcagaatatgtctaaaagaattgaaagcaagatctcaaagagagttacacaccctcgttcatagcagcattattcacaatagccaagaggttgaaagcaacccaaatccccatcaccaaa

SEQ ID NO: 26198 - DNA, 601 bp, Human
gagaatggtgtgaacccaggaggcagagcctgcagtgagctgagatcgcaccgccactgcactccagcctgggcgacagagtgagactccgtctcaaaaaaaaaaaaaagaatgtcaattcaccaagaagatataacaattataaatatttatgcaccaaacaccagaggtcctaaatatatgaagcaaactttgagaggattgtaaggtgaaataaaagcaacacaataatagtaggagacttcactactcaactttcaataatagataaaacaaccaaacaaaagatgaataaggcgayagagtatttgaacaatactataggccaactggacctaacagtcatatacataacattccacccaccaatagcagaaaatacattcttctcaagtacacatggaacattctccaagacagactacatgttaggccacaaaacaagtcctaacaaattcaagattgaaatcatataaagtatcttttcaatcacaatggaatgaaactagaaatcaacagcaaaaagaaaactggaaaatccacaaatcagtagaaattaaacaccacactcttaaagtcaaaggaaatgtaacaagccaac

SEQ ID NO: 26199 - DNA, 601 bp, Human
caaaaaattagctgggtgtggtggcacacacctgtagtcctagctagttgggaggctgaggtagaagaattgcctgaacctgggaggcagagatggcagtgagccgagatcacacaattgcaccccagcctgggcaacaagagcaaaaactctgtctcaaaaaaaaaaaaaattagccgggcatggtagcacgcacctgtagttccagctactcaggaggctgaggcaggagaactgcttgaacccaggaggcaaaggatgcagtgagccaagatcgcaccactgcactctagcctgggcrgcagagcaagactccgtctcaaaaaaaaaaaaaaaattgttataggagacgagagtattatataatgataagaatgtcagccaggtgcagtggctcacacctataatcccagcattttgggaggccgaggtgggcagatcacgaggtcaggatatcgagaccatcctggctaacatggtgaaaccccgtctctactaaaaatacaaaaaattagccgggcgtaggtggcgggcgcctgtagtcccagctactcaggaggctgaggcaggagaatggtgtgaacccaggaggcagagcctg

SEQ ID NO: 26200 - DNA, 601 bp, Human
tgaaaaaaggaaagcaaggcagtgactggaagagggcaaaatggggcttctgggctgctggtaaaggtctgattctctatctgggaggtaaacagctgtgctcacttaggaaatggtggctcatgcctgtaatcccaacacgttgggaggctgaggcaggtggatcacttgaggtcaggagtttgagatcaccctggccaacatggcgaaaccccatttctactaaaagtataaaaattagccgggcatggtggcgggcgcctgtaatcccagttacttgggaggctgaggctggagaatygcttgaacccacgaggcagaggttgcagtgatcacaacattgcactccagcctcggtgacaagagtgaaattccgtctcaacaacaaaaaaagagaaatttggggccaggctcagtggctcacacctgtaatcccagaactttgggaggccaaggcaggtggattgatcacttgagcccaggagtttgagaccagcctggccaacacagcaaaaccccgctctactaaaaaatacgaaacattagttgggtgtggtggtgggcgcctgtagtcccagctactcaggaggctgaggcacga

SEQ ID NO: 26201 - DNA, 601 bp, Human
tatgttctttttcatacttcggtcaattttcttaaaatatgaactgtacaattccacttacagtacaattccatttgtgaactttacatatataaagttcaaaaacaggaaaaaataatccatggaagtcagaatagaagacaggatagtagttacttttgaaaaaaggaaagcaaggcagtgactggaagagggcaaaatggggcttctgggctgctggtaaaggtctgattctctatctgggaggtaaacagctgtgctcacttaggaaatggtggctcatgcctgtaatcccaacackttgggaggctgaggcaggtggatcacttgaggtcaggagtttgagatcaccctggccaacatggcgaaaccccatttctactaaaagtataaaaattagccgggcatggtggcgggcgcctgtaatcccagttacttgggaggctgaggctggagaatcgcttgaacccacgaggcagaggttgcagtgatcacaacattgcactccagcctcggtgacaagagtgaaattccgtctcaacaacaaaaaaagagaaatttggggccaggctcagtggctcacacctgtaatcccagaact

SEQ ID NO: 26202 - DNA, 601 bp, Human
aaaattcatcaagctgagcatggatgatacgtgcactcgtctaacctgtctatatgttctttttcatacttcggtcaattttcttaaaatatgaactgtacaattccacttacagtacaattccatttgtgaactttacatatataaagttcaaaaacaggaaaaaataatccatggaagtcagaatagaagacaggatagtagttacttttgaaaaaaggaaagcaaggcagtgactggaagagggcaaaatggggcttctgggctgctggtaaaggtctgattctctatctgggaggtraacagctgtgctcacttaggaaatggtggctcatgcctgtaatcccaacacgttgggaggctgaggcaggtggatcacttgaggtcaggagtttgagatcaccctggccaacatggcgaaaccccatttctactaaaagtataaaaattagccgggcatggtggcgggcgcctgtaatcccagttacttgggaggctgaggctggagaatcgcttgaacccacgaggcagaggttgcagtgatcacaacattgcactccagcctcggtgacaagagtgaaattccgtctcaacaacaaaa

SEQ ID NO: 26203 - DNA, 601 bp, Human
caccaccgcactccagcctgggcgacagagcaagactgtgtctcaaaaaaaagaaacgagctttgaaaaatatgaaagactggcgataccaagtgctgtcaaagatacagaacaattggaacttacgcaatgccacgtggggtgtgaattaatacaaccatacaggaaaacgggaagaacctactaaaactaaacacgtacctatcttctcccccaataattcccaacaaaaatgagtgcaactgtacagcaaaagaatgctaacagcatctctaatcgaaacagccacaagctacaaaawccaaaatgtctactaagaaaagactagaaaaataaattgccacatactcatgcaaaagaaaattatacagcaatgaaactgctgctcgtaccatgaatgaatctcacaaccatgctgaattcaagtaagatacaaagagttcaaactgtaggattccaaaaaagtacataacaataaaaacaaattggtggctttctttgttttttgttttgttttttgagagagggtctcgctctgtggcccaggctggagtgcagtggcgtaatcacagctcactgcagcctgggcctcctaggctca

SEQ ID NO: 26204 - DNA, 601 bp, Human
acagaaatccagaacatttttacttgggaaaacatctctcaattcataaaactgatgctgatggaataattgtttgaatatgagggattaagatgattacattttgacctgaaaatgaaaattatagtgcagatttcatgtctacattgaaagataaatgagtagtttaaaaagaaatgagctttggccaggcacgttggctcatgcctgtaatcccagcactttggcaagccgaagcagatcacttgagtccaggggttcaagaccagcctggccaaaatggcaaaaatacaaaaatacaaaaaaaaaaaatcgaaggaactcctgagtaacagcctgtctctactaaaaatacaaaaaaaaaaaaaaaaaattagctgggcatggtggcacacaccaacaatcccagctactcgggaggctgaggcaggagaatcacttaaacctgggaggcagaggttgcagtgggcggagatcgcaccaccgcactccagcctgggcgacagagcaagactgtgtctcaaaaaaaagaaacgagctttgaaaaatatgaaagactggcgataccaagtgctgtcaaagatacagaacaattggaact

SEQ ID NO: 26205 - DNA, 601 bp, Human
cttgttttttttttgttttgtttttgttttgagacagggtctcactctgttgcccaggctggagtgcagtggcacgatcttggttcactgcaacctctgccttctggattcaagcaattctgcctcagcctcccgagtaggggggaccacaggcatgcaccaccacacctggctaatttttatgtatttttaatagagacggggtttcgccatgatggccaggctggtctcaaactcctgacctcacgtgatccgcccaccttggcctcccaaagtgctgggattacggacatgagccacygtgcccggccaaggctttctaatgtagagatggccaaagcattcgaagcaaaaaaaagttctttaccctgaaatttctaattctagaagattttatcaaggcccacttagttccacgggggaaaaaagaaatcattgtctttagaaacgggaaaatgtatagcagatttaaatatctgaatttcctgggctcatctctcctgcgtgtagcttgagagaagtcccagcgaggcctggtttggagccggcccagggttaccgcagagaatcagaagaccctgcggctacacttcctcctgca

SEQ ID NO: 26206 - DNA, 601 bp, Human
aaccatgaagcaagtcctctgtgaatctgcttcacaatttgtagggaaaaactgggcaaaagctcgatgggtctgagacaagccctttctctgtttccactctctgagtaaggactacctaccgctggatgggcaggagagaacaggtggggagacagagaagaaagaaagaaggcatctgtatcactattcccactcaatctggactctgaaataaactaaagttgataaataatctgccaaaagttcccgttattctcaatcccaattttgccttgtattcgaagatatctcagaaacmcaaggcttgttttttttttgttttgtttttgttttgagacagggtctcactctgttgcccaggctggagtgcagtggcacgatcttggttcactgcaacctctgccttctggattcaagcaattctgcctcagcctcccgagtaggggggaccacaggcatgcaccaccacacctggctaatttttatgtatttttaatagagacggggtttcgccatgatggccaggctggtctcaaactcctgacctcacgtgatccgcccaccttggcctcccaaagtgctgggattacggacatga

SEQ ID NO: 26207 - DNA, 601 bp, Human
tgtctgaaaacaaaccaacaaacaaaatcttcagccaaaatctgatgtgtgaaatggattaaaataacaatggctcgggttgtctgccaaggggcaggaaaggcctggagggcagcttcctccacaatctacccgggagcttctgcaatggttaagaagctaaacacctgcaataactcaacagtaaggatatccacaggacaggaagtggttctgttttggtttttatgttaatttcagcctgtcggtgctgaggggcatatgaatgaaccaaccatgaagcaagtcctctgtgaatctkcttcacaatttgtagggaaaaactgggcaaaagctcgatgggtctgagacaagccctttctctgtttccactctctgagtaaggactacctaccgctggatgggcaggagagaacaggtggggagacagagaagaaagaaagaaggcatctgtatcactattcccactcaatctggactctgaaataaactaaagttgataaataatctgccaaaagttcccgttattctcaatcccaattttgccttgtattcgaagatatctcagaaacacaaggcttgttttttttttgttttgttt

SEQ ID NO: 26208 - DNA, 601 bp, Human
agtgctcagctctaactgcagtgggctctcagtcagatcctcttgataaggttcagaatgaagcaagataaatcgcaatgacgttcattctccagcagcgatgaacaatttcatgaccaaaaagtagttttccaaagtccctttgtgacagagtccaattatgtggcctgagcctcagttaagatggatcatatttccttttcttcatgtcctggctcttcctatgagattcccagtttcctatggaagacaaaatggcttaaatgtagctgccataattttaaaataaactgacagctartgatttctggattatattaatgatcctaatttagactaagcccaagaatgagaattactgttaggaggaaggcagatgattctcctagaccaagtggcctcgtgctcatgacagacctgctgctgggagggacagctctccatgcagtcgtttccgcttcctgctattatcaggagctgaaaagggctgcacctgaagtcaggagcccaaaggaaacgttctggctcttaaatcaattctgttctacttgcagtaccattccctaatagaagttcccgattctatcaaactttaaatgaa

SEQ ID NO: 26209 - DNA, 601 bp, Human
agacgttatgcaaaacaactgaatgtagacaattgctgaggcaggtgcttaggaccaagtctggcctatattgcttgagggcaaggagccattggtgattcctaaaatgtccatcttcattaacataatagttcagtaataaatagtgggaagcctcacaagccgaagaaaaggtattcatctgtccagagcctctccctactagagtgatggacaagcttttcaaaagtgctcagctctaactgcagtgggctctcagtcagatcctcttgataaggttcagaatgaagcaagataaatygcaatgacgttcattctccagcagcgatgaacaatttcatgaccaaaaagtagttttccaaagtccctttgtgacagagtccaattatgtggcctgagcctcagttaagatggatcatatttccttttcttcatgtcctggctcttcctatgagattcccagtttcctatggaagacaaaatggcttaaatgtagctgccataattttaaaataaactgacagctaatgatttctggattatattaatgatcctaatttagactaagcccaagaatgagaattactgttaggaggaaggc

SEQ ID NO: 26210 - DNA, 601 bp, Human
acaaagtagtgaaaagcactgctccaacctttttcctgtcgtgatccacagtgcttaatgtgggcaacattaaaggcatggaccgtaaaggaaagaaggcagacgttatgcaaaacaactgaatgtagacaattgctgaggcaggtgcttaggaccaagtctggcctatattgcttgagggcaaggagccattggtgattcctaaaatgtccatcttcattaacataatagttcagtaataaatagtgggaagcctcacaagccgaagaaaaggtattcatctgtccagagcctctccctrctagagtgatggacaagcttttcaaaagtgctcagctctaactgcagtgggctctcagtcagatcctcttgataaggttcagaatgaagcaagataaatcgcaatgacgttcattctccagcagcgatgaacaatttcatgaccaaaaagtagttttccaaagtccctttgtgacagagtccaattatgtggcctgagcctcagttaagatggatcatatttccttttcttcatgtcctggctcttcctatgagattcccagtttcctatggaagacaaaatggcttaaatgtagctgcc

SEQ ID NO: 26211 - DNA, 601 bp, Human
tgcttctgttttcatttgcatccctgcctggcatttcatgggggcacctctggctctggagcacaggaggctctgctcaccctgcccacaggaaggggtcccagaggaagggtcctgtccccctgccctctctggccgcctctgagctacgctaaggaggaagtcgtgcaacacaaggagctgagaggcagctgggagagcagctttattatcatggctggggatagaacgggttcctctccctgggggctggggtcttccactggttaccacccgcagcggtcctggaggcaccacgcakctctagacaaaaggggaaacaggtttgggggtgagggaggttgcttcagccccagtcccagctttcctcccaggcttctgacctgtcccctcccaggctcccaaagcccagcccagcccctcagcattcccagggctggcctcatccagacggtgctctcagccccctggtgcctaccagtgctggcttagctgcggggcagggccttggagaaggcgaactgtccagggaagtagaagctgtgggggtcctcaccagcccgctgcaccctgaggcactgggtctcctggtgctcctcag

SEQ ID NO: 26212 - DNA, 601 bp, Human
gggccggaggccgaatacttttgggaggacctaaacacgtgggagggtccggacgggtgggagcggcgggaggcctaatcctcccggcgcgggggctgccgcgggccaccagccagccccagtcgctaggaatgggggtctcgcgccgcccagcccttggctttcccgcttcaggcaaaatcttccctccttcctcttttttctggggccttccccacgacccctcttcctagcccttctgatccgtcccctgatgcatgactggggccaccggaggggctgaccctcccggagagccccrtcggtcctggtggtcttgggaccggagagcgacagatgtggaaaccgaggcccctcagtgaagagctgccagggtggtcgccttagagcaaaggcgttcctcattccgcctgcgcagctgcccctccgcccggctgccgccccagcccgcttcccctcctcacgtccttccctgcgcctggaggtctcccctgaccgtcccgcagctgaaatcttggcctcgctgtccgcctcttcccgctcttcttctcgcggggcggcccccacctcctcccacccccacctcctggaccccctccag

SEQ ID NO: 26213 - DNA, 601 bp, Human
gagatcagaagaccggtcagcaggcgaacgtgcccctaaaggcccgagttctcagagcagggcagtgattaactttccggtttctcctccgccaatgtgtgggcgaaaggaagtgatccgctacagaccggcctcgccctgcagcaggaaagggaaggatgaaacaaaaagcgcacacccttgacccttcaaagctgtaacagtagttatcccagagcctctccccaccgagaagcccagtctaactctccggtgtttgactgtccggtgtccgactgtcctgtgtccgactctccgatckccgactctcggatctccgacaccaaagcacccaggcctcgagcagatctttccgctactcgggagtaaaatcttcccgccagccagctgagagcatccacccttccgggtcggtccgttcagccaatcacagataactcccttctctaattggtcaaggggtgtggtcaccatgagcgtcaccgaacaacattacgagttattggttgagattggaagcaggtttcgccaataggaagcgctcttaaagcggcagtgagggtggctgcgtgtttccggaagacgtggcggctctcgcctg

SEQ ID NO: 26214 - DNA, 601 bp, Human
caaatggcagctgctaataaacaggctttggtggccaatcctcctgcatggaaaagaatggggagatcagaagaccggtcagcaggcgaacgtgcccctaaaggcccgagttctcagagcagggcagtgattaactttccggtttctcctccgccaatgtgtgggcgaaaggaagtgatccgctacagaccggcctcgccctgcagcaggaaagggaaggatgaaacaaaaagcgcacacccttgacccttcaaagctgtaacagtagttatcccagagcctctccccaccgagaagcccrgtctaactctccggtgtttgactgtccggtgtccgactgtcctgtgtccgactctccgatctccgactctcggatctccgacaccaaagcacccaggcctcgagcagatctttccgctactcgggagtaaaatcttcccgccagccagctgagagcatccacccttccgggtcggtccgttcagccaatcacagataactcccttctctaattggtcaaggggtgtggtcaccatgagcgtcaccgaacaacattacgagttattggttgagattggaagcaggtttcgccaataggaag

SEQ ID NO: 26215 - DNA, 601 bp, Human
ggcaaagtttgtaatgtgtattttacttcaataaaaaagctgaaaaaaatcatttctataatcagaatttttaaaacaaactttttcaaatatcatacaaacagaaatagaacagaaggaagaagaaaatgtaatcattgctactaacctgaaacggacgccattctttttctttccaaatttgtttctaaaataatccaaatttctttctaaaaataaaagcacaacagtgacaacaagtttttaaaaatagtactattaatgatgttcactcaacagtaatctgtcattcctaagcacrgaaaatgttagaaagtaaattatatattgcagtgacctttcaaataagaaccacatggttcttttgacactaattttttatggaaaactctatatttcagcttaataacccacaacactcagaacgactaactctctagatttcagagaagtgtccaaagtcacataaacgtatacatgacaaatacagtagcaatgacactcagcaaacatccacaagatacaaagtgatgtaacaaaaaacagcaaacattcaacaggtctagcaccaattgctatgtgactaaattactatgttagg

SEQ ID NO: 26216 - DNA, 601 bp, Human
catccaggaattcacggaattcctactgattgtcatcgtattccccaccaaattacttctgaccaaagaactcatttacagcaaacaaagcacaacagaaggctaatgttcaagatattaactggtctaactatgttcaccaacaacctgcagcagctagcctgagaaaataatggagtggcattttgcagactcaattatgctgccagctgggtatcagcactttaagggctggactagtagcctccaggatatggcatgctatacatcagtgaatagtgctgtttctcccattgccacrattcacgggaatcagcggtggaaatgggagtggctcttctattacccttagtgatccgctagtgaaatttttgcttcccatccttgaaacatcggactcttgctggcctagaggtcttggttaccaagaaagaaatgcttgtaccaggggaaaaagcaatagttccattaaactggaagttgactgccacttggccactttgggttcctcatgccaacaaatgaacaggcaaagaaggcgattactatacttgctggggtaagtgatcctgactattaaggggaaatcagatagctacta

SEQ ID NO: 26217 - DNA, 601 bp, Human
tgaatggtcagagtgtgaaggtatttgtgtcccatgtgaatgctcattaaaaacaacttccacaaagtataatcataattaatcaggtagacaagatgacctggacattgaccacacttgtccttgcacaacgaagtcaagaacaaagtgccttctgcaacatggactgccactcacgaagacccatctggctacatccagagctaagtgctcaacctgcaaacagctcataccaaccttgagttccaatggaggcaccattctctgtggggacagacagatgcttgatggcaaagtgacygcattggaaccgtctataatgaaagaggcagcactttgttctcactgatacagatgcttactccggatatgaatttaccatacctgcctgcagtgctctatcatgtccaccatccaggaattcacggaattcctactgattgtcatcgtattccccaccaaattacttctgaccaaagaactcatttacagcaaacaaagcacaacagaaggctaatgttcaagatattaactggtctaactatgttcaccaacaacctgcagcagctagcctgagaaaataatggagtggcattttgca

SEQ ID NO: 26218 - DNA, 601 bp, Human
cctggcatctggcttcagctattgatctgctgaatgttttattctccatacccatgtacctgttattatagcataggggaatagtatagcacagtaaaagcagtttgctgagccagcaatgtatctttattctcccacctcagagctatatctactctctagccctaatctaggctgcagggatcctgattcccttttcattccaccagacattacactagctctctgcattgatgatatcatgcttgtctgacctgctgagcaagaagcagcagtagcagctactatagacaaactgctmagagagacacttgccagaggatagaagataaatcccataaaaattcagaggcctgacaccttggtgagagtcaaagggtatggggcatgttgagatatctcttctaaagtgaaggataagtttctatatctggcccctcctattactaagagagcagcacagagcctaatggactacttggatttgggaggcaacatacacctaatttaccaagtaaccccaaaacttgccggttttgagtaggacctcgaacaagaggtaacgccatgatacaatcttctcttaccattgagccatatg

SEQ ID NO: 26219 - DNA, 601 bp, Human
tcagaatgtatactgagaacagatatattcagcaagtggcagaatccacccattggtctcctggcaaagtaactaaggattattattataggaaagatcaaacggaagccagcaaaactgcctttaccaaccaatacagcaaactaaaaatattactgcattcctggagggattgcagagattactgcctacatcaacggcatgaaagatatgagggtaatgatgacttccatgtcgcattcaactcacctatgtggtgtatgcagaagacaatggattctggagattgagaatggattaygccaaaattaataaggctgtggctccaacagcagccatggttccagctgtaatttcattaataagacagaacacatgccctggcatctggcttcagctattgatctgctgaatgttttattctccatacccatgtacctgttattatagcataggggaatagtatagcacagtaaaagcagtttgctgagccagcaatgtatctttattctcccacctcagagctatatctactctctagccctaatctaggctgcagggatcctgattcccttttcattccaccagacattacactagc

SEQ ID NO: 26220 - DNA, 601 bp, Human
gactcgacttaagtgaggtgatcaatgcagctttggtttccagagatttaaaaggtagaaatgaagcagtagacatattttctgtatttaagaaagtcagtgtaagggcagggttggtgatctcattggcatggggcagcagcaggttcaagtccagcggctgctagtgatatacagtgggccttctaatctgctgtgtggttatttcctcagtttcagaatgtatactgagaacagatatattcagcaagtggcagaatccacccattggtctcctggcaaagtaactaaggattattawtataggaaagatcaaacggaagccagcaaaactgcctttaccaaccaatacagcaaactaaaaatattactgcattcctggagggattgcagagattactgcctacatcaacggcatgaaagatatgagggtaatgatgacttccatgtcgcattcaactcacctatgtggtgtatgcagaagacaatggattctggagattgagaatggattatgccaaaattaataaggctgtggctccaacagcagccatggttccagctgtaatttcattaataagacagaacacatgccctggca

SEQ ID NO: 26221 - DNA, 601 bp, Human
caccaggaagtttattagggtaactgtgcattagaaaaaaagagaaatcggccgggcacggtggctcacgcctgtaatcccagcactttgggaggccgaggcgggtggatcacgagatcaggagatcgagaccatcctggctaacatggtgaaaccccgtctctactaaaaatacaaaaaattagccaggcgtggtggcgggcgcctgtagtcctagctacttgggaggctgaggcaggagaatggtgtgaacccgggagcggagcttggagtgagctgagatcacaccactgtactccascctgggtgacagagtgagactccgtccaaaaaaaaaagaaagaaaaagagaaatcacttctcagaaactactggacattagctctgaactgatgctaattcttagaaaaccaaaatgccatggtgatccaccagtcagagtatagactcgacttaagtgaggtgatcaatgcagctttggtttccagagatttaaaaggtagaaatgaagcagtagacatattttctgtatttaagaaagtcagtgtaagggcagggttggtgatctcattggcatggggcagcagcaggttcaagtcca

SEQ ID NO: 26222 - DNA, 601 bp, Human
acctggcctcaaagatgaatgtcagaaaattgggatggaataaaacaggtatagagtccagtgaggctggagctctggaatttcctgggtatgctctaaaggaaggtattcagaggcttagagagagagcagtgccagagtggaagatcaaatagattgataatccactcccttgctgtcccccaggagaatccagaggacacttctttcaccaagactgtgaaaaatacagtcatgagcagagcgccagcatcagcggagctcttcagggatgctggggctcccctggctgttctctgtragctaggaatgacagtgggaaatatcatcttccaagtagaccacctgattcaacgacaatgatggattccaaggtatgggggctaaccattggcaattgaatttatgacgaaaaataaagtagatgtggttgccatgaagggcaacagagctgaggcagcaatcagaatggtctgaccgacaagatcttggattgactagttgactgtgaagtccctgaaacggaaatagattacttgatttgtaacacgcagaatagaaagctctgattctggtaaacagaaccagaaacacaacagag

SEQ ID NO: 26223 - DNA, 601 bp, Human
gcaggtgtgtcacacagtgggagatagagtaagaaagagaagaggcagtgccaggctccttgaaacaaccagctctcatgtgaactaacagagcaagaactcagtcattaccatagggagggcaccaaaccattcatgagggatcctgctccatgacccaaacacctcccactaggcccacctccaacactggaggtcacatttcaacatgagattaggaggagacacatatccaaactacatcagaaacctagagaatgtatatgggaatagatcataaaggtactgaaacagggtttayggaatacaatgtcgaattaagctaagtttattgatacgggctcactaagaaattctggatttaatgtcctagatagtggccaggagtggctctagtaatttgcttggctcattgcctgaaacctggcctcaaagatgaatgtcagaaaattgggatggaataaaacaggtatagagtccagtgaggctggagctctggaatttcctgggtatgctctaaaggaaggtattcagaggcttagagagagagcagtgccagagtggaagatcaaatagattgataatccactcccttgctgtc

SEQ ID NO: 26224 - DNA, 601 bp, Human
atcctgcagatggctgaatttcaatacaaactgaattcccaaccttgcagggacttttatgataaagtcagcacactgactgggaaggagactgaaatttggaggggaacataagggcagattccaacgaagcaggttaccttaaaccactaaattatgccaagtctcttctaccctgcctcccctttctgaaacaatgtcctcctaactgaagtccccacaatggtccttgttgccttgtatgggactgctaagcctcctaagaatcagcctctaccatctttcagtgctttaagatccrgaagtcctagaggataaaacacaaagatgtaacctgtcaaaagacatgatatgcaccaaaagagctgcatgtgccaaaatatatcaatagaaactgtgttcatccattttgcattgatataaaggcgtatccgaggctgggtaatttataaaagaaaagaagtttattttgcttatggttctgtaggctatacaaggagcatagcgctggcatctgcttcttgtgaggaccccaggaagcttccaatcatgacagaaggcaaaggggggcaggtgtgtcacacagtgggagatagagtaa

SEQ ID NO: 26225 - DNA, 601 bp, Human
ctgtgggtgacaaagtgtttgctgttacaaatgttttggtgagaataatggggttgactggttgcttctaagtgtgcaaagaactcaggggaaaaatgtaggatctgcattaagggacctcaaagtttctatgattgtccttaaaaaaaaaccttatcctctataggtacagggccaatattttggaaaaatagctgtaagtctaaatcctgcagatggctgaatttcaatacaaactgaattcccaaccttgcagggacttttatgataaagtcagcacactgactgggaaggagactgmaatttggaggggaacataagggcagattccaacgaagcaggttaccttaaaccactaaattatgccaagtctcttctaccctgcctcccctttctgaaacaatgtcctcctaactgaagtccccacaatggtccttgttgccttgtatgggactgctaagcctcctaagaatcagcctctaccatctttcagtgctttaagatccagaagtcctagaggataaaacacaaagatgtaacctgtcaaaagacatgatatgcaccaaaagagctgcatgtgccaaaatatatcaatagaaac

SEQ ID NO: 26226 - DNA, 601 bp, Human
caaattctcaggtgattcttatgtacactaaagtctgagaaagtgctactctacactatgagttctgtgaaaactaagaccacgcccattttgctcactactgtgtctcccagtgcctagcaccatggcagacactcagtaaagatctgggactagaattcaggtctactgattcttcttccagagctgcttctcctacaacatttttgggtttttttgccccttgtatcttctgttcaagtgttctatagcactgtagggtgaatatggttaacaataatttagatagggtttcgaaaarctagaagagaggattttgaatgttcagtacaatatgtttttaaatttatgtttcaggaaccagataaaaggattaatctcagaagtttttaaaactcctcctttagggagagaggagggcaagggctgaaaaactacctagcaggtactatgtttactacttggacgatggatcattagaagtccaaatctcagcatcacacaatatacccatgtaacaaacctgcacatatacccctgaatctaaaataaaaaataaataaaattcctcctttaagtgaaactttaaatttctattaat

SEQ ID NO: 26227 - DNA, 601 bp, Human
cttcttatgctgctctgaaattcattccaatggcttcagtggccatctccacactaacaacccccaactcagacctctaacaccaggctttagacacaaacatcctcctactcataggacaattccacctggatgtcttaaaggcatcgtaaattcaacatgtcccaaataaattcatcatctttcccctctccattcccaagagttctttcgccaatgtaccccatttcagtgaagaacctcaccatttgtccaagcctaaaatttgagtatcattcttgactcttctttctcctttccycccaagcaataaataccaagtcccattgaatctatcttccagatgtatctggaattcatctaactgctagaattatccttctaaaccatgaaataatgagtctcttacctgtgtaaaactcttcaatggcttcttgctaaaataaggaaaagttttaaaaataagactctttccacatgtcttaccactgactgccacatagaaattcctccaggttactgaatacatcataatgtgaatgttctctcttgcttttggatctcaagtattgcttttctgaatgaacactcttccttccct

SEQ ID NO: 26228 - DNA, 601 bp, Human
aacaaggtaagtagaagccaaataaacaaacatacaactaaacagaactctatccttataaaaataaagacagatttttatcatttcaaatgtttaatttgctatcgttttaaataatcactattggtaatttcagtaagacaacatatatcagttcaaacactaaacagtttcatcagggaaaaatcactataaagctttccaaaaaaaccagatttttaattatacagtagtgtgtataattaaacatgatagttgcataagcattcttttactttttgtacgagattcatttatgctragtagaaatcagtgaacagtttactgtctgaatgaagttatagtaatatgcccccttccttataattgaaactgtttaaagtacaaaagctattctacagttaaaattatatatggctttacgtttctgtagtttgtttcttaaaacaacctttggcaaagagcagacatgtttaaaaaacataatcaaattaagaccttattagggatttttcccagtcaattattctctctcctattattttcacttttccttactagcacctactcattacatttaaacatggtcaagtccctctca

SEQ ID NO: 26229 - DNA, 601 bp, Human
aaaaaaaagaaaaagaaagaaaagaaaagaaagagagaaagaaagaacaccacaaggacgcaatcaggaaaatgtagaaagatacaggacagttaacccagtttcttcaacaaagaatttgcatgggaaatataaaagatataaagagaacctatgggtatatcaaccaaatacaatacaatgcatgaatattatctgggctatattttttttaaaaaaaaacataaaaatgagatagaaatctgaattttttttataattctaaagaattgattaaacttcttagatgtgatgatggcayagcacttttctttaaagttagagatacgtactgaagaatttacaattaaaatatgatgtctggaatttgttctgaataaataaactaagaggaaaggggtagggaaaactggaggtatacagattaaaaaaaaagattagccgtatgttgataactgttgaagggggaaatggctacatggcagtttttatgctattctctctccttttgaagatttcagtaatatgctttttaaaaaagaatagctgggaaatgctttattctacagatgagggtaagacagtccattcctaaatacaa

SEQ ID NO: 26230 - DNA, 601 bp, Human
tagaaggcagttttctccacagattgattttgttggaggaaggagcagttataatagaatgacatggagtttaaataaaacaaaaatatatgggtaaactaaaggaaccagggcttcttagaggtatggctgactctaggtctgggcaggaaatgcataaaatgaacatggattatcttactgcaaaagaaagcaaggaacagaagcaatggggttaagagaaaggattcaggaaccaacttaaagaggctctcactgcccaaggacaggactatttcagcattacatatatacatattgttatatatatatatatgattccaaaggtgaatcatattatacgtcaaagcttgtaagtttatagtgatacttggggaaagaaaaccttaaaaatcttgttgaccacctttggagaatgctagaaaaccaactctttctgaaaactcataaagaaagggaaaaaaaaatcaagcattttcatcatgcagagttaatgaggaaaaagtttatttttgtagaaaaagtataactaatacatgaagaaagagtgacagaattagatatcaccattttgcacctccctaatgaaatcatggctctc

SEQ ID NO: 26231 - DNA, 601 bp, Human
acattattagaaggcagttttctccacagattgattttgttggaggaaggagcagttataatagaatgacatggagtttaaataaaacaaaaatatatgggtaaactaaaggaaccagggcttcttagaggtatggctgactctaggtctgggcaggaaatgcataaaatgaacatggattatcttactgcaaaagaaagcaaggaacagaagcaatggggttaagagaaaggattcaggaaccaacttaaagaggctctcactgcccaaggacaggactatttcagcattacatatatayatattgatatatatatatatatgattccaaaggtgaatcatattatacgtcaaagcttgtaagtttatagtgatacttggggaaagaaaaccttaaaaatcttgttgaccacctttggagaatgctagaaaaccaactctttctgaaaactcataaagaaagggaaaaaaaaatcaagcattttcatcatgcagagttaatgaggaaaaagtttatttttgtagaaaaagtataactaatacatgaagaaagagtgacagaattagatatcaccattttgcacctccctaatgaaatcat

SEQ ID NO: 26232 - DNA, 601 bp, Human
caaaatttattatttattaacttctcaaatgataccatcaaatcttttaatctctttatttaaatataaagaccatggggtttcacaaagtatcactcattaaattaagataataataataaatcttaaaaggtaacagttattagattcttagtactcatacaattctatacaatacttagcatattagatgtcattttttttccttctaatctaaagaggaccaaaaaagtataaaaacatgccagtgaatgagatagaaagagacagtcaaactactttcatcatcccagcaaagaakcagtttgttaactcctagatatattctaggatacagatgttctttttttctctctccaactttcaagagtagggatatatcatgaacttgtaattatctgcaactttctaaattactttctattactattatgttctttttcaattttaagaaagtacattattagaaggcagttttctccacagattgattttgttggaggaaggagcagttataatagaatgacatggagtttaaataaaacaaaaatatatgggtaaactaaaggaaccagggcttcttagaggtatggctgactct

SEQ ID NO: 26233 - DNA, 601 bp, Human
attcaatgagttcagaatgggttaaaggtgaaaaatggagatggtaagctgagaagtctgatggtgacagaaagaacagaaagaggacagtaacattaaaaggtcagaagggtgttttagtttctgtttttagggagaggacaaaagagcctgaaggtgaaggagtgaggaatttggcagtgcaagatcttaagaaggcaggaaaggatgaaacgggagtggtcatggttagccttataaagcagtggtcttttctgccttaacaaaagaaaaaaaaaaaaagattactaatgtttgaaartagaaagaggagctgttcatacctgatggcatctattttctgtgaagcagaaagcatctgctaagtacaagttagggcctgaatagaaagttaatgataggagacatttgttggaagaaatgtataaaggagttgaaatagggacaagtataaggacggctgaggataatgaaaagctgaatggagttatgcaatttttgtttttttgacaatgtttagtagccaagcagcaggaatggggaaagccaaagtctagatgaatccagcatctcaggcacaacgcctgaagcagactggcag

SEQ ID NO: 26234 - DNA, 601 bp, Human
ataattctgtaggtagagaatgcagtcttcgggctacaagctcactatccctggagaaacgtaagaaagggtaaagactgaggtcagaaccctagggaacactaatatttaaaaagaagacaggaagagcgaaggaggtgagaatggaagggaagacactgaacagcactgctgtacagtaaccaagggagtagaatgtggcaaggtgagaggtgaatatataaaatgttactgaagtgaagtgggaagaggaatgaagatgagaccacttgatgaagtggtctcatctgggggtgggtcwccgatgacctgtttcagtagtatggtggtggcagaagcatgattcaatgagttcagaatgggttaaaggtgaaaaatggagatggtaagctgagaagtctgatggtgacagaaagaacagaaagaggacagtaacattaaaaggtcagaagggtgttttagtttctgtttttagggagaggacaaaagagcctgaaggtgaaggagtgaggaatttggcagtgcaagatcttaagaaggcaggaaaggatgaaacgggagtggtcatggttagccttataaagcagtggtcttttctgcc

SEQ ID NO: 26235 - DNA, 601 bp, Human
tgattgccctttgtatctcccattaatgagctttacaatatcctcaataaaatcttcagtgtttgagggcttctgccgaacctaaaaaaaacttaacttattaaaaagtaaatgaatgagtaccatccaagtggctgtctacgtacaactttcaggatgcagttctttcatgaccatagtgttttttttcctattactctttcacttactcacaggattcaacccatctgactcatctgttcctcctcccagactcttcttgatctttatttttttaatttaccagagaagagcaagcacrtgagcagtgaataacttgcaaggatgcagacttttttattttgcgatgctacttttataaaaacaaaccgtaacataaataactctttaatgaaaactcagaaaaatattaaatctattcttaaaagggtttagaaagaaagaaaagacagctgttaggttatttgattttcaagtttatcaaataaaattcaaatagaattggcaaatctttaatggcatatgaatacttctatcacttagtaattaatttgaacagagatgttattagggtccttagtatcactccatcctttctctc

SEQ ID NO: 26236 - DNA, 601 bp, Human
gaagttaatttgtaatgggtaccctcaaattaaaaaaaactctaaagagacatcaataatcagctctactaagttaaaaaatgtgtctataatccagttaagttatagatttgaaatcactaattaaaaattcaggaggcaaagatgaacatcaaattatcttaacacacataaaaagaaacaattcagataacagaacataagtaaaaatttctccatatgcaagtaagtgtcaaactgctaaaaatacattgttctaaaaatactatccaataaagataaaacatacagacttattaarcatttatcatgtattttttggaaaagctttctaaaaatttacttctggatttgagtcctacatacctgcacgtccactctcttggtaataattttccatggatttactcattgaatgatggataacaaacctcacatctggcttatcaattcccataccaaatgcaacagttgccactactacctgaaatattttaacattttatcagttaattaaatcaagtttaaatattttaaaggtaaattaggcttctatggaagatatagacctaacctgaatttcattggctgaccattttct

SEQ ID NO: 26237 - DNA, 601 bp, Human
aaattttagagatgtggaagttaatttgtaatgggtaccctcaaattaaaaaaaactctaaagagacatcaataatcagctctactaagttaaaaaatgtgtctataatccagttaagttatagatttgaaatcactaattaaaaattcaggaggcaaagatgaacatcaaattatcttaacacacataaaaagaaacaattcagataacagaacataagtaaaaatttctccatatgcaagtaagtgtcaaactgctaaaaatacattgttctaaaaatactatccaataaagataaaayatacagacttattaagcatttatcatgtattttttggaaaagctttctaaaaatttacttctggatttgagtcctacatacctgcacgtccactctcttggtaataattttccatggatttactcattgaatgatggataacaaacctcacatctggcttatcaattcccataccaaatgcaacagttgccactactacctgaaatattttaacattttatcagttaattaaatcaagtttaaatattttaaaggtaaattaggcttctatggaagatatagacctaacctgaatttcat

SEQ ID NO: 26238 - DNA, 601 bp, Human
tatcttaaccatagaccttttcaaaattattaaatcatgtaactgtacagcagtgccagagaaaaaaagccttcaagttgctatcaatgtgtctcaaaaaccttcaattaaacaagtagttttggaggattatctcaaagatagggcatcttttcttgaactaaggcagatcatacaggttgatgtgctggttcctaccctccaacatctgcttttatggatctgcactttggtgttccaccaatgtatttagtaagaacttaaaaacgatgtcatatactttcatatttgctttaattgrtaaaagttataaaaaggtatgtggcttacttgcttatgttttgacagtatgataccatctcataaagcttctgctgtcccacattttccatcaccaccattgaacttattctgaatatatctccaaagccgtagtacaaaatacagtctgctttcatgtcatctcgacctgtggtgtgagaaaccttgagattgcagaattacatttacaaattcaaaatatgcaaaaatgacatatggtaaaattagcaggcaatgttttatactacatctagaaattttagagatgtggaagttaatt

SEQ ID NO: 26239 - DNA, 601 bp, Human
ggagaaacttggtatttcattgacacatgagctggcaaggtggcacgttactgagcttgactctcaaaatgcctatcttaaccatagaccttttcaaaattattaaatcatgtaactgtacagcagtgccagagaaaaaaagccttcaagttgctatcaatgtgtctcaaaaaccttcaattaaacaagtagttttggaggattatctcaaagatagggcatcttttcttgaactaaggcagatcatacaggttgatgtgctggttcctaccctccaacatctgcttttatggatctgcastttggtgttccaccaatgtatttagtaagaacttaaaaacgatgtcatatactttcatatttgctttaattgataaaagttataaaaaggtatgtggcttacttgcttatgttttgacagtatgataccatctcataaagcttctgctgtcccacattttccatcaccaccattgaacttattctgaatatatctccaaagccgtagtacaaaatacagtctgctttcatgtcatctcgacctgtggtgtgagaaaccttgagattgcagaattacatttacaaattcaaaatatgcaaa

SEQ ID NO: 26240 - DNA, 601 bp, Human
aaacactgtttaaaaaattgtctgagttccatttttaaattcaatgttttgcaactattaggagaatattcttgacagtaaaatagtttcttatattttaataaagtagcaatatttgagttgaaaccttaaaatatgcttcatgagactctactggcctttggaagacattttcattttctcatttcttttaactagattattgtagtatctattggaaagaaagaacatttctatcactgtctggctgctatttaccacctcgacatttctgagcacttcttatgtgataggcaataaragcacaaagataactatgacagaaagctttcaggaagctatctagtctaaagccaccctaagtagatttaaacttacttcttaaggagaaacttggtatttcattgacacatgagctggcaaggtggcacgttactgagcttgactctcaaaatgcctatcttaaccatagaccttttcaaaattattaaatcatgtaactgtacagcagtgccagagaaaaaaagccttcaagttgctatcaatgtgtctcaaaaaccttcaattaaacaagtagttttggaggattatctcaaagata

SEQ ID NO: 26241 - DNA, 601 bp, Human
tgaggtaacatacaggttaggaattaggacgtgaacatctttggggggccactgtgcccccgacataggacttttttccccacatattcttgataaacactgtttaaaaaattgtctgagttccatttttaaattcaatgttttgcaactattaggagaatattcttgacagtaaaatagtttcttatattttaataaagtagcaatatttgagttgaaaccttaaaatatgcttcatgagactctactggcctttggaagacattttcattttctcatttcttttaactagattattgtwgtatctattggaaagaaagaacatttctatcactgtctggctgctatttaccacctcgacatttctgagcacttcttatgtgataggcaataaaagcacaaagataactatgacagaaagctttcaggaagctatctagtctaaagccaccctaagtagatttaaacttacttcttaaggagaaacttggtatttcattgacacatgagctggcaaggtggcacgttactgagcttgactctcaaaatgcctatcttaaccatagaccttttcaaaattattaaatcatgtaactgtaca

SEQ ID NO: 26242 - DNA, 601 bp, Human
cttacatagttatatactgtattagcttcctataactgccataatattaccataaacttagtggctttaaacacatttattcttacatttctgtggtttagatttagaagtgtactatgggtttcactggatcaaaatcagagtgtcaggttcttctcacatcacacaatctaaaataatctccctattttaaggtcagctaatgaacagtcttaattccatgtgcaatgctactttccttttgccatgtgaggtaacatacaggttaggaattaggacgtgaacatctttggggggccaytgtgcccccgacataggacttttttccccacatattcttgataaacactgtttaaaaaattgtctgagttccatttttaaattcaatgttttgcaactattaggagaatattcttgacagtaaaatagtttcttatattttaataaagtagcaatatttgagttgaaaccttaaaatatgcttcatgagactctactggcctttggaagacattttcattttctcatttcttttaactagattattgtagtatctattggaaagaaagaacatttctatcactgtctggctgctatttac

SEQ ID NO: 26243 - DNA, 601 bp, Human
ctattcagaaaaattcaaatattttccttcatttattaaaaatttcacatcctcagtatagcaatataaaatgtgtgcatacacataagacttttccttttattcacctttgtttcaaaacttcatgttgatagttttaattctggaaaatctgattcacactttaatcttttaaatccatttggaagtctaatacttctctcatgtcccagctgtatatacagttttgtgccacataatattttggtcggtgatggaccacgtatatgccagtggtcccaagagattatataataccatwtatttttttttgagacggagtctcgctgtcacccaggttataataccatatttttactgtacttactctatgtttagatacacaaatacttaaccatgtgttacagctgcctgcagtatgcagtacagtaacacgctgtacagattggtagcctaggatcaataggctataccatataacctaggagactataccatctaggtttatgtaagtacactttgatgtttgcacaatgacaaaatcacctagtgatgcatttctcagaacgtatctctgtcactaggcattatgactgtatta

SEQ ID NO: 26244 - DNA, 601 bp, Human
aacttcctcctccactgagtgctccattttcttctgcaacagctctattgccagaacatgaattcgggcaacctggtgtctgtgctcacccaggccgagggtgcctttgtggcctcactgattaaggagagtggcactgatgacttcaatgtctggattggcctccatgaccccaaaaaggtaggctgcagccttctttatctcctaatgatcaggtttgagaagtaagaaggaggttcaagttctggtctcttaagtaccagcttttatcgctttccagaaatcaggctgtttacagatsctctaatgtcctgtgtagcaaggtgcactgtagatgattggagatataagtggaaggctgaatttcctaggtgttcttgtcattcatgaataaacttattctgttttcagtcaacaaagcatctttatgcaccaacttcttacctattttgttactgtcagagtcacaagagagactagattgccgactatataggaaaggagacttgtggtaaaaatctgctgctgtactgctggcatttgggaacctggtagtatactaaataatataatatatcaacaactaatggtcagccaatgc

SEQ ID NO: 26245 - DNA, 601 bp, Human
tttctgagtgtgcacacaggcccagtgattccatgtatttttgagtgaccactgcctctgttctggcccttccccatctagaaccgccgctggcactggagcagtgggtccctggtctcctacaagtcctggggcattggagccccaagcagtgttaatcctggctactgtgtgagcctgacctcaagcacaggtgagaggcagagaatccatccacctgtttctgttctctcctgcttagctccagggatggaactgggactgggatagaggaaaggtgaactcctcattaaggaaatgratgtttggtttttgtcctgagtcctaaagccaggagggtcatactctttcgggtctcccagttgtaactcttctcattgacttataggattccagaaatggaaggatgtgccttgtgaagacaagttctcctttgtctgcaagttcaaaaactagaggcagctggaaaatacatgtctagaactgatccagcaattacaacggagtcaaaaattaaaccggaccatctctccaactcaactcaacctggacactctcttctctgctgagtttgccttgttaatcttcaatagttttacct

SEQ ID NO: 26246 - DNA, 601 bp, Human
gagtcctaaagccaggagggtcatactctttcgggtctcccagttgtaactcttctcattgacttataggattccagaaatggaaggatgtgccttgtgaagacaagttctcctttgtctgcaagttcaaaaactagaggcagctggaaaatacatgtctagaactgatccagcaattacaacggagtcaaaaattaaaccggaccatctctccaactcaactcaacctggacactctcttctctgctgagtttgccttgttaatcttcaatagttttacctaccccagtctttggaaccytaaataataaaaataaacatgtttccactattgtgctgtcttactgtgtctgctatttccacagctgatgcctgggtggttgagatgagagtgattacaacaaagcttgctctggcctatccacttcttaaaagtccatccgcataccatgcatattggaattcagtatttatgaacatatgtggctttgcttatgacaaggttaacaagatggagattgaccaaaaactcacatgctggcatatctcaaagatttttgcattcagttccagatcactgtaataagggtaatgtcacaga

SEQ ID NO: 26247 - DNA, 601 bp, Human
ttgggcatcattgaaaggattgccttgtggcctcttggaggatcaccaggttatctggactgttttgctgagcaaactctgctctgatagtatgcagtagaccagagaagcaaaactgtactattccctgcatgggagatggggcagaaaggtccagctgcaccatggtccatgagggttcacggcttcccattcatcagtttcatcaagcaaccaaccaactcatgctttatactttctgtgtgtcacatatgtggtgctaggtactgggaacacaggagcaaatcagttgctgccctcrtggagcatagattccggtgggaaacagacaaaacagagaatcagattgtgacaaagttgtagcagagagcaacaaaagaggaatggccagggaaggtctttcagaggaggttacatttaagtaaagactaggggagtgcagaaggctgtgcagacacttgtctgctaggtgtgagtcagtgggaagggaatctcttcctgtactgctcgaccttcattaaaatctgcatttataggacttgcctctaaggatgtttcaaaaattgttggacgataataggtgttccatgaagaagagcag

SEQ ID NO: 26248 - DNA, 601 bp, Human
cctataaaacactgtaactttttagaaaggcaaccatataggacttttaagacttgtcttgaaggatgtgtcaaaagcatgtccagtgctctcaccctgggccaaacccctgtccctcaccagctcctctcatccctgggcagcacattcccatcctccaagggtgggtttgattttggagccaaggtagggaaagaaaatggatgatcgaactgggaaaaacccttttttggtattctgaaaataatgagactaatttttttggtgtagctcagaagcttttgaaccagtctctaaaggratttccagaagactgttgaacaaaggacctcttggaataaattcctaataattttccaaaatgactattctgaaaaaaaaaaaaaaaaaaaaaaacaaacaaacctcagttataattttaaaattctggtatttgtttaaaagtaaggtttcagccttggtacgattatagattacaaaagccaggttcttccttgtttgctggtaaacacatagtaggcaattcaaaatgttggtcaaacagaagagtggatggacagaacgatatggaataaatgaaaataaattatttttctccagc

SEQ ID NO: 26249 - DNA, 601 bp, Human
aacactgtaactttttagaaaggcaaccatataggacttttaagacttgtcttgaaggatgtgtcaaaagcatgtccagtgctctcaccctgggccaaacccctgtccctcaccagctcctctcatccctgggcagcacattcccatcctccaagggtgggtttgattttggagccaaggtagggaaagaaaatggatgatcgaactgggaaaaacccttttttggtattctgaaaataatgagactaatttttttggtgtagctcagaagcttttgaaccagtctctaaagggatttccwgaagactgttgaacaaaggacctcttggaataaattcctaataattttccaaaatgactattctgaaaaaaaaaaaaaaaaaaaaaaacaaacaaacctcagttataattttaaaattctggtatttgtttaaaagtaaggtttcagccttggtacgattatagattacaaaagccaggttcttccttgtttgctggtaaacacatagtaggcaattcaaaatgttggtcaaacagaagagtggatggacagaacgatatggaataaatgaaaataaattatttttctccagctcttggt

SEQ ID NO: 26250 - DNA, 601 bp, Human
gaaggatgtgtcaaaagcatgtccagtgctctcaccctgggccaaacccctgtccctcaccagctcctctcatccctgggcagcacattcccatcctccaagggtgggtttgattttggagccaaggtagggaaagaaaatggatgatcgaactgggaaaaacccttttttggtattctgaaaataatgagactaatttttttggtgtagctcagaagcttttgaaccagtctctaaagggatttccagaagactgttgaacaaaggacctcttggaataaattcctaataattttccaaratgactattctgaaaaaaaaaaaaaaaaaaaaaaacaaacaaacctcagttataattttaaaattctggtatttgtttaaaagtaaggtttcagccttggtacgattatagattacaaaagccaggttcttccttgtttgctggtaaacacatagtaggcaattcaaaatgttggtcaaacagaagagtggatggacagaacgatatggaataaatgaaaataaattatttttctccagctcttggtctttgaggaatcagtggctccgatagcttgttgctcatttctaagaagagcag

SEQ ID NO: 26251 - DNA, 601 bp, Human; identical to SEQ ID NO: 18011

SEQ ID NO: 26252 - DNA, 601 bp, Human
tcattaaagtgcaaaacgtctcggaattgtaattaaccttgcaaacaaactgatgccctttgtgagccagaaatagtgtctgccttttgaactaaattcattaacaattctttaaaataccctagtgattataggtagccctgcccttagttgtaaaactagtagatacggtcagattaatggacgaaactgctcagtacatgaggtttaaatgttaggtggataagacttatttgaagagttcttgctttgccttatgcggtttgtctctagttactgggtgactttatttggtaaaaawgcgttcagctgcagtagcatattcaagtgttgctagttagtaattatctttttaattttttgttttagtttaaaagattggaagacccgtttgagctacttcttacaaaattcctctactcctgggaagcccaaaaccggcaaaaaaagcaaacagcaagctttcatcaagtaagttgagaatcctgtgcttgcaaatatcaatagttagctgctgaactgaaaaggggaactctgatgtgcgtaagctaacatacagaacctctcttgcaggccttctcctgaggaagcacagctgtgg

SEQ ID NO: 26253 - DNA, 601 bp, Human
ttgcaggccttctcctgaggaagcacagctgtggtcagaagcatttgacgagctgctagccagcaaatgtaagttaactcttgagcttgagccattgctaacatcgcaaaagcctggaaaggctgcgtccacctaacaaaagagcagcttgcctgagggggattagactgcagtcactataggataaagcctgtttttctttcctttatttcccagggtttaacaaataaatgcatatattctctccaggtggggaagaaaatcagcctaaacaaattaaagtggcagttgcttatagttmaggttgagtcagtttttccattgcatacaatgttttcaagaggcttagttcccagagaatttatggctcccctataaatatttactttgcattgacagcaaagtacttatatttttgcagcagagtgccaacataagccttttgcctactggtatcttagtctttaaaaagctaaattttgagaattacaggtttgagcgaaatctagaaaattcatttagaaataattaaaatgtgagggataggagaaacataaggaatcatttggtctctcagttcttcacattctgcatgctctct

SEQ ID NO: 26254 - DNA, 601 bp, Human
aaaccaaatcaccccaaaagctgtcctcaaaagcaaggaaaatatatactgacttcatagaaaaggaagctccaaaagaggtaaggaaacaagttcctaatttcagcacaatctggacatctttagcacaaaagtgaaacaaagtaatcaaggacaaagcgggctaggaggggtaaaaagtccctccacgttgtagctttcagttatgttaaagttctcctgtgacttagctagtaaagctaatcacacataatttttattttttgttttcaaatactaaattttaatctttaactctgartaccaaataaacaacttttttgttttatttcagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccat

SEQ ID NO: 26255 - DNA, 601 bp, Human
acctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacwtctttccctaaatcgatccatgttaccacatagtagttttagtttaggattcagtaacagtgaagtgtttactatgtgcaacggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttg

SEQ ID NO: 26256 - DNA, 601 bp, Human
gaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaasggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattgaacacttggagtctagatgtgattttatttttgataactggaaatgtggcagataaagggaaaacatct

SEQ ID NO: 26257 - DNA, 601 bp, Human
ctggcaggaacttgtgtggtaacaaggtagcagttgtgggagacattttctactccgaaaggaagtttcttagcctgacttgaagatttattatctatagacacttagaggctctttctgtggtggtttttattatgaattatctttttgtgtttagctaataccagtgagtggtggagaaagatgggctctttaataatgagctgttcgtttttctttcttagggcactgtttgaagaagcaaacatggtagcatcaagcattccttgaaatatggctccaagggaacaatgagacgtgstcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcac

SEQ ID NO: 26258 - DNA, 601 bp, Human
gtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggayggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacaca

SEQ ID NO: 26259 - DNA, 601 bp, Human
aggggaatttgaaagcaaattggaggcaggagggcatcccgggccgtgctttcgcagctcctcctgcgcctcgtgggaggtgcaggagaagcctgggagagacgccttggcctggcccggcctggctgctgtttcctcagttggcctgtggcctggcttccaggcttcggggctgctttcgtctgctcgcaatgctcagagggcgctgctctcctgcactcccaccttgccaagaccaggtgtgtggcgacacacggcagtattgcccctgcgcagctgctgctgggctagcatcgcccgrgtctttgggacactttaagtatccgtttaaacaatcgtagaggagcccgcgcagtgctgctgcattctggccacacttttatttatttattcaagcaagaggtatttactggggcccgtgagaacacatctgtagagcccgggggtgtcgggccttggcaggcagcaggagtgcggggagaggaagccttgccgggctgctcaggtgcctttcctgtcagctttcctacagggcccgggagattttcagtaagtttctctgcagcaaagccaccaccccggtcaacatcgacagccaggc

SEQ ID NO: 26260 - DNA, 601 bp, Human
tgcattctggccacacttttatttatttattcaagcaagaggtatttactggggcccgtgagaacacatctgtagagcccgggggtgtcgggccttggcaggcagcaggagtgcggggagaggaagccttgccgggctgctcaggtgcctttcctgtcagctttcctacagggcccgggagattttcagtaagtttctctgcagcaaagccaccaccccggtcaacatcgacagccaggcccagctagcagacgacgtcctccgcgcacctcacccagacatgttcaaggagcagcagctscaggtaaccgcaggctgtgggagcttgtggggagtccaggctagggctcggggtatagggtccaccttcaaagaacacgtgctatcaggcaggccagtggatcgagagcatcacagacgcaggtagagaaacgcagacagaaagtggggctttcagtagggtagagaaacgcagacagaaagtggggctttcagtagggccatgaaataagtcccgaaccactgcgtgtctgtctgcaatgagccggctgttcacgctggctcatgtttcgatcctgtgcgtgtgtggaatcacacctgc

SEQ ID NO: 26261 - DNA, 601 bp, Human
ggagcttgtggggagtccaggctagggctcggggtatagggtccaccttcaaagaacacgtgctatcaggcaggccagtggatcgagagcatcacagacgcaggtagagaaacgcagacagaaagtggggctttcagtagggtagagaaacgcagacagaaagtggggctttcagtagggccatgaaataagtcccgaaccactgcgtgtctgtctgcaatgagccggctgttcacgctggctcatgtttcgatcctgtgcgtgtgtggaatcacacctgcctgggggatggcgcatctgygtttgaagttttgcatcgtaggacattgctgtggtcatgggcattaggccccaggctattcgagacgtgcctgtgcatgtcgctgcggcacgtgggtcacgttcacagaagcatagggtggcattttcaaagcagtctactgtaagatttctagtcgcttttggttttaatcttatttaacaaaataaaagttctctggggtctgctcgtgttgatggcttctgtaagttgtcaggattcacttaattttaagagtgataaaggctggttcgttatgagaaagaagactcagatatagag

SEQ ID NO: 26262 - DNA, 601 bp, Human
aggtagagaaacgcagacagaaagtggggctttcagtagggtagagaaacgcagacagaaagtggggctttcagtagggccatgaaataagtcccgaaccactgcgtgtctgtctgcaatgagccggctgttcacgctggctcatgtttcgatcctgtgcgtgtgtggaatcacacctgcctgggggatggcgcatctgcgtttgaagttttgcatcgtaggacattgctgtggtcatgggcattaggccccaggctattcgagacgtgcctgtgcatgtcgctgcggcacgtgggtcacrttcacagaagcatagggtggcattttcaaagcagtctactgtaagatttctagtcgcttttggttttaatcttatttaacaaaataaaagttctctggggtctgctcgtgttgatggcttctgtaagttgtcaggattcacttaattttaagagtgataaaggctggttcgttatgagaaagaagactcagatatagaggcacactggaaataactcttaagtaccctcagggctggcgggggaaaatggactgaaacgatgtcctttcaggacagggccagtggttgcctacaggtcgc

SEQ ID NO: 26263 - DNA, 601 bp, Human
ggccctgttggcgggtcgaggaagcttctctgaatgaataaggaatgccgctgtgtctggggacacgacctgtcagccagccagagggcagcagggctgctccagaatcttccagagaaaagggctcaatacatttcagcccatgcctacctcaggcctaccccacacagtggcggctgaacatctgtgtcctctcctgcttttcactatccaagtaataggtgtttttggtagaaaatttggaaaatacaatcaagtaaaaataggaacacacaaatgtgctattgggtgtctcccccartggcagcttggttctctgccagggctttttcctaggtagatgtcagggtccatgtgccttttacatgtgtgtggttttttaaaatgtagtagcatagttggagtagtgagcatttttcaagttaagattggtatttgatattgggggctgcccattctggatgctctgtcccttttttcttcgcacatctgagacttcctgtaacaaaagttaggcagagagacggctcccagggcgccagggggtggggctgcagggcccttggcggctcctggccgagctccagacaccagccgggtg

SEQ ID NO: 26264 - DNA, 601 bp, Human
cacacagtggcggctgaacatctgtgtcctctcctgcttttcactatccaagtaataggtgtttttggtagaaaatttggaaaatacaatcaagtaaaaataggaacacacaaatgtgctattgggtgtctcccccagtggcagcttggttctctgccagggctttttcctaggtagatgtcagggtccatgtgccttttacatgtgtgtggttttttaaaatgtagtagcatagttggagtagtgagcatttttcaagttaagattggtatttgatattgggggctgcccattctggatrctctgtcccttttttcttcgcacatctgagacttcctgtaacaaaagttaggcagagagacggctcccagggcgccagggggtggggctgcagggcccttggcggctcctggccgagctccagacaccagccgggtggttttggcgggtggcagggcagagggcatggagatgcccatgctgaacgctggcgaagatgaggctgttctgtaccaggtgctgaaaagcacataggggagaactgggaagattttcttctctagagatttttgggaaagggattagttttcaggaatgagtg

SEQ ID NO: 26265 - DNA, 601 bp, Human
ccgggtggttttggcgggtggcagggcagagggcatggagatgcccatgctgaacgctggcgaagatgaggctgttctgtaccaggtgctgaaaagcacataggggagaactgggaagattttcttctctagagatttttgggaaagggattagttttcaggaatgagtgtcctgcctgaaggcaggggactggcacttagcctgtggtctccaagtttaaatcaggcagtgaggtgattgcgatagcaccagctggcatggccctggtggaggcaggtgagcagggtgctctgcgctccrtggctgcggctcctgtgtgtgccctgcagtgccaagcatttgtgcgtggctgctccccgcctgcagggggaagcgttgttcccggggcgctgaaggacgcgctggtgagggcttgacgtgggcagccctgagcttctggccatgctgtgaggtgctcttctccgagcaaaggcagctgagagttgcagagttcacctttgtcggaggccacctgggagatggacactatgttattaggtggggccaggcctcccgagtacctgggagatgggagtgttcgcttcagacagtccatccact

SEQ ID NO: 26266 - DNA, 601 bp, Human
taggggagaactgggaagattttcttctctagagatttttgggaaagggattagttttcaggaatgagtgtcctgcctgaaggcaggggactggcacttagcctgtggtctccaagtttaaatcaggcagtgaggtgattgcgatagcaccagctggcatggccctggtggaggcaggtgagcagggtgctctgcgctccgtggctgcggctcctgtgtgtgccctgcagtgccaagcatttgtgcgtggctgctccccgcctgcagggggaagcgttgttcccggggcgctgaaggacgygctggtgagggcttgacgtgggcagccctgagcttctggccatgctgtgaggtgctcttctccgagcaaaggcagctgagagttgcagagttcacctttgtcggaggccacctgggagatggacactatgttattaggtggggccaggcctcccgagtacctgggagatgggagtgttcgcttcagacagtccatccactcgtgcccatccccatacctggcagatctgcaaagggctttgaaaaccttgatagagccaggcgtgggagctcacgcctgtaatcccagcactttgggagg

SEQ ID NO: 26267 - DNA, 601 bp, Human
gtgccattgaactccagcctgggcaacagagcgagactccgtctcaaaaaaaaaaaaaaaattagctgggtgtgatggtgggtactttcagtcccagttacttgggaggctgaggcatgagaatcgcttgaacccgggaggcagaggttgcagtgagtggagaactacactccagtttgtgtgacagaacaagactgtctcaaaataaataaataaataaataaataaatgaaagcaaaccttgatagcagtggcgcctggtggctcatgcctttaaatcccagcgctttggcggtggggygaggtgtgaggatcgtttgagtctaggagttcaataccagcctgggcaacacagcaagacactcatctctacaaaaaaaaattaaaaattagccaagtgtggtggcgcacctgttgccctagctactggggaggctgaggtgggaagaaaattgcttgggtcctggagttggaggctgcagtgagctatgattgtgccactgtactccagcctgggggacacagcgacgctctgtctctaaaaaacacaaagccaaccaaaaaataaaacccagactgcaggcacccccagaagtaacac

SEQ ID NO: 26268 - DNA, 601 bp, Human
tgcaggcacccccagaagtaacacattctgatcttggcccaggatgtggcctgggcatctgttcctgtggaaggtggctgcagtctgcaggccagtaggtctgggagctgccttcccctctctcctcaggccccagagcccatgtgcagcggtgtggtttgggagcaggtgctgtttgaaaagtcctgtgtccgaattttcatgatttgtaggttagcctaagaatatagttagttgaggttggtgaaaattgacacttcattacggttcatgtcaggacgtcagaggaaaaggacgtggwccgagtgggtctggaggccgcatccggctgagagcgctggctgttgccacagttgggggtttccagttaggcccagaaactacatttggggatgaaagctccagatggaatggaggaaaggcccttaccgggacatgcacctgggtctgtgctgtgtaactgcacgtactgatgtgatttgttgggcacctgccatgagccaagcatgttttggagccaggatgtggcagtagacagggcagagagtagcatctctgctgcatggtgggtagagccttgttggtccctgactggcttcca

SEQ ID NO: 26269 - DNA, 601 bp, Human
agttagctcttgttgcctaatacctccgcacccccaaactcagaggctggaaacaattactgttgtgctgggtgtctgggtcgcctgggtggttctgcccattctggccggccttgccgtgtgtttctggttacctggcacgtgagccagctggctggtcccagaggccctcagttgcatggctggcccttggctggggaaggagcactgacaggacccttcgttcgcctcactcagcggaggccagttcaccccgtcccacagccggctcagggaccctgacagtgagcagagtaaggayggcctctggaggcccaggcttggagccgctccttctgcccacccaggtctgggctggggctgactccacctcttcatgggaggagccacagagccgcattatgaggggcacagatacagggaaggggatggttgggaaccacttgtgcagccagcctaccactgtacaaactagtttcctgaaataatgctcagggaaaagagacctcagactaccggaaggcagtgccgacgaagtcacagtccaggcgacgtttccattggaacgatgtgcatggggagctgtgtatagagaggacag

SEQ ID NO: 26270 - DNA, 601 bp, Human
ttagaacataattttcttgaacaatgacctgcctttatatgttgaatagaggctggcacactaggggatcattattattattattactactactattattctgcccaggctctcagcagtcctggggctggctccaaagcacatgagtacacatgtgccacccagagacagacacaaaaggctcctactcacttttactgctcagcagcaggtcgaacgactctctccaccccagcacatcttctgagaagtttctactaaaagacaaaaagaaaaaaaaagagtaagaaaaaaaatcaacaaaccaaagcatagtacaaattctagccagaactctgatggaaaactgcataaaattcacagaaaggcttgcttggtgattgctgaagctgacacctcaaactcttagttggacttagggtaagcagtagtgctttctagagcacaattcagcaaccagaaatcaaagccagggactctttagtcctcagtcaatatctctaagcctgtctcgtctctgtccaaaaattatttcaattcccctgactctcaaagatttgttttgtacaccttcccaaggaaataaggtcctcataaatag

SEQ ID NO: 26271 - DNA, 601 bp, Human
tccaagaggttcccagcacattcagaggtagagtctggtagagaaagggagacagtcaggctgaaacccctgctgagattctccagtagaggcaaactgaaattacaataataaataacaacagcaccaacaataacaaaaacaatgttatgacaatcacagaaaaccaatgatacaatacacttaaataatctcctggaggagctcatggtacagagagaacagtgttgattatcctgggccacaaaggggctgccctgggtagttcacttccccagcctgggctctgccgcaggagttsccatcaggaaatgtttgttcagtgatgccctgaggtgacaggcaggttctgattatccccagtcctgcccttcgaagcagcctctccccccagcttctgcactctaagggtgccatggtcctgggccacctctgcccactccagtgttcatctcacgtctgcaggaaagaaacacaaggctccccttctatctcggggcatctctttttgcctgttctcataccacaaaaaacactggctggatttcagcaggactctcagggaccgccaagagacttatttcctaggatccttttctgc

SEQ ID NO: 26272 - DNA, 601 bp, Human
tgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgycccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctca

SEQ ID NO: 26273 - DNA, 601 bp, Human
gcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcytactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctcaaagttaagggatttgctgaagactgtaaa

SEQ ID NO: 26274 - DNA, 601 bp, Human
tacatgcgacaagaatgcttacttcctaagatgaatataggattaaggatgtcattgcgtgaaatagtaagcaaataacctagggacaggaaggaccagtacattattgagctcagctttgtttcaatgatgtaagtggcagtatttatcaaattaatatctttgtttttcaggacttgaaaatactggaaatctgtccggatccaaattattttgcaagccagatgagtaaccagagggcatgaaaggttgagaacatttgacttccctgcaaaccttggtatagatcacttccttttcygtaggaaaggaaaggcaccaaagagcacaatgagtacagtaagttttatcatctcttgaatttttaattttgtagggctaattaactaccttattccttgtagcacattagtgaaagtgagttccataatgtcacttctaagtaaccccacttcttgaaggagtatgtataggagctttctggtggttacatcagcttacttaccgacattgagctacattcgagtcataaagggcagagccctgaagacaaaaggctgagaaggaatagcttagggtttggtaatctcagaccttcaca

SEQ ID NO: 26275 - DNA, 601 bp, Human
ttggaggcgtgaaggtaaaaagattacttgagcctaggaccagccagggcaacataggccccatctctacaaacaaacaaaatgtagccaggcgtggtggggcgcacctgtagtcccagctacttgggaggctgaggcaggaagattccttgagcccaagagttcaaggctagctatgatcacaccactgcatttcggcaggatgactgagtgagactctataaagtatttgcaacccagttttctgttttcccgtctgttttgtttccctgtgacattcttggttcattcagtgtgagcwtggtagtaataatccatagtgaaaagtttcttatattcactgaccaaagttgattcgtcattataattactgtttagcgcttttgtttgtttgtttttgaaacagggtctcgctctgtcacccagcctggagtgcagtggcccgacctcggctcactgcaacctccacgttctgggttcaagtgattcttgtgcctcagcctcccacatagctgcgattacaggcatgcacctccccgcccagctaattttgtatttttaatagagaccagtttttgccatgttggccaggctattttgg

SEQ ID NO: 26276 - DNA, 601 bp, Human
gggtaaatattaaagagtcctaagtgtttgaaatgcttgttttctggtgctgtaaagaaatagcatttgaacgtaaatttaattttttttagcaaggccatatttatactttctgcagaaagggtacactcaccagttgttttgccatgagaatacattgaataaaggagacagggttatttataacttgatgtgtttactctgctgctgtgtccagtttttattggctggaacaggacctcacattctgtatttgtcccaattggctagcaacttagaacttttttttttttttttttttggagacagagtctcactctgtcgcccaggctggagtgcagtggcatgatctcggggtcactgcaagctccacctcccgggttcacaccattctcctgccgcagcctcccaagtagctgggactacaggtgcccgccaccacgcctggctaattttttttgtattttttagtagagatggggtttctacgtgttagccaggatggtctcgatcttctgaccttgtgatccgcccgcctcagcctcccaaagtgctgggattacaggcatgcgccaccacacctggccagaacttttgaaaa

SEQ ID NO: 26277 - DNA, 601 bp, Human
agagagggagaggagtctcttaaagcaagagaaagcaattttaatagcgacttatttaaagctaactctcagatcttacagcctcggggctggtgagatgcctacttcatacactcagtggaaaatcaagataatcaccaagaaaaattgagataatcaccacgcattaaaatgtggctcctgagaggatgttgctgtacatgaactcaaagtaattcaaggattaaacttaacaaccaaagaaagacaactatgaagataacacagaaaacaaaaaaggtggccaggtagtggctgatayctgtaatcctagcactctgggaggccaaggcaggtggatcacctgaggtcaggaattcaaaaccagcctggccaacatagtgaaaccctctctctactaaaaatacaaaaaaattagctgggcgtggtggtgaacacctgtaatcccagctactcgggaggctgagacagtagaatcacttgagcctgggaggcagaggttgcagtgagccaagatcgcaccactgcattccagcctgggtgacagaccgagactccaactcacaaaaaagaaaagaatagatatactcacatacaagaa

SEQ ID NO: 26278 - DNA, 601 bp, Human
actgcatctcttcctattaatctcctaatctcccttccccccagcccatctacacaatctcaaatcaacattcccacattcattttacaagttgttaaatgctgccacataatttaattttgctttgataattcagaagacaaatcagaacctttcagcactccaagatcattaggaacatcaagtcttaccaaaatgtggaagcaccagctaatgaaggtttttcaatcaataaaaggctagacaacacagaactgtctaaactgatgtacatggagcaggtcttttttttttttcctawagctcttctctagctggatctaatgggagaacattgtgtgaatgacttggttttttactcatgtactcaaactgatttactgagaaccccatataggtcagtttctgtggcaggaagaggtgataaagacaaattcatataatgtatgcacatataactagaaatgaataaaatggtaagctatgaaaaaaaattttttaatgttcccaactgtgggctttaaggataaagcccacgcctttaataatggttcagagcagtccttaaactgaactcaacccaccctacacagcttcacct

SEQ ID NO: 26279 - DNA, 601 bp, Human
tactgcatctcttcctattaatctcctaatctcccttccccccagcccatctacacaatctcaaatcaacattcccacattcattttacaagttgttaaatgctgccacataatttaattttgctttgataattcagaagacaaatcagaacctttcagcactccaagatcattaggaacatcaagtcttaccaaaatgtggaagcaccagctaatgaaggtttttcaatcaataaaaggctagacaacacagaactgtctaaactgatgtacatggagcaggtcttttttttttttcctraagctcttctctagctggatctaatgggagaacattgtgtgaatgacttggttttttactcatgtactcaaactgatttactgagaaccccatataggtcagtttctgtggcaggaagaggtgataaagacaaattcatataatgtatgcacatataactagaaatgaataaaatggtaagctatgaaaaaaaattttttaatgttcccaactgtgggctttaaggataaagcccacgcctttaataatggttcagagcagtccttaaactgaactcaacccaccctacacagcttcacc

SEQ ID NO: 26280 - DNA, 601 bp, Human
acttccacctcccaggttcaagagattctattgcctcagcctcccgagtagctgggactactggcacctgccaccatgtcctgttaataaaagacttaaattactatattaaaggtgatctcttggctgggtgcagtggctcatgcctgtaatcccagcactttgggaggccaagtcaggtgaatttcctgaggtcaggagttccagaccagcctggccaacatggcaaaaccctgtctctattaaaaatacaaaaattagctgggcgtggtggtgcacacctgtagtcccagctacttgrgaggttgaagtgggaggatcacttgaacccgggaggcggaggttgcagtgagccaagatagcgccactacactccagcctgggtgacagagagagactccatctcaaaaaaaaaaattttaatagaaccacacaacagaatactgacagtcgttagaaatatggcttcacacaatagaatattggcagtcattagaaatatggctaacctacatatctatattaacatggaaagatgtccatgtacaatgtaaataacgaaaatctgtttacaaatgacaaagaataactccatttaaaa

SEQ ID NO: 26281 - DNA, 601 bp, Human
acacctgctatcacagcactttgggaggccgaggcaggcggatcacctgagctcaggagttcaagaccagcctggccaacatggagaaaccccgtctctacaaaaaatacaaaaattagccaggtgtggtagcgggcacctgtaatcccagctactcaggaggctgaggtaggagaattgcttgaacccaggaggcagaggttgcggttagctgagatcgccccactgcactccagtctgaatgacagatcaagactccttctcaaaaaaaataaaataaaataaagacaaaaaaaaaaaagaaacaattatttcaagtagcattagaacaaagtattttgattgcacatccttggtgacacatgttctaaacacacagagagatgcaaagacatcttttttttagagtggggtggtgcaatcatagctaactgcagcattaacctcctgggctcaagtaatcctcccacctcagcctcccaagtagctgagactacaggagtgtgtcaccatgcccagcttattattttttgtaaaaatgaggtctcactatgttgcccagactggtcttgaattcctgggcacaaataatcctcccata

SEQ ID NO: 26282 - DNA, 601 bp, Human
ttgtgccactgcactccagcctgggcaacagagcgagactgtctctcaaaaaaaacaaataaacaaacaaaaacaaaaacaacaaaacaaaaaaactgtttacaggccagccgggcacagtggctcacacttgtaatcccagcactttgggaggccaaagtgggtagatcacttgaggtcaggagtttgagaccagcctggccaacatggtgaaaccctgtctctaacaaaaaatacaaaaattagccaggcatggtcgcacatgcctgtaagtcccagctactggggaggctgaggtggragaatcacttaaactcaagaggcagaggttgcagtgagctgagattgcaccactacactccagcctgggcgagagtaagaccctctcttaaggaaaaaaaaaaaaaggttgacaaaggtaatgtagtaatatgtaaaatgtttagagaatattctaagtggcaaaggtattacacaatactttatacataatatgacaataagcataataagtacattaaaaagccctatgcttagacacgactcaggtactaaaatgtccatagtgtcgatagtggttgtgaactgacctcaaatcttc

SEQ ID NO: 26283 - DNA, 601 bp, Human
tttttaaattataaacggtctcactctgtcacccaggctggagtacagtggcacaatcttggctcaatgcagtctcaacctcctgggctcaagcaatcctcccacctcaagccccatgagtggctgggattccaggtgcatgccaccacgcccagctaattttttgtattttttgtagacatggaatttcaccatgttccccaagctggtctcaagcaatctacccaccttgacctcccaaagtgctgggattacaagcataagccactgtgcccaaccagcaagagattttaaaatgttyatatccttcaatttgaaaaacattacttcagaaaatcctgagaatacaaaaattcataacttttgtataatatgcagagatgtatattataatattaaatagaaaaaaactgtttaactatagaaacttggcaaataagctctaggacatcaaatcagtgagtcagccacttaaaaacggtttacaggctgggcacagtgaaactttgggaggccaaggcgggcagatcacaaggtcagaagtttgagaccagcctggccaatatggtgaaaccccgtctctactaaaaatagaaaaatt

SEQ ID NO: 26284 - DNA, 601 bp, Human
ctcatttctcacaatgtccaagttgaacattccataccttaaaagaacggatggaggatattccactatctggctgtctctggtaatcatagcgtgagaaaggccccttaagcacagctcctgtgtgctttaagtccacattttcttccacagcaatattaccccagtgagagacttcaatgactcgggtcatgctggtgatggtcaggaaagggctgttgttctcataatgtactttaaaagtatcctggaaggaaggaaacaaatagttcaaagttttggcaacagagaatgcaccatyagtttaaatcagattgattggagacaacctatatatcagcaacagaacgggtaaattatgatgtatctaacgtatgcaacattttaaaattatgtttactaggacttcttgctaacatatgggaataaatattcatgatatattattaactcaaaaaataggacacaaaaaaataatgtgtctggagctgattgtattaggcagttttgtaagagttctaaataagtgcattatctcatctcattctcaagacaatatgatgaaataagaactacttatccccatttgacaaataaaaat

SEQ ID NO: 26285 - DNA, 601 bp, Human
agaccagcctggccaacatggtgaaatcctgtctctactaaaaatacaaaaattagccaggtgtagtggtgcatgcgtgtaatcccagctattcaggagtctgaggcagaagaatcacttgaacccaggaggcggaggctgcaatgagcagagatcacgccactatgctccagcctgggtggcagagtgagactctgtctcaaagaaaaaaaagaaaatggcttatctatatatatgggggggtattttttaagattctgttggtttctaacactgccaatcaacaagatgaacatcagtyaaccctaaacaactgcctaaatatttagctagtttcgaaaagcaaagaataggtagctgtgataaagtcctcatttctcacaatgtccaagttgaacattccataccttaaaagaacggatggaggatattccactatctggctgtctctggtaatcatagcgtgagaaaggccccttaagcacagctcctgtgtgctttaagtccacattttcttccacagcaatattaccccagtgagagacttcaatgactcgggtcatgctggtgatggtcaggaaagggctgttgttctcataat

SEQ ID NO: 26286 - DNA, 601 bp, Human
actttgagaggccaaggcggccgggcgcggtggctcatgcctgtaatcccagcactttgggaggccgaagtgggcggatcacctgaagtcaggagttcgagaccagcctgtccaacatggagaaaccctgtctctactaaaaatacaaaaaaaaattagccaggcttggtggtgcatgcctgtaatcccagctactcgggaggctgaggcgggagaattgcttgaacctgggaggcggaggttgtggcgagccgagatcgcgccattgccctccagcctgggcaacaagagcaaaactccrtctcaagaaaaaaaaaaaaaagaaagagaagccaaggcaggtggatcacttgaggccaggagttcaagaccagcctggccaacatggtgaaatcctgtctctactaaaaatacaaaaattagccaggtgtagtggtgcatgcgtgtaatcccagctattcaggagtctgaggcagaagaatcacttgaacccaggaggcggaggctgcaatgagcagagatcacgccactatgctccagcctgggtggcagagtgagactctgtctcaaagaaaaaaaagaaaatggcttatctatatat

SEQ ID NO: 26287 - DNA, 601 bp, Human
tctccaaaaaaaaaaaaaatatatggtttaggctgggcatggtggctcacgcctgtaatcccagcactttgagaggccaaggcggccgggcgcggtggctcatgcctgtaatcccagcactttgggaggccgaagtgggcggatcacctgaagtcaggagttcgagaccagcctgtccaacatggagaaaccctgtctctactaaaaatacaaaaaaaaattagccaggcttggtggtgcatgcctgtaatcccagctactcgggaggctgaggcgggagaattgcttgaacctgggaggyggaggttgtggcgagccgagatcgcgccattgccctccagcctgggcaacaagagcaaaactccgtctcaagaaaaaaaaaaaaaagaaagagaagccaaggcaggtggatcacttgaggccaggagttcaagaccagcctggccaacatggtgaaatcctgtctctactaaaaatacaaaaattagccaggtgtagtggtgcatgcgtgtaatcccagctattcaggagtctgaggcagaagaatcacttgaacccaggaggcggaggctgcaatgagcagagatcacgccactatgct

SEQ ID NO: 26288 - DNA, 601 bp, Human
ccgtctctactaaaaacacaaaaaattagctgggcatggtggcgggcgcctgtagtcccagctactcgggaggctgaggcaggagaatagcatgaacccgggaggcagagcttgccgtgagccgagatcgtgccactacactccagcctgggcaatagagcgagactctgtctccaaaaaaaaaaaaaatatatggtttaggctgggcatggtggctcacgcctgtaatcccagcactttgagaggccaaggcggccgggcgcggtggctcatgcctgtaatcccagcactttgggaggcygaagtgggcggatcacctgaagtcaggagttcgagaccagcctgtccaacatggagaaaccctgtctctactaaaaatacaaaaaaaaattagccaggcttggtggtgcatgcctgtaatcccagctactcgggaggctgaggcgggagaattgcttgaacctgggaggcggaggttgtggcgagccgagatcgcgccattgccctccagcctgggcaacaagagcaaaactccgtctcaagaaaaaaaaaaaaaagaaagagaagccaaggcaggtggatcacttgaggccaggagttc

SEQ ID NO: 26289 - DNA, 601 bp, Human
caaggtcagaagatcgagaccatcctggctaacatggtgaaaccccgtctctactaaaaacacaaaaaattagctgggcatggtggcgggcgcctgtagtcccagctactcgggaggctgaggcaggagaatagcatgaacccgggaggcagagcttgccgtgagccgagatcgtgccactacactccagcctgggcaatagagcgagactctgtctccaaaaaaaaaaaaaatatatggtttaggctgggcatggtggctcacgcctgtaatcccagcactttgagaggccaaggcggcygggcgcggtggctcatgcctgtaatcccagcactttgggaggccgaagtgggcggatcacctgaagtcaggagttcgagaccagcctgtccaacatggagaaaccctgtctctactaaaaatacaaaaaaaaattagccaggcttggtggtgcatgcctgtaatcccagctactcgggaggctgaggcgggagaattgcttgaacctgggaggcggaggttgtggcgagccgagatcgcgccattgccctccagcctgggcaacaagagcaaaactccgtctcaagaaaaaaaaaaaaaa

SEQ ID NO: 26290 - DNA, 601 bp, Human
actcgggaggctgaggcaagagaatcgcttgaacctaggaggcagaggttgcagtgagtgaagatcaagccaagaaaaacagatgtaggtattaactgcagattaatagataaggcaaattgaatagattgaaaagggcaaaactaaggtatagtatgtagagatatacacttgggtgataaaactacaaagatattcaagaaagtgattactcaaagtcggggcaatgactttgagaaggaagaggtacatggaacactttttgagtagctagcaaattttgatttcttgacaggagggkgtggggagcggcacaaggtcttcctcataataattcactgagctatacattttttgtatggttttctgtatcttatttttcagtaaaaaggtttaaaaaaaagacttggccgggcatggtggctgtcacctataatcctagcactttgggaggccgaggcctgtggatcacctgaggtcaggagttcaagaccaacctggccaacatggtgaaaccccatctctactagaaatacaaaaaattagctgagcgtggtggcgggcacctataatcccagctactcaggaggctgaggcagga

SEQ ID NO: 26291 - DNA, 601 bp, Human
gaaggagaacgcagagagaagaaacagggcaactgatgggcttgagaacagcagaaccccaaaacacacaaccgggattccctagagagcacagcaggccagtgtgaggagtggctgaaactcggagcagttgtgccctgcctaatggtgagtgaaacgggcctgcagaaggtctacgagtctgcagcagtctagtccctgagagcagaactccccttctgggacagtgccctacagtgaggagaaactgctcaacacaatcaaaaatgaacatgatagggacaatggaactcaaaaaccrcacagaggaaagctcagaaagcaagccacatgtttttgcactaaaatagcagagatctgggaaggtacaaaagccactctaaaccatccctccttcggaaaggtcacattaaaaatgatcaacagacagtggctcatgcctgtaatcccagtactttgggaggcagaggcaggcagatcacctgaggtcaggagttcaagaccagcctggccaacatggtgaaaccccatctctactaaaactataaaaattagtcaggtgtggtggcacatgcctgtaatcccagcaacttgggaagct

SEQ ID NO: 26292 - DNA, 601 bp, Human
atagcctccaaccaactacatcaataaaccagatttaggatcagagaattccaaggctaaggagcctttcaagatcactaaattcacactcctccactctgctcccttctcagctatggagaacacccactctcttgagacaggggagccagtgccagaaagccctttgttttaaagcccttgtctgctggggcaacaactgtccctctgaatcctccactcccaagttctcaccagtactggccccactccttggagtcacaaagttgacacagctctcctgtacatcctacccagtgartccctgggaggcttgaacagatgcctcacgagctgttctgaatgttctttctcttcacatgaataagagcttcttacggggcaggggacatgtcctgcttttgtctgcccaggcccactgtcccttctcctggtaaacagcacagcctggatttgcatgaggaactactcttccactatggaacattctccacaggaagaaaatcaaggggtctctcattctggcagtcagagtggacatgtgactcaagagaggccaagtagatgttccctgataaagtaaatctagagaaaagtgaca

SEQ ID NO: 26293 - DNA, 601 bp, Human
gcaatgggcaaaactagggccataaagatgagcagaccagccgggcctggtggctcatgcctgtaatcccagcactttgggaggccaaggtgggcagatcacgaggtcaggagttcaagaccagcctgaccaatatggtgacatcccatctctactaaaaatagaaaaaaaaattagccgggcatggtggcaggcacctgtaatctcagctactcaggaggctgaggcaggagaatcacctgaacccaggaggcggaggttgcagtgagccgagatcgcaccactgcactccagcctgggygacagagcgaaactccatctcaaaaaaaaaaaaaaaaagatgaagcagacatttcacttcacagtccagtaaggcagacagatagatgtgaacaaggatgataatgtcagtgtgccctgcatatatattacagcagtcttgcccatttaatcagcaggaaacattagataaaccaaaattaagggacattctataaaactggtctctacaacaccacaaatgtcaaggttattaaacacaaagaaaggaccaggaatggtgggtcacacctataatccccacactttgggcagctgaggc

SEQ ID NO: 26294 - DNA, 601 bp, Human
cactattcccaaaattaagaattaaattatgagagatcttcaacagaccaaaaacaaatgttcacagtccctgctttatttccatttgttcacacacgctttaaaaaaaaaaaaaaaaacacatgcactcacacaatacccaaacatcagaattagaagggcataaaacagggggctttataggctgaaaaatatcttagacttcagaacagaataccaatcaaatattgaaaattcctttgttcaaaacacaaagatgttttgtttttaatgggagtttttttaaagttttctttttttwaaaaaaaaaaaaaagaaagttaaggacaaacggcaaactcacactgcctgacgcagggcctggtttctcttccttgaaggccttttacagatgtcagctttcactggcctccatgcacaacctcccactaccacccaatctgcctgccacagcaaagtgcaggcaccctgggccccctggaggatgcgggcaggggctacagggcatccaggatgtggtcgatcttggtgaccagctcctggcgctttcctgagatgagcttctcattctcaatgtacgtgtctttcttgagcttgccag

SEQ ID NO: 26295 - DNA, 601 bp, Human
ctagaatacctcagtgttctaatatgtaaaatgtaaatgcttgccttgcaaacctgctgagaagcaaatccattatttaatgaataaaaagcacttgataaaagcactattcccaaaattaagaattaaattatgagagatcttcaacagaccaaaaacaaatgttcacagtccctgctttatttccatttgttcacacacgctttaaaaaaaaaaaaaaaaacacatgcactcacacaatacccaaacatcagaattagaagggcataaaacagggggctttataggctgaaaaatatcytagacttcagaacagaataccaatcaaatattgaaaattcctttgttcaaaacacaaagatgttttgtttttaatgggagtttttttaaagttttctttttttaaaaaaaaaaaaaaagaaagttaaggacaaacggcaaactcacactgcctgacgcagggcctggtttctcttccttgaaggccttttacagatgtcagctttcactggcctccatgcacaacctcccactaccacccaatctgcctgccacagcaaagtgcaggcaccctgggccccctggaggatgcgggcagggg

SEQ ID NO: 26296 - DNA, 601 bp, Human
cgaagctcaggcggcggcgcaggcgcggtgcacggcgcggggcgggagcctggcgcagccggcagaccgccagcagatggaggcgctcactcggtacctgcgcgcggcgctcgctccctacaactggcccgtgtggctgggcgtgcacgatcggcgcgccgagggcctctacctcttcgaaaacggccagcgcgtgtccttcttcgcctggcatcgctcaccccgccccgagctcggcgcccagcccagcgcctcgccgcatccgctcagcccggaccagcccaacggtggcacgctcgaraactgcgtggcgcaggcctctgacgacggctcctggtgggaccacgactgccagcggcgtctctactacgtctgcgagttccccttctagcggggccggtaccccgcctccctgcccatcccaccacccggcctttccctgcgccgtgcccaccctcctccggaatcgcccttcccttcctggccacgaatggcagcgtcctccccgacccccagtctgggcgcttctgggagggctcttgcggtgccggcactcctccttgttagtgtctttccttgaaggggcgggcaccaggctagg

SEQ ID NO: 26297 - DNA, 601 bp, Human
gctccctacaactggcccgtgtggctgggcgtgcacgatcggcgcgccgagggcctctacctcttcgaaaacggccagcgcgtgtccttcttcgcctggcatcgctcaccccgccccgagctcggcgcccagcccagcgcctcgccgcatccgctcagcccggaccagcccaacggtggcacgctcgaaaactgcgtggcgcaggcctctgacgacggctcctggtgggaccacgactgccagcggcgtctctactacgtctgcgagttccccttctagcggggccggtaccccgcctccytgcccatcccaccacccggcctttccctgcgccgtgcccaccctcctccggaatcgcccttcccttcctggccacgaatggcagcgtcctccccgacccccagtctgggcgcttctgggagggctcttgcggtgccggcactcctccttgttagtgtctttccttgaaggggcgggcaccaggctaggtccggtgccaataaatccttgtggaatctgacttgaggggcagtgaaggcagtcttggactttatctcctgcaggggaagccgggaagggccagaccctggtctttgggcgc

SEQ ID NO: 26298 - DNA, 601 bp, Human
ctacctcttcgaaaacggccagcgcgtgtccttcttcgcctggcatcgctcaccccgccccgagctcggcgcccagcccagcgcctcgccgcatccgctcagcccggaccagcccaacggtggcacgctcgaaaactgcgtggcgcaggcctctgacgacggctcctggtgggaccacgactgccagcggcgtctctactacgtctgcgagttccccttctagcggggccggtaccccgcctccctgcccatcccaccacccggcctttccctgcgccgtgcccaccctcctccggaatckcccttcccttcctggccacgaatggcagcgtcctccccgacccccagtctgggcgcttctgggagggctcttgcggtgccggcactcctccttgttagtgtctttccttgaaggggcgggcaccaggctaggtccggtgccaataaatccttgtggaatctgacttgaggggcagtgaaggcagtcttggactttatctcctgcaggggaagccgggaagggccagaccctggtctttgggcgcgtgtcctggcctttggatgcctgttctgctttttacagatgtcatttgagccccag

SEQ ID NO: 26299 - DNA, 601 bp, Human
ctctactaaaaatacaaaaaattagccgggcatggtgttgggcacctgtagtcccaactacttgggaggctgaggcaggagaatggcgtgaacctgggaggcggagcttgcagggagctgatatcataccactgcactccagcctgggtgacagagcgagactccatctcaaaaaaacaaaaaaacaaaaaactcttccagttgagaaccactgcgataagaattatagtatgcctccttaagcgtctcctttgagttaatattgtaccacttcacataaaatgtagaagccttgcaaccrtataggtccattcactgactcccctttgccgtacactgtcccttatgttataattgtcatatgtgttatatctatttacattgaaaaccccaatatataatattataagttttgctttcaacagtcatacacttagatgtctgttatatgtcatgggtaaaaatgtcacacataattttaaagatactaagagggaaaaagtattttatacttatccagatatttatcattttttgttgctcttcattcttgaacacccaagtttttctctgtaatcattttctttagcctaaggaactt

SEQ ID NO: 26300 - DNA, 601 bp, Human
atggtgttgggcacctgtagtcccaactacttgggaggctgaggcaggagaatggcgtgaacctgggaggcggagcttgcagggagctgatatcataccactgcactccagcctgggtgacagagcgagactccatctcaaaaaaacaaaaaaacaaaaaactcttccagttgagaaccactgcgataagaattatagtatgcctccttaagcgtctcctttgagttaatattgtaccacttcacataaaatgtagaagccttgcaaccatataggtccattcactgactcccctttgccstacactgtcccttatgttataattgtcatatgtgttatatctatttacattgaaaaccccaatatataatattataagttttgctttcaacagtcatacacttagatgtctgttatatgtcatgggtaaaaatgtcacacataattttaaagatactaagagggaaaaagtattttatacttatccagatatttatcattttttgttgctcttcattcttgaacacccaagtttttctctgtaatcattttctttagcctaaggaactttttgtagcattttttataaagcagatctttt

SEQ ID NO: 26301 - DNA, 601 bp, Human
acttgggaggctgaggcaggagaatggcgtgaacctgggaggcggagcttgcagggagctgatatcataccactgcactccagcctgggtgacagagcgagactccatctcaaaaaaacaaaaaaacaaaaaactcttccagttgagaaccactgcgataagaattatagtatgcctccttaagcgtctcctttgagttaatattgtaccacttcacataaaatgtagaagccttgcaaccatataggtccattcactgactcccctttgccgtacactgtcccttatgttataattgtcrtatgtgttatatctatttacattgaaaaccccaatatataatattataagttttgctttcaacagtcatacacttagatgtctgttatatgtcatgggtaaaaatgtcacacataattttaaagatactaagagggaaaaagtattttatacttatccagatatttatcattttttgttgctcttcattcttgaacacccaagtttttctctgtaatcattttctttagcctaaggaactttttgtagcattttttataaagcagatcttttggagatgaattctcttagttttccttca

SEQ ID NO: 26302 - DNA, 601 bp, Human
cagtcatacacttagatgtctgttatatgtcatgggtaaaaatgtcacacataattttaaagatactaagagggaaaaagtattttatacttatccagatatttatcattttttgttgctcttcattcttgaacacccaagtttttctctgtaatcattttctttagcctaaggaactttttgtagcattttttataaagcagatcttttggagatgaattctcttagttttccttcaactgaaaatgtctttgcttaaccttaattcctaaaggaactctgggctgattatagaattctrggttgacaggtcttttagcacttaaaacatgttgtttcagtcttctgaccgccatagtttctaacgaggagtcatggtcattcaaattgttgtttctctgtatgtgatgggccatttttctctagctattctcaagatttttagcagtttgattgtgtaatgtctaggcatggttttcttttaatttattctctgttgtgttttctgagtttcttaagtctgaaaatgcaaaacttttaccaaatttggcaagttttcagccattatttctttaaatgtatgttctgtcccaattttttc

SEQ ID NO: 26303 - DNA, 601 bp, Human
ttctttagcctaaggaactttttgtagcattttttataaagcagatcttttggagatgaattctcttagttttccttcaactgaaaatgtctttgcttaaccttaattcctaaaggaactctgggctgattatagaattctaggttgacaggtcttttagcacttaaaacatgttgtttcagtcttctgaccgccatagtttctaacgaggagtcatggtcattcaaattgttgtttctctgtatgtgatgggccatttttctctagctattctcaagatttttagcagtttgattgtgtmatgtctaggcatggttttcttttaatttattctctgttgtgttttctgagtttcttaagtctgaaaatgcaaaacttttaccaaatttggcaagttttcagccattatttctttaaatgtatgttctgtcccaattttttcctcctcttcttctggacttccaatgatgcatatattagacctttggatattgtcccataggtccctgaaactgttcactttgaatccccttttctctctgttcttcacatttgataatttatgttgatatatctttaaattcactgactcttccttcat

SEQ ID NO: 26304 - DNA, 601 bp, Human
atgttgtttcagtcttctgaccgccatagtttctaacgaggagtcatggtcattcaaattgttgtttctctgtatgtgatgggccatttttctctagctattctcaagatttttagcagtttgattgtgtaatgtctaggcatggttttcttttaatttattctctgttgtgttttctgagtttcttaagtctgaaaatgcaaaacttttaccaaatttggcaagttttcagccattatttctttaaatgtatgttctgtcccaattttttcctcctcttcttctggacttccaatgatgsatatattagacctttggatattgtcccataggtccctgaaactgttcactttgaatccccttttctctctgttcttcacatttgataatttatgttgatatatctttaaattcactgactcttccttcatgttctttctactcatgaaccattctaatgagttttctatttcaaatattgtattttcagttctaaaatttccatttggttcattttatagtttctatttctctgctgagagcttacatctttttgttcatttctagtgggctttctttaccttgtagttctaacagctgt

SEQ ID NO: 26305 - DNA, 601 bp, Human
tttaccttgtagttctaacagctgttttaaagtctttaataattccataatctgggctttcttgggttttgcatctgttgattgtcttttaccttgagagtattggttacattttctgattctttgtatagcaaacaattttggattgtatcctggacagggtgaatgtcctattatatagatcctttggagaatgttgatgtttttgttttagcaagcatttaagccagtatgttctgacaataagttctgtcttgccttctgagggtggtggttaaagtctttgctcagctctctaaaygtatgcctacgtcagagtaagcctgagacttgtacaggtctatacacagaattaggggatcctcttctctggctctctccactatagacttcttcccttactctccagcctgcagagatttcttttcctagttcctttggttaggaagatggggtttctgttagagttttagctacctttgctgtttctgctgccatgctgttccagggctgtgctcaaccttggggcaaagctgttgagagagagagagcctaaaaagaaaaaaagacaaccaggacctcacccttatgcagtggcttc

SEQ ID NO: 26306 - DNA, 601 bp, Human
ttgaaatataaaccactcacctccatcttccttgtctcaatgtgtcctataccctttccctgctttcttttttcccttggcatttatcaccactttacatatttctttacttattttatatattgtctgtcttttcctcacccctctccccacataacttaaactccatgatagtagggattttcgtttggttcactattgtatccataagttcctagtttagtttttggtacagaacaggtataataattgttttccaaaagcgtatgcatttgttttcctatctatgctaggggagagygttcatttacagtactttaatctctgaatatttttagttgatgagttcaagataacttccctttggaatcttttaatactttacaagattgtatatattataggaaaagtgtagtgaattattcacttttaggggttagcttgtgtttagtttgctattacttgctacagaaacaatatttagcagtttgtaagtagcaatagtagatagatttatctcttatgactagagcctcagagcaatttccaaggtagaaacataccaaaaaataaaagagagaatgccttagccaatggtttt

SEQ ID NO: 26307 - DNA, 601 bp, Human
tagaaaagaacacattttggcaaaattatgcatttttaaagctgacagttattttagttatagcattatatccatttcagttctattctcctagttctctgaatctctaccatatttagagcaattttggaagtcagagagctctaaggaactaataggagcttttgtttcatacaggaaatgttctgaaaatgtaagtatttattacttttaaaagtgcttatgtcaaattattgttagtttgaactgttaagaaatatttgctccaagaaattcttggctatatggaaatcttataaargcatatcatttgttctattgttactattaatatttgtgaatactattttttcttctataggacaaggtgcaacgctggttgatagaggagataatacatatggaggaaagtgggtcataaatcctagtggtggactgatttcaaagggacacccactaggcgctacaggtaatgctacatacagatttcatacattttaaaatcattttttccttaagtgtgaatgagttagtctttcatttgaatgaaagattatattctctgaacttggtagctggtgctttaaatgattgtttagct

SEQ ID NO: 26308 - DNA, 601 bp, Human
gacagttattttagttatagcattatatccatttcagttctattctcctagttctctgaatctctaccatatttagagcaattttggaagtcagagagctctaaggaactaataggagcttttgtttcatacaggaaatgttctgaaaatgtaagtatttattacttttaaaagtgcttatgtcaaattattgttagtttgaactgttaagaaatatttgctccaagaaattcttggctatatggaaatcttataaaagcatatcatttgttctattgttactattaatatttgtgaataytattttttcttctataggacaaggtgcaacgctggttgatagaggagataatacatatggaggaaagtgggtcataaatcctagtggtggactgatttcaaagggacacccactaggcgctacaggtaatgctacatacagatttcatacattttaaaatcattttttccttaagtgtgaatgagttagtctttcatttgaatgaaagattatattctctgaacttggtagctggtgctttaaatgattgtttagcttcaatatttttgatgttccattaagtagagcacacttaaataa

SEQ ID NO: 26309 - DNA, 601 bp, Human
tttcagttctattctcctagttctctgaatctctaccatatttagagcaattttggaagtcagagagctctaaggaactaataggagcttttgtttcatacaggaaatgttctgaaaatgtaagtatttattacttttaaaagtgcttatgtcaaattattgttagtttgaactgttaagaaatatttgctccaagaaattcttggctatatggaaatcttataaaagcatatcatttgttctattgttactattaatatttgtgaatactattttttcttctataggacaaggtgcaackctggttgatagaggagataatacatatggaggaaagtgggtcataaatcctagtggtggactgatttcaaagggacacccactaggcgctacaggtaatgctacatacagatttcatacattttaaaatcattttttccttaagtgtgaatgagttagtctttcatttgaatgaaagattatattctctgaacttggtagctggtgctttaaatgattgtttagcttcaatatttttgatgttccattaagtagagcacacttaaataatcttcattaattgatgagaatttgaattaat

SEQ ID NO: 26310 - DNA, 601 bp, Human
ttcccaaaaaggactggcttttaatgttaaagaaccagtaaattccagggaacaggaacaggtcaaagccacctcctcccaaggatttggaggctccatcacagagttgccaatcttaggctttggaattaggcaaacttgggttggagtcccatccatgccattcacataatgtgaccttgaacaagttatttaactttctgagactcagttttctcttctgtaaatgggcttaataaatggccccttttcataaggttggtatgaagattaagaggattctttcttaattaaccgtaargcacacggtccagtgcatggctggtggccttggaagacctgtccatactcacaatcgccagttattcttatccaaatcttttttgaccccactctagtcagcttttgtcctcatcactatccccagactgttcctgtcaagatcaccagtgactaccacattgctaaattcagtggtaaattcccagccctcatgatattacacttacacgttttccttacctactgactgttcctccttggcctctcttgatggtttctttttgtcttcaaatttctaagcattggagtgttccaaggc

SEQ ID NO: 26311 - DNA, 601 bp, Human
aagcgattctcctgcctcagcctgccgagtagctggaattacaggcacctgccaccatgctcggctaatttttgtatttttagtagagatggggtttcaccatgttggccaggctagtcttgaactcctgacctcaggtgatccgcccacctcagcctcccaaagtgttgggattacaggtgtgagccagcgcacccggcttctattccgtctcttttattaaggcacagattatctgattagctattatgacataatttgatcatcttttgaaattcacataatctattaatttattcarcaagtatttattgatttcctatgtgtcaagtactcttcaaggacctgtgcatatagcagtgatcaacactgacaagggctctgcccccttgaagttttcattctattggacaaatacagacagaaaacacatacacatataagtagtttcagatcagtgcactgtgaataaaatgtgacttcattttagggagaggccagctttaatttgagctaattcttaatgagaggaggagccaactgttagaatcctattgttatattaattgattgcctaaaacgttgactgctgaaaatgttg

SEQ ID NO: 26312 - DNA, 601 bp, Human
gttagaatcctattgttatattaattgattgcctaaaacgttgactgctgaaaatgttgatttcttggtgaatttttccttttgcacttgaaacctctcatttggacaaggtagacatggctgatttagcaatgagatattagtctttgttgtccagtcttttttccactattttactttgataataaaattaatattttaaaagctttgtattattaaaattgcatacacttgattttaaaaaattagaaaagatagacaaacgaaacgaagaactaccctaccaaaattccactgtccrggttaggagttggcaaattatggcctgcagaccaaatctagcccatcacctgtttttttgttttgcgttttgtaaaatttttgttgaagtctagcctgtagtaaagggcgtaattccagagtgtaccacgtgatgaatgtttacaaatgagtacacctccaaggtcaagacacagaatgttgccagtactccagaagcctccctcctgcccccctgctatcactattcactcccaaaaggaaccattatttcaaatcctatcaccatagcttgattttatttattttagaaattcataca

SEQ ID NO: 26313 - DNA, 601 bp, Human
ttttgttcaacagcataagattcattcatatggttgcgtgtggcaatagtttgtgtttactaggcgaataccccagaatttattccttgtgcatttgatgtatctttgcattgtttcaatctgggagcctgatgaataaagttgttatgaatattcttatagatgtcttttagtggacatttccatcgtacttacttctactggacacgcacccagggctaggtgataaagtgcaggttttgggtatggatgtactattttacatttccttccatattacatgagagttttagttcctccrcatttttgacagtacttggtacttgccaggtttttttaaaaatcaggttaattgatgtacaattaacaataaacaataaaatcaaccctttttagatgtataattctgtgaatttagacaaatgcatacagttgtgtaactatcaccagaaatcaagatacagacagtttccattaccccagaaagtgtcctcatgtccctctatagtcagccccctcaggcccttttagccactagtttgatttctctccctgtagttttgctttccttaggaagtcatacacatgaaatgatacagta

SEQ ID NO: 26314 - DNA, 601 bp, Human
ttcattcatatggttgcgtgtggcaatagtttgtgtttactaggcgaataccccagaatttattccttgtgcatttgatgtatctttgcattgtttcaatctgggagcctgatgaataaagttgttatgaatattcttatagatgtcttttagtggacatttccatcgtacttacttctactggacacgcacccagggctaggtgataaagtgcaggttttgggtatggatgtactattttacatttccttccatattacatgagagttttagttcctccacatttttgacagtacttggwacttgccaggtttttttaaaaatcaggttaattgatgtacaattaacaataaacaataaaatcaaccctttttagatgtataattctgtgaatttagacaaatgcatacagttgtgtaactatcaccagaaatcaagatacagacagtttccattaccccagaaagtgtcctcatgtccctctatagtcagccccctcaggcccttttagccactagtttgatttctctccctgtagttttgctttccttaggaagtcatacacatgaaatgatacagtatgtagctttttgagcctcct

SEQ ID NO: 26315 - DNA, 601 bp, Human
agtacttggtacttgccaggtttttttaaaaatcaggttaattgatgtacaattaacaataaacaataaaatcaaccctttttagatgtataattctgtgaatttagacaaatgcatacagttgtgtaactatcaccagaaatcaagatacagacagtttccattaccccagaaagtgtcctcatgtccctctatagtcagccccctcaggcccttttagccactagtttgatttctctccctgtagttttgctttccttaggaagtcatacacatgaaatgatacagtatgtagctttttgagcctccttctttcactgaaatttattcatgctgttgcatggatcatgaagtattttattcttttttgctgctgaatggttaccccttcaccagttgatgcacatttgggttttttccagcttttggcaagtatgaatcttaaagccactataagcattcacatacaggtttttgtgtggacgtaagttttcatttttcttcggtaaatacctaggaataggattgctagttcatatagtatgtgtatgtttagctttatgtgaaacttccagactgttttctgaaagtggctgcatca

SEQ ID NO: 26316 - DNA, 601 bp, Human
tcaccagaaatcaagatacagacagtttccattaccccagaaagtgtcctcatgtccctctatagtcagccccctcaggcccttttagccactagtttgatttctctccctgtagttttgctttccttaggaagtcatacacatgaaatgatacagtatgtagctttttgagcctccttctttcactgaaatttattcatgctgttgcatggatcatgaagtattttattcttttttgctgctgaatggttaccccttcaccagttgatgcacatttgggttttttccagcttttggcaaktatgaatcttaaagccactataagcattcacatacaggtttttgtgtggacgtaagttttcatttttcttcggtaaatacctaggaataggattgctagttcatatagtatgtgtatgtttagctttatgtgaaacttccagactgttttctgaaagtggctgcatcattttacagtctttctggtattatgttgacctttcatttgtttcccatcctcactaacactgggtattgtctttttttttttttttttaaatttcagccatttgttctagtaggtatgtggcactcatcatga

SEQ ID NO: 26317 - DNA, 601 bp, Human
tctgccacctgtttaaaataattttattggaacatagccaacatttgtttatatattatctatgactgcttttgcactacaggggcagaattgggtagttgtgatagagacctactgacctgcaaagcctaaaatatttagtgtctgatctgttacagaaagtttgttaacccttgatctagagaaccgtattcattttctattactgcataacaaattgccacaaatttagtagcttaaaacaatgcccacatttattagcccacagtttccatggataagtaggctgaggacagcttarctgggtcctctgcatagagtcacacaaggctacagttaagcttttggccagggctgggctctcatctggaggcttcaatggggaaggatccatgtccaagttcattcaggttgctggcagaattcatttccctgtggccttgggaatgatagcttccctcttttactggctataggccagagctggccctcagctcctaacggccagttccctgccacgtggccctctccataggaagtccacaacatagcagtgagctcattcagagccagcaggagagcaagaatgagtctgctagca

SEQ ID NO: 26318 - DNA, 601 bp, Human
taagtaggctgaggacagcttagctgggtcctctgcatagagtcacacaaggctacagttaagcttttggccagggctgggctctcatctggaggcttcaatggggaaggatccatgtccaagttcattcaggttgctggcagaattcatttccctgtggccttgggaatgatagcttccctcttttactggctataggccagagctggccctcagctcctaacggccagttccctgccacgtggccctctccataggaagtccacaacatagcagtgagctcattcagagccagcaggaragcaagaatgagtctgctagcaaggtagaatcatttaatgtaacaaaatgacaagagtgacatctcattatctttgccatattctgttagctagaagcaagtcacaggttctactcacactggaaggaaggggatgtacaccaggagggtcaccttagagtctgtcacagttactattagtaatatattggtgtcttaagtttacagatgtttttctatgtttatatagttgaattctgttttaagcaaaaatggcatcatacagtttcttttgtaactggcttatataataatatcatg

SEQ ID NO: 26319 - DNA, 601 bp, Human
gtcctctgcatagagtcacacaaggctacagttaagcttttggccagggctgggctctcatctggaggcttcaatggggaaggatccatgtccaagttcattcaggttgctggcagaattcatttccctgtggccttgggaatgatagcttccctcttttactggctataggccagagctggccctcagctcctaacggccagttccctgccacgtggccctctccataggaagtccacaacatagcagtgagctcattcagagccagcaggagagcaagaatgagtctgctagcaaggtrgaatcatttaatgtaacaaaatgacaagagtgacatctcattatctttgccatattctgttagctagaagcaagtcacaggttctactcacactggaaggaaggggatgtacaccaggagggtcaccttagagtctgtcacagttactattagtaatatattggtgtcttaagtttacagatgtttttctatgtttatatagttgaattctgttttaagcaaaaatggcatcatacagtttcttttgtaactggcttatataataatatcatgaataatgtaacatgaacattttttcat

SEQ ID NO: 26320 - DNA, 601 bp, Human
taggaagtccacaacatagcagtgagctcattcagagccagcaggagagcaagaatgagtctgctagcaaggtagaatcatttaatgtaacaaaatgacaagagtgacatctcattatctttgccatattctgttagctagaagcaagtcacaggttctactcacactggaaggaaggggatgtacaccaggagggtcaccttagagtctgtcacagttactattagtaatatattggtgtcttaagtttacagatgtttttctatgtttatatagttgaattctgttttaagcaaaaatrgcatcatacagtttcttttgtaactggcttatataataatatcatgaataatgtaacatgaacattttttcatgtcagtaaatccagatccatatcatttcttattgtggcttgtatcatacctcactatttgaatataccataatttatttaatcaattccgtcttgttaaatatcaggattgcttgtggtttatgtcacattttaccaggctgccatagaagtatatgtgagtgcccatttccccacactgcctcagtgctggttataattctgttgcagtcagtggctcttgacaaa

SEQ ID NO: 26321 - DNA, 601 bp, Human
tatatagttgaattctgttttaagcaaaaatggcatcatacagtttcttttgtaactggcttatataataatatcatgaataatgtaacatgaacattttttcatgtcagtaaatccagatccatatcatttcttattgtggcttgtatcatacctcactatttgaatataccataatttatttaatcaattccgtcttgttaaatatcaggattgcttgtggtttatgtcacattttaccaggctgccatagaagtatatgtgagtgcccatttccccacactgcctcagtgctggttayaattctgttgcagtcagtggctcttgacaaaaatgtatatgtgaaactgaacacctcctattctccttccttctcctgtgtatctgttttagataagaaggctgactgcacaatcacaatggctgactcagacttcctggctttaatgactggtaaaatgaatcctcagtcggtaagtatgatggagcttatatcctgctagtaggtaggtctttcagccctttctactccatctcctgactcagactctaaagtgcaaagtggtcagactcacaaaactcagtgttccccaaacagttg

SEQ ID NO: 26322 - DNA, 601 bp, Human
ttgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcartttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaa

SEQ ID NO: 26323 - DNA, 601 bp, Human
agctctcaggcctccgctaggtcacttccccagggatgacctcagcctccttccttagctctctcacccctcttctgaggtccactcaagagccacctcctctgtgaagcttccctgaccacctccagctcagggacttctctcccccagtcccccacagggaaaggggaagtaaggaagggagcttggatggaagagctacaccccagctggctctgtgctgccttacagctccacaagcttatcaggtcaaggtattattcccattttgcagatgagaaaacagaggctcaggagtcawataaccttctgaagggggttccagaggtttcttagtgagtaaagctattcctagtgaatatgagcctgcgtgcagcaggcggccctggggccttctggagctcacagccttcacctcacctccgagcatgagctctccttaaccaggcagctcacggaccccattcctctcctcagcattgccctttggagccagctgggtggagacagggcaggcagggtgcactcagtacatgctcagtaaacacaggagactgcctgaccactgcccccaggcatgacctgttgccgtcttgggtgg

SEQ ID NO: 26324 - DNA, 601 bp, Human
cagatatcctaccttgcagctctcaggcctccgctaggtcacttccccagggatgacctcagcctccttccttagctctctcacccctcttctgaggtccactcaagagccacctcctctgtgaagcttccctgaccacctccagctcagggacttctctcccccagtcccccacagggaaaggggaagtaaggaagggagcttggatggaagagctacaccccagctggctctgtgctgccttacagctccacaagcttatcaggtcaaggtattattcccattttgcagatgagaaaayagaggctcaggagtcaaataaccttctgaagggggttccagaggtttcttagtgagtaaagctattcctagtgaatatgagcctgcgtgcagcaggcggccctggggccttctggagctcacagccttcacctcacctccgagcatgagctctccttaaccaggcagctcacggaccccattcctctcctcagcattgccctttggagccagctgggtggagacagggcaggcagggtgcactcagtacatgctcagtaaacacaggagactgcctgaccactgcccccaggcatgacct

SEQ ID NO: 26325 - DNA, 601 bp, Human
ctccaggccggtgggttctggagacgtgggaatagccgtcaggagctgcgtgtccttccaagtggagggggtctgctgtgacaaggtgatatcttgcaaagcacctgcaggaccagaagcagagtgtgttggggaggtggggggtggggaggaccagaagcagagtgtgttgggtgggtcgggggaggctccagagcacctgggctggccaagctcaggctatgagggaggctagtacctggacaaggcagctgaggctaagctccttggaaaatggacaaggagagctgtcccttcccaytgtgtgtgtccaggtgcagcctggtctctggagccacgagacaggtgcctaggccacctgggaaagcttttctgtgaccacaggggtggggtgggcatcccttaggggcataactactgtggttatcctacttatcccagggcacacacttctctggccccaccctccctgaaaaaaaggcccccacttccaacaacagacacttccaacaacagatatcctaccttgcagctctcaggcctccgctaggtcacttccccagggatgacctcagcctccttccttagctctctcacccct

SEQ ID NO: 26326 - DNA, 601 bp, Human
tcagcggccacccccccaagatgcttggtcctaccagtaagtgctacaggtgtgtgagccccaagccccacccgcaggatcttccagccacatgaggccatttaggtccaaagcagtcggatccccctcccctccagagctggacctggggagaggctgcttcagtttggagaaaccgagtcagaatggtgcgatgccaggtgctggctgtggtggaaaggtcctatgcgagaaacccctggtgccctaagtctccaggcagaagtcagagaagcagagtggagctcccagcacaccccasgactccgtgggcaggagcgaccagaggggctggaatgctggggaggtggcctggtggcaggggaggccagggcctgcagttcttcaaggaagaggcaagtgggggcctagtgagtggcagggcggagggggcgcatggctcccgcgtcaggcatagaattcctcctgtttggtgggcttctggtaggccccgccgttggcttgtttcggctcctccaaggagtagctgccttcgtccttcttcttcatgcggtacagcatgaaacccaccaggcacacagcaaagatgagccccacgagg

SEQ ID NO: 26327 - DNA, 601 bp, Human
ctccctacagtcctctctgtctgaaggctgagtcccagcattcacttctcacacgggcttctccaacgtggcagcggcccaggcctcagcatggccctgagcgcatggacacaggcacgactgcttgaaagaggcggcggccccacggcagcctggactggccagcctgccaacagaccaccagaaacggggccaccagacagatagtccataccctgttgcacacatgagcgacaaactcaagagacaacacacaaactaagcctacattttggcttccagatttggttctcctagtttaaaaaaaaaaaaaaaaagtcttcttaaccctgatgctgtctcccgaccatagattagggaagcaagatggggggataccgaatcaacttacttaacttacctcagaagtaacaaggtctactgggctatgaacaaagaactagaggaaacatgtgcaaaaacaagtcgatatctagattagacctccccacgaaacaaagtggactcctgtcccctgccactcagcggccacccccccaagatgcttggtcctaccagtaagtgctacaggtgtgtgagccccaagccccacccgcaggat

SEQ ID NO: 26328 - DNA, 601 bp, Human
ggctggagggtactaggagcaggtggcggtgcccttctgtcggtccacacccggcaagtggcgggaaaggtgtggaatgagtcagccgtggaggggagccctgggcctggaagacccctgtctttggcttgagaatgactttgaagggctcagggggtagggagctggggggagaccgggaggagagcggcaggtctggctctaccccgaggcttcaggctgcggaccatgcgtggccccagctctgtctgggcagcaggtgtcagcgactttgggttgctgtgggaatttgctccgtttrtcagaagaaaacgcaccctggcaacacaggcccctctcaggtcaccaggcacatctggtcacatctgagtctcagataaacaaccaatgatgtcctggtgaaagcttgtcccgtgggacactcgggacacacttatattaaaacacgattaacgatctcaaactcagatgttactgggtatcctgcgtttttgttggcagctctgccactctgcccgtctgcctgagtcctctcctgccatcctcctgaccagaggcgtgggcttgagttgaatgccacgcagtggctaaaaatcagaga

SEQ ID NO: 26329 - DNA, 601 bp, Human
accagggaagggaaagtgaggggaggcagcctgggtctgttccaggtggggcagcgggtaaggcccagcaggagccctggcaggacacgcctttcagccgagagaactccaccttcgaaggcggctggggcaagggttcgtggccaggctgccctgcctctcgggtgcctgcacccctgctaggaaaagtccctaggtagggcggcaactccagccctgcctctcccagctcccagtgcagcccacacgccggagtgcagatgacctgcagggaactcccatgagggaactctgtaaagcraccttcagacgtgctatttatagatgtctatagatttatagatgtgtgtttctccaaacaaataaaccaccagaaagtgtcacagcaggacacgtcaccaaccccggggaccccatgttaccaggggtcctcctggagcctggagtctgggcctgctgaggacctggcttgcagacgggctccggccttctcgtcccattgccccaagcgctccaaccccctgtgaacatgcctctagtcatccctgggccctgcacagccacaggcagccacccggtcattcccatactctcaccatgg

SEQ ID NO: 26330 - DNA, 601 bp, Human
ctgtccaccagcccccccaccaccctgcccgtccaccagcccccctcccggggcagcactcagttgcgttcctttcgaatccatcgtttacacctctgtgtgttcctaatgcgcaagtcagctttacctctgctgctctcactggcaaggcaggctgctgggcagcttccagcaggcgagcctccttgtgccatcttgtctcaggcctgcaaacactaggggccccctagctgtgtggctcctctcccgccaggcagaggcggctccagggcacacacccacggtgctgggggagggcccsacaggcagtgatgagcctctcacaggccccagcgaggtcgccgcttctgtgcttcccacggggtccccactcatgccctgcatacaggaggtgctggatccgtgtggatctggatcccctgagagtggctgggggatgagggtccctgtgtggaagctccacaaagccccacctgcctccacgcaggagctcagccttgcacaggagactaccctaacctaaccccaaccctaactcagtcagtcccgccggtggggtctgggccgatgcctgggctggtcaaaggtcaggccctcacgt

SEQ ID NO: 26331 - DNA, 601 bp, Human
agtggccccgcacggtggggtggccgctcagggcctagggagcaggtgggaggggcttggagggcagaacagagggcctgggggctgctctgctggccaccactgctttctggttgaaccagataagtagctggtggtgacggctgtgggccctgagtcgggggagaagaggcagagggagcagtgggctgggctagtggggacatgagtgggtggtgatcatgcctgtgtcgggggagctgaggcagagagtggggcagcgagcatcccctgagggcaggaggagaggggtggggacagrgaagggtcgggggtggtcccagccctgaagacaggagtggcgagggcaggtgtggtctaggtgcttgtcgaggtggacaacatgggagtgggagtgggaggggcggggcaggaccgtggcagcctgggaggcccctgttcgtggtcactaagggtgctgcgcgggcgaccttgagcacctctgggtgaccccagtaaagggagggcaggtgcctcgaagccaggtgctgcgggtctggagggcctctcagagcacaggtatttggggtgcagtttccccacacagccggggtgggggtgg

SEQ ID NO: 26332 - DNA, 601 bp, Human
ggagcctggctctgtattcttgaccatagccggctgggcccctggcggggactggctctctgggaccggtgctccccccaccctctcctggagccccagcaggtgcaggacagtaaggctgacctcagcctggggcagccccacccaagactccccaccccgcacaaactggggtgcagggcctcctacctcccggcgttgctgggaacagcggcacctgtaccaggcgaacatgaccagagcgaccaagaggatgaagacagcagtgaccaccgctggcacaggccagaacccagtgtcrggggcggactggggttctgcacctgaaggaggcagttcaggggtgtacaggtgggctgggcatcccccaccccctacctcctccgtgtagctcccagcctcctcctcctacacactccctggggtgagaatgagccttggaagacggcaccgccgttgcccaggaggtacaggggtgggagggagccaggaggagagggggcgcaggaccagaggtggaaggagacccagagcgcaggtgtgtcggggcagcgagggaaacatctacccctggatgtgccaggtcccaggagctgcgcgc

SEQ ID NO: 26333 - DNA, 601 bp, Human
caagggacaggtatgtggccaaggccccccacagccctgaactggagtgtgtctgaggctccggcaggggccccctcacttgggcgcggagccctgggagtggagagagcggaccccacacctggggccggaccagcctggggtggcagaaagggagtccgggtctgtgggtttgatgagggcagagggaggggcatgcgtcctggtaagtcgggtgctgcggaggtgaggtggttccattttggaaactgaggaagcagagcttggaagacctggggggtggaggggaagggtctgcacrcacccaggagtgggtgacacagaggcccagcctgccaagcaagccggtgtctgtgccctccgggtgggacgagagacccaggccccgccacccaaggtcggcactcagggctggctctcctgtgtcctctctgccttgcaggcggctatgggtctgcggcatatggaaacaagggttggggggacagcagctccagggctccaagtggtgagggtttgaacaccagtgccagcggccttggggtgggctcggagtctggggtccacagttcagcggaggctctgctcaggccctgctggg

SEQ ID NO: 26334 - DNA, 601 bp, Human
ttcagatttttgttttccattttaaaaattgcatttggagctacttggaggtttgtgagtcggtttgttttcttcatttcagatattcgagtcatggaactttttcaaagaactgaagggggattcccggtgatttttccaccccatacagatgaagacatcaaagggccccgccgcagtgacgaagacaaaagcatgaacagatctgggtccaaagaggctcggcaggtgcggtgggcacgagggagcgacccccgggtggccgagggactgagggatgcgcgtccagccccggagggcrgcgtccacctgaccccccagcccgagccgccgccgccgcctcccagcccggcctgcgctgccccctggcggtggggccaggagccatcccagcctctaagcccccgaccctacctcggcccccggggctgccgcggaagggcccccaaagcctgctcatagccaagggacaggtatgtggccaaggccccccacagccctgaactggagtgtgtctgaggctccggcaggggccccctcacttgggcgcggagccctgggagtggagagagcggaccccacacctggggccggaccagcc

SEQ ID NO: 26335 - DNA, 601 bp, Human
gtgggaagaatgcatctttctctgaaaagaacttttttatgcgtccataacatgcagcttcaagagaaatcctgcactccccctactttctggagtcttccagacctaatctcagctctgcccctaaacaaatcccttcacctctcccgacctcagtttcccatccaggaaaggagaggataagatcatttctagggaaacactcatggtttctctgattttcaaaatcagaatgccgccaagccagacgctgcaggcaaactggccagggagggaagtaagttaatgggaggctggggcyggtgggtcacacctgtaatttcagcactttgggaggccaacgcaagaggcttgaggccaggagtttgagaccagcctcggcatcaaagtgagaccccatctctaggaaaggtaaaaatattagctgcatgcggcgatgtgcgcctgtagtcccagctactcaggaggctgaggtgggaggatcacttgtgcccaggagtttaaggctgcagtgagccatgattgtgccactgcactccagcctgggtgacagagtaagaccctgtctcaaaaaaagaaggaaaaaaaaagttggcaggag

SEQ ID NO: 26336 - DNA, 601 bp, Human
aacagaagcccagatatcgacaatatggggtgtgtgtgtgtgtgtgtgtgtgtgtgtgtgtgtgtgtgaatgtgtgtacagcagggcacaactggcccccaccatttccttttagtgtcctgaaagtatctcaaatacaaactaataagagtattctaatttttttttttttgagacagggtctcactctgccacccgggttggagtgcagtggcacaatctcggcttactgcgacctccccctcccaggttcaagtgatcctcccacctcagcctcccaagtagctgagaccacaggcayacaccactacacctagctaagtttttgtatttttggtagagacgaggtttcaccatgttgcccaggttggtctagaactcctgagctcaggccatccacctgcctcggcctcccaaagggctgggattacaggtgtaagccactgcacccagccaagtattctaattattattattattattgttttcccttttgctaacaatagtatcttaattctaatattttaatagtttgccacagacaagtgtcatttcctcagtcttataaaaagtgggaagaatgcatctttctctgaaaaga

SEQ ID NO: 26337 - DNA, 601 bp, Human
gctctgggggcctcaaagtcagagatggaaaaaaaaggaaaacagaagaaagaggaaagaggaagagaattccaggcaacagaagcccagatatcgacaatatggggtgtgtgtgtgtgtgtgtgtgtgtgtgtgtgtgtgtgtgaatgtgtgtacagcagggcacaactggcccccaccatttccttttagtgtcctgaaagtatctcaaatacaaactaataagagtattctaatttttttttttttgagacagggtctcactctgccacccgggttggagtgcagtggcacaatctcrgcttactgcgacctccccctcccaggttcaagtgatcctcccacctcagcctcccaagtagctgagaccacaggcatacaccactacacctagctaagtttttgtatttttggtagagacgaggtttcaccatgttgcccaggttggtctagaactcctgagctcaggccatccacctgcctcggcctcccaaagggctgggattacaggtgtaagccactgcacccagccaagtattctaattattattattattattgttttcccttttgctaacaatagtatcttaattctaatatt

SEQ ID NO: 26338 - DNA, 601 bp, Human
gattaacaaacacagacccccaacacacacacaccagccatcttatctccttctagaccactggcccccactgccatcttcctgttcaagttcagcaaaggaagccgagacacaggcctagggtcaccacgaactccatgggcatcctgcagccagaagccatgccgccagaggcagctgcttctccccttcaagcctcagttttctcatctgtaaaaggggcactgtccaccctccaaggttctcggatgattgattccccagctcctctgaatgccccactctgggcccagcctagcarcccagcccttccgctctctgaggtttaactcccctggctgctggccaagcctgctgagggaggcatcaaccacccagggcacggcctcggaagagactctggggctgtctgagggcctgggagccaccttctgaggccccggcccactgaggggcctggctctgggggcctcaaagtcagagatggaaaaaaaaggaaaacagaagaaagaggaaagaggaagagaattccaggcaacagaagcccagatatcgacaatatggggtgtgtgtgtgtgtgtgtgtgtgtgtgtgtgtgtgt

SEQ ID NO: 26339 - DNA, 601 bp, Human
gggctcaagcgatcctcccaagtagctaggactacaggtgcatgccaccagacccggctacttttaaattttttgtagagatgggttttccccatgttgcccaggttggtctcaaactcctgggctcaagcaatccatctgcttcagcctcccaaagtgctgggatttataggcatgagccacggtgaccagccctcctcatgaaaagttaatagcacagatatgctgtgtatctgtttaatgtttggtggcttgcaaaccacagtgttagttgagatttttttgttacacccccctcccyaccctccaccccaccaagaaccaagttacacctgttggaacccaaacttgctggcctgatccagaggcagtaaggtacttggcacaaatgaattcaatgagacctacatctggttagttgaacaactgtctttaaacagttttctaaacacccctgtgtagacagacagattaacaaacacagacccccaacacacacacaccagccatcttatctccttctagaccactggcccccactgccatcttcctgttcaagttcagcaaaggaagccgagacacaggcctagggtcaccacga

SEQ ID NO: 26340 - DNA, 601 bp, Human
ctgagctgtgggttccttagctggaatacaaggacaatggtagcacccgctttttatggggttgttgtgggttgaagagggccagggaaatgctgagtcctcccagaagcctttccagattgccccaggcacgattagtcacctcccgtgtttaaatcatttctgctgttcatttattttctaaaaatgtattcacattgactcctaaacttccagaaggcaggaaccacagctgtcttgctgatcaggccacaggcccaggattcagccgatgggcaggcacacacccctcgcaacactygccccagtggctggcaaccactgtggctgtctgctctgctgcccccaccagaccacaagtttttggagggcaggagctctcctgggtctcctggcatccccaggggcctcactaaatgcctctgcagaagaggacatgtgactgaggcaggggaacgtgcacagaactgcacagcacgtgctgtcttcacacttttcacaccacatttgccagctgacactttccaacctctttccgtcatctacctcaactcacatcagggagtctctgtagacattttttcccacttatcatcgccct

SEQ ID NO: 26341 - DNA, 601 bp, Human
gcagcagcccggaggctgggagaataacacagaaacacggagggtgctggggcccagttcttcaggtaggctgtcactgttgcccacccttcccctacagccatccccacagcctcctgcacccagagacagctggggtggaggagaggctggggcctgaatcccacatttgcccccacttagcggctgtgtaaactcgggcaggttgcttcaccctctctaagcctcagtttcctcattgtaaaaccggcaatattgcttaaaaaaaatcatcatgagaattgaatgagtgtatggaagktcccagacgctggcttccagccgggggtactttatctgaaggactctcttcggcgctgcaggcagatgagcagaggaaatggaggtctcagactcagagggtatggagatggcggcctctctacctcccctgtgggtgtttgggctttgagaaagcagagacctccgtacctgttatgataagacctggtacattcggaaagcccagacctcctttcctgggcccgtctaaagcaaccaccttatcctacatgttcctggtgtcagtgctgaaagtccctcaaccccagaaacccctcac

SEQ ID NO: 26342 - DNA, 601 bp, Human
agcagaatttctttggggtagagttcttatctgggggaagaatctacggcccaaccttggccccactttcctggaggcagggactttaggaagaagccattagcctagagacatatttcatacttatgagcacactcacagctaccaacccccacttgggcagttctctgttcctggaaggcaaagccctcagccacttcctggaagcagagaaggtgggggcaaagttgcaaggcctggtctccctggttcccgggttgggggaggcatcttggtgagtcagggccggacttgcagcagsccggaggctgggagaataacacagaaacacggagggtgctggggcccagttcttcaggtaggctgtcactgttgcccacccttcccctacagccatccccacagcctcctgcacccagagacagctggggtggaggagaggctggggcctgaatcccacatttgcccccacttagcggctgtgtaaactcgggcaggttgcttcaccctctctaagcctcagtttcctcattgtaaaaccggcaatattgcttaaaaaaaatcatcatgagaattgaatgagtgtatggaagttcccaga

SEQ ID NO: 26343 - DNA, 601 bp, Human
catcattcctcgggtgactgtaactcactcacgggcccctcaccttccagccaggttcaatctgatctctttcatatgttagttagaattatgttggtttcttttcttttttttttttttttttttctccaagacagagtctcgctctgttgcccaggatggagtgcagtggcacgaccttggctcactgcaacctccgcctcccgggttcaagcaattctccttcctcagcctcccaagtagctgggactacaggcgcacacaactatgcccagctaatttttgtatttttagtagagayggggtttcgccatgttggtcaggctggtctcaaactcctgaccacaagcaatctgcccacctcggcctcccaaagtgctgggattacagggcgtgggccaccgtgccaggcctatgttggtttcaaatatgcaaatctgatcatatcttaaactaatttatttccatttatttattgacttacttatattagagacagattctcactttgtcgcccagtctggagtgcagtagtgcaattatagctcactgcagcttcgacctcctaggctcaagtgattctctcacctcagcctcctga

SEQ ID NO: 26344 - DNA, 601 bp, Human
gtgagtgacagccacgttctggggcaggattcaggtattcctgcattccctggatataacacccttcagcagcacacaacttttagaatagtgtctgatgcagagtgggcattcaagaatagcacccggacaatttccagtctcttcctttgtacttcattcacatgatttggaggaacgaacagttgctcatcattcctcgggtgactgtaactcactcacgggcccctcaccttccagccaggttcaatctgatctctttcatatgttagttagaattatgttggtttcttttcttttytttttttttttttttctccaagacagagtctcgctctgttgcccaggatggagtgcagtggcacgaccttggctcactgcaacctccgcctcccgggttcaagcaattctccttcctcagcctcccaagtagctgggactacaggcgcacacaactatgcccagctaatttttgtatttttagtagagacggggtttcgccatgttggtcaggctggtctcaaactcctgaccacaagcaatctgcccacctcggcctcccaaagtgctgggattacagggcgtgggccaccgtgccagg

SEQ ID NO: 26345 - DNA, 601 bp, Human
agcatgtctggtctggagcagggactggggacttaggcatccctgacatgcctgggatggagaagatcctcagccagtagcagttattattattactcatcaacatgaataaagccatccaggagggccctttaacttcttctagatggtgcatagaaattgatttgcctccctctccattttggttaagccactttatttgtggacaagacaatccactggggtgtagaaagatttagtgcttctgcttctagttctattaacttttcatgtcactccttttttctttttttttttttttagatggagtcttgctctgtcacccaggctggagtacagtggcgctatctcagctcactgcaacctccacctcccgggttcaagtgattctcctgtctcagcctcctgagaagctgggattacaggcatgcacaaccacacccagctaatttgtgtatttttagtagagacggggtttcactatgttggccaggctggtctcaaactcctggcctcaagttatctgcccaccttggccttccacagttctgggattaggcatgagccactgcgcccgacctcatgtcactccttcttaatt

SEQ ID NO: 26346 - DNA, 601 bp, Human
actgccacagctggaagcatgtctggtctggagcagggactggggacttaggcatccctgacatgcctgggatggagaagatcctcagccagtagcagttattattattactcatcaacatgaataaagccatccaggagggccctttaacttcttctagatggtgcatagaaattgatttgcctccctctccattttggttaagccactttatttgtggacaagacaatccactggggtgtagaaagatttagtgcttctgcttctagttctattaacttttcatgtcactccttttttytttttttttttttttagatggagtcttgctctgtcacccaggctggagtacagtggcgctatctcagctcactgcaacctccacctcccgggttcaagtgattctcctgtctcagcctcctgagaagctgggattacaggcatgcacaaccacacccagctaatttgtgtatttttagtagagacggggtttcactatgttggccaggctggtctcaaactcctggcctcaagttatctgcccaccttggccttccacagttctgggattaggcatgagccactgcgcccgacctcatgt

SEQ ID NO: 26347 - DNA, 601 bp, Human
gggcttagcaagcaccctagaccaccaccctctactgccacagctggaagcatgtctggtctggagcagggactggggacttaggcatccctgacatgcctgggatggagaagatcctcagccagtagcagttattattattactcatcaacatgaataaagccatccaggagggccctttaacttcttctagatggtgcatagaaattgatttgcctccctctccattttggttaagccactttatttgtggacaagacaatccactggggtgtagaaagatttagtgcttctgcttctmgttctattaacttttcatgtcactccttttttctttttttttttttttagatggagtcttgctctgtcacccaggctggagtacagtggcgctatctcagctcactgcaacctccacctcccgggttcaagtgattctcctgtctcagcctcctgagaagctgggattacaggcatgcacaaccacacccagctaatttgtgtatttttagtagagacggggtttcactatgttggccaggctggtctcaaactcctggcctcaagttatctgcccaccttggccttccacagttctggg

SEQ ID NO: 26348 - DNA, 601 bp, Human
caagacagtttcacccttgggcttagcaagcaccctagaccaccaccctctactgccacagctggaagcatgtctggtctggagcagggactggggacttaggcatccctgacatgcctgggatggagaagatcctcagccagtagcagttattattattactcatcaacatgaataaagccatccaggagggccctttaacttcttctagatggtgcatagaaattgatttgcctccctctccattttggttaagccactttatttgtggacaagacaatccactggggtgtagaaagawttagtgcttctgcttctagttctattaacttttcatgtcactccttttttctttttttttttttttagatggagtcttgctctgtcacccaggctggagtacagtggcgctatctcagctcactgcaacctccacctcccgggttcaagtgattctcctgtctcagcctcctgagaagctgggattacaggcatgcacaaccacacccagctaatttgtgtatttttagtagagacggggtttcactatgttggccaggctggtctcaaactcctggcctcaagttatctgcccaccttg

SEQ ID NO: 26349 - DNA, 601 bp, Human
agcggggagagccatgggagatgttagagggacccagagaagatgggggacaggaaaaaggagagaatctgtctcaagtaaatggcctcctgccttggacctcggctgaaatgtggctgggcttcatccgcggagggaggaaagaggtggctccacttgcccgtctgcttggccccaggctgctcttgtcctgtttgggtggccagagttccttccctgaagatccccatccccaggggtctccgaggaagcccagagctgtggaatggggtctgggcactcaggggtggcccaggagagmccgtggaggtggggtcttgccaaaacagatggcagagtgagctaagggaggaagctgtgcagggtgaggtcatccccctcacggtcctccctgggctctggcgtcaggcccgggctcttggccttggacaggcccccattggctgtggcagagggcccctcacccccatcaggcaacagggatgagatgcagaccatctcggtgggggagtaattacgcacggggtacatgtggcccttgcgggagaggcggaccgccagcaccacagtgcacacgaagaagatagtggccaccagcgcc

SEQ ID NO: 26350 - DNA, 601 bp, Human
cagagctggtacctggaaggggtggagaaacagaagtccccacggttcctaaactttctcagccagttttgcagcaatcccaaggctacttgactgaatgaccagtgaaggaaagggcttggttttattttttaaatctttgtcgaacctatgaaaataaacaaaagctgctccaagcattctctcggcctttctgaactttctacgctttgggtttttgttttttcctcccgtctcagaggttaaaaacttcgatagggactcggagtcctcctagaggagagggaagctcccctgttayttaaagcgcaaggctttgtttcaggtatgggaaaggcgaagttggatcccaggaagagcggctccggggaccacagcgagtccctgcgaggccaaggcgcagagctgccgctcccgggccagccccgccgtgcacctgggtcgcgaggggcgctgagcgatacctgggacagaccagacgcgcttaggaatcacgtgcacagcatgcgagcaacctcgggccctcagtccccagcaccgggacccagcggcgggcgggcgtagggtggcgcgggttctcctgcagctccggccgggggat

SEQ ID NO: 26351 - DNA, 601 bp, Human
aggaagtgtgacaatatggaaaggaccaggttacttgcacaaggagagtgaactgtgcttttgggttttccttgtttaggttattttgaaaaaggaaaagtgggagttacacaaacacacatagcaacgttctgtgaatacaatcttgaccaaatagtgaagtcagggtgatccaaacataaagggcacatctctgcccgctccacacactcactgcatctcctctggacacttgaagttcgcctgaaccaatcggccaaggagggctctgcacttctcagggacattttcctcagtcccrtcaattacatttggacttcagtgcctctcagaatggcaggagctcgttggggtgggctctgtgtgtttttaccacggctttcccctatctcagcttttctaacggctgactctggagcagcctgatccagagagagaaagagaaatgtgtgatgcggtattaacctgcgcctcattggtgcgtcttggggctctacaggctgcctctgcaggagaaatccacccagtcatccttctgagaggtggaactaaatcgctgttttcagttgtatttaaaataatgtttaaagcaaatgaacaa

SEQ ID NO: 26352 - DNA, 601 bp, Human
aggaaagaaaaaaacggaaagctctgtgagttttgctagggggtgttaggttctagggcaaccacggactcttcaggaaggaaagccacacagctacactaccagggaaatccgcctcccttggcaaatgcctggggagagctgctcctctgggaagcagcctcggacggatcaggagaccttgttctagcacacctttcaaatgctcaatgtagactgttttaaaaccttgaaaaataagtgggtgtttgtcattgttcttttaaaaatgtgaaaaggaaaaaacatgagattagaatcstaagctcttcacccaatttcacaattcaccctgactagcaatttgctggactgttctaaaatttttttcatttgtttcttttttaactatgtgttttgaaaactactgccttctcagcccgaaaatcgccgtctctctcaggctcactgtggtttcctttttctgacacaaaggcaggcacaggctgcccctccacatgtcttggggatcagatcatgccccgggctcataggaaccgaaactttggggcatctgagactggctgattcagattcaaagacaatcacacggaaagactgt

SEQ ID NO: 26353 - DNA, 601 bp, Human
tctgcagaaatgaaacaaatatatgtaaaaagtgcggggggacaggcaggctgttctgaatttctttgatccataggcaatcaagttcaaaggaaatgtttctttacaggaaagaaaaaaacggaaagctctgtgagttttgctagggggtgttaggttctagggcaaccacggactcttcaggaaggaaagccacacagctacactaccagggaaatccgcctcccttggcaaatgcctggggagagctgctcctctgggaagcagcctcggacggatcaggagaccttgttctagcacrcctttcaaatgctcaatgtagactgttttaaaaccttgaaaaataagtgggtgtttgtcattgttcttttaaaaatgtgaaaaggaaaaaacatgagattagaatcgtaagctcttcacccaatttcacaattcaccctgactagcaatttgctggactgttctaaaatttttttcatttgtttcttttttaactatgtgttttgaaaactactgccttctcagcccgaaaatcgccgtctctctcaggctcactgtggtttcctttttctgacacaaaggcaggcacaggctgcccctc

SEQ ID NO: 26354 - DNA, 601 bp, Human
tcttcaagagttaacagaatctaccatcctttcctccgggtcaggctagggccgcagggggccactttacagcctcactgcagcatcctcactgggtataagcattggcccagagggacaatcataaatgtcctcaaagtgttgcagagaattaagaatccggctttgggggaagaaattaatatgcattttttttagaactacttcctgtacattggacaagaagggtaaagttgtctaagtgaactggcttatatacatcgctgattaaacataagggctttgggaagtatctcagggyacttgggaaaaactgcagagatgttttgcttttgaaactctctcgctggatggggacaccccacccatgtcaactttccatctgcagaaatgaaacaaatatatgtaaaaagtgcggggggacaggcaggctgttctgaatttctttgatccataggcaatcaagttcaaaggaaatgtttctttacaggaaagaaaaaaacggaaagctctgtgagttttgctagggggtgttaggttctagggcaaccacggactcttcaggaaggaaagccacacagctacactaccagggaaatcc

SEQ ID NO: 26355 - DNA, 601 bp, Human
tgacacagcaaccagttactcagagtctgatgagaaaaacagattttaggtttgggaaatgggattactgtaatttacacatccaaatgcaaactggagctctgattgaattctaccctggggagaacttgatgctaacccacaggtaccaagagccaagtgttacacaggatattttaaaaataaaatgtttttggaatcctcacctcccatgctatcttctaagataactacaaatattcttcaaagatttaactgagttctgccaaggacctcccaggactctatccagaatgattaytgtaaagctttacaaatcccaccttggccctagcgataattaggaaatcacaggcaaacctcctctctcggagaccaatgaccaggccaatcagtctgcacattggttttgttagatactttgtggagaaaaacaaaggctcgtgatagtgcagctctgtgcctacagagagcctcccttttggttctgaaattgctgatgtgacagagacaaagctgctatgggtctaaaaccttcaataaagtaactaatgacactcaaggtcctgggactctgagacagacggtggtaaaacccaca

SEQ ID NO: 26356 - DNA, 601 bp, Human
taaccttctctctgatctgaaacacacacaaccaggagaaacacttctggaagttatttataggagcagatggtaaatgggagggtgggggccacgggtagcctgtggtgcctcccaagttctccttcagcccacccacacccagttaccatttgcaagctgttgaactgggaccagaaagcatcactgaagaaactcaagaggagaaagatacatgtggttcaccggaaagggtgagaagtgtatgactgagtgggaaaaaaaagtcacagctcacagtatcattgattaattgagtgaytttagtcaagtgaatattgatacatggctgaaaaagcatgaaaataaaatgaacacgtacgggaattactattaacataagcgataacatcaaaacatctggtaaaatgcagttaaaaaaacaacacaaatgaaatggaatgtaaaacattttcacagtattcaaagcttttgtaagagacttaggatctaaaagaggagtactacaggaagaaactagaggaaacgggaatttcatccatgtcctgtgtatctgctggcaacaggtcagaacggccagtatgttattccctgcaggctg

SEQ ID NO: 26357 - DNA, 601 bp, Human
aaagttaaaaaaattagaaaacccaaccctgcatgtattggttgtctagtacctatggcctcacagcagtagcaataacttattgggataaaagggagaagcagaggctgaggaatgaatcccgggaatcgagccacgggcggaccagaagggggtctatgccgaggctgggctgggcttgctctccagtctggggggagctctgggccttggggcagggaaatgggcaagctggggaaggcagggggtgtggctggaggcactgagaccctaactcctttcctaaggggggctaggatgwcgcgtacaggggcggtggggagaactttcccaaatagcttagcctaatattgagacttccctcttcaaggtgaggccccaccaccgacagaggggagctggagctgacatcaccttctactctgaaacctccgcctcagggtgccctgagcccctccacctttcccttaccctctcctcccctgcctactttctgagaccctgaggtcttcacccagatgaagaagccctgctcctgagagaggaagcccaacatcccagggaccccaggacccctgggtcaaaaaggacagcctgggct

SEQ ID NO: 26358 - DNA, 601 bp, Human
ttcttaggcattccaaggaggtctatgtggccaggccatgggttaagataagggcttctttttgaagctccattctaaacctccctctccccccacctcttgggaaccagctgacaaagaaaccacctggtccaaaccagttattgttttctttgatttaattaaaaagttaaaaaaattagaaaacccaaccctgcatgtattggttgtctagtacctatggcctcacagcagtagcaataacttattgggataaaagggagaagcagaggctgaggaatgaatcccgggaatcgagccrcgggcggaccagaagggggtctatgccgaggctgggctgggcttgctctccagtctggggggagctctgggccttggggcagggaaatgggcaagctggggaaggcagggggtgtggctggaggcactgagaccctaactcctttcctaaggggggctaggatgacgcgtacaggggcggtggggagaactttcccaaatagcttagcctaatattgagacttccctcttcaaggtgaggccccaccaccgacagaggggagctggagctgacatcaccttctactctgaaacctccgcc

SEQ ID NO: 26359 - DNA, 601 bp, Human
aagcaaaacgaggaggctgtgggctcaaaacggtcgggcagggccccttctgcagaaggctggggccagcccttcccgtctgccttggcggtccagatggagcacggctgagagctgcacccaggagtctggcgctcagagacccaggacagggccagcccttggccactcccacccgctggcatttgcctccgcaagagggctccatgccccattacctgcgatcttgggggctgtggtgcaggggaagcccccgttggactgctcaggctctccaaggtcaaagggctcccggggcttsggcttatactcccgcttagggcgtgaggaagcttcccgcatcctgtgaagggagaggcgtgagtggaccgagcccgtgtcacggccgaggcagccccactcttgtatttatgctgctgcctaatgacctggcctgggactgcaggaagaggccgtcagtggggttgtgacacatggaccctgggacacagctagactgggatgtctacccagagggcctccagcctggacccccaccttggaggcatcccagagattgccaagcagctggggcctgccacagcatctacctacaacaccc

SEQ ID NO: 26360 - DNA, 601 bp, Human
ggtggcaggcccacccctgcaccaagacgaggcaaggggctgtagaaagagacatttaatacttctgtttacaaaattcaggcgtacatttcagtttgccctggaccgtgcccaaagctgtgtgctcatctctgcgcccctcatgtacttctgacgaggggggtgcagggcagggcagagcagagcctggggtccggaggcttcactggaccacagggggaggggaatgtgaatgtggcctggcccagagaactccccatttcatcgattttgcattgggcgatagaggaagcagatgtcrgggctgcctgccttggtctagaggagatggctggggccacttcccacagggtgaagtggcagcggctcagcaaggggagcctggccaccaggggctgggacatgcgctcactggaacctttgtgcttggccctcggcagcgcggctgtggtcccgtgtgaggtgtgctggggtgggtgtgggtggctggtggtggcagcttgtgccagagtgacacaggcctccctgggttgggatgggggcagttaaaaagctgaaaaggtacttggctttctgagggcggggcttgggaggcagggcc

SEQ ID NO: 26361 - DNA, 601 bp, Human
ccttgggctcaggagcacctggggtgctggagggacctcctggggtgtgtgtggctttggagccggcccctcaggaaggcggtgggtggcaggcccacccctgcaccaagacgaggcaaggggctgtagaaagagacatttaatacttctgtttacaaaattcaggcgtacatttcagtttgccctggaccgtgcccaaagctgtgtgctcatctctgcgcccctcatgtacttctgacgaggggggtgcagggcagggcagagcagagcctggggtccggaggcttcactggaccacagrgggaggggaatgtgaatgtggcctggcccagagaactccccatttcatcgattttgcattgggcgatagaggaagcagatgtcggggctgcctgccttggtctagaggagatggctggggccacttcccacagggtgaagtggcagcggctcagcaaggggagcctggccaccaggggctgggacatgcgctcactggaacctttgtgcttggccctcggcagcgcggctgtggtcccgtgtgaggtgtgctggggtgggtgtgggtggctggtggtggcagcttgtgccagagtgacac

SEQ ID NO: 26362 - DNA, 601 bp, Human
aaaaatccgtggccaggagaaggggccaggctatcctcaggcagaggcgctgctggcagaggccatgctcaaatttggaagagagcttggagatgattgcaactttggtaacaagtgcttcctcacattgtaattctttcatttgtccatggggattttggtgctggtaagaaattctgtagggaatcggtcaaatcattttatattttggttttcagttttagatcctacacacatgggccaaaaatttgttttcagaattatttcatccgctctaatgtgatttatcttacaagttttsttcccaccccccccactataagacctcagtctttacaacagctttggttgacatatccagatgcctccttggcactttctattgggtgtttctggcagtcattgagtattgaagcagagtgagcaggcacagtcagcatgattcaaagccctccctgcctcatggcctttttcatagatctttgctcacttgtatatggtacctagttctactgcccaaggtgagacatgatttattccttcaccctgtctcccccaaaactcagctaccacacccaacatcttctattttcaccccctt

SEQ ID NO: 26363 - DNA, 601 bp, Human
tagttctactgcccaaggtgagacatgatttattccttcaccctgtctcccccaaaactcagctaccacacccaacatcttctattttcacccccttgtgatgtgggatctccttcctggttgaacccggctatttctggtacttgcttctgctaatagatttgccttaagctagtcccacattagggaaagctggtacttacaagagagggcagggagcttcctaaattgcttcttaaaggaaaaagtaactgttccattcttgatgagaggtatttaccctcttagggggcattgagtstgttgcctggagtgaactgaagatacctattctctcttgtctgttgtctttagaagacaagtggtaatcctttgggttttcatctgtgaagggccctgttattgcgagtgcatttcatctttattctgtaacatgaaagagctttattctctcctaggcccagcacttggtgaggtcggggaggccatgcgggaactgtcggaggtcaaagactctttggacatagaagtgaagcagaacttcattgaccctcttcagaatcttcatgacaaagatcttagggaaattcaagtatgtaca

SEQ ID NO: 26364 - DNA, 601 bp, Human
ttctctatgtttgattttcatattgaatagtttttttcagactttttctccagaggataatatacttttcctgagaatacacagttttgttaattattctatggtttgctgggctgatttcacccactaaaatgttagttgtactagttgttagcttaaataaatagttattctatcactgcataagcacatatttttatttttttccaagtctagaaattagatggatgttatgtgtttttatattaatattttcataatggttgttaggattgaggaagaataccaactagccactttytaaaacatgtagagcagttgagctgtttataataaagttcatatgtctttgagtgtggaatgtttgctcacttttttttatctaacaaatatttgttgagcttttttgaaactttgttgggtgtaaaatggattgccataacttgaactagggcctcctcctccttattctagcttaaatctcctttagcagtaccatttgctcaagattatagagttagtaagtgacagactgaccctaaatccaaaatagaactctgactccaatgctgtaccctatagctcaaatgtttaaaaaaga

SEQ ID NO: 26365 - DNA, 601 bp, Human
catgtagagcagttgagctgtttataataaagttcatatgtctttgagtgtggaatgtttgctcacttttttttatctaacaaatatttgttgagcttttttgaaactttgttgggtgtaaaatggattgccataacttgaactagggcctcctcctccttattctagcttaaatctcctttagcagtaccatttgctcaagattatagagttagtaagtgacagactgaccctaaatccaaaatagaactctgactccaatgctgtaccctatagctcaaatgtttaaaaaagaaagttycttccaaatgagcatttagtttttggatcagggcatggactgaggggcgggggatgcagtgtgagggaaggtttagaatattattcttcctcctttccttttcatttttttaactactccctactttgttttcatttcctttcattctgctccatacatactagtaacaagggaaaatccaggattttccttcatccattagtagtgaaagactagctatcggggaaaaacaatactttttagctttggaaaactactttgctacctggtcactagagatgatgggtggagcctgggcag

SEQ ID NO: 26366 - DNA, 601 bp, Human
aggtttagaatattattcttcctcctttccttttcatttttttaactactccctactttgttttcatttcctttcattctgctccatacatactagtaacaagggaaaatccaggattttccttcatccattagtagtgaaagactagctatcggggaaaaacaatactttttagctttggaaaactactttgctacctggtcactagagatgatgggtggagcctgggcagccatctaccaggtatggtgcaaggaggggattgaagctcagcatggagcattagatataatcccttggwaggtcccttccaagtgagattttgttcttgagttcaattatatgtcaagtgggaggcttaaactaaatcactggatttagtttctctggtgacagctgcatcagtcagctggggcaagtgttaagatgtagattcctaggcccccaccctagatatcgattcaagagctcaggaatccatattgtgatgagcaacttacgtgattctaacagactggatgatttgaaaagcaagactgccatttctatctcacttaatttcaaggaaagagtttttcctctggcttctcatgagatacca

SEQ ID NO: 26367 - DNA, 601 bp, Human
cagcatggagcattagatataatcccttggtaggtcccttccaagtgagattttgttcttgagttcaattatatgtcaagtgggaggcttaaactaaatcactggatttagtttctctggtgacagctgcatcagtcagctggggcaagtgttaagatgtagattcctaggcccccaccctagatatcgattcaagagctcaggaatccatattgtgatgagcaacttacgtgattctaacagactggatgatttgaaaagcaagactgccatttctatctcacttaatttcaaggaaagwgtttttcctctggcttctcatgagataccatttctcttgaagacagggcctgtggggcctgtgagtgtgtcctttcattgtgtgtagggcatgtgcattccttctctgtttctgtcatgggctgcaaaggcttagtccagcttggctttggcctgacaaggccagaaaataaagggcactgatatttcctataatttatcttttattcttaattatttttaaagatattcccccatatttagcctttgaaagcactggccccattgatgcatgtttctttatttctctggtggcgttgta

SEQ ID NO: 26368 - DNA, 601 bp, Human
atcatcgaggcacaacattaatatgttaaaggccataacccttaaaagcattaatatctgattacactatgtgataagaacttcagtagatagttatttattttaaataattgtcagtcataaagtagactgagaaatagaaaagtttcttctgcattcctgtagtttaactagattctcgactgctaatgaatcttaaagtacagatgctccttaacttatgatggggttaaagtcttgaatatatcatgtaatttatcgaataatgcattaaaagtaaaaaacagaatggttgtaaggrtacttgaggtatggtttctactgagcacatatcaattttgcaccatcataaagcctacaaatcgtaaagtcagggaccatctctcttatcaatagtgggaagataaaggatatttctgaggatctatgtataactcaatagaggcctgagaactcagttgtggagcagggggcatcagtagtactggtgcaagtcccagagtccaaaggccagaaagcctagagctgtgacatccaaagacaggagcgtatgggtgtcccttcgctagaagagagagagaacaaacttgcctttcctctg

SEQ ID NO: 26369 - DNA, 601 bp, Human
atagttatttattttaaataattgtcagtcataaagtagactgagaaatagaaaagtttcttctgcattcctgtagtttaactagattctcgactgctaatgaatcttaaagtacagatgctccttaacttatgatggggttaaagtcttgaatatatcatgtaatttatcgaataatgcattaaaagtaaaaaacagaatggttgtaagggtacttgaggtatggtttctactgagcacatatcaattttgcaccatcataaagcctacaaatcgtaaagtcagggaccatctctcttaycaatagtgggaagataaaggatatttctgaggatctatgtataactcaatagaggcctgagaactcagttgtggagcagggggcatcagtagtactggtgcaagtcccagagtccaaaggccagaaagcctagagctgtgacatccaaagacaggagcgtatgggtgtcccttcgctagaagagagagagaacaaacttgcctttcctctgctttttattctatctgggtcctgagctgagtgggtggtctccacccccatagggaagggcagctcttcctttgtttagtctactaagtg

SEQ ID NO: 26370 - DNA, 601 bp, Human
ctattgcatagcccttggcatatccattggcactcttccagaaattttaggaatagtccaatctggctgcataggaaatatgcagtaatacatttcttatggagtcagttgtcaggtagaaactctgttaaaggaatccttttgtctttttttcatttaccttttctttccttccttctcattcttctctataaaactttctttgtatatcccattttctctgtcaatcatcagcacacacgaacacattttgttttgaccctcctttgtggtcgtaaatcgcctttccttgtcagtttgrtctgcgagtgtcatcttttctcctgcgtgttcgctctgaatccagcctgtatgacagtgaatgcccctggacagtgtgtccccatatgcattcgcatataacccacagacagcaagcggctccagaaatgtgctgatgagctggatttcttgagtcacagaagcatatggttaaatatatttgtagaagaagatattttgaaactcgacacttgctgggttttccttcccatgcctcacctctgatcactttatcatgctgtggcactggggttgatataataaaagctagatgacattt

SEQ ID NO: 26371 - DNA, 601 bp, Human
ttctctataaaactttctttgtatatcccattttctctgtcaatcatcagcacacacgaacacattttgttttgaccctcctttgtggtcgtaaatcgcctttccttgtcagtttggtctgcgagtgtcatcttttctcctgcgtgttcgctctgaatccagcctgtatgacagtgaatgcccctggacagtgtgtccccatatgcattcgcatataacccacagacagcaagcggctccagaaatgtgctgatgagctggatttcttgagtcacagaagcatatggttaaatatatttgyagaagaagatattttgaaactcgacacttgctgggttttccttcccatgcctcacctctgatcactttatcatgctgtggcactggggttgatataataaaagctagatgacattttatctcaggaatatcgatgcataccaaatagagcatcctttaccttgtcacacttgctctccactcctacacgcagattacacaacagcctgtgctggagacattttcaacctccacatttgcttgtttgaagtgggaactgtcttatactggatgtggatgttagagataggtagctttcttt

SEQ ID NO: 26372 - DNA, 601 bp, Human
aatcatcagcacacacgaacacattttgttttgaccctcctttgtggtcgtaaatcgcctttccttgtcagtttggtctgcgagtgtcatcttttctcctgcgtgttcgctctgaatccagcctgtatgacagtgaatgcccctggacagtgtgtccccatatgcattcgcatataacccacagacagcaagcggctccagaaatgtgctgatgagctggatttcttgagtcacagaagcatatggttaaatatatttgtagaagaagatattttgaaactcgacacttgctgggttttcyttcccatgcctcacctctgatcactttatcatgctgtggcactggggttgatataataaaagctagatgacattttatctcaggaatatcgatgcataccaaatagagcatcctttaccttgtcacacttgctctccactcctacacgcagattacacaacagcctgtgctggagacattttcaacctccacatttgcttgtttgaagtgggaactgtcttatactggatgtggatgttagagataggtagctttcttttatttttcctgtatccccagtgcttgatgttctactgtaga

SEQ ID NO: 26373 - DNA, 601 bp, Human
ggttgatataataaaagctagatgacattttatctcaggaatatcgatgcataccaaatagagcatcctttaccttgtcacacttgctctccactcctacacgcagattacacaacagcctgtgctggagacattttcaacctccacatttgcttgtttgaagtgggaactgtcttatactggatgtggatgttagagataggtagctttcttttatttttcctgtatccccagtgcttgatgttctactgtagaaaactttttataagatgctctcaggagacttactaagaaaaaaagygaggtctgagccggcaggtggtgctctctgtcctttgcgctcagcacttcagggcatgacataagcagctgtggctcctggagctggccaccaggactagtcacagaaattgtgtatagctatgcttctccctgtctgaaaaccaaccatatatttcacttttcatctggagactcagtaatttgcttctttctctaaataaaaaaataaattacattgtttcctttccagccacctagatggcatgggaactgtgtgcacttgtctgagtctgtatctacatgtgtatgtatgtagtat

SEQ ID NO: 26374 - DNA, 601 bp, Human
gctcctggagctggccaccaggactagtcacagaaattgtgtatagctatgcttctccctgtctgaaaaccaaccatatatttcacttttcatctggagactcagtaatttgcttctttctctaaataaaaaaataaattacattgtttcctttccagccacctagatggcatgggaactgtgtgcacttgtctgagtctgtatctacatgtgtatgtatgtagtattaatacagcgggtcatttggaatagatccctcttaagatatgatttcatccttcattattttactcaaggtggrgtacattatttttgtatgccatagctccagtgcactgcatatatttatgtatgcaacagtttaccttaccaagtataaattacaaaattttttacataatctcatttagtagccacagtagtaatgtgaagtaagtcctactgttacatccaatttcagacagtgaaactgagagcgaagtaccatgtgcaaggtcacagaaagtaaaaacttgaactcagtgttttatattattccgttttcaccacattacagcagttttccagaggctggggttatcattttaaagagtgataaccg

SEQ ID NO: 26375 - DNA, 601 bp, Human
tctttctctaaataaaaaaataaattacattgtttcctttccagccacctagatggcatgggaactgtgtgcacttgtctgagtctgtatctacatgtgtatgtatgtagtattaatacagcgggtcatttggaatagatccctcttaagatatgatttcatccttcattattttactcaaggtggagtacattatttttgtatgccatagctccagtgcactgcatatatttatgtatgcaacagtttaccttaccaagtataaattacaaaattttttacataatctcatttagtagcyacagtagtaatgtgaagtaagtcctactgttacatccaatttcagacagtgaaactgagagcgaagtaccatgtgcaaggtcacagaaagtaaaaacttgaactcagtgttttatattattccgttttcaccacattacagcagttttccagaggctggggttatcattttaaagagtgataaccgaactgttacttaaaagcattctccatgtaattcaccatactttttcagatatgcaaaggttttaaagtgctcagatgagagaattcttgccatgctgtgttattaacctacatc

SEQ ID NO: 26376 - DNA, 601 bp, Human
ttagtagccacagtagtaatgtgaagtaagtcctactgttacatccaatttcagacagtgaaactgagagcgaagtaccatgtgcaaggtcacagaaagtaaaaacttgaactcagtgttttatattattccgttttcaccacattacagcagttttccagaggctggggttatcattttaaagagtgataaccgaactgttacttaaaagcattctccatgtaattcaccatactttttcagatatgcaaaggttttaaagtgctcagatgagagaattcttgccatgctgtgttattarcctacatcattatattcttcttaagtcattgtccctcctatttctgggcattatcacgaaggcaaactataatgaactgtgttgtatgtatcacaagaatagatgtgactgtttttcatactggaaacagaaacaggaatatgcagcaacttccaaaggtccgagaaagcttctgaggattggtagagggcaagatgcccagtgcagtggacactaaggtccagtagcaagaagaagcttcaacaggaagaggaatgagggaggaaagacggggagcagcaagccaggtgggtacagcag

SEQ ID NO: 26377 - DNA, 601 bp, Human
ccaatttcagacagtgaaactgagagcgaagtaccatgtgcaaggtcacagaaagtaaaaacttgaactcagtgttttatattattccgttttcaccacattacagcagttttccagaggctggggttatcattttaaagagtgataaccgaactgttacttaaaagcattctccatgtaattcaccatactttttcagatatgcaaaggttttaaagtgctcagatgagagaattcttgccatgctgtgttattaacctacatcattatattcttcttaagtcattgtccctcctatttatgggcattatcacgaaggcaaactataatgaactgtgttgtatgtatcacaagaatagatgtgactgtttttcatactggaaacagaaacaggaatatgcagcaacttccaaaggtccgagaaagcttctgaggattggtagagggcaagatgcccagtgcagtggacactaaggtccagtagcaagaagaagcttcaacaggaagaggaatgagggaggaaagacggggagcagcaagccaggtgggtacagcaggcagcagattctgtgagttaaataccccttatccttttgtgttc

SEQ ID NO: 26378 - DNA, 601 bp, Human
aaactgagagcgaagtaccatgtgcaaggtcacagaaagtaaaaacttgaactcagtgttttatattattccgttttcaccacattacagcagttttccagaggctggggttatcattttaaagagtgataaccgaactgttacttaaaagcattctccatgtaattcaccatactttttcagatatgcaaaggttttaaagtgctcagatgagagaattcttgccatgctgtgttattaacctacatcattatattcttcttaagtcattgtccctcctatttctgggcattatcacgamggcaaactataatgaactgtgttgtatgtatcacaagaatagatgtgactgtttttcatactggaaacagaaacaggaatatgcagcaacttccaaaggtccgagaaagcttctgaggattggtagagggcaagatgcccagtgcagtggacactaaggtccagtagcaagaagaagcttcaacaggaagaggaatgagggaggaaagacggggagcagcaagccaggtgggtacagcaggcagcagattctgtgagttaaataccccttatccttttgtgttcttctcttctctcctgc

SEQ ID NO: 26379 - DNA, 601 bp, Human
actaaccaaattgatgagaactggtatgaggggatgctgcatggccattcaggcttcttccccatcaattatgtggaaattctggttgccctgccccattaggatgttatgctggctggctcgcctcctcttgacccagatagttacggttaaccactgctttggcaatgctgcttataacacatcccaagtgcaggccgcagtggtccacgtcatccagccccaccaagtgactttggttgacttgtgggctcccacaggagtcatggtgatggatgatatcctcttagcctggtgggcrtggcatgtgctttttaaaacatcatctgagaccagccagtagtcacagaactgctgtttacacagttctcaggaggctgtggtttcttagaatatgaccatgagccatttcacagaaaaaccatcccaccgaagatattgtctatcaccccaggggccatctgaaggtctctttgcatttctccatgcaaagaggagaaagcttttgctttcacactgtcccttcccaaatatgtgagtcatggaattgtcaaagtaagccttccctcaccagcaaattgtctcctgatctgaatgaatt

SEQ ID NO: 26380 - DNA, 601 bp, Human
attgtctatcaccccaggggccatctgaaggtctctttgcatttctccatgcaaagaggagaaagcttttgctttcacactgtcccttcccaaatatgtgagtcatggaattgtcaaagtaagccttccctcaccagcaaattgtctcctgatctgaatgaatttgtctcttaatgcatccatagaaaagtgttaattgtgggttcaaagcattctctgcaaataggcatctcagctcctcacacttatggctatttctgacgtatagccagttttcttccctccttgctattaaagccasagcggtaattccaaattatttttcagtaagacagttaatcagcattattgtgagagggactgaaaagaaattctccattatgaggaattgggaagaaatctggtatccaagcttaaatttcttgctatacagaaactatgtatgtatttaggctatttctgaagggcacagggaagggggaacaaatatcttcacttcagttttatttgtgaattacatgtttcatgaatccatttggcacagagacacaaggaagaaaacactagtaaccatctttccactagttcatatactgagaaa

SEQ ID NO: 26381 - DNA, 601 bp, Human
atttactcaccactcactatatccttgatctcacggggctgatgaagggagaggaagagtcaacagagagatacaggaaacaattccagatagtgacaagggttatgcaggcatcctggggttatgataaggcagtgactggggttgtatgagatgcccgcttagaaatgaatgggcaggggaggcccctgaggagatgacatgtggcctgagaacatgagaaggagccaatcgtgaagagccaaagaaaacatctctgcaaaacaggcagcaagtgcaaaggtcctgaggtaggaatgcrcttgcagtgctcacagagcagaaaggcggcaagaatgacccaggcactgtgagcagcgggcaggaggtaggcccagttcttgtgcccaggaggagaagtttgatttcatccacagcaataagagttttaagagatgttacttgccctgggaaatcttacagacagtcagtcaggttggcgtgaggaggggccagaggagacaagtcaggatgctagtgaagtagttcacacggcaggtggccgcggagatggaggaataatggattctggtggtacttaggagggagcactggcagaatt

SEQ ID NO: 26382 - DNA, 601 bp, Human
aatgcttttctttcttttttttgagacagggtctcaccccgtcacccaggctggagtgccgtggcgcgataatagctcactgctgcctcaaactccagggctcaagcaatccccccaacccccagcctccagagtagctgggactacaggtgcgtgccaccatacctggctattttaaaatcttttctagagacagggtcttaatatgttgcccaggctaatctcgaattcctgagctcaagtgatcctcccaccccacctcccaaagtgtcaggattacaggcgtgagccattgcatccrgcctgattttccttgtgtgtgtgtgtttccttttttttttttggtttttagagacaggttttcactttattgccctgactgaagtgtagtggtgtgatcacggctcactgcagccttaaattcctgggctcaagggatcctcctgcctcggcctcccaagtagtgggcctataggcacgcaccgccatgtctggctcactgattttcatgactggaagagctgacggtaaaactgcagggaaagaataaagatcctcactgcccatgagtggacacactcaaaatacattcctgtttaca

SEQ ID NO: 26383 - DNA, 601 bp, Human
tggaaaccatcagagggtgctgatgggagggccacgctctgactcagggatgtgtgcagacatggatggtgggcagggaggtagctgtccatgctcctgccagacggctctagcaccacttgggcatgtgggaatcccagcattactgctcccagatgccatgcatgccagaggagggcaggcggcagaatctgaggggaggagtgccgtgcagagggcccgactcatccctcatctcccatcagaggaggaaatgggagcaatgcttttctttcttttttttgagacagggtctcacccygtcacccaggctggagtgccgtggcgcgataatagctcactgctgcctcaaactccagggctcaagcaatccccccaacccccagcctccagagtagctgggactacaggtgcgtgccaccatacctggctattttaaaatcttttctagagacagggtcttaatatgttgcccaggctaatctcgaattcctgagctcaagtgatcctcccaccccacctcccaaagtgtcaggattacaggcgtgagccattgcatccagcctgattttccttgtgtgtgtgtgtttccttttttttt

SEQ ID NO: 26384 - DNA, 601 bp, Human
atgctctggtgcagggagtcaggccacagacactcaagtcatcacagagcacagtgtgaggacaggcatcatggagatgaagtggcataggctcatggagctgggggctggtgagggactatttcaggcagggtggccagggaagccttctcaaggtgaggtggctcacgcctgtaatcccagcgctttgggaggccaaggcagttggatcacctgaggtcagttcaaaaccagcctggccaacatggcgaaaccccatctctactaaaaatacaaaaattagccgggcgtggtggtgggygcctgtaatcccagctactcaggaggctgagactggagaatcacttgaacctgggaggcggaggttgcagtgagttaagatcatgccactgcactccagcctggaagacacagcaagactccatctcaaaaaaaaaaaaaaaaaagaaaaagaaaaaagaaaatggaaaaaaaagaagaaagaaaaaaaaagtgacatttcagtgcagacctgcaggaggcaaggagggaagccagagaggagctttcttggtagacaaatcagcagcgaaggccaaggcagaaggctgcctagcgtatt

SEQ ID NO: 26385 - DNA, 601 bp, Human
ggcatctctttggatttgcaaatattttaattcacagaaactcaaggagagggtgggggtgggggctggggtggtgtgttgccgcccttctgtctttatccaggccttctccagcccccgtaagtggcaacagcattctagagacatgcagtggtgtgctagtaccatacacacaacacaaacgacacagccagcaacagtggctgggctggttggtggggggcctctggcacctccaagtctcaggctctgtcacagagcagggcaggtctggtccgctcacagggtcctcacagccacrggatagaggagggacaagtgctcagcccctttgatgggtagctttctggtggtgtagtagtggatgacttccgggacactgtcgaacggagggctgttctgacccagaacgtatttctctttggttttggccagtttcatgtgcataaaaccctggttgctcctgtgaacaaaacacagagttatcagaactacccccctgacactcaggctgaggccaagggtctcctcagctgtctgggacagaagggatcccagccatgaagtggctgtgagctgcacctctccaagccaggaccga

SEQ ID NO: 26386 - DNA, 601 bp, Human
ttgagacagctggagaacaaagagatgtcagccagggagctcccgccccaccctaccccgcccctcggagctggtctgcctttgttcatcctggaaggcatctctttggatttgcaaatattttaattcacagaaactcaaggagagggtgggggtgggggctggggtggtgtgttgccgcccttctgtctttatccaggccttctccagcccccgtaagtggcaacagcattctagagacatgcagtggtgtgctagtaccatacacacaacacaaacgacacagccagcaacagtggcygggctggttggtggggggcctctggcacctccaagtctcaggctctgtcacagagcagggcaggtctggtccgctcacagggtcctcacagccacgggatagaggagggacaagtgctcagcccctttgatgggtagctttctggtggtgtagtagtggatgacttccgggacactgtcgaacggagggctgttctgacccagaacgtatttctctttggttttggccagtttcatgtgcataaaaccctggttgctcctgtgaacaaaacacagagttatcagaactacccccctgaca

SEQ ID NO: 26387 - DNA, 601 bp, Human
ccttaattcaatccaccatgacaaagagcctggagtgccctgggagtctggcctggctttcccctcccccagccctgtggcagccccagttgagtgggaggcaggcaggcaggcgctgggtctgagtacccctctttccccagggaggccatcagtctggtgtgtgaggctgtgccgggtgctaagggggcgacaaggaggagaaaggtacttggggtccttggggatagggatgctgctgggaaatgtggaggggcagtggggaggcaagtgtggggcatgtggggagagggccaggagrcaaaagtgtggtttgcctgtgctgggaaccctcaccttctgagaccctgggccctaccttagccctgtagccgcccgctcagctctatcctggggaggagtaacctgaaatttgctggaatgccaatcactctcaccgtctccaccagcagcctcaacctcatggccgcagactgcaaacaggttggtgaaggtgggcagacggaccagaaacactgatgggggtgctaaggggagatctagttaggaggccaaaatctaggaagagggcttgagagcaggagaccagtagggaaggagg

SEQ ID NO: 26388 - DNA, 601 bp, Human
gaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattggtaagttgcttggatggaggcgggctggggctagggtgggagtggttggttagggcttctggtctcaccttatttttatccctgcagcctgtaggacagcctgttgggggagatccagaagtccgcaaacagrtgccacctccaccaccctgtccaggtatgaagggagccgagataggcagagctggggagtgttggaggcagggctgggatcactgtagagcctccctttcctcagcaggcagagagctttttgatgatccctcctatgtcaacgtccagaacctagacaaggcccggcaagcagtgggtggtgctgggccccccaatcctgctatcaatggcagtgcaccccgggacctgtttgacatgagtgagtgctcgtctctctcctctctgcatccccacctttctacttggttctggcccttct

SEQ ID NO: 26389 - DNA, 601 bp, Human
atccctcctatgtcaacgtccagaacctagacaaggcccggcaagcagtgggtggtgctgggccccccaatcctgctatcaatggcagtgcaccccgggacctgtttgacatgagtgagtgctcgtctctctcctctctgcatccccacctttctacttggttctggcccttctcctgcctatctgctctttccttcctgacttcccttccctgaagtctgggtcttgggtgtgtgttgtgcctgctacttcccctcaccctccctctatacttccagagcccttcgaagatgctcttcgsgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggtgagtgtggcagaggtgtgggtgaggggtggcaaaaaggaaggtacagtaccctacagtgtatccctcttccttccctcattg

SEQ ID NO: 26390 - DNA, 601 bp, Human
atacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttsttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggc

SEQ ID NO: 26391 - DNA, 601 bp, Human
ctggatgttacctgcttaaacttgacaacttttacaggcagtatgacagattttttaaaattcaaataaagcttgcttttgtattccactttcaataataaagcatattgattgactcacaaattaaagtttttaaaaccccattaaagtaaaaatactgcttcagagctttcattggtatgtttttgaaagcaagtgtcatagtcaatgtaaatcttcaaaaatttctctgctatttagtacaacagagggtggattttgtgccagggtggcatcctttgtgtaattcacatggcctgargcttcttgcctttttttcccctagaagagttggaattaagatactaataatcataactgtaataattatcatcatgtttttaaggggttgctgagcctctggagatctcagtgcacagagcgaagcaggagaggcttaaaaaggaaggctctgctgctgatgctgtgatgaccaaggcagcctattattacttttcctcttcaacgtgactgctctgatttttttttcctgatcccgttacaagatgtggggaagccccttaagaattgtgcatagttcgctacagatggtggtctctgt

SEQ ID NO: 26392 - DNA, 601 bp, Human
tggagttgattttcttgttttctacatttagctcttcgattttgaaaccaaacctataggttggagggggaaaaaaaataaaacctagatgttatgactaaaaatttttttaaattacaaaagtacaaagagaaaagagtcgtggtttagacaagaattgggagatacagcaagcaatctttgaattgtataaaacagcctcaaattccaaagttaaacatgtaaattaactacagaaatagaaagatagattttatagactttcacaagatagattactattagtcctgatttcatcttktcacataacagagtccccatggcctaaaactctgcttggtacctgataccaacatgataatggtttagatatttgcccagttaagacctgagaagaatgtgttcattaatagcctgtaatgttaattagcttcatcttaaagaaaaaccaaacaccagagcaaataatgactcctttgcggagaaggagttgtaagggttggggagaggtaattagtgtcataaaagcctcactacaaagaagtttagaatttctctgttctgctgtgcagcagagtgaaacacagtagcagaataattg

SEQ ID NO: 26393 - DNA, 601 bp, Human
tagttttttaaataagtatacctcttctttctgctttgccttcttagcgcatttttaaaaacacacatttaagttggtaactccccccagtctctcgagaatcgtctgggttgtttttccatatttttaaatgtataaaatactttaattttaaaatttgtttttgctccttggttctccaatttcagcttctgccaaatagcagttaagaaataagtttccttcctctttttctctcccgtttgtctttcgatttttttgtttgctcattttttcattgttaacaagatttttttttctrtgcaagagtccatcgttgtagctttgcggtgagccaaactccgcggttccagcactcccctgtccagtctctctccagactcccccaaacccgctcctacaaaacccaattctaggccctcgagtaggaaaacgggcaggagccacggagcctgcgtgcctcgtgagatccctggtcctgcgtggagtctggctttccgagtccaagatgcgataggggacgagggatggtcagtgaggcgggaagagggccggctcccgaggtctcaaaggggtaacggagaagcagcggggcgcggag

SEQ ID NO: 26394 - DNA, 601 bp, Human
taatttctcagagaaatcattgtctgtggcatttttttgtgttaatattatttttctctctcctcgttttaatattttctcttttcttgctcttccatacatggtgggtttaaactcaaagcatctgattcaacgtaaaaggaggcccgcctctctcatcaaatttctcgtattaacgtgaacttcgcagaaaaaggtcagtttcaaaacctgtgaacttcccagctgcgcacttttttcatcttagttttttaaataagtatacctcttctttctgctttgccttcttagcgcatttttwaaaacacacatttaagttggtaactccccccagtctctcgagaatcgtctgggttgtttttccatatttttaaatgtataaaatactttaattttaaaatttgtttttgctccttggttctccaatttcagcttctgccaaatagcagttaagaaataagtttccttcctctttttctctcccgtttgtctttcgatttttttgtttgctcattttttcattgttaacaagatttttttttctatgcaagagtccatcgttgtagctttgcggtgagccaaactccgcggttccagcact

SEQ ID NO: 26395 - DNA, 601 bp, Human
tataatccagggaagaagaccaattagaaaatctagaaaaagatttacatttaaaggacaaagaaaagaacagggaaaagtcagaagggtcagagaccggctagaggagaactaggtgtgcaccatacaatggaaggcaaagggggatggagtttgagggatgttggctgttggtatcaaagtctgcagaggtgggacatattcttgggcagaataaggactgagaagacacctgtgaactgagtagcttggagaacatgatcagttatatcaggggtcagcaagcttttcttaaaaggcyggatagtaaatagttttggctttgagggccatgatgtctgtcacaactactcaactctgctgttgtactgcagaagtaacaatagatagtagtaaatgaacaggcctggctatgttccaacaaaactttatttacaaaatgagggatgcaccagatttgtccttcaagtcatagtgttttgttttgtttttgacggagtcttgctctgttgcccaggctggagtgcagtggcatgatctcggctcactgcaagctccgcctcccaggttcatgccattctcctgcctcagcctcccgagt

SEQ ID NO: 26396 - DNA, 601 bp, Human
gccattctcctgcctcagcctcccgagtagctgggactacaggtgcctgccaccacgcctggctaattttttgtatttttagtagagacagggtttcaccgtgttagccaggatggtctcgatctcctgatctcatgatccgcccacctcggcctcccaaagtgctgggattacaggtgtgagccaccgcgcccggccaagtcatagttttttttttttttaactctgatctatagtatgtctgttttcttcaaccggactcagaatgtaattttccataaatggttgtaggatgtattargctaacttgaaaatataaaagcgtttggtgataaattgtgataaaatttctttcataataatttctagctatttagagttaactacacctagaggcagtggattttgatgtatttatgaatttactaacttgagctgattctgttgaattttctaagcgtgtgattgtataatctgaatacagtgatgcatttattttttcttctcctaatttgcctctttttctgagctctaattctaagttacagagaggtggtagtttcttttttctgcagcctttccccctcgctaggcttgtttg

SEQ ID NO: 26397 - DNA, 601 bp, Human
gctgggatctcagtagttgtggatttctcttggtgatttcttagaggcctatttgagtttgaaagttcaactttcaattagcagggaggtttgacaaacaggatttttttctctttaagtacccaagtcagtttaaagttttctttttaaaaatttgatatataataattgtacatatttatggggtacatgtgatattttggtacatgcatacaatgcgcaatgatcagattgggtaattagaatatccatctcctcaaaaaagttttctcctttgattggcttttttcttttcctttcttttttttttttttgagacagagtcttgctctgttgcccaggctggagtgcagtggcgtgatcttggctcactgcaagctccacctcctgggttcacaccattctcctacctcagcctcccgagtagctgggattacaggcgcctgccaccatactcggctaatttttttgtatttttagtagagacgaggtttcactgtgttagccaggatggtctcgatctcctgacctcgtgatctgcccaccttggcctcccaaagtgctgggattacaggtgtgagccaccgtgcccagcctgatt

SEQ ID NO: 26398 - DNA, 601 bp, Human
ctttctcttgactgaaggtctcagatcctgccaggaggccgtcccagtcttggtcctgctctgtcccttttcccttcagttctatgagatccaagggaaggggcagaaccaggttgggatattgactccctcaggctccttcttgcccggaggttggcaatagctgtgttcctctcctaaaggcaacagctcccgacaggtgtccctcctcagctcagggtctccgctcatcaggccacagtagacctggggtggtaatgacaccctgcagtcatcaaccctggggctttagcctattccrtgttgatttctttaaactctaccccaacttggtaagtagtccttttatgaatctctcaattactccattggagcttctcatctcttttctactgggattctcaccaataatttattcatctgtgaaatggaaaagttgactaactgaagtttctgatggatctgtgtttctcatgcaattactactaatccctttcgaaccagtgactgattctgacaaaatgtgttgtaattctgagttgtgtaaagatatacctcctgccctatgtgcacttcagtgtacctgccctgtaagatgata

SEQ ID NO: 26399 - DNA, 601 bp, Human
tttcagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtgagttcatgtcggggaaaagaccttgcatgtttgtttctagaagagatgagctttttttctggggtctcattcagtcattcgtttgttcatttgttcactaaacaattgctaggattytgctctgcttgtagaccatgccaagttctatctaaaatacagagggaaatcagatagaatcctttttcctgagggcatctattggggaggtcaatcagatgtctgaggcaatattcaatttgtgccagaagggagagacaacctggtgtcataggagagaggacaccttctagctggacagttgcttatagcctcatggaggaagtagtgttcggtaggctttggagaggggagaatttggcagaggaagatggagggaagggaagctatgaacaggggagggaggtgggaaaatgagga

SEQ ID NO: 26400 - DNA, 601 bp, Human
tatcgtaagctgcaccccaatcagcccttttacatcctcaagccccagatgccttgggagctatgggacattcttcaagaaatctccccagaagagattcagccaaaccccccatcctctgggatgcttggtgagttcatgtcggggaaaagaccttgcatgtttgtttctagaagagatgagctttttttctggggtctcattcagtcattcgtttgttcatttgttcactaaacaattgctaggattctgctctgcttgtagaccatgccaagttctatctaaaatacagagggaaatmagatagaatcctttttcctgagggcatctattggggaggtcaatcagatgtctgaggcaatattcaatttgtgccagaagggagagacaacctggtgtcataggagagaggacaccttctagctggacagttgcttatagcctcatggaggaagtagtgttcggtaggctttggagaggggagaatttggcagaggaagatggagggaagggaagctatgaacaggggagggaggtgggaaaatgaggagcggggctgcacctcagacgaggggagcaaggcacttttctcaggtgtaca

SEQ ID NO: 26401 - DNA, 601 bp, Human
ttgtttctagaagagatgagctttttttctggggtctcattcagtcattcgtttgttcatttgttcactaaacaattgctaggattctgctctgcttgtagaccatgccaagttctatctaaaatacagagggaaatcagatagaatcctttttcctgagggcatctattggggaggtcaatcagatgtctgaggcaatattcaatttgtgccagaagggagagacaacctggtgtcataggagagaggacaccttctagctggacagttgcttatagcctcatggaggaagtagtgttcrgtaggctttggagaggggagaatttggcagaggaagatggagggaagggaagctatgaacaggggagggaggtgggaaaatgaggagcggggctgcacctcagacgaggggagcaaggcacttttctcaggtgtacaatttaagggcgtaccccttaaaaactcagtcatcaagataaataatatttcactacagtatcttcagaaaacacaattaatgtaaaaattatgatgagtgaaatatcaagtatttaaataaagataggatcagtaacagtgctgtgcagagtttattggaaca

SEQ ID NO: 26402 - DNA, 601 bp, Human
gatgtctgaggcaatattcaatttgtgccagaagggagagacaacctggtgtcataggagagaggacaccttctagctggacagttgcttatagcctcatggaggaagtagtgttcggtaggctttggagaggggagaatttggcagaggaagatggagggaagggaagctatgaacaggggagggaggtgggaaaatgaggagcggggctgcacctcagacgaggggagcaaggcacttttctcaggtgtacaatttaagggcgtaccccttaaaaactcagtcatcaagataaataatrtttcactacagtatcttcagaaaacacaattaatgtaaaaattatgatgagtgaaatatcaagtatttaaataaagataggatcagtaacagtgctgtgcagagtttattggaacaatgctggccaggggcccccttcttggattttctctacatctcatcattcagactgtggagtgctcctgttccagctgtccctttgcccagctaagggaagaaaagtcttccctccccaacactgtttcatgcaaatgctataaggaaaaatctgctcccaaatagcaccatccaagaggttctg

SEQ ID NO: 26403 - DNA, 601 bp, Human
ctgctcccaaatagcaccatccaagaggttctgcaggatgtcacagtgctagaaagtgctaactacacatgatgccactgtctcctcaatcagctcagtaatcttgtcctctttctccaaataaattattccatggatacattcattggctgattgatggagtcatttaatctactagcatttagggaggatctattattcaccaggccctggcctaggtgctggggattcaaaggtgtataaccctcacacagccctgcatcctaaggaacactgctgggcttggcttgctgaaacttakattgggaatcacagtcataaatagaaactccagagggaaagctctccaaatttggggtcatgagctgctgaacccactgggcagagctctggggtgctggggtgggttgtcaggcatgactcacctctgctcccctctccaggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtg

SEQ ID NO: 26404 - DNA, 601 bp, Human
cagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatamctacccccaaatcttctcctaaccaccatctgttttttttttttaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgca

SEQ ID NO: 26405 - DNA, 601 bp, Human
agggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacmtacccccaaatcttctcctaaccaccatctgttttttttttttaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcag

SEQ ID NO: 26406 - DNA, 601 bp, Human
cactctttgtccttcttccctctcacccagataatcccaaacctgtccttatccaatcacttgctgtctctccttctatacgtggctggtaagcatgtctgggcagaatcacccagcagtgcaggctgctgcccctacaatttggcagtctctgtccctggctgaatatgtctcagcaattccttttcatgctcccgcaggggcctcctgtttttcctggaactgacgtgcacatcaccactctgctcagtccctttaccaagcgtcccctcgtttgaaatttacccctgctcctttgttsccgttttcccactcactcaaagatttaatccgtcttcagatcccacttgctacttacacatgatttgatcaaaaactaagaagaataaggtatagaataaaatgaatccattaaagcatttattcatagagagtggtccttaaggaaaagaacaatttaaaaagccaaaatcacctgactgtacaatctaaaatgagatgtgagattttccactttcccctgctccctttattcacagcagagtgggtatctctgttccgcctgagccttcttggctttgtcctttctcggggcatgttc

SEQ ID NO: 26407 - DNA, 601 bp, Human
ccaagtgagaaaaaaaaatgtctttcaaggagaccaactctgagagggaacttagcccccacaagtacatggcttctcttgaaactctctcaaataaagtttttactcttccctctcccacttagctcagggctcagaggtgacttagcatcttcttggctaccttttttccactcctagactgttactcgtttatacttaaaaataaacaggaatacaaaatctcgctcagctttctgtccttgatgttgctgcagtcttcacccttcctggccacagagtctgctggcacttggttcayagtcatttccacctcagtgaggcttcagggtccacctgaaaggtccctcagagtctatcctcaaggctcctttatttgctccataacaaatgttttctttttctacaacatgtccactcatccccgagataccctgagctctgaaatcttgccctccagaaagccattctttgactttagcttcttcttattccacgtctccttcattcatagccaggagccacaacttacctcacccctgctctgaatgaccccatcatctgaccccatcctttctccttcactcatctcagagcgctc

SEQ ID NO: 26408 - DNA, 601 bp, Human
gaaattactttaatttttttgtatatgtgagcaggcaaaacatacatttgagcataattcaaaaggcaccaaaattatgttccctcattcatgtccccaagccaaccagttccttttgaggatgcaatccctgttaacttttgtctggcaaatcttcccaataaattgaattcaatgatattattttttaaagtactgcttttggctacagagcaaatgtttactttgagaaatgggaaattgattttcagcactagaagatgtgtttgaaaacatttaagcaaagaaaattatgaaattrttatatcctagtcctagaagacactttgaactgtaatctggtatatcactgtgtacaggcagtgctatttttggatgttctctctcactgtatctgtccattacacaccctacagtctaggaccagacatacgacatgctttctaatctacgtttattcattaaatgtttaattttgaatatataatatctcgatacattaagcatgccccaaaatgcatattaagcaatgatttattaatagatctgcaaatggtcaaataattttgaaataatttatcaacttttattactcctataa

SEQ ID NO: 26409 - DNA, 601 bp, Human
tacaaagatgtacacaaaaggcacatttaatacagtcaaattgttttaataaggcataattgtggtgtaaaatgtttcaaagtttgcattatcgctgttggcacaattaacaaatattaatgactaaagtgtcttagcaactgtgctcatgatcctaaaagagatctgatcagagaattaatgagaagtgaatattctttgaattgggatgtggaagtaagtgggaaatgggcttgagagaaagaaatcttaaagcagaaaaatcatgaaattactttaatttttttgtatatgtgagcakgcaaaacatacatttgagcataattcaaaaggcaccaaaattatgttccctcattcatgtccccaagccaaccagttccttttgaggatgcaatccctgttaacttttgtctggcaaatcttcccaataaattgaattcaatgatattattttttaaagtactgcttttggctacagagcaaatgtttactttgagaaatgggaaattgattttcagcactagaagatgtgtttgaaaacatttaagcaaagaaaattatgaaattgttatatcctagtcctagaagacactttgaactg

SEQ ID NO: 26410 - DNA, 601 bp, Human
ataattttagttcctcaactcataaattgataattacaaagatgtacacaaaaggcacatttaatacagtcaaattgttttaataaggcataattgtggtgtaaaatgtttcaaagtttgcattatcgctgttggcacaattaacaaatattaatgactaaagtgtcttagcaactgtgctcatgatcctaaaagagatctgatcagagaattaatgagaagtgaatattctttgaattgggatgtggaagtaagtgggaaatgggcttgagagaaagaaatcttaaagcagaaaaatcaygaaattactttaatttttttgtatatgtgagcaggcaaaacatacatttgagcataattcaaaaggcaccaaaattatgttccctcattcatgtccccaagccaaccagttccttttgaggatgcaatccctgttaacttttgtctggcaaatcttcccaataaattgaattcaatgatattattttttaaagtactgcttttggctacagagcaaatgtttactttgagaaatgggaaattgattttcagcactagaagatgtgtttgaaaacatttaagcaaagaaaattatgaaatt

SEQ ID NO: 26411 - DNA, 601 bp, Human
agactaaaatttggatacttatctcttaaagaagctttgatcttaattgcccttggaagcaggtgagaatcagctatgttacgctaaaactgtaaattctgagtattgctggagagtactgtcaacatgttttgtcattattaaacaaactggttttcatgagtaaatactttgttttcctgtgtgttccatggctcatgtgtctgggtcttttcatatttactgccacagagtaatagcccaataaaaacttgcaggtatttattatcttctagaacagaggtgaatgcttaaaaccatraagataacattttatatgaattttgatgtatttccagaaaataatgacaatacattttggtgtaagttcttctgggtaaactttttctctaagtgcaaatatctgtgacactttcctgtatctcttctctcaggaaaagcacaccaataattttagttcctcaactcataaattgataattacaaagatgtacacaaaaggcacatttaatacagtcaaattgttttaataaggcataattgtggtgtaaaatgtttcaaagtttgcattatcgctgttggcacaattaacaaatattaa

SEQ ID NO: 26412 - DNA, 601 bp, Human
ctttttccaaaatcaaaattataagagtgcattcagggccatgtactattcacttaaatcacagcatgtctgacttgtgtgtgtgtggccaatgggtaggctgattactggtgaaggtataatggctcatcatccaaagaaatgcagtgatccaccatcccagttcagccaaaggaaagagtacaggtgatgtttccctggtgatgggaacagccaccccactcccactcccaaaaccccaccctgccccagttgctctccttggccaccatgtcttatgaatgcttacaatgggaaataygaccactgcgaattcaaatcccatggctttctgcctgtggaacattaggcaagttaattcatttgcctgacttcagtttctccattatacaaaatgaggataatgatttttcctcttttcttgaattgttgttaaggactaaaaaaggtatgtaatataaaaattccccaaccttgatgtgtacacttagtaaatattcaaaaatatcacaggtcagaaatagcatacaaaaataattaaatatgtatttattatctatgaaaatgccaaatgcgcctatagtttccattatgctttctt

SEQ ID NO: 26413 - DNA, 601 bp, Human
atagtagtggtggctgatgggctgctcatgcatattcacagagaagggccagaagccatagatggccacctcttcacagagacccagagctgcgctcaccagaaaaagtcctgtggacaggcgcttggcatggattcctctacttttccagaactttccaatgctacgcagaaagttggggttggcaaacagcactgtttgattggcaccaacatctgacagtgtataataaaccctcaaagatggctctgttcctgtcttcatagaaaaggcaggcatgtagatgtaactgtggttatarattttcatgttgtccacaaatgtctttctggaccacagaaggttctgaaacctattgaagaaaaaaaaaactgttcaattaaacctagagaaaaagaaactcaccaaaacccactctgttgtcttctggtggccctgatacctcaaatcatctcaatgaaacacatgaaaaacactttatttgtatttaaaatcctccttgaacttatcaattatctctcatcaaatagcctgactttttccctgaccccaacttcttaaaacgcagttaacatttgttaatggggctccctctaaacta

SEQ ID NO: 26414 - DNA, 601 bp, Human
ccctaacaactcgagtctgtcttgtttttgaactgcatcttctagatttgaaccatgtgctttaccaacagcatttcaccagcattttactagttgcaaatctgccatgtgctataaagtatttcataggatgtttcatttcttatttgtcctccaagccaacgctgaaagtaaagttttgcttggatcttcattgctcctttcctgtttttccaagggcccatgcaaactcatgaaacaacttgaccattccctcttggagtcacatagaaaacctaacaaaaataccctggttcagtcytttcttcttccattgttcctaggaagtgggctggagtgaggtatcttcacatgggtccagctgcattctcagtgcaccgattttatgaagataccagagttggagaaattcctcgggcatggcatggaagccagaaaagggtaagacgttgtcatagtagtggtggctgatgggctgctcatgcatattcacagagaagggccagaagccatagatggccacctcttcacagagacccagagctgcgctcaccagaaaaagtcctgtggacaggcgcttggcatggattcctctactttt

SEQ ID NO: 26415 - DNA, 601 bp, Human
gccctaacaactcgagtctgtcttgtttttgaactgcatcttctagatttgaaccatgtgctttaccaacagcatttcaccagcattttactagttgcaaatctgccatgtgctataaagtatttcataggatgtttcatttcttatttgtcctccaagccaacgctgaaagtaaagttttgcttggatcttcattgctcctttcctgtttttccaagggcccatgcaaactcatgaaacaacttgaccattccctcttggagtcacatagaaaacctaacaaaaataccctggttcagtmctttcttcttccattgttcctaggaagtgggctggagtgaggtatcttcacatgggtccagctgcattctcagtgcaccgattttatgaagataccagagttggagaaattcctcgggcatggcatggaagccagaaaagggtaagacgttgtcatagtagtggtggctgatgggctgctcatgcatattcacagagaagggccagaagccatagatggccacctcttcacagagacccagagctgcgctcaccagaaaaagtcctgtggacaggcgcttggcatggattcctctacttt

SEQ ID NO: 26416 - DNA, 601 bp, Human
aaaattgggtttatgtcctaaattctgaggaaggaaagtggctcctgttatccagactatgaagcaacacagtctaaattcaataatgcttcacattgtctctgtggacttgacaaaagaggaagaagcaattcttatgtaaaattttaaaaatagaggggagctatagttaatatagacgtggctcaacaaatcacaattatcagcagtaacattttgtatctttattactcaggaagggattttttaaatctacccacccacttccccaaagagggcaaaaataaataataattttttwaaaaaacctacggttctaaagccagtcttaataagacaggttcttattaatattattaagccagtttgtgttgacaatcagcaacacttttaccccaacattttctttgttctaccttgattggttcctcagccctaacaactcgagtctgtcttgtttttgaactgcatcttctagatttgaaccatgtgctttaccaacagcatttcaccagcattttactagttgcaaatctgccatgtgctataaagtatttcataggatgtttcatttcttatttgtcctccaagccaacgctga

SEQ ID NO: 26417 - DNA, 601 bp, Human
caaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgagcttgggccgggccacaggggagcccatccagtacaaagccgccttagagctggaggctgggaccagagcgtgggtggcctctctttccctgctttccctggccccccmccttgacctccatgaggtcagcctgccatgctcctgccaaccccacccttagagacaggggataagcccgactgagaatcagagtactgttctgcagggcctttctgtgttaccttgagcaggtccctcagcctctctggtcctccagtttgccacctccaaagaggcaggacaaggccaggcttgtgtctcccaagccccagacattcacacacctccttatctgtccgccatatctacttgcctctgactctttatctttcctttaatattcatgtttgcttttctaactttaccaaa

SEQ ID NO: 26418 - DNA, 601 bp, Human
acctccttatctgtccgccatatctacttgcctctgactctttatctttcctttaatattcatgtttgcttttctaactttaccaaatgtactccagaaagcaaattctgttacccgctgtagatggaaaactggtatcatttgtcatgctccaaaggtatccaggaataaaaagtacagtgaagatattttttaaatgtagtgactgcacttggttgggttgatgagttggttggtttgggtttttggattttggtttgcttttgtttttgtgtttttgcctgctgaaggctccgagcargaaccctctgacaggtcttctgttacggggttgtgttgaggtcaggcagcacctaacggtggtttcttgctggtgccatgatggggttgaagagaaccggatagggaggaactgctcacggctggtgactgcttgttgtcaaaggcttgtgtgtcagcagagatgggcatgccttgtgctgcccacattagtagaaccaccttttggggaattttcccttagagcctggtttcttaaccttttgtaggtctcaggcccctttgggactgtgatgagtgtcctagacgctccccagaacaa

SEQ ID NO: 26419 - DNA, 601 bp, Human
gaaccggatagggaggaactgctcacggctggtgactgcttgttgtcaaaggcttgtgtgtcagcagagatgggcatgccttgtgctgcccacattagtagaaccaccttttggggaattttcccttagagcctggtttcttaaccttttgtaggtctcaggcccctttgggactgtgatgagtgtcctagacgctccccagaacaaagcacatacactagacccaagttgcccacagtttcaaagggtttatggacccgctgaagccattagtggacaccaggtaggatcccctgccccratgctttgcccccccattcttccccttggtcccgcccccaccggagatgcctaccctctgccccttaccacctcacccttcctagctggtgcttttctgcctcctgccctgggcaggcctggggagggtaggtgaaggccccaacaaagaggcgacgtgtgagtgggtcttaagaggccaagccgtccttgttcaggggacggatgtggaggagacaggcaggcagtaggcacagctgacatgaaggctctgaggcagccgggcgcggtggctcacgcctgtaatcccagcactttggga

SEQ ID NO: 26420 - DNA, 601 bp, Human
cactgttcacagtagcaaagacatggaatcagcctaggtgcccatcggtggtggactggataaagaaaatgtggtgcatatataccatggaagactatgcagccataaagaatagcagtatggcctttgcagcaacgtggatacagctgaaggtcattatcctaagtgaattgatgcagaaacagaaaaacaaataccacgtattcttgcttataggtggaaactcaaccttgggtatacagggacataaagatgggagcaacagacgctggggactccacaaggggcggggagcaagggytgaaagactacctatggcatactgtgttcactacttgggtggcaggaatctatggaagtgcaaacctcagtttcatgcaatattcttctgtcacaaacctgcacctgcaccccctgaatctaaacaagaaaaaagaagcctgtagctacttggcagtagagtgcagcagataaacattcaggttcaggaggctttctgtctgggttcaagtctcattaactccccttgatagttttgtgactttgagaaggtcactttatacttcaattttctcatctatgaaatagaaatatagtcgta

SEQ ID NO: 26421 - DNA, 601 bp, Human
ggactggataaagaaaatgtggtgcatatataccatggaagactatgcagccataaagaatagcagtatggcctttgcagcaacgtggatacagctgaaggtcattatcctaagtgaattgatgcagaaacagaaaaacaaataccacgtattcttgcttataggtggaaactcaaccttgggtatacagggacataaagatgggagcaacagacgctggggactccacaaggggcggggagcaagggctgaaagactacctatggcatactgtgttcactacttgggtggcaggaatctrtggaagtgcaaacctcagtttcatgcaatattcttctgtcacaaacctgcacctgcaccccctgaatctaaacaagaaaaaagaagcctgtagctacttggcagtagagtgcagcagataaacattcaggttcaggaggctttctgtctgggttcaagtctcattaactccccttgatagttttgtgactttgagaaggtcactttatacttcaattttctcatctatgaaatagaaatatagtcgtatgtttacttcacagggttgctatgaagacaaaatgacatagccacgtagaat

SEQ ID NO: 26422 - DNA, 601 bp, Human
gcggggagcaagggctgaaagactacctatggcatactgtgttcactacttgggtggcaggaatctatggaagtgcaaacctcagtttcatgcaatattcttctgtcacaaacctgcacctgcaccccctgaatctaaacaagaaaaaagaagcctgtagctacttggcagtagagtgcagcagataaacattcaggttcaggaggctttctgtctgggttcaagtctcattaactccccttgatagttttgtgactttgagaaggtcactttatacttcaattttctcatctatgaaatagaaatatagtcgtatgtttacttcacagggttgctatgaagacaaaatgacatagccacgtagaatgctttgtacacagtcagcatcaaatgaatggtagcttccttagtcctatgtttagtacttagtatgcacacaaaataatcactgttatgatttaattggcagagacgggagcatatgtgagtctcttcattcggtcatccacgtaaatccatttatccttaagcctttcttccattaaaccactcagtaattagactatccatccattttccatccatctatccatctattcat

SEQ ID NO: 26423 - DNA, 601 bp, Human
ggagcaagggctgaaagactacctatggcatactgtgttcactacttgggtggcaggaatctatggaagtgcaaacctcagtttcatgcaatattcttctgtcacaaacctgcacctgcaccccctgaatctaaacaagaaaaaagaagcctgtagctacttggcagtagagtgcagcagataaacattcaggttcaggaggctttctgtctgggttcaagtctcattaactccccttgatagttttgtgactttgagaaggtcactttatacttcaattttctcatctatgaaatagaaatatagtcgtatgtttacttcacagggttgctatgaagacaaaatgacatagccacgtagaatgctttgtacacagtcagcatcaaatgaatggtagcttccttagtcctatgtttagtacttagtatgcacacaaaataatcactgttatgatttaattggcagagacgggagcatatgtgagtctcttcattcggtcatccacgtaaatccatttatccttaagcctttcttccattaaaccactcagtaattagactatccatccattttccatccatctatccatctattcatcctt

SEQ ID NO: 26424 - DNA, 601 bp, Human
ccaagagggaggtggccagtggtggcgtgctggtaagcccgccctctggaaaaaagtaaaactcaggtttgttgtagcgtttgtccatttcatggtgtcagtgctcccaccatgtttgctttcaagctgtccacagtttaatgaccagctcacagaattcctgaatattgaagagccaggctctcaggagcctacacgagctagccccatccaccacagctttctcatctcaaggtattggcagtcagtgcagatggtagcagataactaatgttgggcttctaataaataggttagctgrtaacaggaggttagccagcaaccgtggtaagagccattagccacagcatggaccctcgctttgcagagggggccacaagcattcccatcagcattgcagggagcttcgtgggcctgccccaaacctacaaactccaaggctgcgttgtaacattatccccagataatccaagagcactttatgggttgagaggcactggcttagattttagctgctaaatcagattaactgagttataactaacatttcagccggcacctccaatgttagttgttcaggaaagcgttagctgataattaa

SEQ ID NO: 26425 - DNA, 601 bp, Human
tagcaatagtggaaatgttaacccataactgaaatgttacctgttactaattagagctgaactgttccctgaaaacctagacactggctgttgtcatggctttgctgatgccaaaggctggtgcgggggtatgttgtgatcacaggtgtgagcctgaacccagggccctaagctataaagaacaaaggcgtttgctcatctgcctttagatagtgccctgtcaacgctttccccagtgactcacatcccaaaagagggaacgtctctttaagatcaaaaaacccccaaaagtcaaaggagygtcttaaggtagcattccagatggagctgtgggcagtgaccttagctgccccagccacacagtggaattgagggttgaggaatgtgtctccctggataaagagcccccaaagaggcaaaatcatagatttgtagagatccaagtaattattccagtcacttaccctgcaagacctgggactccagggttgcaagaggtagaatgggggtgatcctgtgcacccccctccaacacacacagtgccctctgcttgtttcttggggcagaaccaccctgccatcctgaagccaagggtggaag

SEQ ID NO: 26426 - DNA, 601 bp, Human
tgttccctgaaaacctagacactggctgttgtcatggctttgctgatgccaaaggctggtgcgggggtatgttgtgatcacaggtgtgagcctgaacccagggccctaagctataaagaacaaaggcgtttgctcatctgcctttagatagtgccctgtcaacgctttccccagtgactcacatcccaaaagagggaacgtctctttaagatcaaaaaacccccaaaagtcaaaggagcgtcttaaggtagcattccagatggagctgtgggcagtgaccttagctgccccagccacacastggaattgagggttgaggaatgtgtctccctggataaagagcccccaaagaggcaaaatcatagatttgtagagatccaagtaattattccagtcacttaccctgcaagacctgggactccagggttgcaagaggtagaatgggggtgatcctgtgcacccccctccaacacacacagtgccctctgcttgtttcttggggcagaaccaccctgccatcctgaagccaagggtggaagggaagcagtccaggccttggacacctgcccgtgcccaccagtgagcacggtcctgcccggaa

SEQ ID NO: 26427 - DNA, 601 bp, Human
aaagaggcaaaatcatagatttgtagagatccaagtaattattccagtcacttaccctgcaagacctgggactccagggttgcaagaggtagaatgggggtgatcctgtgcacccccctccaacacacacagtgccctctgcttgtttcttggggcagaaccaccctgccatcctgaagccaagggtggaagggaagcagtccaggccttggacacctgcccgtgcccaccagtgagcacggtcctgcccggaacaggcgggagcaggggacatgggtaactcctgcacctccttggagarcaccttcactgtgctaccccggttctctgtctcacaagcacaccattttattcctttctttaaacaatgagaaaactcaggcttagggaggtcaagtgacttgtccaaggtcacttcctcctctctgagcctcagtttcctcctctataaaataggtgatagtagggttaaaatgaggtgtgttaaacacctggcacaatgcttggcacagacggttctgtaaatgctaattctcttctttttttttttttttttttttttttgtaatttgaggtggggtctggctctgttgcccaggct

SEQ ID NO: 26428 - DNA, 601 bp, Human
tgtagagatccaagtaattattccagtcacttaccctgcaagacctgggactccagggttgcaagaggtagaatgggggtgatcctgtgcacccccctccaacacacacagtgccctctgcttgtttcttggggcagaaccaccctgccatcctgaagccaagggtggaagggaagcagtccaggccttggacacctgcccgtgcccaccagtgagcacggtcctgcccggaacaggcgggagcaggggacatgggtaactcctgcacctccttggagagcaccttcactgtgctaccccrgttctctgtctcacaagcacaccattttattcctttctttaaacaatgagaaaactcaggcttagggaggtcaagtgacttgtccaaggtcacttcctcctctctgagcctcagtttcctcctctataaaataggtgatagtagggttaaaatgaggtgtgttaaacacctggcacaatgcttggcacagacggttctgtaaatgctaattctcttctttttttttttttttttttttttttgtaatttgaggtggggtctggctctgttgcccaggctgaaatgcagtggcttgatctc

SEQ ID NO: 26429 - DNA, 601 bp, Human
ctcttctttttttttttttttttttttttttgtaatttgaggtggggtctggctctgttgcccaggctgaaatgcagtggcttgatctcagctcactttctgggctcaagccatcctcaaaccatcctcccacctcagcctcctgagtagctgagaccacaggcacatgccaccatgcccttcttcactctgcctcagtttccccacacagaagtgagaaagtttctgtggagcactggtcctgagcagtgctagagacatcatcacttacttacgcactagtattttttgagcctctacygtgtgccaggtgctttgtagaaacagggctgggggacatgcagtggttcacaaaacagacaaaaattcctgtgctccaggagctgatggcctggcaggaagagtcaggttgtaacaaaacgaatgggaaaaatatataggagtcaaatggggatgcgagctatgggaaaaagtcaagcagagaaggagaatggggagtgttgggagcaattttgaatagggtggccaggcaagacctaccaagaaggtgactctaggcaaagatgtgaaggaagtgaagggctgagccaggtgagtatgt

SEQ ID NO: 26430 - DNA, 601 bp, Human
aatagtgataacggtggcgaaagcgcagtagcctgtgagtgccgggcagcattctcagtgctgctaggtagctcattgaatcctcctcatggtttggagtatgtgcagttattagtcccattttacagatggggaaattcaggttcaaggaggctcattaccttgcccagcatcccacagcttgtcagtggctgtgctgggatttggacccaggcggccccactcccgacctgggtgccccacactcttccgcctcttgtgcccacccccgtgccagcctgaggatgcagtaagtagggcrtgtggcaggcatgtccctgctgtcacagagtggggtctgggaagggggcagagatccagacactcacacaggaagtgcaagccctgcagacgcacaggggaggaggccccggagtgagcatggacattcactgaggctggggctcttcgctgttggcctccggagcagctctttttgcctggttaaaaacaaagcagggggtagtcagagccaggtccttttagctctggatcccccagactgcatgactttgaacaaggccctttcactttctcagcctcaccttccccttatgtgaaa

SEQ ID NO: 26431 - DNA, 601 bp, Human
tcttgtgcccacccccgtgccagcctgaggatgcagtaagtagggcgtgtggcaggcatgtccctgctgtcacagagtggggtctgggaagggggcagagatccagacactcacacaggaagtgcaagccctgcagacgcacaggggaggaggccccggagtgagcatggacattcactgaggctggggctcttcgctgttggcctccggagcagctctttttgcctggttaaaaacaaagcagggggtagtcagagccaggtccttttagctctggatcccccagactgcatgactttgracaaggccctttcactttctcagcctcaccttccccttatgtgaaatgagttagtgaagcccctcaccaacagccagggcgctgaggatccttagggcctgcctaggatctctgggatcaatggcgagccctgctgcccaggcccttacctcccaaaggatgcctggctccccctgctgctgctgctgcccagacacttacctcccaaaggatgcccggctccccctgctgctcagccaccctcttttctactgcccagaggggatggagaaaagttgtccttgtgagtttcctggacag

SEQ ID NO: 26432 - DNA, 601 bp, Human
aggggcttgtcctcggagcagcagattctgcaaagcaagggtggctttcaaacctgctactgtaaaccaaaacccatctgagacagggggctcgatgagcttagaggtttattttgccaaggttgaagatgtgctcaggaaagagactgagccacagtaggatctgtggcctgcactttttccaaagagagttttgagaacctcagtacactaaaggggaggcccagcacagtagctcacacctgtaatcccagcacttgggggagccgaggagggcagattgcttaagttcaggagtccragaccaacctggtcaacatggcaaaaccctgtttctactaaaaaatacaaaaattagctgggcatcgtggcgcgtacctgtagtcccagctactcaggaggctgaggtaggaggatctcttaggcccgggaagttgagactgcagtgagctttgattgcgccattgcactctagcatgggcgacagagaccgtgtcttaaaaaaaaaatgtaaggggaaacagcaggaagggacagaggaacaggtaattcaggtaattatgcacgatgtctctcagcaaatctgcattttccatagggt

SEQ ID NO: 26433 - DNA, 601 bp, Human
ccagctgacccacagcctctctacccctcgacctagagtggcagagtgggaggcaacctcagagctcctacggtcccagccctttacttcctggtggggaaacagtctagagcggacagcggcttcctggaggtctcatggcaagccagcctctaagcttggcttcagacctgagggcctccctactggctgccctctggtcttggggagaatcagtaaactgccagttgtgggaggctttttgctggtctgctatgtgtgggctgtggggcaggtccccattctgttgcttaagcccacrtgaccctgggcaagtgatggactctctctgggcctcagttttattgttgcaaaatggagatagtaatacaacttacctcagagggttagggcacgggccagtgaaaatagacgtcacagcatttggaacagtgctaggcacacagtaagtgctcaataaacgctgcctaggggttgttgggctgagggcagctgagctaagcaggccctgaaagcttcctttttgcccttttccaaagcccctttctcattgtttctactcaaagggatcatggccacaagaatttgctctgtcgagggt

SEQ ID NO: 26434 - DNA, 601 bp, Human
ctaggcacacagtaagtgctcaataaacgctgcctaggggttgttgggctgagggcagctgagctaagcaggccctgaaagcttcctttttgcccttttccaaagcccctttctcattgtttctactcaaagggatcatggccacaagaatttgctctgtcgagggtcgtggtgccagctaggtgaggtttggggctctgtcactattggtcagtgtctgttacatacttgggccccagcagtgccctggcactgcacccccaactccatgggcacatttgtcctgttctcttcatctcartttcctctcctgtaaaatgggtgcattgactgtgcagtggttcctccaaggtcccctgatccccagatgcggcccagggctctgccaaccagtctcaatgtttcaaggtggccaccatgaactttctgcatgtcgaagtaaaacacttcatgcctttctgcacagaggttagccctccacaggctctgggttcaaatcctggattccgttgatgccctgggcacgtccttaaagcccaccaagcctcagtttctccactgtaaaccaccgtcctggggggcatggtgaggatgaagtggg

SEQ ID NO: 26435 - DNA, 601 bp, Human
atacttgggccccagcagtgccctggcactgcacccccaactccatgggcacatttgtcctgttctcttcatctcaatttcctctcctgtaaaatgggtgcattgactgtgcagtggttcctccaaggtcccctgatccccagatgcggcccagggctctgccaaccagtctcaatgtttcaaggtggccaccatgaactttctgcatgtcgaagtaaaacacttcatgcctttctgcacagaggttagccctccacaggctctgggttcaaatcctggattccgttgatgccctgggcamgtccttaaagcccaccaagcctcagtttctccactgtaaaccaccgtcctggggggcatggtgaggatgaagtgggcttgtgcctgggacgttcctactcagccagtgccctgcctgaaacactaggatcgaactgtccattcagccaggcaccttcgaactcctcccaggcataatctctgtctggaaactccttgtgttgaataagatgggaaaatccatccatgagaactgaagccacaaacagcgcttgcaggacaagaggagagaaggtctttgggaggagatggccacatcgtt

SEQ ID NO: 26436 - DNA, 601 bp, Human
gctgtggctcatgcctataatcccagcactttgggaggctgaggcaggtggatcatttgaggccaggagtttgagaccagcctggccaacctggtgaaaccccatctctactaaaaatacaagaattagctgggcatggtggtgggcacccgtaatcccagctactcgagaggctgagccaggagaatcacttgaacccaggaggcggaggttgcagtgagccgagatcgtgccattgcactccagcctgggtgacagcgaggctccgtctcaaatttaaaaaaaaaaaaaaaaaaaaaaagaaatctgtgaggtaggtacctgtatatacccagattacagatgaggcagctgagacccagagtggttaagcaatgtgccaaaggccgcacagcaagtaagacagcaaacctggctccagaactcctgatcctgaccagtgctcccctctgcctctctgagaggatgctcagacttagcagcagcaagtgatgcccatggcctcctgaatccctctcgcccttgcaggtcgtctacttcacagccacttttccattcgccatgctcctggtgctgctggtccgagggctgacgctgccgg

SEQ ID NO: 26437 - DNA, 601 bp, Human
ccatggcctcctgaatccctctcgcccttgcaggtcgtctacttcacagccacttttccattcgccatgctcctggtgctgctggtccgagggctgacgctgccgggcgcgggcgcaggcatcaagttctatctgtatcctgacatcacccgccttgaggacccacaggtactgtggggctgggacacaccatcctccctcccatccagggctgggccggcacaggacagggcaggatgtagaggccactggcagcacatcttccgtggttcttcagtgcacaggtctagctgggccaccrccccctggtacttttccaccgggcctgtggcgggtgtgcctgtccacggtgctgatggacctttctagctgtgtgcatctcttttcatgtcaaggacgtctgagggtggccacttagagaggctgctttaggccctgcaccaagggggagaaatcttctgatgagcaagtctcccgctcggacccagcttctgcccactgcagccacaagggctgctgcatcctggggatgggagagtcggggcctggagagctgcgggcttccttggctgagggtggaattcagagttaatggccttgg

SEQ ID NO: 26438 - DNA, 601 bp, Human
ctcgcccttgcaggtcgtctacttcacagccacttttccattcgccatgctcctggtgctgctggtccgagggctgacgctgccgggcgcgggcgcaggcatcaagttctatctgtatcctgacatcacccgccttgaggacccacaggtactgtggggctgggacacaccatcctccctcccatccagggctgggccggcacaggacagggcaggatgtagaggccactggcagcacatcttccgtggttcttcagtgcacaggtctagctgggccaccgccccctggtacttttccacygggcctgtggcgggtgtgcctgtccacggtgctgatggacctttctagctgtgtgcatctcttttcatgtcaaggacgtctgagggtggccacttagagaggctgctttaggccctgcaccaagggggagaaatcttctgatgagcaagtctcccgctcggacccagcttctgcccactgcagccacaagggctgctgcatcctggggatgggagagtcggggcctggagagctgcgggcttccttggctgagggtggaattcagagttaatggccttggagggtccacgggcagatacc

SEQ ID NO: 26439 - DNA, 601 bp, Human
agggctgctgcatcctggggatgggagagtcggggcctggagagctgcgggcttccttggctgagggtggaattcagagttaatggccttggagggtccacgggcagataccgaaagcacaccttctggcactcagccttgtgaccttggggaggtggagaaagccctgggagattttctgggtttgtttgaggacctgaatccccagggccttccggttgcttcccaagggcctgtgctctccttccccaccacccttccccctggacaggacacagttgtgagaggggttggccagccytggaggacagctgggaacgagctgcttagtgaagattctggagagcagctttgcctgcatagttccttgggacctccttctgcattctaactcgggggtctgcaaacagtaacaacaatggtggtgacagcagccttgacttacgggcttgccatgtaactggcactgggctgaatcgccactctttgaacctgggaaatagctctatggggtagggcaaaggagcccattttatagatgtgaaaactatctataaactgcaggagtgatatttacttgcccactgtcattccagggttg

SEQ ID NO: 26440 - DNA, 601 bp, Human
tgtgttgtgaattaacttgctccctgacatatgtgtaacttagggactgtatgctgctgggatgcctgaacagtggtaccagttttgtgtctggcttcgcaattttttccatcctgggcttcatggcacaagagcaaggggtggacattgctgatgtggctgagtcaggtacggtggtatcggtggcagtggtggtgggcactgccacctagtgtgtaagccaagtactgcaggcatgaagccagaccccagggggctttgaggggggacgagcctggtttctaaaatggaccccccccccgccaccaagatatcccccaaatttcaaagagtacaaaagccaaattttaaacatttttattgcaatttggcccgaggggtggcaaaagcatggggggtggttaagttggggaatttttagctaccttagtgtggtcttccccgcccccccgtccttccccagcaaactcctggtttccacaatagaaaccactttcctaactcaggcccaagtcagccaccaatcggcattccatcaccaccttctcagccttggtttctgtattttgcactttgctcccagcgtgctccctctaagcag

SEQ ID NO: 26441 - DNA, 601 bp, Human
ccctctaagcagacgcattcatccatcccaccgatttctcgtgaatgagtcccaactctgtgtcaggcaccaccgtaggcactgggtgcagtgtgtggggggagggcgtagatgaggggacgacctactgggacggtggcagatccaactgggggtgggttgtaagcacagtgtcgcccctcggggtgtgggccctgttgaccaggcactcttcctcgggctacctggagtcacaggcatggaggatgccagtggcttagaatcacggactctgcacagacggggaacttaggaatctggratcccagagttccagcaaggtgcttctggaacctgagaatcatggggccttcagttgctagaatctgcaatctctcaggtgcctcgattctgggacttggccatggctgcttgaggtcctgggtctgtagctttaattgcagtggcttgggttatgggattccctcaggctcccaggatcctcaaagtccacctttccgacctctccacccttccccggccctgcacagtttacttggagggtggtcatcagttggttttgttattttacatgctgagcccccagccccaccccgtccat

SEQ ID NO: 26442 - DNA, 601 bp, Human
cctcagatgtactgttccctccactgagcccaaagagcccccaaaagcaggccagagactgaggacacagaatgtaactccagaagtccccacgccccttagggagtttggcaattagagtggtgagggggagccagagatgatttatacctcctctgtagatggcttgctttcagctgagggcttgcaaaccaatcgcaattgagtgggaatctccaggagtatggagtgaatttggcaatgggagatacagatagatacatacaatgtatcttcctccatggacaacgaagtattttcrtagacacatatattgtcaatctcagttgttttttcctcccgtccacttcaaacaccttgtcatttattccccacggtgatgtctgaacagccggcacatcaagggtgattatttctctaataagcttttaacaagcaccatattgagtgaagtgcatttgaacaagataattatttagcctaacagagtgcaaacaagacgtggcatggcacattgtctgctagcagagaggcatccagaggttctcggagtggctggattatgtctcctggacttctctctcttgagttcaccatgcac

SEQ ID NO: 26443 - DNA, 601 bp, Human
gatttatacctcctctgtagatggcttgctttcagctgagggcttgcaaaccaatcgcaattgagtgggaatctccaggagtatggagtgaatttggcaatgggagatacagatagatacatacaatgtatcttcctccatggacaacgaagtattttcgtagacacatatattgtcaatctcagttgttttttcctcccgtccacttcaaacaccttgtcatttattccccacggtgatgtctgaacagccggcacatcaagggtgattatttctctaataagcttttaacaagcaccayattgagtgaagtgcatttgaacaagataattatttagcctaacagagtgcaaacaagacgtggcatggcacattgtctgctagcagagaggcatccagaggttctcggagtggctggattatgtctcctggacttctctctcttgagttcaccatgcacttttagagaaagacgctcagaccctctcccagaggctcgcttgagaaaggcaaaactaaaatacagaaacgagcgaattgagaatcttcacaacgtccctggtgggttgggggttgtgggggcccattttgcatctgtctt

SEQ ID NO: 26444 - DNA, 601 bp, Human
ctacccaagagggacacggttttttgtttgttttgagatggagccttgctctgtcgcccaggttagagtgcagtggcgcagccttggcccactgcaacttctgcctcctgggttcaagtgattctcctgcctcagcctcccaagtagctgggattacaggcatgtgccaccatacctggctaattttttttttttttgtagaaacagggttttgtcatgttggccaggctggtctcgaactcctgacctcaggtgatctgcctgccttggcctcccaaagtgctggaattacagacgtgarccactgcacccagctgggacatggttttttttaacaaattgtgagaggagatgagagttggaacccactcctcctgcaaccaaagagctcacccagcccgctgacatgggttaacagttatctcccacttgcagatttactctaataatttcaaatctttctcaacatccctgccaagtggacaagatcctcccatttcacggagaggcaagtgaggctcggagaagccaatcacacagctgttaagcgacggagggctgaagaggctggtggagaagggcagtgttctctggaagcggc

SEQ ID NO: 26445 - DNA, 601 bp, Human
attttttttttttttgtagaaacagggttttgtcatgttggccaggctggtctcgaactcctgacctcaggtgatctgcctgccttggcctcccaaagtgctggaattacagacgtgaaccactgcacccagctgggacatggttttttttaacaaattgtgagaggagatgagagttggaacccactcctcctgcaaccaaagagctcacccagcccgctgacatgggttaacagttatctcccacttgcagatttactctaataatttcaaatctttctcaacatccctgccaagtggrcaagatcctcccatttcacggagaggcaagtgaggctcggagaagccaatcacacagctgttaagcgacggagggctgaagaggctggtggagaagggcagtgttctctggaagcggcaggaactgagaaatgggggtttgtgctggtcttggccctgattcacagcgacactgaccttcctgtctttaatttccccatctcaaaaaaggaaagaacctttgtttttagctccttttgaagcttaagtgtttgagctgccggtttgctataattcggtggcaatttaggttcaaaacccc

SEQ ID NO: 26446 - DNA, 601 bp, Human
aatatgcatatgaagccttttcctctgaagtgcagactttctcccacaaaaataagtaatggtaagagccagtaaccacaacaattggtgagtttatctttggagatgagtttagttggcccacctgtgttctcatcctggtttaatgtttgcttgtgggcagctcttctcagcactctgaccctcagtttccttatctctctccctgaggagctggatacgtcagagataggctgcattcccaggtggtgagatgaggtcaccctcatggagaggaatgggaaacaggcaggcactggcgcaagctcctcctgcttgggagggcccagggcagcatctcttgggactcactcatctgagccacagccctacacgtagggacgggaacaacagcagggccagacgtgcagttggtgcccagtaaaagatgcctgcaggctagtgctctcccttgcccatcaccgactctgctttagaaagatgcatcttcctgtcaaatcccagttactaggtgttgaagagttaggccattttcacattatggaacaatcagaggccaccctgggccctcctcagagatgctgtcattctgactagaagc

SEQ ID NO: 26447 - DNA, 601 bp, Human
aggagctggatacgtcagagataggctgcattcccaggtggtgagatgaggtcaccctcatggagaggaatgggaaacaggcaggcactggctcaagctcctcctgcttgggagggcccagggcagcatctcttgggactcactcatctgagccacagccctacacgtagggacgggaacaacagcagggccagacgtgcagttggtgcccagtaaaagatgcctgcaggctagtgctctcccttgcccatcaccgactctgctttagaaagatgcatcttcctgtcaaatcccagttacyaggtgttgaagagttaggccattttcacattatggaacaatcagaggccaccctgggccctcctcagagatgctgtcattctgactagaagcagaagccccgggagccccgagccagccttaggtgctcttctcacagggaaaggtgggctttgctccctttagaggcacagggctgaccccaccccaccattcatgcatgctgatggccactagccattagcatggacccagggctgggctgtggacaccgaacagggcaaggctcaggtgcccaggcccctgctgctggtggctcaga

SEQ ID NO: 26448 - DNA, 601 bp, Human
tcaggtgcccaggcccctgctgctggtggctcagagatagacatggagggtggcagtgggggaagaaaggctttcatctacgctgctagcacttatggtgcacttgttgtatgtacctggagctgcactgggtgttaaagaactaggacaagacacacacattcctactctcagactcacagtctggcagaacacgtgtgcccaagagatggttacaaccactcgctttctggaaggagaggtatgggtggtgcctgggcaagtaaggcagacccagtggagccaagttaggatgagaagatgtgggggaaagagggccaggcagaggaaacagcccatgccaagacccagagttcagtgacagaggagctagaaggaattcttcagggtggctggagtgtggacacggagggagagttgaggcagatgagggaggaaggggtacagcttctgctgacactcccggctgcaccgaggagtttgggctgcatctgctggcactgggagccacagaagggttttgagcagggaaacgacttactgtgtttttaccggggcgggggggatccttatggcagcagagaggggtgtgagttctgag

SEQ ID NO: 26449 - DNA, 601 bp, Human
gcaaaggccctactctttccaagaaattcttttctcagaatctcccttaaccttttgagcttgggctggctccaagagtgcactgttttgttctgggctgtttttattgttattctcttttaaaaatctggagccaggatgtcctggggccctggctccctgctgggctgggtcctgtttcctcctgggcaggggaatggcctggaggtggtgctggtggcaggggagggaggggagactgaggaagctggcagggcaggaggaaatccttgaaactgggggggcccctggggttatcctrgagcttttgacccattctattttttcagaggacagagggcagcaccccaaccagtctttagccagaacgctaaatggccctatgagctgttaacagactgaaatactgggcctggggacaggcagggaacagtgactgtcccgagccctccaggtgaccccacaatactccaggccaacccaaccagagtttccagaatgtccttactgtccagaagccaaagggttcattagggcacagcaaggggtctctaaaggttctgattggtctaggggtctctgctctgattggtgagtgccc

SEQ ID NO: 26450 - DNA, 601 bp, Human
aagggttcattagggcacagcaaggggtctctaaaggttctgattggtctaggggtctctgctctgattggtgagtgcccaaagcaattacataccattggttcagggggacacccaacaggtcactaacttggtgtccttcaaagcctcattttaaaatattggtccagcccacatttagaagtttgggtggagtggggttggcatgggggaaagaggtgggggagtgggtgagggcaggcttcaccccacactggtaccccgtcctcctgtgccagtctgacttcaccaaaggcccctstgaaggcagttgagccaccatctgtctgtctttctttatgtgcccctcaggggctcccacctgcacaagtcatcaaggtgtcctcccagccatgagcttctctctgagccaggttctggcaaacccagatctctgtcccaggatggttccagctctgcctgagcctcctgtgtaggcagagccccaagtggctgcctgggggtttgactctcctccgccctcccaggcacagcccattgtatggatgtggagaggcaaagtgatggagggagagctggcaggtggctcaggtgagggaag

SEQ ID NO: 26451 - DNA, 601 bp, Human
gcaggcttcaccccacactggtaccccgtcctcctgtgccagtctgacttcaccaaaggcccctgtgaaggcagttgagccaccatctgtctgtctttctttatgtgcccctcaggggctcccacctgcacaagtcatcaaggtgtcctcccagccatgagcttctctctgagccaggttctggcaaacccagatctctgtcccaggatggttccagctctgcctgagcctcctgtgtaggcagagccccaagtggctgcctgggggtttgactctcctccgccctcccaggcacagcccrttgtatggatgtggagaggcaaagtgatggagggagagctggcaggtggctcaggtgagggaagtcatgggggtagggctgggagcaaactggagaaggtgctacaaggaggggacctgggcctggagttgccagatcttgcagcttttcaagaaaagatggaaaactggatttaaaaacaaaaaaaatagagacagggtcttgctcctttgcccaggctggagtgcagtggctcaatcacagcctcaaattcctgggctcaagcaatcttctttcctcagcctcccgagtaacttggac

SEQ ID NO: 26452 - DNA, 601 bp, Human
caggagatcagagagggtgtgagtttaccaaaaaccaaacagcacatgagccaattcaggaggaggcagatggccctggcgaaggggagaccaggccgcctgacgtttcccccctcactcctgtcatccttctccagagagtcaagtacctgctgaccccaagggaacccaaccgctgggctgtggagcgcgagggagccacaccttacaactctcgcaccgtcatgaacggcgctctcgtgaaaccgacccacatcattgtggagaccatgatgtgagctctctcgggtcgacggggccrgcggctttcctgctgtttactaacattagattctcataggaccaggtttacagagctttatatttgcactaggatttttttttttttgtaattgtcacagaaaatgtaattgtgggtatgtgtgcgtgcgtgtgtgtgtgtgtgtgtatcgtgtgtgtgtgttttgttttgatttgggggatattttgtacaaaaagaaaacccacgggaagatgtccgtggagaggcagagctttcatactgaattagatgtattttatgggaatttggtaaatttttctttgtatttttttttttaca

SEQ ID NO: 26453 - DNA, 601 bp, Human
agaccaggccgcctgacgtttcccccctcactcctgtcatccttctccagagagtcaagtacctgctgaccccaagggaacccaaccgctgggctgtggagcgcgagggagccacaccttacaactctcgcaccgtcatgaacggcgctctcgtgaaaccgacccacatcattgtggagaccatgatgtgagctctctcgggtcgacggggccggcggctttcctgctgtttactaacattagattctcataggaccaggtttacagagctttatatttgcactaggatttttttttttttgtaattgtcacagaaaatgtaattgtgggtatgtgtgcgtgcgtgtgtgtgtgtgtgtgtatcgtgtgtgtgtgttttgttttgatttgggggatattttgtacaaaaagaaaacccacgggaagatgtccgtggagaggcagagctttcatactgaattagatgtattttatgggaatttggtaaatttttctttgtatttttttttttacatataagtatatatacacttagagattgtcatatacttttaccacttgaattgatcttcttgccagcaatagatctcattttcaaaag

SEQ ID NO: 26454 - DNA, 601 bp, Human
tcctgtcatccttctccagagagtcaagtacctgctgaccccaagggaacccaaccgctgggctgtggagcgcgagggagccacaccttacaactctcgcaccgtcatgaacggcgctctcgtgaaaccgacccacatcattgtggagaccatgatgtgagctctctcgggtcgacggggccggcggctttcctgctgtttactaacattagattctcataggaccaggtttacagagctttatatttgcactaggatttttttttttttgtaattgtcacagaaaatgtaattgtgggtrtgtgtgcgtgcgtgtgtgtgtgtgtgtgtatcgtgtgtgtgtgttttgttttgatttgggggatattttgtacaaaaagaaaacccacgggaagatgtccgtggagaggcagagctttcatactgaattagatgtattttatgggaatttggtaaatttttctttgtatttttttttttacatataagtatatatacacttagagattgtcatatacttttaccacttgaattgatcttcttgccagcaatagatctcattttcaaaagcaattcttcggtgctgtgtagctggcagaaa

SEQ ID NO: 26455 - DNA, 601 bp, Human
ggacccattagctggcagacccagggggaagaaaggagggctgtgaggagatacctcattaaacttggcttagtgaagaagagagatgccaaaggaatgaaccaacccttcacataaaggagactggctgaagctgaatgaggaggccctatagcagaagtctgattctaagagcagtagaaacttgtaccagaagcaaaatcccacttttaattttgagatggtgagtggatagtcagtagaccgtcagaaccactggccagagagggagctgctagagatccaagaaggctggcaggartgaggctcacaactcagcctcgcaagaggtggcagaggcacaggaggccacagtccttcctggggcattccaggcagagaaggagcagaggctctcccggcaggagctggggtctcagggctcagatgagtctgttgcatttgaatggggtcatagcaggttctggtcattccccaagcaacatctcagcatctcttaaagttgcctgcaggaatgaagcatgacatacctgttgagggactaggggagtggtggggaggtgagtggaccaaaggatataggccccaggcatgcagatgg

SEQ ID NO: 26456 - DNA, 601 bp, Human
gcctaggagagttttctagaaggttgggattgtcagggtcctggcccctcagaactggcttgatcaagggccttatgtggagcagaggttgtctctgaaccaggagagaaggtactatacctttcaaatccccagggcagacacacccccacccagcccctatttggacctaaactgtgccatttgaacagtcacttccaagctcagtctaaatgaaaccgaaacgtgaccacgcacaaaggcagtcactgcctcgaggggtgcagaccgcagaattttcacagcaggggctcttggaacyctggaaacccccttcttaaatttgggaggaggagtatgcctttggtgtccccctcccaaggggcaattctgaaccccatctttggcaggcatacatatttcactgtttccaaagctatctactctgccaaacaacacccagtcctattccaaactctcaacgattctatcttgttcctgtttttctatgtatttatggttgccgtttgtgtctgatttgattttactgttttttccctgattttatggagtagcattgtgacctgttttcctttgtcttatataactttagtaaactaac

SEQ ID NO: 26457 - DNA, 601 bp, Human
tttggacctaaactgtgccatttgaacagtcacttccaagctcagtctaaatgaaaccgaaacgtgaccacgcacaaaggcagtcactgcctcgaggggtgcagaccgcagaattttcacagcaggggctcttggaaccctggaaacccccttcttaaatttgggaggaggagtatgcctttggtgtccccctcccaaggggcaattctgaaccccatctttggcaggcatacatatttcactgtttccaaagctatctactctgccaaacaacacccagtcctattccaaactctcaacrattctatcttgttcctgtttttctatgtatttatggttgccgtttgtgtctgatttgattttactgttttttccctgattttatggagtagcattgtgacctgttttcctttgtcttatataactttagtaaactaaccactgtcaatgattgagggcaggtggcacgtggggaagaggggacttggcacgcagtggctacctgggcatttgtggtcatttcagtttccatctccccagcgggggctccctgggtgaaaggccacagtattttgggttggtaggcaaattgcaacattct

SEQ ID NO: 26458 - DNA, 601 bp, Human
cagtctaaatgaaaccgaaacgtgaccacgcacaaaggcagtcactgcctcgaggggtgcagaccgcagaattttcacagcaggggctcttggaaccctggaaacccccttcttaaatttgggaggaggagtatgcctttggtgtccccctcccaaggggcaattctgaaccccatctttggcaggcatacatatttcactgtttccaaagctatctactctgccaaacaacacccagtcctattccaaactctcaacgattctatcttgttcctgtttttctatgtatttatggttgccrtttgtgtctgatttgattttactgttttttccctgattttatggagtagcattgtgacctgttttcctttgtcttatataactttagtaaactaaccactgtcaatgattgagggcaggtggcacgtggggaagaggggacttggcacgcagtggctacctgggcatttgtggtcatttcagtttccatctccccagcgggggctccctgggtgaaaggccacagtattttgggttggtaggcaaattgcaacattctggacatggcctgaggaaggcctcttcttataagattctcaga

SEQ ID NO: 26459 - DNA, 601 bp, Human
ggaccccaaggcctcgagtcccgctgccttcctaagccgagcccgggctacctcggtcgtccccagcaggcttggctggcagaggccgggcctcgccaggtccccaggacaggccccgcccgggcctcaggtgcactcccggcccgccccgcgccctcgcgtcccgccccagctccgccttcgccggcgccgctctgcctgccagcggggcgcgccttgcggcccaggcccggaaccttccctggtcgtgcgccctatgtaaggccagccgcggcaggaccaaggcggcggtgtcagctckcgagcctaccctccgcggacggtcttgggtcgcctgctgcctggcttgcctggtcggcggcgggtgccccgcgcgcacgcgcaaagcccgccgcgttccccgaccccaggccgcgctctgtgggcctctgagggcggcatgcgggactacgacgaggtgaccgccttcctgggcgagtgggggcccttccagcgcctcatcttcttcctgctcagcgccagcatcatccccaatggcttcaccggcctgtcctccgtgttcctgatagcgaccccggagcaccgctgccgggtgccggac

SEQ ID NO: 26460 - DNA, 601 bp, Human
taagccgagcccgggctacctcggtcgtccccagcaggcttggctggcagaggccgggcctcgccaggtccccaggacaggccccgcccgggcctcaggtgcactcccggcccgccccgcgccctcgcgtcccgccccagctccgccttcgccggcgccgctctgcctgccagcggggcgcgccttgcggcccaggcccggaaccttccctggtcgtgcgccctatgtaaggccagccgcggcaggaccaaggcggcggtgtcagctcgcgagcctaccctccgcggacggtcttgggtckcctgctgcctggcttgcctggtcggcggcgggtgccccgcgcgcacgcgcaaagcccgccgcgttccccgaccccaggccgcgctctgtgggcctctgagggcggcatgcgggactacgacgaggtgaccgccttcctgggcgagtgggggcccttccagcgcctcatcttcttcctgctcagcgccagcatcatccccaatggcttcaccggcctgtcctccgtgttcctgatagcgaccccggagcaccgctgccgggtgccggacgccgcgaacctgagcagcgcctggcgcaacca

SEQ ID NO: 26461 - DNA, 601 bp, Human
ttctttttagaagagaagaaatacttctctttcctgaacttttaaaagttaaataaagcatgtgtatacaactgcctcttccctttttcctctagttactccttcccctaccgtccacaacccaaaaacgacaatctggtcatgccctgtaagtaattgtttgccttttcccatggtcagttgtcagtcttttttttttttttttttttttgagacagagtctccctctgtcaccaggctggagcgcagtcgtgtgttcttggctcactgcaaccttcgcagtcgtgcgttcttggctcastgcaatcttcgccttccgggctcaagtgattctcctgcctcagcctccgagtagctgtgagccacgacgcccagctaatttttgtgtttttagtagagacggggtttcaccgtgttggccaggatggtctcgatctcttgacctcgtgatctgcctgcttctgcctccaaagctgggattacaaccgtgagccaccacgccaggccgtcagttgtcactctttaagatccattcatctgaagatgggttcagggtgacttgttgacctggaatattttctcaggtattatgaggcaaggc

SEQ ID NO: 26462 - DNA, 601 bp, Human
aaagttaaataaagcatgtgtatacaactgcctcttccctttttcctctagttactccttcccctaccgtccacaacccaaaaacgacaatctggtcatgccctgtaagtaattgtttgccttttcccatggtcagttgtcagtcttttttttttttttttttttttgagacagagtctccctctgtcaccaggctggagcgcagtcgtgtgttcttggctcactgcaaccttcgcagtcgtgcgttcttggctcactgcaatcttcgccttccgggctcaagtgattctcctgcctcagyctccgagtagctgtgagccacgacgcccagctaatttttgtgtttttagtagagacggggtttcaccgtgttggccaggatggtctcgatctcttgacctcgtgatctgcctgcttctgcctccaaagctgggattacaaccgtgagccaccacgccaggccgtcagttgtcactctttaagatccattcatctgaagatgggttcagggtgacttgttgacctggaatattttctcaggtattatgaggcaaggctgtcggccagatttagttaaagcatacagccttaggtcataggg

SEQ ID NO: 26463 - DNA, 601 bp, Human
tcttccctttttcctctagttactccttcccctaccgtccacaacccaaaaacgacaatctggtcatgccctgtaagtaattgtttgccttttcccatggtcagttgtcagtcttttttttttttttttttttttgagacagagtctccctctgtcaccaggctggagcgcagtcgtgtgttcttggctcactgcaaccttcgcagtcgtgcgttcttggctcactgcaatcttcgccttccgggctcaagtgattctcctgcctcagcctccgagtagctgtgagccacgacgcccagcwaatttttgtgtttttagtagagacggggtttcaccgtgttggccaggatggtctcgatctcttgacctcgtgatctgcctgcttctgcctccaaagctgggattacaaccgtgagccaccacgccaggccgtcagttgtcactctttaagatccattcatctgaagatgggttcagggtgacttgttgacctggaatattttctcaggtattatgaggcaaggctgtcggccagatttagttaaagcatacagccttaggtcatagggtgtaggggagcctttctcatttctcatcccct

SEQ ID NO: 26464 - DNA, 601 bp, Human
ttcccatggtcagttgtcagtcttttttttttttttttttttttgagacagagtctccctctgtcaccaggctggagcgcagtcgtgtgttcttggctcactgcaaccttcgcagtcgtgcgttcttggctcactgcaatcttcgccttccgggctcaagtgattctcctgcctcagcctccgagtagctgtgagccacgacgcccagctaatttttgtgtttttagtagagacggggtttcaccgtgttggccaggatggtctcgatctcttgacctcgtgatctgcctgcttctgcctscaaagctgggattacaaccgtgagccaccacgccaggccgtcagttgtcactctttaagatccattcatctgaagatgggttcagggtgacttgttgacctggaatattttctcaggtattatgaggcaaggctgtcggccagatttagttaaagcatacagccttaggtcatagggtgtaggggagcctttctcatttctcatccccttggattttccctctgggtggttttgtctgtcccctccgaacctgttggagcagttgttggagctggatgtaggaacatgatgttaatgatg

SEQ ID NO: 26465 - DNA, 601 bp, Human
cgagtagctgtgagccacgacgcccagctaatttttgtgtttttagtagagacggggtttcaccgtgttggccaggatggtctcgatctcttgacctcgtgatctgcctgcttctgcctccaaagctgggattacaaccgtgagccaccacgccaggccgtcagttgtcactctttaagatccattcatctgaagatgggttcagggtgacttgttgacctggaatattttctcaggtattatgaggcaaggctgtcggccagatttagttaaagcatacagccttaggtcatagggtgtrggggagcctttctcatttctcatccccttggattttccctctgggtggttttgtctgtcccctccgaacctgttggagcagttgttggagctggatgtaggaacatgatgttaatgatgtatgtgttttgtgtcttttttagacactggcactctagctccctgaagtttcagcagcattgagtaagtagccagtgaatagccctcattgatagataggctcactaaatgtgcagatgaccaattcgcaggttagagaaggcttcccagaagaggaggcctctcagtgagcctagggtgt

SEQ ID NO: 26466 - DNA, 601 bp, Human
taggtcatagggtgtaggggagcctttctcatttctcatccccttggattttccctctgggtggttttgtctgtcccctccgaacctgttggagcagttgttggagctggatgtaggaacatgatgttaatgatgtatgtgttttgtgtcttttttagacactggcactctagctccctgaagtttcagcagcattgagtaagtagccagtgaatagccctcattgatagataggctcactaaatgtgcagatgaccaattcgcaggttagagaaggcttcccagaagaggaggcctctcmgtgagcctagggtgttcagctcagcataatagtgagctgaaggccccaatgcagcagcaagaaaccacccagcaggacggcggagttcacagagaggggagagttcatagagagggagagtgccacaggccctggcacagcttcaagccctgctggatgttggtgctgagcctcccctcctggagcctcagaggggcttacaggggctctggagatcccaactgtgttgcttcttggcgtcatcacccttcaatggagtctgagagctaccctgggagatccaagtgtgtgtgcatgtgt

SEQ ID NO: 26467 - DNA, 601 bp, Human
gagatcccaactgtgttgcttcttggcgtcatcacccttcaatggagtctgagagctaccctgggagatccaagtgtgtgtgcatgtgtgtgttttttctttttggaaatttgatgtccccagcatttggacctgctttctccacatatatgtagtgggagtgtgaccggagccccactgggatttcttagctagtgacatagcttcagtgtccagaggcatcatggcttgacaaaagaggcactccttggaggtagccaactgtgctttctggcccatgaatccacaggaaattggaacyttcagttgccacaaatcctgggtcctagcctcacaggtgggtgtgttaccttcccggaagccagtgagtactatgaaagcagaggctgtccctgaggttgcaggcagaggccacagaggggaacatgacacaggaatccctacaaattctacttggggctgcctaaagaagagggaagtagtgaagcaagaagaagcacatggcatctcttggagttttacattgacccctgagggttccccggcttactctagtcacttgttcctgctttgctgcctccatcccacattgggctgagtg

SEQ ID NO: 26468 - DNA, 601 bp, Human
gcctgggcgacaaagcgagactccatctcaaaagaataataataatattaataaataaaaatgatttatgaggtaaaagagttttatgcccccatgttccaggaatagtttggtggtccacatggttctcggctggcctctcctctggcccctcagtcatccctggggtactggggaattagccaacccatcatgcagtgcttcttggccatggactgccccatctgctggaaacctgggttgtttctgaggttgtctgggctgtccgctctttggtttcaccatagctctgtccagcctrtggacagacaggttccttgagaaacttccggctgggtgtggtggctcatgcctgtaaacccagcactttgggaggctgaggcaggtggatcacaaggcaggagttcgagaccagcctggccaacatggtgaaacctcgtctccgctaaaaatacaaaaattagccctgcgtggtggcgggtgcctgtaatcccagctactcgggagggaggctgaggcaggagaatttcttgaacctgggaagtgggggttgcagtagccaagatcgcaccattgcatgccagcctgggtgacaagagca

SEQ ID NO: 26469 - DNA, 601 bp, Human
tcctctggcccctcagtcatccctggggtactggggaattagccaacccatcatgcagtgcttcttggccatggactgccccatctgctggaaacctgggttgtttctgaggttgtctgggctgtccgctctttggtttcaccatagctctgtccagcctatggacagacaggttccttgagaaacttccggctgggtgtggtggctcatgcctgtaaacccagcactttgggaggctgaggcaggtggatcacaaggcaggagttcgagaccagcctggccaacatggtgaaacctcgtmtccgctaaaaatacaaaaattagccctgcgtggtggcgggtgcctgtaatcccagctactcgggagggaggctgaggcaggagaatttcttgaacctgggaagtgggggttgcagtagccaagatcgcaccattgcatgccagcctgggtgacaagagcaagactccgtctcaaaaaaaaaaaagaaaaagaaaagaaacttccaagctgctctgcatcgccttgctctccacctgtctgcttctaagaagccctcggcccagtcctgggtgggactcccactccctccccattgtcctg

SEQ ID NO: 26470 - DNA, 601 bp, Human
attagccaacccatcatgcagtgcttcttggccatggactgccccatctgctggaaacctgggttgtttctgaggttgtctgggctgtccgctctttggtttcaccatagctctgtccagcctatggacagacaggttccttgagaaacttccggctgggtgtggtggctcatgcctgtaaacccagcactttgggaggctgaggcaggtggatcacaaggcaggagttcgagaccagcctggccaacatggtgaaacctcgtctccgctaaaaatacaaaaattagccctgcgtggtggygggtgcctgtaatcccagctactcgggagggaggctgaggcaggagaatttcttgaacctgggaagtgggggttgcagtagccaagatcgcaccattgcatgccagcctgggtgacaagagcaagactccgtctcaaaaaaaaaaaagaaaaagaaaagaaacttccaagctgctctgcatcgccttgctctccacctgtctgcttctaagaagccctcggcccagtcctgggtgggactcccactccctccccattgtcctggactagcttttctatcagccttatcttgtgtagagac

SEQ ID NO: 26471 - DNA, 601 bp, Human
acttccggctgggtgtggtggctcatgcctgtaaacccagcactttgggaggctgaggcaggtggatcacaaggcaggagttcgagaccagcctggccaacatggtgaaacctcgtctccgctaaaaatacaaaaattagccctgcgtggtggcgggtgcctgtaatcccagctactcgggagggaggctgaggcaggagaatttcttgaacctgggaagtgggggttgcagtagccaagatcgcaccattgcatgccagcctgggtgacaagagcaagactccgtctcaaaaaaaaaaaagaaaaagaaaagaaacttccaagctgctctgcatcgccttgctctccacctgtctgcttctaagaagccctcggcccagtcctgggtgggactcccactccctccccattgtcctggactagcttttctatcagccttatcttgtgtagagacagatagtcttagaagatgagagagccctcactgttatccccaaagctgcctggaggaaaagccagagcaacctgggagctgggaccggggctgactctgggcagcagagacccgagagacctggagcttgaacctcactgttacgcc

SEQ ID NO: 26472 - DNA, 601 bp, Human
gtgaaacctcgtctccgctaaaaatacaaaaattagccctgcgtggtggcgggtgcctgtaatcccagctactcgggagggaggctgaggcaggagaatttcttgaacctgggaagtgggggttgcagtagccaagatcgcaccattgcatgccagcctgggtgacaagagcaagactccgtctcaaaaaaaaaaaagaaaaagaaaagaaacttccaagctgctctgcatcgccttgctctccacctgtctgcttctaagaagccctcggcccagtcctgggtgggactcccactccctycccattgtcctggactagcttttctatcagccttatcttgtgtagagacagatagtcttagaagatgagagagccctcactgttatccccaaagctgcctggaggaaaagccagagcaacctgggagctgggaccggggctgactctgggcagcagagacccgagagacctggagcttgaacctcactgttacgcctttgttgatttctctcactcaggggacacacagaccctcatccagccttttgcagctatatggcaaggcagagaagccacttgcggggtcccgtggcccactat

SEQ ID NO: 26473 - DNA, 601 bp, Human
ctactcgggagggaggctgaggcaggagaatttcttgaacctgggaagtgggggttgcagtagccaagatcgcaccattgcatgccagcctgggtgacaagagcaagactccgtctcaaaaaaaaaaaagaaaaagaaaagaaacttccaagctgctctgcatcgccttgctctccacctgtctgcttctaagaagccctcggcccagtcctgggtgggactcccactccctccccattgtcctggactagcttttctatcagccttatcttgtgtagagacagatagtcttagaagatgrgagagccctcactgttatccccaaagctgcctggaggaaaagccagagcaacctgggagctgggaccggggctgactctgggcagcagagacccgagagacctggagcttgaacctcactgttacgcctttgttgatttctctcactcaggggacacacagaccctcatccagccttttgcagctatatggcaaggcagagaagccacttgcggggtcccgtggcccactatgcacgtacatagtagacacatctggccatgagtggtcagattgagccactctctagctagctgacacc

SEQ ID NO: 26474 - DNA, 601 bp, Human
actccgtctcaaaaaaaaaaaagaaaaagaaaagaaacttccaagctgctctgcatcgccttgctctccacctgtctgcttctaagaagccctcggcccagtcctgggtgggactcccactccctccccattgtcctggactagcttttctatcagccttatcttgtgtagagacagatagtcttagaagatgagagagccctcactgttatccccaaagctgcctggaggaaaagccagagcaacctgggagctgggaccggggctgactctgggcagcagagacccgagagacctggarcttgaacctcactgttacgcctttgttgatttctctcactcaggggacacacagaccctcatccagccttttgcagctatatggcaaggcagagaagccacttgcggggtcccgtggcccactatgcacgtacatagtagacacatctggccatgagtggtcagattgagccactctctagctagctgacacctgtcatcctgggtcaaatttctgacagttgacacaaagcagggggtcagggagccaaaaaaaaaaaaaatggccaggtgtggtggctcttgcctgtaatcccagggc

SEQ ID NO: 26475 - DNA, 601 bp, Human
atcgccttgctctccacctgtctgcttctaagaagccctcggcccagtcctgggtgggactcccactccctccccattgtcctggactagcttttctatcagccttatcttgtgtagagacagatagtcttagaagatgagagagccctcactgttatccccaaagctgcctggaggaaaagccagagcaacctgggagctgggaccggggctgactctgggcagcagagacccgagagacctggagcttgaacctcactgttacgcctttgttgatttctctcactcaggggacacacataccctcatccagccttttgcagctatatggcaaggcagagaagccacttgcggggtcccgtggcccactatgcacgtacatagtagacacatctggccatgagtggtcagattgagccactctctagctagctgacacctgtcatcctgggtcaaatttctgacagttgacacaaagcagggggtcagggagccaaaaaaaaaaaaaatggccaggtgtggtggctcttgcctgtaatcccagggctttgggaggccaaggtgggcagataacctgaggtcagagttcaagaccagcctg

SEQ ID NO: 26476 - DNA, 601 bp, Human
tcgactttgggcagccaagcaagaactaaagtataccaagatgttgaaggttgatacctttttatttatcgattcattcactcacctatgtaccaaagagctcctgagcctctcttctatacagggggcactgccaggagttgtagaggatgtgatagcaaagataggaaataccttttctctttgctctgacaacggtggggcaaggattcatcattgatttcagcaggaggcaggataaaatgtgtgtaggaatataggaatacatggcaatcagtaacatgtggtacctagcagcatrtctgactgttgatacggtcaggctaggtacatcccctcagggaagaacttctgtcttaggggcacacaccctatcttttttcccttcctgccaattcacaggtaagaacatttagtcccagggaactatgtcatctctctacttctcataactgaaaaagcagtgccaattatgtatgaggtataggagacacaattctccctctttttaaaaatgtttaatagctttattaaggtgtaaatgacataaaaactgcatgtagctaaagcatgcaatttggcacacatgtatctctacacc

SEQ ID NO: 26477 - DNA, 601 bp, Human
cagatatgtggacggattggcaggctgggacccaatctatgtttgcccttgtgttcagttttgagacctagcacctttcctgatcctgctcacagaccccctgcggccaataggaaagaagtgttaatgcatatttgcttttggagggcccaaagccaggcccagagagttgtcaagggcggtcagtggtgggtggatggcagagttaaccaaggagttacacacctgcctagactaaggacaggctggaccaagtagagagggtggggctaagggagcctgagagatgctctggggcctrtctcaaaatgagcactatagtcaccctgtcccctgcagagattgtctgacctggttttaggtcacacccaaccttgccagccaaggagtctttagaagcctgatattgggagacctgtcctggggtctacaaccccagaactcactgcagaagcccacgtggattgctagtctagctcagccatatgggtccccaaccctcacctcatgatagtcctgtgagaaaccgctgctgaccctttgttcatgttttcatcttttccactataaaagacatgctagctgggaaatagagcccatc

SEQ ID NO: 26478 - DNA, 601 bp, Human
ctgagcaccatctctctgtctgaaaaacatttttcatttttctgtgaaccactaagtttcccgtttgggctttcttcctgcttttggctcttgtttaggcaggcgcagccagatccaagcgtctggctgcttccccatgtcttcagacctctttttctgttcatggtaactatagatggaaccacacattggaagctggaaactcaagcggtgcagcctattccttaccccaatccctgttttacaaatggggaaatcaaggcacagcatggggtgatgcttatctgaggttggaagagttaatagtagagtgggagctaaaacccagtttcttacctccaagctcagggctttcagctgtaattgagcctagtatagttggtgtgcagcatcagggattccagctctaaaggtcacaaaaaggacccgggggtcattggcccagggtgggaacctgagcagagcaggtccagatggtgcactctgtgccctggccttagtttcttgctggatgctttggcccgtagagccccagagccctgcttccagaaccactccagtgacgttcatgccaatggcctgaaccccactgagcgagggt

SEQ ID NO: 26479 - DNA, 601 bp, Human
ccccatgtcttcagacctctttttctgttcatggtaactatagatggaaccacacattggaagctggaaactcaagcggtgcagcctattccttaccccaatccctgttttacaaatggggaaatcaaggcacagcatggggtgatgcttatctgaggttggaagagttaatagtagagtgggagctaaaacccagtttcttacctccaagctcagggctttcagctgtaattgagcctagtatagttggtgtgcagcatcagggattccagctctaaaggtcacaaaaaggacccggggktcattggcccagggtgggaacctgagcagagcaggtccagatggtgcactctgtgccctggccttagtttcttgctggatgctttggcccgtagagccccagagccctgcttccagaaccactccagtgacgttcatgccaatggcctgaaccccactgagcgagggtgccctgcctcttccacagccctgggctccgctcagatttttaggagcaagcgttagaggccttgctttctccagggtcagcatgtggacagaacacttactctctgcctgtctctcctcctcaaaatggaag

SEQ ID NO: 26480 - DNA, 601 bp, Human
tctgttcatggtaactatagatggaaccacacattggaagctggaaactcaagcggtgcagcctattccttaccccaatccctgttttacaaatggggaaatcaaggcacagcatggggtgatgcttatctgaggttggaagagttaatagtagagtgggagctaaaacccagtttcttacctccaagctcagggctttcagctgtaattgagcctagtatagttggtgtgcagcatcagggattccagctctaaaggtcacaaaaaggacccgggggtcattggcccagggtgggaaccygagcagagcaggtccagatggtgcactctgtgccctggccttagtttcttgctggatgctttggcccgtagagccccagagccctgcttccagaaccactccagtgacgttcatgccaatggcctgaaccccactgagcgagggtgccctgcctcttccacagccctgggctccgctcagatttttaggagcaagcgttagaggccttgctttctccagggtcagcatgtggacagaacacttactctctgcctgtctctcctcctcaaaatggaagcaagacagtggggcctacaatgc

SEQ ID NO: 26481 - DNA, 601 bp, Human
tttcagctgtaattgagcctagtatagttggtgtgcagcatcagggattccagctctaaaggtcacaaaaaggacccgggggtcattggcccagggtgggaacctgagcagagcaggtccagatggtgcactctgtgccctggccttagtttcttgctggatgctttggcccgtagagccccagagccctgcttccagaaccactccagtgacgttcatgccaatggcctgaaccccactgagcgagggtgccctgcctcttccacagccctgggctccgctcagatttttaggagcaagygttagaggccttgctttctccagggtcagcatgtggacagaacacttactctctgcctgtctctcctcctcaaaatggaagcaagacagtggggcctacaatgctatgaaaaacaggatgggaaagaagcctgctctctgccttcctgcccaggtgagccatcacctgactaagtgagttcacactcagagcgtgtggggatggcaggatgttctgacttcattttccaggatgcctttgctttaaaaccttttaaaaagaagtgaatgatacaccccctttgctcatcttgcagtggaa

SEQ ID NO: 26482 - DNA, 601 bp, Human
acaatctccttgttcttcgtgggtgtgctgttgggctccttcatttcagggcagctgtcagacaggtaaggtgtctgtcttctggagcaccaggggacctcagcactgaggaagaagcgtgtgcctggcccttgatttcagttggtagtattctttcagcgcagggccctgtattttaaagaagaggaagctatgtctgtgatatagactccatgcctagtaagaagagccaacaaatctgactccgtaattcttgctaagtaaagaaacctgagctgtctaagctgaatgtatctgtgayccggttgactaggtaatatgccatgattcacttctgcagtagcctggcttgcctcccctgggtcactgtgactctgtcatgcccctgagcatgggagaggttgacatcatgcacacatgcacatgtgctagattgtagatctgtagtagtgccacggtgtctgcctctgtagtcccaagaagaccagcattctctctgcaaagtgaaaggagctctcaccagccactagtggtatgaaaagcagaactcttttgtccacaaggctgatgccccttagctaagtggcctgtggttttggca

SEQ ID NO: 26483 - DNA, 601 bp, Human
tgactctgtcatgcccctgagcatgggagaggttgacatcatgcacacatgcacatgtgctagattgtagatctgtagtagtgccacggtgtctgcctctgtagtcccaagaagaccagcattctctctgcaaagtgaaaggagctctcaccagccactagtggtatgaaaagcagaactcttttgtccacaaggctgatgccccttagctaagtggcctgtggttttggcatttactttatgacaggagggagaatagtgttttgatccatttcttataagcaggttatttgtataattmtaaagcttttaactcaaggaaacattaacggcttagagaatcccaaacccctcgaaattatatgcacaatgttagagactacatgtgagcatttttttggagagaggtccgtagctttcatgaagttcttagaggggtccattatgttgtgtcttctttccctggagcttcagggtctgtcagagaagactgtgaagagagtagcagccttcagcaagtccttggccacatggcacatgtgagaacaccccacaaatcggtgggttagccggtggaaaggagtcccagcatcttccctgg

SEQ ID NO: 26484 - DNA, 601 bp, Human
ttactttatgacaggagggagaatagtgttttgatccatttcttataagcaggttatttgtataattctaaagcttttaactcaaggaaacattaacggcttagagaatcccaaacccctcgaaattatatgcacaatgttagagactacatgtgagcatttttttggagagaggtccgtagctttcatgaagttcttagaggggtccattatgttgtgtcttctttccctggagcttcagggtctgtcagagaagactgtgaagagagtagcagccttcagcaagtccttggccacatgrcacatgtgagaacaccccacaaatcggtgggttagccggtggaaaggagtcccagcatcttccctggtttttaattcctggcctcaagcaatcctccctccataacctcccaaagtgctgggattacaggcgtgagacaccatgcgcagccagatattttttattgttgttgtttttttttggaaaaggagtttcactcttgttacccaggctggagtgcaatggcacgatctcggctcactgcaacctctgcctcccaggttcaagagattctcctgtctcagcctcccgagttgctgg

SEQ ID NO: 26485 - DNA, 601 bp, Human
ctcccaggttcaagagattctcctgtctcagcctcccgagttgctgggattacaggcatgcaccaccatgcccagctaattttgtatttttaatagagacaaggtttctccatgttggtcaggctggtctcaaactcccgacctcaggtgatccacccacctcggcctcccaaagtgctgggattacaggcgcgagccactgcacctgcccagccagatttttttttaaaaagcaggttaacctgtttattattcctactttacagatggagaaagtgagacagagggattaaataacttscccaaggtttcacagctggcaagtggcagagttaggatttggacccaggtagtcttgctcctctattgtgtatggactactgttctaggtccctgctgtcctaaaacttgctttctagcaaggtggaatgtattaaacaaccaagtgaggaagtcgttgttgtccttggccatggtaagagatacagagaagtgcagggtgccacaggagtgtctaacagaggaggtcaggggcagcatccctgagaaggtgaagcatgagcgagagtgggaagatgagtcgaaagtagccagctgaggg

SEQ ID NO: 26486 - DNA, 601 bp, Human
tgagtcgaaagtagccagctgaggggtagagaggagaaagaacatccaggcagggagaatagcaagtgctaaagccggggctcatgaaaaggcatgggagcaggacaaagtccgtgtggtagaggtgcggagagtggtgttaagatgaaggggagaggcaggcagagccctgggcagatgagcaaccagggcttagtggatcacagttaggactttgggcttcagccacagagcagcggtgggctactgagattttttaaagcaatagtgtgacaatcagatttgtcctttttttttttttaaagatgctttgacaaccttgtgaagaaagaattgaagggaagcaaaaggtgttgtagagagaccaattaaaaggttgtcacagtagttcatgccagagatgatggtggcatggcctagcatgacggtggtagaaatggagggaagtggtaagaggtaaaatcaacaagacttgccgatgggctggatgtcggaattgggggaagaaagctttctggcctgagtaactgggtgaatgaaggtacacttctctaagacagagaatgctggaaaagaaccacgttcatggatattgagttca

SEQ ID NO: 26487 - DNA, 601 bp, Human
atgaggttgcctggggagaggggagtggggaggggaggggggaactgggggaggattgtgctatgcttagaggccacctgagtggacatgggagattccttctcacggagctaagtgacagctgcggctcagaagaatgcccttgatgtgaaaaggagataccccaagttcagagtagaaatgcagtgtatttttctgggtcagctgtgtcatgggtcagcttaagaaccttcttgccatgtgacacaatgattacctgaggaaagcatttaagttccaaaaggtctattcccagggaaastggaaacaaaatttgtgagtgtgtttaggaccactttagtctacagaagggctaatatagtgtttttcaaacctttctaaacattttggccacagaactttcattaaagtaggataatttaagtctagtaaatgaaatacaccctaagtggctaaaagtatggctgttctgcctgcagcccctgccttcaattcccaatgccctgcctcaagcctgtctgtgcccccttggaaggcccagggccctgtgggatggacagcttctgagtgcattacttctgagtaaaccagttctaaaacc

SEQ ID NO: 26488 - DNA, 601 bp, Human
ctgtctcttccctaccatcccagggagctcttaggaagggaaagggcatagagattataccagcctgccttgtggttaggaaccaccccttggttggcatatagaacatgcttgttaaaaaaaccatgcaggggaaagtagagtctactaccaggcgagagtttctcaacctcgaccctattaacattttgagccaaataattttgttctagggcattttcctgggcattttagaatatttaacaacatatctggcctctactcattagatgccagtgaaccccaagtgatggaaaaaaamaacaacaacagaaaaaaacctcttttattgaggaaaaacaccaaactcttccacatagttgcaagaccttgtgcaatttgcctcctagccaccactgtactcttgaattgcacgcctgatgccaaccacactggttcctcatgttcaccatgccccctccagccatgggggtgtgtggtcttctcagagtctgaagcattccccacccaccccaacccaccccctgtggccttctttaaccatgctggctaattcaggatccctagttccttatgactttcctttaaaacgtctaccaga

SEQ ID NO: 26489 - DNA, 601 bp, Human
tcttccacatagttgcaagaccttgtgcaatttgcctcctagccaccactgtactcttgaattgcacgcctgatgccaaccacactggttcctcatgttcaccatgccccctccagccatgggggtgtgtggtcttctcagagtctgaagcattccccacccaccccaacccaccccctgtggccttctttaaccatgctggctaattcaggatccctagttccttatgactttcctttaaaacgtctaccagaaattgggggaaaaaaagtgttattataggattaatgttggtcttccscactatactgtgaatatcattgagagcttggtccctacaccttaaatcccccatcgtcaactattttttcccatctcagtgtcccatgatcaaggagaccctccctgaatgtccagttccccaacccttacccccagtccagggtagcttccttccttgtgcctctcattaacctgcatgccgatccttcagtgcacttgactcagtgtgtaattgtatattcagtagcgtgttgttagattaaaatgtggttaatatgtgtttcaccagttatactatgacactccttaagggcagaaa

SEQ ID NO: 26490 - DNA, 601 bp, Human
ccctacaccttaaatcccccatcgtcaactattttttcccatctcagtgtcccatgatcaaggagaccctccctgaatgtccagttccccaacccttacccccagtccagggtagcttccttccttgtgcctctcattaacctgcatgccgatccttcagtgcacttgactcagtgtgtaattgtatattcagtagcgtgttgttagattaaaatgtggttaatatgtgtttcaccagttatactatgacactccttaagggcagaaacagcatcttttttaatttattgatatccaagtrccctctataatagatgctcaataaacattgaatgaaagtgggtgtcagccagtactggccagactcaaactgaacccactgcttcccactagcttgactttttcctcctgtttgtggcactctctttaaaacaaaccaaaataaacccaattttaaaaactttttaaaatgagcacggatacagaaaaccacacagaacaaatgtgtagcttaatgaatttttttcagagaaataaccttatgaccaccaccaagtcgagcagtagaactttgctgtccactaagaagccctgtccatgt

SEQ ID NO: 26491 - DNA, 601 bp, Human
ctatagaatttcccagtctggatttgttgattgcacactgatgatgcagttcagcacattcctctatgctctgcatttcctcaaaattggcagttggatccagagacttgagattcaggttctgattcaggttcagtccttttggcaagaccataggaagcatgcaattcctgactgtctctttatgatgttaacagtaattagtatataatgcatagatctattaatccattgggggctataaatggtattattctaattttattaccttttcatttaaaagttagaatacttttgtacrtgatactacctcttatctattattggttgctgttcacatagtttacaaaggaaaatcaggacaaatgcttctttctctttatttgccagttttcatttataatgaattgtttctctgttattctccaaatttggcagattcttttttaaaaaaaatatcattatgaatgtatggattaaataattgatgtatttcagtctcttgcaatcattatcataattgtagcattgctttttaggcaaccctggtacccaggctgtacatttgtcatggggagtggggagggggagaaatagcatg

SEQ ID NO: 26492 - DNA, 601 bp, Human
ctataaatggtattattctaattttattaccttttcatttaaaagttagaatacttttgtacatgatactacctcttatctattattggttgctgttcacatagtttacaaaggaaaatcaggacaaatgcttctttctctttatttgccagttttcatttataatgaattgtttctctgttattctccaaatttggcagattcttttttaaaaaaaatatcattatgaatgtatggattaaataattgatgtatttcagtctcttgcaatcattatcataattgtagcattgctttttargcaaccctggtacccaggctgtacatttgtcatggggagtggggagggggagaaatagcatgggcactgtgagaccgagactgtccctggcagccagtattctggcaacactgttcacacccacttactggatggatcttgagaaagccccacttggtggagcccattcctgctgcccttttccagctggttatctgtcactctccttttcttcccaggtttggccggaagaatgtgctgttcgtgaccatgggcatgcagacaggcttcagcttcctgcagatcttctcgaagaatttt

SEQ ID NO: 26493 - DNA, 601 bp, Human
tacctcttatctattattggttgctgttcacatagtttacaaaggaaaatcaggacaaatgcttctttctctttatttgccagttttcatttataatgaattgtttctctgttattctccaaatttggcagattcttttttaaaaaaaatatcattatgaatgtatggattaaataattgatgtatttcagtctcttgcaatcattatcataattgtagcattgctttttaggcaaccctggtacccaggctgtacatttgtcatggggagtggggagggggagaaatagcatgggcactktgagaccgagactgtccctggcagccagtattctggcaacactgttcacacccacttactggatggatcttgagaaagccccacttggtggagcccattcctgctgcccttttccagctggttatctgtcactctccttttcttcccaggtttggccggaagaatgtgctgttcgtgaccatgggcatgcagacaggcttcagcttcctgcagatcttctcgaagaattttgagatgtttgtcgtgctgtttgtccttgtaggcatgggccagatctccaactatgtggcagcatttgtc

SEQ ID NO: 26494 - DNA, 601 bp, Human
ccacttggtggagcccattcctgctgcccttttccagctggttatctgtcactctccttttcttcccaggtttggccggaagaatgtgctgttcgtgaccatgggcatgcagacaggcttcagcttcctgcagatcttctcgaagaattttgagatgtttgtcgtgctgtttgtccttgtaggcatgggccagatctccaactatgtggcagcatttgtcctgggtatggccatcaggttggagttgagtacttgatcctgtatttcaccatcatcccatcacctacctttctggagacarctgtgatgtccctcaagggggacagggtttctaacaaaactagccagagcttcctggtgaaccttacttacaggcagggaaactgagccagacatgagaccagcctggggtccccagcagcacaatggcctgacttctgatttccagttcttttctggcctctgggctgtggctccttggtcttagtacttgatggtcaatttactaggactcaccagagatcctccatttacaaaaagggcctgccactgcacagggctgagccagccccagaaagagggcggcatggttggaggagga

SEQ ID NO: 26495 - DNA, 601 bp, Human
atctccaactatgtggcagcatttgtcctgggtatggccatcaggttggagttgagtacttgatcctgtatttcaccatcatcccatcacctacctttctggagacagctgtgatgtccctcaagggggacagggtttctaacaaaactagccagagcttcctggtgaaccttacttacaggcagggaaactgagccagacatgagaccagcctggggtccccagcagcacaatggcctgacttctgatttccagttcttttctggcctctgggctgtggctccttggtcttagtacttgrtggtcaatttactaggactcaccagagatcctccatttacaaaaagggcctgccactgcacagggctgagccagccccagaaagagggcggcatggttggaggaggaggggctgtgactggcaagcttgctaaggtagagaaccccttgtctgcagagcactgtggctggtgatatctacggacaagaataaattgataggaaggggctttcgtcaccttcagggttttaattcagagtgcacactgcagggctttgtctcaaatgtgccagcctgttgtcactgagaagctgccaggcc

SEQ ID NO: 26496 - DNA, 601 bp, Human
ctccaactatgtggcagcatttgtcctgggtatggccatcaggttggagttgagtacttgatcctgtatttcaccatcatcccatcacctacctttctggagacagctgtgatgtccctcaagggggacagggtttctaacaaaactagccagagcttcctggtgaaccttacttacaggcagggaaactgagccagacatgagaccagcctggggtccccagcagcacaatggcctgacttctgatttccagttcttttctggcctctgggctgtggctccttggtcttagtacttgatrgtcaatttactaggactcaccagagatcctccatttacaaaaagggcctgccactgcacagggctgagccagccccagaaagagggcggcatggttggaggaggaggggctgtgactggcaagcttgctaaggtagagaaccccttgtctgcagagcactgtggctggtgatatctacggacaagaataaattgataggaaggggctttcgtcaccttcagggttttaattcagagtgcacactgcagggctttgtctcaaatgtgccagcctgttgtcactgagaagctgccaggccgg

SEQ ID NO: 26497 - DNA, 601 bp, Human
aaagcaagagtcctcagggtagccacatggaggaagccaggctccttctgcaccaccaaggtagaggagttgaacaggcagagaagaggccattccagaccaagaggggaacactgcagaggtgctaaggtgggaatcaccccttgcaggtggagaaggtgagatcaccagcccaagtggagcagagagcatttcagggcatagtgggagagtaagccgcacatcatggggcccagtcatgaccgagggtggggggcggctacctggtcccagcaaggtggaaaataatatccatagagcmctcaagtgccttgataaacatgctaatttttttcctttttttcttttctttttctttttttttcttttttttttctcagacaaagtctctgttgcccaggctgtagtgcagtggcgtgatttccacttactgcaacctccgcctccccagttcaagcgattctcatgtctcagcctcccgagtagctgggactacaggtgcctgccaccacacttggctaattttttttgtatttctttggagagacgggtttcactgcgttggccaggctggtctggaactcctagcctcaaatgatcc

SEQ ID NO: 26498 - DNA, 601 bp, Human
tctacctggtctgtgggtctgctgttggcagggaggcctcactgagattggaccttgtactgccaggttcatccctgagtccccccgatggctcatctctcagggacgatttgaagaggcagaggtgatcatccgcaaggctgccaaagccaatgggattgttgtgccttccactatctttgacccgagtgaggtaagcaccatgtgggtgtgggtgagagggacagactgaccgtgatttgagagcagcagcacccagccctgaagtcctccctgctcacagcagcccagccctctctcygcccaagccccaactgcccattccccccatccccccactccccacccccacacgggccctgttaacactcagaagttgaggaataggttacagctgcctcactcttttcaccacgggtttcagattttcattttttacttcctttctaggcaatcatatattttaaccattacttctaacaataaatactctttttgagtaataggcctttcataaagtcagcatttgggaaaatcattgtttcttatacctaaggtggcttgtcaccttacaaagctaaccccaaacgtaaaatgtaaa

SEQ ID NO: 26499 - DNA, 601 bp, Human
tgcagacagctaagatgccagggattcaagtatgttattgtgtgctctgagtctctgaccacctcttcttcccatacacttatgatgttgttcctgcagttacaagacctaagttccaagaagcagcagtcccacaacattctggatctgcttcgaacctggaatatccggatggtcaccatcatgtccataatgctgtggtatgtaaaagagacctgcctgaggcttccagacaaagcttcttgaagtggccattgggcctcttgtttacagacatgcctcagacaaaattcaaagcctrtgtcatcagagagtgaaaaggatatgtcttgtgttagatggaaaaaatgggcatgtcacaattcttaatgggatggaacctcagaaaaggagaatgaaaacaattgtggaggctgttgtgggaaatatggactctcgtggggaatctctccagatcttaagatgaatccttgcccaatttgggtcatttagttcccgtctcctacccagttaccgacagtggctgaggaggccaggtagggcttttaagaaggatctgagtgaagacaccatgtcctgtaggctgcagaggctgccagtt

SEQ ID NO: 26500 - DNA, 601 bp, Human
gacagtggctgaggaggccaggtagggcttttaagaaggatctgagtgaagacaccatgtcctgtaggctgcagaggctgccagttactttctggaaatgtggaagtgggatgtgctcctcctgggatgtccataaacggtcctggagtcagggctatagcctagatgtccttaccaggttcccactaatgaggcaaagtatgtcagaaagggatttgtgaattaccagggagaggaaacatgtccaagtgcacatcgctagcttttgctcagcggccgaaccctgggattctaggcgacwtctggagcctggtgggttagcggtgagaagatgggcgaggagggcggacttcatctcagagtccttattactagtctcatccagctttgaggcagtcagccactgtgcctactgagggagtgctatgagtcacccgcttccaaggaatggcccaggatccctccaggcagttcaccattccctgagttggcctcaagacaggagcagcatgtagcctgcaccacagacatgcaagcctgtgatgagtcacccacttttgtgttcacccaggctctcctccctgctctggatttcctgggg

SEQ ID NO: 26501 - DNA, 601 bp, Human
aatcaagcccatcacagctcccttgcttatatacattcttggcctaaaaatcaatagaaagtgtcttctgagactagaacacttatggcctgggctttgagggagtgggaaaaagcagccattggggctgttggttaattttactctgtacccaagttaatgtgctcatactgttttccactgcagaagaagagggaagaaatagctatcccattcctttttttcctggccctgtcttctttatttattcaacaaatagctatggcatgcctaccatgggctgggcactgtgctcggtgayaacgatacacaagaaaacaagccaggcagaaccccaggccctcatggaacgtacaccctagatgagaagacagacaacaaacaagtaaataaaatgcttaatatagttcagactgtgttaccttctaggaatacaaatgaaggacaatgccgagttagtttacatagtcacagatagtgtccctgaacagggggcagttcagtagaaatgtacataaagtgacagaaagccctgaaaaagtctaggagaacattttaggaagaagaaatggcaaaggcagcgaccctgagcaggggatga

SEQ ID NO: 26502 - DNA, 601 bp, Human
caatagaaagtgtcttctgagactagaacacttatggcctgggctttgagggagtgggaaaaagcagccattggggctgttggttaattttactctgtacccaagttaatgtgctcatactgttttccactgcagaagaagagggaagaaatagctatcccattcctttttttcctggccctgtcttctttatttattcaacaaatagctatggcatgcctaccatgggctgggcactgtgctcggtgataacgatacacaagaaaacaagccaggcagaaccccaggccctcatggaacrtacaccctagatgagaagacagacaacaaacaagtaaataaaatgcttaatatagttcagactgtgttaccttctaggaatacaaatgaaggacaatgccgagttagtttacatagtcacagatagtgtccctgaacagggggcagttcagtagaaatgtacataaagtgacagaaagccctgaaaaagtctaggagaacattttaggaagaagaaatggcaaaggcagcgaccctgagcaggggatgagcctggcatgtttgaggaggagggagaaggggaggggccagaccactgaga

SEQ ID NO: 26503 - DNA, 601 bp, Human
gagctcagagtgaccttcaggtcacacatagctctcccatcagcacagcacagagagattagaagatcaactcgagattctgatggcctatgatttttttgaggtctgagtgggaggaaagcatgaaatgagttagaactgaattctccattcatctaaacatcatgagttaattccatagtgcctgcagtgtgaggttctggggtgacagttaatccctgacagacatgtctttaatgacttatagactgggaagcaggttgattggactattaaggagcttactctggtggtctccagsttgaggaaagtgcatgtccttatagctgcaggtcccagcctcctttcagcaatcaatttggagggaaatcttggctatagccccttcccccacaataggaagtgatagaaactgactccccaaaaaatttgggaagaaagtatgtttgttttgctctcaatagctgcatgccatgggttggtacctactcctaccctctttcctttgcttctccagacttgtattatttggctacagtcctggtgatggtgggcaagtttggagtcacggctgccttttccatggtctacgtgtacacag

SEQ ID NO: 26504 - DNA, 601 bp, Human
tcagtcatttctgaattagcaggctacccatcacacttctttctttcttgggatttacctcttactacttcttgcactttaatggtgaccttgaatatttgttgttttatgtgattttagatgaataaaacatgaagagttaaggtgagaatttctagtgaattcaattcaatcaacacatatgctaactgtaaggtgtggtgtgaacattcctttcacacacatttatacactttaggaagaatgaaccagttaggcagaaattcagatcagccaagttccatttttctgcttttaaccmataaagacactttgggtttcattttaaacattccctgaagtcaaggtcatgccatatgatccagtgattgcaaatggatgaactaaaacccaaaaagctctgaataaattgtgcaggaagtttgacattggctttctttgaatggagacttagagaagatagaaaaaagaccatcttccataatacaagaaagaaaaaaaatttttttttactaggaagggagaaaatgcatacccttaggagaaaaaaaaaggaaaacagaaagcaatagtactcactttatatcttaaggcatgctgt

SEQ ID NO: 26505 - DNA, 601 bp, Human
tcaagaaatgcagagataagcagaaaatatgaagcctggcttataatggtcaaaacaattcaaggagagcaaaacaacggtcccaccaaatctgcctattaaattaagctgttaagtcatgggaatcatggatagtgatccaacaggatatactcagaaaatgagaaaaatactattgaaagctgttccacagctctgtttgtgttaccttcgcaacaactcaggcaagtgttactgcagtttttatctttctcaagattacagctgagaaactgacttttagagagaggagattaagatgtttgtgtaatgacagataacaagttagaggcaaagctagaattagcagactggaactagttactagaattcctaggagttatgacacaagtgaattgtcactgcaattaactggcctggctaaacaaagttagcataaattttcaaccactttggaaaacaatttagctttcttagaattaatgttgaaaatgttcattctctaatatctggcatttcacttctaccttaagacagtcaaggacgtgcgtgccaggttacataaataaagagttcacagcaatattatcacaataactcc

SEQ ID NO: 26506 - DNA, 601 bp, Human
aaataaaaaggggaaaaaatagaaaatctttacaaagatttgcatggaggagaaagtaaacagaataaaatgaatggatcaaggaaaaaggatttatgagaatgtacaaaagagcagaggagaacagaacggtaatgagtcttgccaaggtgcctggaggcaaaggaatgagaaacgaagacagactctttcttataaacttatcaatgaaataaaaccatagtccaaatgtccatctatttgggtaagttctcaagaaatgcagagataagcagaaaatatgaagcctggcttataatgrtcaaaacaattcaaggagagcaaaacaacggtcccaccaaatctgcctattaaattaagctgttaagtcatgggaatcatggatagtgatccaacaggatatactcagaaaatgagaaaaatactattgaaagctgttccacagctctgtttgtgttaccttcgcaacaactcaggcaagtgttactgcagtttttatctttctcaagattacagctgagaaactgacttttagagagaggagattaagatgtttgtgtaatgacagataacaagttagaggcaaagctagaattagcag

SEQ ID NO: 26507 - DNA, 601 bp, Human
gttcaagaggctgaaagggttgttagcaagcttttggtctgagtggtatttttaaactatctagcatgactgaattattaattgtaattactgtattgattatattatcaatggaccaaattgttaattgcataaatgccaactgaatgatcatttttcatattgtgtaattggcataacatacaggttcagccaggcatggcagtcggtacctgtagtcctagctaattgggaagctgaggtgggaggatcccttgagcctaggagtttaagaccagcttaggcaacataatgagacccygtctcaaaaaaaaatacaagttcaaatcagatggtgccaaccagtagatatatagccaaatgatgacagatttatatttcatctcccttttaattattatccatcttttagacctcagcatgaaggaaatagtaaattgccaatgaaaaccattacaaatggctgggcgtggtggctcatgcctctaatcccagccctttgggaggctggagtgggaggatcacttgagcctaggagttcaagaccagcctggataacacagcaagaccctgtctctccaagaaaataaaaaggggaaaa

SEQ ID NO: 26508 - DNA, 601 bp, Human
agcagatattgtgagtgcaggtcacaggtgccctcggatggagaatggcatcctgtgacaatgacagcagtggggtctcagggcatagagcaggcagctccggagcatctcagtcaatcccaggaccatggcatggcctctcagtactgataggacctcacaaggagccacataagaataaccgtaatcaagacaatagtgaagttgagaaacagctcccgggtgtttatccccattttcacagcggcttggtgagaactgcaggcagatttctgagggcacaccaaggacctctggcttstcctcacctcctgataaaacataacaaagaaaacacaaggagattaatgggcattcctgtataacaatgctcgttctttcctcaaaggaaacagaagtgttgtggaaaaggagagtgtgatgggctaaattgtgtcccccaaaaatctacatgtcaaagccctagctcacagtatctcagaatgtgactgtgtttgaagatagggtcttttaagaggtaaataagttaaaattaggtaattaaggagggccctaatccaatatgactagtgtctttatcagaagagattaggacacagac

SEQ ID NO: 26509 - DNA, 601 bp, Human
ccattatactatgaataacacaaaaagaggaaatcttccagtatttgaaaattatgattctctaaggcaaagaaatcctttttgtcattcacaaatgagtacaattccaacacatgccttcattgtttaattttcttcttactcattaatatacatgaaaatatccaaccaacattcatgtcagaactactctggttcatcacatggttagctgtagacacaaaagttcagcaaaaatcagtaaaagttttctgtgagaatcaattggctatgcggaatttacaataaagagagtattgtwtattttattattatttataaattttgtgctattcatcctttatatcagtaaaataataaacttgaatacatgtatgtatttgtgtatttttcccagagagccggtagttaaacctttaccagcagactgctgcttgcagccattctatttcaaaaagcagctggctgacagctcttccagggaagttaacatccttcaggttcctgcagaatcttgttcaaaataagtttgtcagttaaaagcaaagctttgagaaatcacactggttgttggattctagtcgtttcaaaagaactgaga

SEQ ID NO: 26510 - DNA, 601 bp, Human
atgctgcaactggttgaagaggtaagaagtgacagtattttaagataaaggaacaaatcccttatgctgatacatcctttcctagttgctatgatgtttccttgggccatgatcccctagattccagtgtggatgtagcctatcagaaaggcacagaatgagggagatgctgtatttaagttgccagatagccatgaagacaccttcaccctccttcccagcccaagccacctctgtagtctggtctgggaagcagagaataatagaatttccaagtctgtgctctcaagaaatcacagamgattgtatcactttaagcaaattagagcaattcttaatatacaaaggaattatctacataaaactttatttgtaattatttttgtgcctataaattacatctaatcttgagattctgttctaactttagccacatatatgacttttaaaaatatgtacgcatataggtgtatcatttttagaaattgttctatttaaagtcaagcactaaaatttatgaaaaaataggaaagccctttaacaaagggaaatatcaagtccaataatataaatacagaagcttttttatattcctgcctgg

SEQ ID NO: 26511 - DNA, 601 bp, Human
tatttaaagtcaagcactaaaatttatgaaaaaataggaaagccctttaacaaagggaaatatcaagtccaataatataaatacagaagcttttttatattcctgcctggattgagcatccatttgccaggcagggttaatgaatcccaaactatttttaaatgggtaaaatggggcaaatagcaataatggaatcaaaagggcacttgcaatcataaacctcactcattccaatttggtagagcagcagtcggccaggcaaaataaatggattaattgaacttgcccaatgggagagatraagtggaaaaagaatgggttggactatacttatcttaacctaataagacaagcctaatagtttttattcagcgagatgctgttttagctgtgctttgaactgcttatcagtatataaattcatgtgtgattatcgtttttagagatcttgggctttctctggcagaatgattaaatgagcctactcccctcatgctatcataaatttcatatgcaacaacttgaaagggaagaaaagataaattttacaaaggataaaaggaaaggcagccgcctctcacactctaggagccaatgtcct

SEQ ID NO: 26512 - DNA, 601 bp, Human
aagggagcctagaaatcaactgagatatttatttgattgtatattattacattattatcataatacatccttatggctttcaaccatagcctccaatcccatttttctttttttggttacgtgtgtgcacatctgatataagtttccaaaatatcagaaccgtcactaatttgcctgcctgtgcaatgttgaaatgctgcctagactgtggaaaggagcaaaacaaatgaatcagaacgcacaccttgaactgatcccttacacatcagagtctgagacatggtcactttttcatgtatcrtcttaaactgcaagccatgtcgtccagtcttcaaaaatgagtatctgctctaatttattctgggggaaaatctctcaaaagcttattgattgaagtaggattctcgaatcatatgtttttgtttctcctaaagcatttttcaatcaagcatgcagctatatcttagaacaaggagcaaaagagatggaagctatctcctgcctctaataaatgagaggaggctattagactttccatgcttaggaaattgtgagcaaagtgttattagagtagattgatttgctcttacttcctcctggg

SEQ ID NO: 26513 - DNA, 601 bp, Human
cgtcactaatttgcctgcctgtgcaatgttgaaatgctgcctagactgtggaaaggagcaaaacaaatgaatcagaacgcacaccttgaactgatcccttacacatcagagtctgagacatggtcactttttcatgtatcgtcttaaactgcaagccatgtcgtccagtcttcaaaaatgagtatctgctctaatttattctgggggaaaatctctcaaaagcttattgattgaagtaggattctcgaatcatatgtttttgtttctcctaaagcatttttcaatcaagcatgcagctatatcttagaacaaggagcaaaagagatggaagctatctcctgcctctaataaatgagaggaggctattagactttccatgcttaggaaattgtgagcaaagtgttattagagtagattgatttgctcttacttcctcctgggttattttctatttatggtcaaacatcctgatgtctaggacatttgctgtttagatgatattctgcttttcaatcaaaaaggacgttctctaaagagaatctgcattaaatattcatcaaggacagaaatcatttggaaaacctgaggattgaagtaccag

SEQ ID NO: 26514 - DNA, 601 bp, Human
caaactaaaatcactaacctttttcccatccactgtccccagtagaatggagcgaagatttcatgtgtggcctgattgggccctcgaggagaaagtgctctccgagatgcctctgccctcagcagaacctgcattgtcacatccctatgcccgaatagccatctgccttttataatttcatctcacaagaaatggagaaagaatgcagaaaagagcaaataaatcattaaaatacaggctagtacagacaaaagcctgtttacaacccatttaaagaaaatattttgaaatgtcttttgtrgtctagaatcttgctactcaatgtatgtccctgaaccagctcaatatgtcagggagcttgttagaaatgaaaagcccaggctctaccctagccctactgaatcagaatctacattttacaagatgattcatgtgcagaggattcatatgcacattccagtttgaaaagtagtggtctagaagcttcagatactcgataatgatgatatttttagtttgcctagataggctgctatagatgcattttctgaatatatttattttagaaacacttattttagaaacactccattctagcaca

SEQ ID NO: 26515 - DNA, 601 bp, Human
gaaacgcatacttcccactcctttgactttgccaaagatggtatagcagacatttgacatagcagaaaacatcacaaagtccatataacttcttttaatctgaggagggaggagatggggagttggaaaaataaaaattaaaaaagccagactctaagccctattaaatttagtttggggatctcgtttcattgaatgggtccatggccctttggtgcaattaattttgactgcactaaggcctgcggcattatagacttgattgtgggagttgctgaaattccattggtacaattttccwgtttgtctctagggttgcttggcccccagtctgcaagtattagagccagttttaatagatggctgtggtcctctggcgaaagaagaagataaaatgttaaattctggtgtcttacaaaaaaaaaatgtgaaaatgggaccaaagaatgtctcttgtttttggactaaaaagcatatggtttctactatgtaaagaacctaaaaacatctttgattgcctttaattacaacactcaccaaaatatgctgcacatgtttctattgggcacaataggtatgcctggattttaagtcttttctc

SEQ ID NO: 26516 - DNA, 601 bp, Human
gaaaaataaaaattaaaaaagccagactctaagccctattaaatttagtttggggatctcgtttcattgaatgggtccatggccctttggtgcaattaattttgactgcactaaggcctgcggcattatagacttgattgtgggagttgctgaaattccattggtacaattttcctgtttgtctctagggttgcttggcccccagtctgcaagtattagagccagttttaatagatggctgtggtcctctggcgaaagaagaagataaaatgttaaattctggtgtcttacaaaaaaaaaatgtgaaaatgggaccaaagaatgtctcttgtttttggactaaaaagcatatggtttctactatgtaaagaacctaaaaacatctttgattgcctttaattacaacactcaccaaaatatgctgcacatgtttctattgggcacaataggtatgcctggattttaagtcttttctccaaggcagctcagtgaaatacagcccatggagaccataccagcattaaaccactctcctccattacaaccccaggatagtttaaactaggagtttgtaagcactctctgccctgcccctcagccc

SEQ ID NO: 26517 - DNA, 601 bp, Human
aaagcctactgaaagccagagggtaagaggagctgggtgatatagtcatgaggtcagctcctgagagcacagagcaaagaaggtccaagaacggatttggagtgaaaatagagaataatgagcttcttattaatgatttattttgaaacctagaatcaaaagccaatttaaatatctatttttaaaagttcaaattatgactcaggggcatttcctttaaaaaaaaaaaaaactcaagttacacacatcagccaattcagaactcagctctccctttgctcccagggaaagtagcccaagsgttctcaagcctggctgtacattagaatcaccaggggagacttttttttcttttactaccagtgtttgggcccaatccacaccaattgaaccagaatctcttgaagtgagacacaagcacctgtggcccattaaagctcctcaggtgattctgatatgcactcagggccaagcaccattgaactagaagtatctcttagctattgatgatcatttaaataaacttcttccctacaggaaaaagccagaaagttctcctttagttttttaattttctctgccctgggctgcttttgaaacc

SEQ ID NO: 26518 - DNA, 601 bp, Human
ttaattttctctgccctgggctgcttttgaaaccataatgagccagtctgcattgggagttaccatgggggaaggattttaacccttctgaatattttttagctcaataccatatatactagggaaattctgaaataagtacctccttaactttcaagttggactgtgaaaaaatgtaatgtgttttgtgagccagctccttcctcccattcccattccactcaacctgaaacaatactcttttgtcacagtttcacagtttttgactctgaaatcacctatgcaccatgccactaaaaaacccatgttattaacatatgagtaaataaaaatcatcttgaacaagtagctctccttggagttcctgggagcaagcagggttaaggggcaaactgtaattatcattactcttcccattggtgtcaatcccaagtgtgaaaagagatgagcacagagactctgacttagcacaataagctttttattgtattcttaatttgagtcttagaaattttgagacttaatttgagtcttagaaatattaagaatattcttagaaagaagaatatcgtttctaattccatcttcgtgctctgaccta

SEQ ID NO: 26519 - DNA, 601 bp, Human
ttgtactggatggagattaaagatagataaagttgatgcccagaggacgacagatttccactatgctttgggtccttggtattcaatatgttttccaccctctgtcttctaaaacttgctctttggatcccagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggtgagcacgtggcagtcagcaartccctactgcgagtcacttctgaaatgaccaacaggaagtgtgaagggcataacaagatcctcaaaacacgaccttggattcaggcgcactgatagctggaaatgttcttcattttccaagagaaaaatataggactcagcaacagaattggagtgaaaataagagggtcaaatttaatccagcaaatattctcaaaggctcctgtcagccaggcattgtgctaggcactgtgggccatgtacacatgagaaagacaccacccctactgccaagaaattcacggcctatgggaggctacg

SEQ ID NO: 26520 - DNA, 601 bp, Human
agaaaaatataggactcagcaacagaattggagtgaaaataagagggtcaaatttaatccagcaaatattctcaaaggctcctgtcagccaggcattgtgctaggcactgtgggccatgtacacatgagaaagacaccacccctactgccaagaaattcacggcctatgggaggctacgagcctccagatgaattttctatcactcaaaatataattcactaagagatccacagataaaatgctaaacaaggttagataaggaaagatctcaagaggcaaagttcgggaaaatctcagaayaagttgactttgaattgaatcttgaaggatggttagtattaatagtttgtcaagtggaggtggtgaagggatagaatcagaaaatgggagaaagaatagtcagtatagccaggacatgattatgagctttgcttttataaatgccaaagctttaatgagaattcaaaaatatccaggttccatttccagtttaacagttcacatccccagttctaaaaacagggaattttatatgatgaaattgagtttacacaaggacaccagacttggctctaagatccaccatgtcaacgtgggcca

SEQ ID NO: 26521 - DNA, 601 bp, Human
ttgtacatctataatctactcaatgtgggtaacttatgttgtgtgtttattccctgggagacgttgaagttctttgtctgatatcctaaattttcttataataattcattccattttggtgagcagagaaggatacttttaagatttttagaatcataaatctaaatagtagtttcttggtatgcaagcaacctccaatgacttgaaaaaggagtaagtaggcataaagggaacactttgtcctgttgtgttgtacatactccatgttaaaaatatctgattgcatattttgcctgatcartatgaaaactacgcaaactttagtgttggttggcaaaatacttgtgctttgcttacttttgcaagtaatggcatgcttatcgttgttaagaaggctttcatatgataaagcttttaaagctgtgtaaatcaatagatattagaataataatgagagtttcaaaactcactagagccaacacaagctgacctaacccattacggcccagaataatgaactaaaaaatcattgctgagctgccctccaacagaaaaaacaatttgaaaaaaacaggaagtattcattttctattaatggacc

SEQ ID NO: 26522 - DNA, 601 bp, Human
ggagcgtctttactaatagaagggtcaaactcttattgacagagttgaactttaagcaagaaaatgtgttcctggaaaggcaagtggcatcttgattctgccactttgaatttctagttctcatctttagggagaaggtttttcttctacgcccagtgtactataaagacagagacatatgcagctacaaggtttaatcagaagccaggcaggtggatggataatgactatttcaatttgtatcattccttgagtgcagaatcatttaagtgggagaagggtctaattgcctttgaataaytagtttccagtcagcactttaaatagccccttttttttccagaatcaaaatccacacatgatttaaatagagcccacttcaacccagcattgccccaaatgatcatgtcgcatgaactgcacaattattaatagatttccaccttctcattgaagttctcatttctgataacgggacagtatgtggaagtttcctgcatatctaagatgtaattgcaatcacactgtaggggtaaggagagtcttatgatgtttctctcataatctctcatgaccccaacagcaacctttacccagctct

SEQ ID NO: 26523 - DNA, 601 bp, Human
aatcacactgtaggggtaaggagagtcttatgatgtttctctcataatctctcatgaccccaacagcaacctttacccagctctatcaatcatgatcttttctcatcacttggatcaatagtgaagttttgggagtccttaacaatgagattttcaatacatcctcatggattgtcaagaaattactttatttaaaaatctcgttttctgcttaagggtatttatgtatataaataataaccttatatatataaataaataactatatatattatataatatataatatatatattatatrtatatggttattatatatatataaaaaccatatataaaaataaccatatatagatataccttctaaggttaaaaacataattttttcagaaaacttactgaattggaagcaagcctatatcagagggtttatgggaactgttgctaaggaaataccttagcaatgttcaaactttgatttaaagttatcagtggtaagttaggcatgcagtcccagctactccagaggctgaggcaggagaattccttgagcccaggagttccaggctgcagtgagctatgatcgtgccactgcactcgc

SEQ ID NO: 26524 - DNA, 601 bp, Human
gtcttatgatgtttctctcataatctctcatgaccccaacagcaacctttacccagctctatcaatcatgatcttttctcatcacttggatcaatagtgaagttttgggagtccttaacaatgagattttcaatacatcctcatggattgtcaagaaattactttatttaaaaatctcgttttctgcttaagggtatttatgtatataaataataaccttatatatataaataaataactatatatattatataatatataatatatatattatatgtatatggttattatatatatatawaaaccatatataaaaataaccatatatagatataccttctaaggttaaaaacataattttttcagaaaacttactgaattggaagcaagcctatatcagagggtttatgggaactgttgctaaggaaataccttagcaatgttcaaactttgatttaaagttatcagtggtaagttaggcatgcagtcccagctactccagaggctgaggcaggagaattccttgagcccaggagttccaggctgcagtgagctatgatcgtgccactgcactcgcactccagcctgggcaacagagcaa

SEQ ID NO: 26525 - DNA, 601 bp, Human
gtcacctggcatggtctgaagttgaagagattcccggagcgttcagaagatgggctgaacagctccttctaaacttttactggctctttggtggtcatcctggccttctcacaaggacaaacatgtaacatatgttgggcactccagcaaatttagaattttctaaatagaaatataaaaattggaatgggacagccatcataaataaagtcctacagcatataagtagggtgatcataggggcattctccaaataccaggaagacatctacaaggagattccagacttttttttttttttaaaagaagctaattcttttatataataaaggggcagtactttctgtgtcaaatattgcatggggtggaattttcatatgcttcagaagtaagttaggtggaaatcacagatgctcattgaacataagtctgtttcagctcctcccagatcctttaaggatatacagagtaacctcatgctctacttcaaatatccccaggtgaaggcccctcagtgcattcttgtacaggagatcctagaatgtttgcgctcaggaatgccatcattttaaaatgaattatttttctcatttgagctttt

SEQ ID NO: 26526 - DNA, 601 bp, Human
ctggccttctcacaaggacaaacatgtaacatatgttgggcactccagcaaatttagaattttctaaatagaaatataaaaattggaatgggacagccatcataaataaagtcctacagcatataagtagggtgatcataggggcattctccaaataccaggaagacatctacaaggagattccagacttttttttttttttaaaagaagctaattcttttatataataaaggggcagtactttctgtgtcaaatattgcatggggtggaattttcatatgcttcagaagtaagttaggtrgaaatcacagatgctcattgaacataagtctgtttcagctcctcccagatcctttaaggatatacagagtaacctcatgctctacttcaaatatccccaggtgaaggcccctcagtgcattcttgtacaggagatcctagaatgtttgcgctcaggaatgccatcattttaaaatgaattatttttctcatttgagcttttcagagcatttagtctggcaacataataattcaatctacaggaacatttcacattgctctgatcctgtaactttcctttgcactgaagtgtcattatttc

SEQ ID NO: 26527 - DNA, 601 bp, Human
gcccctcagtgcattcttgtacaggagatcctagaatgtttgcgctcaggaatgccatcattttaaaatgaattatttttctcatttgagcttttcagagcatttagtctggcaacataataattcaatctacaggaacatttcacattgctctgatcctgtaactttcctttgcactgaagtgtcattatttctgataccatttgtagctggaaagggagggcttaagaaccaagtaaaattggtgagattatccattttccaattgagaaacctgaggtcaaaaatgtgagtctgtagytcaaaacaatcaaaatcaatgccctatcttactatgtaaatactgattttaaaagacaagtgtcaattatccaaacagatgacagagaaccattgccaggtattcaaagttatgattaatctggaaatatgtttgttttaactttgcaaatttctatttgaacatggataattctaatgtcctgagaattcacgatatgaactgaatacagaagactcagctcaataaaaattgggaagtacagcaccacaataggtacaaagctggtaatcattgagtgatactggttgagagaaaaac

SEQ ID NO: 26528 - DNA, 601 bp, Human
catcccagaagcaagccaagttctcatacggtaacaataattgcaagataaactaatgagcccttcgttttgcaaaacattattccaagcacattatgtgtataaactcatttgatctcagcaaattgaatagtaagtgatgaatagtgtggactctgactccaggttgctagcattcagactctggtttctccatttattagtactaagacttcagacaaattccccagatcgtttctgactgcttttctcatttggaaaagtgagctaataatagtacacactttatagttgatattgktaatcttgatgttgtcaaagtttaatgagtggaacaaagtacagttgacccttgaacaacatggagatttagggtgtcaacccccatgcagctgaaaattttttgactcccccaaaatttaactactagtagcctactgttgactggaagccttaatgacataaaaagtccattaacatctatgttttatgtattatttactgtattcgtatgataaagtaagctggagaaaagaaaatgttattaagaaaatcataaggaagataaaatacatttataatactatgctgtatttattga

SEQ ID NO: 26529 - DNA, 601 bp, Human
tcttaattgttgcaaatctccaaagcattttccagtgtatttattgaaaaaaaatcctggccaggtacaatggcacatgcctgtaatctcagcattttgggaggctgaggagggaggactgcttgagcccaggagtttgagaccagcctgggcaacatagtgagatctcatctatacaaaaaatagaaaaattagccaggcatggtggcatgcacctgtggtcttagctatttaggaggctgagatgggaggctcagttgagcccaggcagtcaagggtgcaatgagctatgatcacaccrctgttccccagcctgggcatcagagcaagaccctgtctcaaaaaaaaggaagaaagaaattcacacaaaagtggatccacaccattcaaacccatgatgtccaagggtccactgtacatgctcatgctcattagcaatattttttatcatccaggttggagaagagaaagctgagcccccaagatgtaatttgttcaaagggacactgctaataaattagccatggtttcaatcctacagtataagaagtgtaattcaacttggtccaacagatgtgaatgcctaccacagaagtcattg

SEQ ID NO: 26530 - DNA, 601 bp, Human
gatctcatctatacaaaaaatagaaaaattagccaggcatggtggcatgcacctgtggtcttagctatttaggaggctgagatgggaggctcagttgagcccaggcagtcaagggtgcaatgagctatgatcacaccgctgttccccagcctgggcatcagagcaagaccctgtctcaaaaaaaaggaagaaagaaattcacacaaaagtggatccacaccattcaaacccatgatgtccaagggtccactgtacatgctcatgctcattagcaatattttttatcatccaggttggagamgagaaagctgagcccccaagatgtaatttgttcaaagggacactgctaataaattagccatggtttcaatcctacagtataagaagtgtaattcaacttggtccaacagatgtgaatgcctaccacagaagtcattgagtgtctttctaggatagaaagataaatcatatataagcctacgctctctggtagggaaaattattaaaaatgaaaattaaaaaagcaatgattctgaaaaaatatattcgttcattaaaaaaaaaaaatgaaaattaagcttctacggtcacattcaaatag

SEQ ID NO: 26531 - DNA, 601 bp, Human
caaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcytgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaa

SEQ ID NO: 26532 - DNA, 601 bp, Human
gatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctaygttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaa

SEQ ID NO: 26533 - DNA, 601 bp, Human
gagggcggtgtgcgggtgagtgcggagcaaaggggctcttgcagcttggggtcaaacagggtgcagccttgctcgtgcgctcctctgggactcatccctgagaagggcctgtggtttagacctgggctaggagtattaccctttaaagctttcaacccgctggagccttcctgggacaccaggagaagtcctgggacccgaatgcacagtttctacgagttggagcaaagggacaagacagctgcatcaaagactagtttttccatttgcttattctaagagtgcttgttaataaagaaargcaatcagggcaacagcgacgtgtacctgccattgacagacactttgacaatggaggaacctgagtaatgctgaagctgcgggagacttcatcagaggagtgttaaaaccccgactaactggtttcttttggggaccttccgggtattctgttactgaaatatttcttaaaagtgccttatttggggatgaaaatataaaaataactttaatctctttctccatttaacagtactggctgccttcatcggccttttcattataaaatataatcacagaaatcgttgtcttaagttctggc

SEQ ID NO: 26534 - DNA, 601 bp, Human
cctattccaccaaaccaaccacaaatgattttttaaaaaaacttaaacagggtggagtgcttgaggtcaggagttcaacagcagcttggccaatatggtgaaaccccacctctactaaaaatacaaacattagctgggcgtggtggcacccgcctgtagtcccagctactcgggaggctgaggcaagagaatcacttgaacccgggaggtggaggttgcagtgagctgagatcgcgccattgcactccagcctgggtgacacagcgcaactctgtctccaaaaaaaaaaaaaaaaaaaaaactgtcaaacagctctcatatatctgaagttggctagaatgacagaaaagagcaccatcaaactgggaatcttgtaaactatcactgtgccccagatgttacaaaaatgagcaagaggaaataaaatctaacgagagcttgttgcagataatcaggaaataactgtttatacagatcaactttggagactacctgttccactcggaaacaggtaaagcctgttaagtctagccggtcgtggtggcgggcgcctgtagtcccagctacttgggaggctgaggcaggagaatggcgtgaacct

SEQ ID NO: 26535 - DNA, 601 bp, Human
tgtgcaaaaagaacatataacttacaaaggcaaacttacaaaaagcatcacatgttgaaaaactgacatacaaagcaaggcaacatagagcagtgtttttttttaaagctcaatgaaggtgtgaattgaaggattttatatctaactgaatgttctcaaatgtcaaggttatagaaaaagagttttcgacataacgaaaacctgggtaatttctgtacctgctggccatttctgaggaatatacaagagaatgagctttatccaaccaattgatgactggaaaattttcagcaaaaggackaatacagagaggatgagggtggaagatttgtgtaaccgttgggtattgcaacaaagtacagtattgcaactaaaatgatggaaggagaaaaatggataatgtgtgggcaatagatgggttttaaagactactgcagaggagaaaaaacctgacacaccagatagtaaagtgttaaataagaaaatgggtaactctaggatttaaaaaatgtgagtagaaaggtaaccagtagaacaataatagaaatatcaactccccctcaatttctaaaaattaaatggaaaagaagggtatgcattt

SEQ ID NO: 26536 - DNA, 601 bp, Human
gtccgtctgctccacaggctgactatattcgtttttggtgactagtgtggagactagcatatggctcacatgtagatttcacttaagtacctgttgagttatgctgaaaatggtttttagatatttaggttcttcagggttgccatctcagtgcttttggagagaaacaataggataagaaaagtagaatttcaaaattttacgcggagcaggaaatacgagatttatctttttctttcttttttttttggatggggctctgttgcccaggctggagtgcgatgatgcaatctcggctcastgcaactttcacctcccagtttcaagtgattctcgtgcttcagcctcccaagtagctgggattacaggtggccccactgcgcccagttaatttttgtattttttagtagaaacggggtttcaccatgttggccaagctggtgtcgaactcctgacttcaggtgatccacccgcctcagcctcctaaagtgctgggattacaaggtgtgagccaccgtgcctggccaagatttttctttaaagcagcggtggcaatcttctgcaaagttttttaaccttgtcaaaaaaaacgtaagatgta

SEQ ID NO: 26537 - DNA, 601 bp, Human
cgatgatgcaatctcggctcactgcaactttcacctcccagtttcaagtgattctcgtgcttcagcctcccaagtagctgggattacaggtggccccactgcgcccagttaatttttgtattttttagtagaaacggggtttcaccatgttggccaagctggtgtcgaactcctgacttcaggtgatccacccgcctcagcctcctaaagtgctgggattacaaggtgtgagccaccgtgcctggccaagatttttctttaaagcagcggtggcaatcttctgcaaagttttttaaccttrtcaaaaaaaacgtaagatgtaactgttaaataataagatcagtctaagaagaaaaatctgaatttaccctcttcactccaaccatctgaacattgctcaaagcagtttgagtcagatctgggaatcggtcttaccttcaggaaaccctggagaatgtttgtctgtctgttttttaatcaagtccagtctgggcaacaactcactgtgttgcccagcagaaggttttaaccaggctttgtcaatttacttggtctgtacattgctgctgatagcttcggaagttttttaagcagggattaa

SEQ ID NO: 26538 - DNA, 601 bp, Human
actgcagcctctgcctcccaggtcaagccattctcgtgcctcagcctgccaagtagctgggactacaggtgtgtgccatcatgcccagctaatttttgtatttttagtagagacagggtttcaacatgttggccaggctggtcttgaactcctggcctcaagtaagccgactgcatcggcctcccaaactgctaacgttacaggtgtgagccacaatgcccagcatattgtagccatttttaatctgtattctaacccaacagttcaaacctattggtttcagcattttttttttttttttgagacagtttcgctcttgttgcccaggctggagtgcaatggcgtgatttcggctcaccacagcctctgccttccagtttcaagcgattctcctgcctcagcctccccagtagctgggattacaggcaggcaccaccacgcccggctgattttgtatttttagtagagatggggtttttccatgttggtcaggctggagtcgaactctggacctcaagcgatccgcccacctcggcctcccgaagtgctgggattacaggtgtgagccaccatgcccagccttgcatttctttatactata

SEQ ID NO: 26539 - DNA, 601 bp, Human
cagaaagtccctgcttccatttttggtcttactgactcttctccaaaattttgtatcccatgcactccatctcaggaaactatcagaagatgtaaaagtgcttcacagaaagtgtaaaccatgaacaagaaagacatggaatgcaacacagaataggttaaatagacataaaagggattctcagaattatggaaaagtgaaatcccagtgtgagagctttacaccagacccagagatttgatcaagggtctggagccaggagcatacagaactcaggaaggatgtctgggaggaaaaataraactggtagactcccggttgttcactgttctgtcagaaaataggggactgaattcgtgacaggtacactgaaaattaagcaaatgggccaggcccggtggctcacgcctgtaatcccagcactttgggaggccaaggcgggcagatcacgaggtcaggagatcgagaccatgctggctaacacagtgaaagcgtctctactaaaaatacaaaaattagccaggcgtggtggtgggcacctgtagtcctagctactcgggaggctgaggcaggagaatggcgtgaacccgggaggtggagc

SEQ ID NO: 26540 - DNA, 601 bp, Human
ctggtagactcccggttgttcactgttctgtcagaaaataggggactgaattcgtgacaggtacactgaaaattaagcaaatgggccaggcccggtggctcacgcctgtaatcccagcactttgggaggccaaggcgggcagatcacgaggtcaggagatcgagaccatgctggctaacacagtgaaagcgtctctactaaaaatacaaaaattagccaggcgtggtggtgggcacctgtagtcctagctactcgggaggctgaggcaggagaatggcgtgaacccgggaggtggagcttrcagtgagctgagatcgtgccactgcactccagcttgggtgacagagcaagactccatatcaaaaaataaataaataagaaaattaagcaaatgcaaatgggagagaattaatagattaatagctacaaaacaaaatgtcgtccaacagatgtcaactgtgtggcttaggtagaagtagcagtaattcgtcctgaattaaatatctgtttaaccaaaattatggtagttctgtggtgagaagttgaggagctaaattctaaacaaacaattaagaatggaaaacaattgcccctagggaag

SEQ ID NO: 26541 - DNA, 601 bp, Human
tgctggctaacacagtgaaagcgtctctactaaaaatacaaaaattagccaggcgtggtggtgggcacctgtagtcctagctactcgggaggctgaggcaggagaatggcgtgaacccgggaggtggagcttgcagtgagctgagatcgtgccactgcactccagcttgggtgacagagcaagactccatatcaaaaaataaataaataagaaaattaagcaaatgcaaatgggagagaattaatagattaatagctacaaaacaaaatgtcgtccaacagatgtcaactgtgtggcttargtagaagtagcagtaattcgtcctgaattaaatatctgtttaaccaaaattatggtagttctgtggtgagaagttgaggagctaaattctaaacaaacaattaagaatggaaaacaattgcccctagggaagaagaatggggaggcaagagccagaagaatacataaaccttggatttatatgacttttaaaattatagacagtacatttatgtctttgatgttattaaaattttatatcagcagcctggcatggtggctcatgcctgtaatcccagcacttcgggaggccaaggtggcc

SEQ ID NO: 26542 - DNA, 601 bp, Human
cactatagagaacttaagaggctggcttatgttatacctaaatttttactttcttgtatacaacaatgctaaaattgagcagattgataactgccagcaaaccatagatttaagataaatgaatgatttacccaaccctaaaattccatgggtaaaaattttgattcctttattttcaatactgcgttccttataggtcttacatgcatatgcaaggatattttatcttattcattcatttcatactctcaaaacaccaaacttcaaaaagttaattattgtcataatgcattattccatrtgtggtgtcaatacattttagcggacaaagaagaaacatgccagttaaaacatttctgctactgggattctttattaattatttgagaatgttattttgctagttcttaaggttaagtttttcatcaaagactcaggtacctattattgttccctggtgaaactgaggagaaaagttaatcaaccaggttactcccacagtttgcccgtgtgttatgtatcagttatacaggtatcccaccaagttcaagtcaaaagaaattcctaactttgtatatttctggagctataaaacccctga

SEQ ID NO: 26543 - DNA, 601 bp, Human
tcaccacaaccaccccttcgggggacttgggagcccatctcatagacaaggaaagtgaggctcaaaaccacatcttccggacggctctcagcacttaggagacaccccattttataagtgaaaacaggatcccacacggtgacaggcagcctcccgggcagtggtcaccaggccgggggctgagtagcaccagccccgcccccagggcctagcctccctccctgggctgggcggggcagctgcctcctgctgggagcctcagggaagtagcgtcccctagtggtaagaaagcagtgctgcktctgaccctaccctctgcagctgcctttgtgtgtgtgtgcacgtgtgttgagtgagcatgtgggtgcatttgtgagaatgtgtgggtgtacatgcgtgtgaatgtacacatgcgtgtgcggcccaatagcagacagcacaggagcagtggggcgcaccccagggacgggtgttggctgggtgagctgtcccagcacctgtgacacagcaagctctgctttacgcattgtacgcttattagttcatttaatagacacaaaatccatgagacggtgtggaaactaaggcccagagagattaa

SEQ ID NO: 26544 - DNA, 601 bp, Human
tggctagttcatgtgagcttggaattcccctgagcagcctgtactctgagagaccctgtggcagtgtaagtggtggcctgggctaggattcctacctgggggtggggcgggggagcagtgtccagctctcctacctgctccaggcctcctaggtggtggagtctgaggctctgagcactgagaatccctgcgttaggagtgggtgggtggaagggtgggggctgccctactcctcttggctctggggcgatgcccaggtgtctgcttccagggccagcacagggtctccatgtccttggarctggcagccgctccctctcctagttcccctttctcgtcgtatgaccttgagaagcaaaggaacctctctgggcctccgtgttctcatctgcaagatgggggtgagagtgtcggcctccctgggctgtgtgatgaggcagggccatgacctccatgaagcaattctcctggtctatgtgagcacccagcagaggaaggtgaccatcatcatcatcatcatcatgtgtcccaggcagaacacatagagccccagggggctcctccctcctcacccccagcaaaagaggccctggggtgaggg

SEQ ID NO: 26545 - DNA, 601 bp, Human
ccctgagcagcctgtactctgagagaccctgtggcagtgtaagtggtggcctgggctaggattcctacctgggggtggggcgggggagcagtgtccagctctcctacctgctccaggcctcctaggtggtggagtctgaggctctgagcactgagaatccctgcgttaggagtgggtgggtggaagggtgggggctgccctactcctcttggctctggggcgatgcccaggtgtctgcttccagggccagcacagggtctccatgtccttggagctggcagccgctccctctcctagttcycctttctcgtcgtatgaccttgagaagcaaaggaacctctctgggcctccgtgttctcatctgcaagatgggggtgagagtgtcggcctccctgggctgtgtgatgaggcagggccatgacctccatgaagcaattctcctggtctatgtgagcacccagcagaggaaggtgaccatcatcatcatcatcatcatgtgtcccaggcagaacacatagagccccagggggctcctccctcctcacccccagcaaaagaggccctggggtgagggtgcccgggcattccttgtgaatcccgg

SEQ ID NO: 26546 - DNA, 601 bp, Human
ctgtactctgagagaccctgtggcagtgtaagtggtggcctgggctaggattcctacctgggggtggggcgggggagcagtgtccagctctcctacctgctccaggcctcctaggtggtggagtctgaggctctgagcactgagaatccctgcgttaggagtgggtgggtggaagggtgggggctgccctactcctcttggctctggggcgatgcccaggtgtctgcttccagggccagcacagggtctccatgtccttggagctggcagccgctccctctcctagttcccctttctcgtygtatgaccttgagaagcaaaggaacctctctgggcctccgtgttctcatctgcaagatgggggtgagagtgtcggcctccctgggctgtgtgatgaggcagggccatgacctccatgaagcaattctcctggtctatgtgagcacccagcagaggaaggtgaccatcatcatcatcatcatcatgtgtcccaggcagaacacatagagccccagggggctcctccctcctcacccccagcaaaagaggccctggggtgagggtgcccgggcattccttgtgaatcccggagcagggctag

SEQ ID NO: 26547 - DNA, 601 bp, Human
ctgccctactcctcttggctctggggcgatgcccaggtgtctgcttccagggccagcacagggtctccatgtccttggagctggcagccgctccctctcctagttcccctttctcgtcgtatgaccttgagaagcaaaggaacctctctgggcctccgtgttctcatctgcaagatgggggtgagagtgtcggcctccctgggctgtgtgatgaggcagggccatgacctccatgaagcaattctcctggtctatgtgagcacccagcagaggaaggtgaccatcatcatcatcatcatcmtgtgtcccaggcagaacacatagagccccagggggctcctccctcctcacccccagcaaaagaggccctggggtgagggtgcccgggcattccttgtgaatcccggagcagggctagtgagcccttggagccacctcgagggagactcatttcctggtgacaccccaaaaccagtcacgactcatctcccagtgaactgtgaaaggcctcagcagggactatctgaccactcatacccctggcctcatcatcagccttagggcagcaggactcagcaggtggccacctgccctgcccctg

SEQ ID NO: 26548 - DNA, 601 bp, Human
gagcagggctagtgagcccttggagccacctcgagggagactcatttcctggtgacaccccaaaaccagtcacgactcatctcccagtgaactgtgaaaggcctcagcagggactatctgaccactcatacccctggcctcatcatcagccttagggcagcaggactcagcaggtggccacctgccctgcccctggatagcctggccgactcccgccagcacagcactgcccttttatgccccactccgccaaggggcaggatggccctggggcaacacagaggtgacagtatccccgcctcccccccgtcccccgccagaggcaggtgctgaggccagagtgcagggcaatcaccagtgtggtcctacacacccagctgtcatgatatctcacgcaagtgtctggccggcatggagtgcaggagatagaagatgggaagtgagagaggactgtgtaacctctgctggccctgaccagcctgagcccagagcctgtccaggaggcaaagagagggagccatgctcctgtggactgaagtgggcctgaagcaagcctgatctgatgccaacacaccccaccactttgagctcgaaggccctg

SEQ ID NO: 26549 - DNA, 601 bp, Human
cactcagggtggcccattaaggctggggcctggagctgggtgtgcaggtcattctctctcccaggcccagagtgggggagactagagggctacaggccagcgtggatgacctgaagagcgctcctctgccttggacaccatcccctcctagcacaaggagtgcccgccttgagtgacatgcggctgcccacgctcctgccctcgtctccctggccacccttggcctgtccacctgtgctgctgcaccaacctcactgccctccctcggccccacccaccctctggtccttctgaccccacwtatgctgctgtgaattttttttttaaatgattccaaataaaacttgagcccactcctgccatgcttcctctgggtgctgtgtagcttgaggaggggtccccaggtcctcccaggaacaggaacgggttcagcctgttgataggaccaggtatcctatagggacacacacagggcattcatgggacctgcgtgagccttcaggaacacccccaacccacccattgcctttaacatggaggaggcagcactgccttcggctccccaagacattcgacaggactcacagtcccatccacgggg

SEQ ID NO: 26550 - DNA, 601 bp, Human
gagctgggtgtgcaggtcattctctctcccaggcccagagtgggggagactagagggctacaggccagcgtggatgacctgaagagcgctcctctgccttggacaccatcccctcctagcacaaggagtgcccgccttgagtgacatgcggctgcccacgctcctgccctcgtctccctggccacccttggcctgtccacctgtgctgctgcaccaacctcactgccctccctcggccccacccaccctctggtccttctgaccccacttatgctgctgtgaattttttttttaaatgatkccaaataaaacttgagcccactcctgccatgcttcctctgggtgctgtgtagcttgaggaggggtccccaggtcctcccaggaacaggaacgggttcagcctgttgataggaccaggtatcctatagggacacacacagggcattcatgggacctgcgtgagccttcaggaacacccccaacccacccattgcctttaacatggaggaggcagcactgccttcggctccccaagacattcgacaggactcacagtcccatccacggggatagcttagctcagcctcaaggtagcccccgc

SEQ ID NO: 26551 - DNA, 601 bp, Human
acctcggcctcccaaagtgctgggattacaggcatgagatgagccactgtgcctggccatgagaaatgtttcatgatgtgagaaaatacaggagtttttggtcatgattccaccagtggtgaaggactgtcctgcagatgatggactctcaggtcagattacaatagaaataaagagggctttgaaaatggaagggttttggcattaacagtacagagaaaagcagtctggagagagagaacaccctacatcattgtggtttggtttacttaggggagtggacagtttagagcatgcatcrtcacagagaaggataatcacctgtaaggaggtgaaaattggttcttgagatgtgaaaaaatacttcataatcctttgtggtcctccaaagagccatactaaatatggaagaatgttggtgaaaaaggagagaatatttgtttagttaaggaaaccaggcttagattatgtaagggtggagaagaaacaggagaagattagaagactagggtgttggcaagctgaacatgactcttgtcttactgcttctagactgttggcaagagtagcaagatgctgcagcacattgactatagaatga

SEQ ID NO: 26552 - DNA, 601 bp, Human
tttttgaaacatttaggaattactaggtaaaataaaattcaatgactttcatcagtcctaagtgtgtcaaatgtgagagttaagaatgagggactagggaaatgtggcagtcccttggtgaggaagctagtatgagaggaaggatgtttttgaacgtgtctgtcatagtgattttcatgcaaaattgtctgcctgttttaaaacatggtagattgcagtgcagctttaacatgctttcctctgcaggctccatctactctttgaagcttctgcccagcttgcattgtttctaggagaaccygcgtcatacctttatctatagccttcccctaggtcttcagaagcatcaagttttaactgtggacattggatttggtggaacagcaatcatggtaagctgtatgataaggctgagggttgaaatgtgctgtaagggccgaaagaaatagtttgccagcatgtgcagtgatcttgggttctgaatgttagaaataaggatacatccatggatatggattctcattgcattgagtatcagctgaagatgagctgatttttttatttttatttttttcagacggggtcttgctctgtctcccag

SEQ ID NO: 26553 - DNA, 601 bp, Human
tttttgagatggagtttcactcttgctgcccaggctggagtgcaatggtgcgatctccgctcaaaaagatacttttgaatccttttcaaaagtaatttgtgtttcattttttaattagtatgataagcacttcaagaccctttacaattctggctagatttggttgccatatttaatagcattttataaataatggagaaaagggaaacattatgcatgcttgattacggtcatgagctgcattaacaattccgttcaacaacagactgcatatgtcagagcagtcccttaagattacaaraccatgttttcattgtgccttctctctcttccccaccacccccaaccctgagatggagtcttgctctgttgcccaggctggagtacagtggtgccatctcagctcactgcaaactctgcctcctggtttcaagcgattctcctgcctcagcctcctgagtagctgggattacaggcgcctgccaccacacccagctaatgtttgtatttttagtagagatagggttttcgccatgttggccaggctggtcttgaattcttgacctcaggtgatccgcccacctcggtttcccaaagtgtt

SEQ ID NO: 26554 - DNA, 601 bp, Human
tcagattcatggccactgaatgacagccaggcattagagtattctttttttttttttttttttgagatggagtttcactcttgctgcccaggctggagtgcaatggtgcgatctccgctcaaaaagatacttttgaatccttttcaaaagtaatttgtgtttcattttttaattagtatgataagcacttcaagaccctttacaattctggctagatttggttgccatatttaatagcattttataaataatggagaaaagggaaacattatgcatgcttgattacggtcatgagctgcattaacaattccgttcaacaacagactgcatatgtcagagcagtcccttaagattacaaaaccatgttttcattgtgccttctctctcttccccaccacccccaaccctgagatggagtcttgctctgttgcccaggctggagtacagtggtgccatctcagctcactgcaaactctgcctcctggtttcaagcgattctcctgcctcagcctcctgagtagctgggattacaggcgcctgccaccacacccagctaatgtttgtatttttagtagagatagggttttcgccatgttggcca

SEQ ID NO: 26555 - DNA, 601 bp, Human
tagtcatcttattttactatttgctatgtgtgctttggccaaccctagtcatcttattttacttttgaattaaagtagatttacatttttatgtagtttaatcatttgaaagtctacagtttcctaaagtttgaaaacttgtgcttctgtgagggataccagttcgttaatttgcttatgtgccctttgatctcagaagatacactatgactgctcatccatccttgcagtgtgatgttgctactctcgtcgcctttctcatgaagttttgttttcttgtgctgtaaagataaatttgacmactctgcagtgatttattttcttctttcacttacaaggtcatgactacattgtatcacatttagggatgagagagaactgtttctaaattccaaatctgtctcttaagggaatccttttaactgctgtaggaggtcaactcctattgtgagtaaaacatatatctcttctagctatacaggttattattatattatgatatatatataaatataaaataataatctgtccctaattctctaggtcttcagttctttgggccataactcacatccctagatgtgtttcatacctctggacc

SEQ ID NO: 26556 - DNA, 601 bp, Human
ttgttacattgttttctaaacacatcatgagaagtgctgatggccactaaaaattagtagaccattagtttctcagtaccaccctttgtattctggtgtttttttgtttttgttaaataaacctttccaataaaggaaatttgttttcttgtgtttttaattggaattattgtgtattaatattttgcatttagttttcttttgtcacttgtttttgcatactcttcgatggaggatctctatggagaccctctataattttaaattttaacagatcaatactgatattccatggtgtgtytcatttgctatgtgtgccttggccaaccctagtcatcttattttactatttgctatgtgtgctttggccaaccctagtcatcttattttacttttgaattaaagtagatttacatttttatgtagtttaatcatttgaaagtctacagtttcctaaagtttgaaaacttgtgcttctgtgagggataccagttcgttaatttgcttatgtgccctttgatctcagaagatacactatgactgctcatccatccttgcagtgtgatgttgctactctcgtcgcctttctcatgaagttttg

SEQ ID NO: 26557 - DNA, 601 bp, Human
aatcagttaggcttgtttatggccaccattttgagttattaattaatttatttatttagagatgaagtttcactctgttgcccaggctggagtgcagtggtatggtttcggctcactgcaacctctgcctcccaggttcaactgattttcctgcctcagcctcccaagtatctgggattataggcacccaccaccacacctggctaatttttgtatttttggtagagacggggtttcaccatgttctccaggctggtctcaaactcctgaactcaggtgatccacctgccttggcctctcaaagtgctgggattacaggcgtgacctaccgcgcccggcccattttgagtttaaatcaaaggagacagaaattttctgagaaatcctcctttcttgaatcctttatacacaacattttctagcaattgcataagcaaattggaatctaatcattgtccaaagcttttcccttgagtaagggaatttttcattgaataggtgtgcacaactgattttttactttttaggaattttttagcttctcagttcagttcacagatttttgtaaatttttaaatacaacatttaagtcatacattat

SEQ ID NO: 26558 - DNA, 601 bp, Human
atgatggtggtgttgatggtggcggtggtagggtggaggggagagaagaagatgctgatgatattgataagatgtcgtgacgcaaagaaattggaaaacatgatgaaaattttggtggagttaaagtgaaatgagtagtttttaaacatttttcctgtcctttttttgtcccccctcccttcctttatcgtgtctcaaggtagttgcatacctagtctggagttgtgattattttcccaaaaaatgtgtttttgtaattactatttctttttcctgaaattcgtgattgcaacaaaggcaragggggcggggcgggggaggggaggtaggacccgctccggaaggcgctgtttgaagcttgtcggtctttgaagtctggaagacgtctgcagaggacccttttggcagcacaactgttactctagggagttggtggagatatttttttttcttaagagaacttaaagaactggtgatttttttttaacaaaaaaagggaccattgcaacttttgttaattaaatttttttttttttttttttttttttttttttggagggagaaaactgatgtcttctatgcatccgattcttaacaaaac

SEQ ID NO: 26559 - DNA, 601 bp, Human
agccgggtaagaagacccggggccgcgtgaagatcaagatggagttcatcgacaacaagctgcggcgctacacgaccttcagcaagaggaagacgggcatcatgaagaaggtaccaagccggggggctggccggccccggggcccggttggggtggggatgtgcaaagggagcccgggaggaccgcagagccgaggcggaggtgagaggctgcgagtccgcaggaggtgtgtgggaggggatggctcctgcccggggagggccgaaggggaggggccgccggggaaatgtggggagaggggagatcccgcgaacgctcgcaaccgtggggaaaggcgcagaggtgggagtgaccggcgccagagaggaagagggcccttgctgagtgaaggggtgaggagcggtgatgggaggctacgaggctgccggggaggtggataatgagaacccgggatcagtaggtccagtgcactccggtgttcggacgagggcgccggaaaagcagggagcaaacgagaaggtatggaggtgaggaggctggagctgcatgacaacaatgagcgaacatgtgtgggaggaagtgggcaccacgagagtagtgc

SEQ ID NO: 26560 - DNA, 601 bp, Human
gccattcaagtgcaccaggccccacagcaagcgtctccctcccgtgacagcagcacagacctcacgcagacctcctccagcgggacaggtatagctcgcagccctgtcaccctccctccctgccttcccccacgaggcctagcagtaggtgcccaacagtaaccctcctgtaactaaagtcaggggatttcttaaagtggagattgaggctttgggcctaataattatggggaagtcaggtgaggatgactgggttttgaatcccgccctgcagtgggctgcggattccagaagaaaattrgggaccattgacctacctcctcattcagatgaggagcctgaggcctagaaataagaagttacttgctcaaagacacatttgcttaattatcaggaaggacttagagagcaattttctctttgtgcgagggtcttacaggttttgagtagccacagttaccctcaggtatctctagacatttcagaaatgatgagatactctcaaagtaaggttaattttaagttcttattatttataacctttttactcaaagtgtggcctatggactgggaacaccagcattacctgggagcttgttgg

SEQ ID NO: 26561 - DNA, 601 bp, Human
tcgatgtttgccatgagtattagcttacccaatgggaccgtgccccacctccccacacacaggccttctgtggggctgggcaccgtgtcctcctctgaggaagcagttggggccctcttgccagcctccttgctgaccccaggtcagccctgtgtctgtcacaggctgggtcaaaagagccctggctctgcccctcagggggccagctggggagatgggggcttcttcctcacactgctgtcctctcccccttcagctcctgagtagctgggcctgtgcactgggcaggttcctggggccrcctgccctgccttgccgctccccttggacctccaggggctcctgggttggagggaaccaccagcgttcccttctcccccttgtcttcccccctctcctcccagctgctttacttaaagttgattttgaactttttatttgaggagacgaagtgaaaacaaatctataaatatatatttttaaaatatttaacttttttttatggcgtttttctcgtccccctccctgcccaaactccccttccctggggagccctcaggctccccagaactggctgggcccctggggacagagccacccc

SEQ ID NO: 26562 - DNA, 601 bp, Human
tgggagggggtgagaggcaggaatgggggtcagaagaagtgggagcagcttcttgggctgagtgcagccaaaggggagccagaaatgggcagttctcccagggagtgagcagctactgtaacttttttaaattaagacaaaaagccttgaagaaaatgactttatttttctaagtgtaacctcagtatttatgtaatttgtacaggggccatgccccacccccctcctccccctttggggtagaccttgagggtgggccagcataggggggagggtcttttaccctgtgtcagagcctacyttcaccacctatatccagaaggggagctttttcagaaacagggcagcagtggggtgaaattttcttaacccctaagactgccttcagtaggaacaagctggcttctgtgattaggtgaagggatgggggaagattttatgcacagcctagttatcaaggggatgatttgccgacatgtttgagaaccccctaacctctaaccctcattgctgtcttgccccagtttggggtgccaagatggaagtcacctttctgggctttctcctggagatagctggggcttatgggtggctttcaagg

SEQ ID NO: 26563 - DNA, 601 bp, Human
attacttttgcaccgatcaaacagtttgttgaataagtttattcctgttctgaataacaagaactcctccattgtttggtccattgatccagtgagacggaaggagaaactgagtccctaaaagagggaatgaaaattggcaaggacctcataaagctgttgacagttctactctcatcatgtccattcctgcttaaaccctcagtgctcatccatctcctgtcgggtaccaacaggcctccatgttgctgagaaattatagctactttttaccatgtaccttccatgtgccagagatacktcatgctttgaatatatcttcattaatccctcctataacggcggaagtcagttgcatatatgtatgtaggtgtatatgtatgtatacacacagagtaacaggaaccgtggccagcactccctgggctcttttctcagctgctccaaacttagtttagttcctgacaacacttattctaggacaaagaataattctgaaggcctatacatttctggttgaacatcctaaacagcctgcccctctcacctctggaggacttttggacctgggagtctccagaattgcagacctccccgacac

SEQ ID NO: 26564 - DNA, 601 bp, Human
agaattgcttgaacctgggaggcagaggttgcagtgagccaagattgtgccattgcactccagcctgggcgacacggcgagactccctctcaaaaacaaaacaaaacaaaacaaggcataaaattaatggcaaaacaattaatgtcaaaaacagtaattacttttgcaccgatcaaacagtttgttgaataagtttattcctgttctgaataacaagaactcctccattgtttggtccattgatccagtgagacggaaggagaaactgagtccctaaaagagggaatgaaaattggcaagracctcataaagctgttgacagttctactctcatcatgtccattcctgcttaaaccctcagtgctcatccatctcctgtcgggtaccaacaggcctccatgttgctgagaaattatagctactttttaccatgtaccttccatgtgccagagatacgtcatgctttgaatatatcttcattaatccctcctataacggcggaagtcagttgcatatatgtatgtaggtgtatatgtatgtatacacacagagtaacaggaaccgtggccagcactccctgggctcttttctcagctgctcc

SEQ ID NO: 26565 - DNA, 601 bp, Human
ggtggtgggcacctgtaatcccagctacttgggaggctgaggcaggagaattgcttgaacctgggaggcagaggttgcagtgagccaagattgtgccattgcactccagcctgggcgacacggcgagactccctctcaaaaacaaaacaaaacaaaacaaggcataaaattaatggcaaaacaattaatgtcaaaaacagtaattacttttgcaccgatcaaacagtttgttgaataagtttattcctgttctgaataacaagaactcctccattgtttggtccattgatccagtgagacrgaaggagaaactgagtccctaaaagagggaatgaaaattggcaaggacctcataaagctgttgacagttctactctcatcatgtccattcctgcttaaaccctcagtgctcatccatctcctgtcgggtaccaacaggcctccatgttgctgagaaattatagctactttttaccatgtaccttccatgtgccagagatacgtcatgctttgaatatatcttcattaatccctcctataacggcggaagtcagttgcatatatgtatgtaggtgtatatgtatgtatacacacagagtaa

SEQ ID NO: 26566 - DNA, 601 bp, Human
aaataaaaaataagaataaaaataatgggtcaggcacggtggctcacacctgtaatcccagcactttgggaggccgaggtgggtggatcaccttaggtcaggagttcaagaccagcctgaccaatatggtaaaaccctgtctctactaaaaatacaaaaattagctgggagtggtggtgggcacctgtaatcccagctacttgggaggctgaggcaggagaattgcttgaacctgggaggcagaggttgcagtgagccaagattgtgccattgcactccagcctgggcgacacggcgagaytccctctcaaaaacaaaacaaaacaaaacaaggcataaaattaatggcaaaacaattaatgtcaaaaacagtaattacttttgcaccgatcaaacagtttgttgaataagtttattcctgttctgaataacaagaactcctccattgtttggtccattgatccagtgagacggaaggagaaactgagtccctaaaagagggaatgaaaattggcaaggacctcataaagctgttgacagttctactctcatcatgtccattcctgcttaaaccctcagtgctcatccatctcctgtcggg

SEQ ID NO: 26567 - DNA, 601 bp, Human
atgatgcaaaggaaaataaaaaataagaataaaaataatgggtcaggcacggtggctcacacctgtaatcccagcactttgggaggccgaggtgggtggatcaccttaggtcaggagttcaagaccagcctgaccaatatggtaaaaccctgtctctactaaaaatacaaaaattagctgggagtggtggtgggcacctgtaatcccagctacttgggaggctgaggcaggagaattgcttgaacctgggaggcagaggttgcagtgagccaagattgtgccattgcactccagcctgggygacacggcgagactccctctcaaaaacaaaacaaaacaaaacaaggcataaaattaatggcaaaacaattaatgtcaaaaacagtaattacttttgcaccgatcaaacagtttgttgaataagtttattcctgttctgaataacaagaactcctccattgtttggtccattgatccagtgagacggaaggagaaactgagtccctaaaagagggaatgaaaattggcaaggacctcataaagctgttgacagttctactctcatcatgtccattcctgcttaaaccctcagtgctcatcc

SEQ ID NO: 26568 - DNA, 601 bp, Human
atggtcaagtaaccacctggtcagatggtttccttaagtttattcctcacagcccttgtcatttcctgaaaggcttagctagcagttgggtttctactaggatatttgtctcacacatccaggtgctgacgccatcacacctctgagactagactcagaggagctcgaaactttagggtatagctagatcctctcagcaccttcttccaggattcttgatcttcaggcctgatggggagctcccctttgaacctgcatcatttttattcccctctatttgtaaacctagagagcagctggyttctggagagtgagacggaccaactctatcactgctcagagaggcacagctacggttaaggctgtgagttgaggactctggaccctgcccagccttccagcctaagatctccttcaggatgtcattcttaccttccagtctgctctctttattgcaatttccacttccaacttctcagccaactcctgctttcttctcagttcccctaatgccacctggagcttctcctgcagagaaagacagcttattcgtcccccatgcaaaccaagtaatagggtggggtaatccttgcagcatttt

SEQ ID NO: 26569 - DNA, 601 bp, Human
actgagacatcagccctgtgggtgatgtgatccatctttggtccctggggcactgttcctctccttcctctggtcctaggccccagagatgattctgaccagctcaaagcagaaaggatgtgtggctgcttgtgaggtaaccagaagcccagcatggatgtgacctatggctagggaagggttatcagtttcaggactctgactcaaagaccagtttttttttttttttccccaggggagaaagaaaggagggcagagagggcacatagcccagcttggcttaagcccagaaacaatcacrggcagagaatggccgagttcaggtgtccagaaaccactctattccacttgtgggctagcattgtttgggaaggaaaggttggttagttaaagctcccttgggtacttaatgttgcctcttcctgtatgtgaaaccaaatcactgagaatatttttgtcgtagggattaggcgccattacatgggagctagcaggctcctagactcagtcaaaagtgtgttggaaagcctggtttacagacaggtgtagtggctcactcctgtaatcccagcactttgggaggctgaggggggcagatcac

SEQ ID NO: 26570 - DNA, 601 bp, Human
acccaggaccataggataactatcaaatctctcttcatttccaggtatgctctgctgggtgtctccaagcctcacttgtctccgatcttctgaaagtatcagccacggattggctgtgtctggatccagagtgatgtggactgcagagagaggaccacagtcaggccttgcatggggggagttcactaagtctgtgcctgtggtggggggattttgtgtaaactccagggtaagcatgaggggtgaacctccctgtgtgaggaaatgaccatcagccagttctggccttggtcctgacctytgaagaaaccatcttccttacctccatctctgttccccctgctctgacctgccatctctcctccaagttgccatccaggctccctgaccctgggatctactctgcaccccattatcccccgcaaaactagaacttgcctcacctgcacatgtcctcagcatcttcttcagccctggcacatggcacacactcctgagttctggagaggtaatatccaggtccttcaggttccaggactcactcctgggggaaagagagtttgagactcctgtctcctactcctatcccaaaccctaacac

SEQ ID NO: 26571 - DNA, 601 bp, Human
tacaagatataatagagatctcaccaaagacgacatcctagagatggagaggagaaaaaaaaaacttaagtcccataaagaaggcagaaacatgtttttggttgatcaagatgagtttgggccaaatataaggaggctgcttcactggagggaatcacaaagccatctggggcaggaatgttgatggtgaagtgacttccctgctaaagctcgcttgctgggatccggatgcctctgcagagacaaaggtggttcagagttcatggggaaaagaggcagggtttgtggctgagaagcggtkccaatggggagagtggcagtgtccagagaaagccatcaatagtcagtggatccttgtgatccaatattcagtggacagagggttagaggggctgtgttttttcctccatcattgaaaccaggactgaagaagggccgcagaggtcctgtaaaggcacattcagagaaggagtagatgagggagccatggtcagtgatgttgtagaaggagaccatgccagcctcatagtccaggaaaatcccaacttggcatggaggcacctgaaggtggaggggagtctgggggtaggtgccagcctca

SEQ ID NO: 26572 - DNA, 601 bp, Human
caagaagaggaagaaggcagaagggagacatcccacagggattcttcagtctgcttggcagcaggggcggataacgggggtgacgatggggtagtttttctgaaatcaagcctcctagtaacacatacgggtcaagcagggcgtgaacaaggcagatgaccattgaacaagacactctgatggcttagatgtgtagaaaacaagggttttggcaaatgaatgaagacggactcccggcgtggaagctaaagacacgtcagccctgagcgcgaggggctgggggtggagcggagccggaggyggccaaaagaaacagcccggctgcggcgcgctcggagcgcagccgtgtccagcgcctcctcctgcagccgaggaccctccagttctggccgctcctgcaggcgagggtccagggcaagaggagcaagcccagccctcggccggccacgaagcaaggtcgcccgggcacggccccgcgctccgcgtgcaaggggcaggccgcagcggggtctccagcgcccgcggggacccctgctgctacgagcctaggcttggggagagggcggagagaggccagcggggtggacgcggaccccaggac

SEQ ID NO: 26573 - DNA, 601 bp, Human
cttaagttctaatgttctatgtaggaaacactgttatcagaggtgactacagctgaaactcttagaactggatagtttgtaagccaaggaacaaatatctgtaatcatatccatggtaaaaactggcttgcatgaaaaacattgtttagtaaaaactgtattggtagcttcaggtttgatagcaaagaaagaatccaattatttttgcatgtggcttcaaacatgttttaagatattttttctcaaacttagtgttacaaagtacaggtataatgcaaaaaaaaggtgaatcacagttttrtagacaatagtactctaagtaagtcacattatatctatttcaggcaagaccataaaaagaatttcaaagttctagtgtcttccaacatctctcagaaaaaatgatgatgtggcaattctgtggataaaaaacatgggaagggaagcgtgttttcacccaggagaaacagttaaggaccatgcatttgcagtcttttccatgtctttaagttctcactggctgctaagatttattgcaaaatattaaagaacactgaaccatgcattatgaactaaagagatttcactgcctgctgaacaa

SEQ ID NO: 26574 - DNA, 601 bp, Human
gcaaattaaggaaaataattttttgcaaagataagaaacttctaaatgtaatccctgtcattaaccatacaaagcaaactaaacaacccccacgtttaaaagaaaacagcattcttggccggcgcggtggctcacgcctgtaatcccagcactttagaaggctgaggagggtgaattacttgaggccaggagttcaagaccagcctggccaatacagagaaaccccgcctctactgaaaatgcaaaaattagctgggtgtggtggcacacacctgtggttccagctactccagaggctgargcaggagaatcgcttgaacccaggaggcagaagttgcagtgagccaagattgtaccactgcactccagcctgggcgacacagcaagacaccgtctcaaaaaaataaaaataaaaaaataaagcattcttaagttctaatgttctatgtaggaaacactgttatcagaggtgactacagctgaaactcttagaactggatagtttgtaagccaaggaacaaatatctgtaatcatatccatggtaaaaactggcttgcatgaaaaacattgtttagtaaaaactgtattggtagcttcagg

SEQ ID NO: 26575 - DNA, 601 bp, Human
acctcggcttcatcatcttcatcctcaattatggaatcttctactgtttcttcatcctctgtaagatcttgtgccactgctaacaagcctaatgataaaatacagaaaaagcagttaccctttactctgaaatactaatttctttttttaacatcaggtataggcaaaaaaaacttcccttggactaacagaatctcccagttcacctgaatgatgccaattacaatgcaccgaagaatatttatattttagtttactagtagtcttaacaactgcatatcaattttttttttttttttttaagagtcagggtcttgctctgatgcctaggttgggagtacagttgtgcagtcatagctcactgcagcctcaaactcctgggcccaagtgatccttccacctcagcttcctgggtagctaggactagaggcgtgaaccactgttccctgccttccatgttatttttaatgggaaatgtggtttaacttcaaaaagtgcccaacagatggaaaaatgaatggcacaaactaaagatgccttgaagcacaaagaacttcaagcaactttgttaagcaaattaaggaaaataattttttgcaaa

SEQ ID NO: 26576 - DNA, 601 bp, Human
atgaggatcatcacttgagcccagaagttttagactagcctgggcaacatagcaagaccctgtctctacaaaaaaaaattacaaaaattagccgggcttgttggggcatgacggtagtcctagctactcaggaggctgaggcaagaggatcacttgagcccaggagttcgaggctgcagtgagctatgctcgtgccactgcactccagcctggggaacagagcaagtctctgtctctaaaaataaataagtaaggataaattctagatgtactattgataacggttttgctgtgtccccarccaaatctcatcttgaagtgtagttcccataatctgcacatcgtgggaggaacctggtgggaggtaaatgaatcacggggacggttacctccatgctgttctcgtgaaagtgagttctcacaagatctgatggtttttataaggggctttccccaccctttgctctgcacttctccttgctgtcaccttgtgaagaaggacatgtttgcttcaatttctgccatgatggtaagtttcctgaggcctccccagtcatgctgaactgtgggtcaatgaaacctttttcctttataaattacc

SEQ ID NO: 26577 - DNA, 601 bp, Human
gtgccttcagagtccgaggcatgaggatcatcacttgagcccagaagttttagactagcctgggcaacatagcaagaccctgtctctacaaaaaaaaattacaaaaattagccgggcttgttggggcatgacggtagtcctagctactcaggaggctgaggcaagaggatcacttgagcccaggagttcgaggctgcagtgagctatgctcgtgccactgcactccagcctggggaacagagcaagtctctgtctctaaaaataaataagtaaggataaattctagatgtactattgataacggttttgctgtgtccccaaccaaatctcatcttgaagtgtagttcccataatctgcacatcgtgggaggaacctggtgggaggtaaatgaatcacggggacggttacctccatgctgttctcgtgaaagtgagttctcacaagatctgatggtttttataaggggctttccccaccctttgctctgcacttctccttgctgtcaccttgtgaagaaggacatgtttgcttcaatttctgccatgatggtaagtttcctgaggcctccccagtcatgctgaactgtgggtcaatgaaacc

SEQ ID NO: 26578 - DNA, 601 bp, Human
cattaacaaacctctaaaagttgggattttaaatttttgtataaggataagctctaggccaggtgtggtggctcatgcccataatcccagtgccttcagagtccgaggcatgaggatcatcacttgagcccagaagttttagactagcctgggcaacatagcaagaccctgtctctacaaaaaaaaattacaaaaattagccgggcttgttggggcatgacggtagtcctagctactcaggaggctgaggcaagaggatcacttgagcccaggagttcgaggctgcagtgagctatgctcrtgccactgcactccagcctggggaacagagcaagtctctgtctctaaaaataaataagtaaggataaattctagatgtactattgataacggttttgctgtgtccccaaccaaatctcatcttgaagtgtagttcccataatctgcacatcgtgggaggaacctggtgggaggtaaatgaatcacggggacggttacctccatgctgttctcgtgaaagtgagttctcacaagatctgatggtttttataaggggctttccccaccctttgctctgcacttctccttgctgtcaccttgt

SEQ ID NO: 26579 - DNA, 601 bp, Human
ggaagcagcaggtattccaaatctatgaaaccatgaggtccagtgctatttctactatgttgttacccttctagactcatgtcaccacgatcctgaattgttaactatttcatgtctccttccctgttccagaaaatacttatgctctgttctcaatgactggtgcctattctcccaacttcaattcactttgatcacattaacaaacctctaaaagttgggattttaaatttttgtataaggataagctctaggccaggtgtggtggctcatgcccataatcccagtgccttcagagtcygaggcatgaggatcatcacttgagcccagaagttttagactagcctgggcaacatagcaagaccctgtctctacaaaaaaaaattacaaaaattagccgggcttgttggggcatgacggtagtcctagctactcaggaggctgaggcaagaggatcacttgagcccaggagttcgaggctgcagtgagctatgctcgtgccactgcactccagcctggggaacagagcaagtctctgtctctaaaaataaataagtaaggataaattctagatgtactattgataacggttttgctgtgt

SEQ ID NO: 26580 - DNA, 601 bp, Human
agcaagcgaaaaagaaactgagacccacagagataagtcagaaaaggaagcagcaggtattccaaatctatgaaaccatgaggtccagtgctatttctactatgttgttacccttctagactcatgtcaccacgatcctgaattgttaactatttcatgtctccttccctgttccagaaaatacttatgctctgttctcaatgactggtgcctattctcccaacttcaattcactttgatcacattaacaaacctctaaaagttgggattttaaatttttgtataaggataagctctaggycaggtgtggtggctcatgcccataatcccagtgccttcagagtccgaggcatgaggatcatcacttgagcccagaagttttagactagcctgggcaacatagcaagaccctgtctctacaaaaaaaaattacaaaaattagccgggcttgttggggcatgacggtagtcctagctactcaggaggctgaggcaagaggatcacttgagcccaggagttcgaggctgcagtgagctatgctcgtgccactgcactccagcctggggaacagagcaagtctctgtctctaaaaataaataag

SEQ ID NO: 26581 - DNA, 601 bp, Human
acaaaatctggaatcatgagaggttccaggttcaagtatgacacgaaaatagaaagaaaaaaagctgtgtaggatggattatagtcgttccagagaggaaataaaattaactagatgcatgctgcaatgatcccaattccagcccaatattcttactgttgtattacatagtaaacatttcagagctgaacaacttttaagagatcttctctaacccccttattcttcaccagatatattttacatactgtttgttgtctgcttctcaccccctgccattaaaacacatataactgccccmaaaaaaagtctgaaagagcagagaaaatatctggtttgcccacccagcaccaagaacagtgcctggcacataaggattcagaaatacaacaagcaagcaaaaagaataaaaacagagtaaaagcaagcaagcgaaaaagaaactgagacccacagagataagtcagaaaaggaagcagcaggtattccaaatctatgaaaccatgaggtccagtgctatttctactatgttgttacccttctagactcatgtcaccacgatcctgaattgttaactatttcatgtctccttccctgttcc

SEQ ID NO: 26582 - DNA, 601 bp, Human
gagactgaggcaggagactggcgtgaacccgggaggtggagcttgcagtgagcggagatccacgccactgcactccagcctgggcgacagagcgagactctgtctgggtggtgggggggtgggggaaagcccaaggtgacttaaaaaaaaaaaaaaaaggtttgtcctcaaaagttctaaaccaataacctgtgtctaaaccagctgttgatatcttagatcttatgaaaaacccccttttccttcacttgactccaggacactggcccagtggcaaaggatccttccatatctcccaatyccttgatgccttggcagctgagtatagggtgataaatcttgggaacagcagcagtaggtgaactttctagctcattcagttctggaggtgacttctgtagcagccttgcctttgagggcccatctttcttagacagtctacacacaagcctacccctgctggtgtggtctagtacaatggaaggtaatacttttcctgcctttctatttcaatctaccttaattattttctgatttgagataagtaacaaagcagagggtactaacacttctgtactaattggccagggtagaaagtgga

SEQ ID NO: 26583 - DNA, 601 bp, Human
tgtaacaaaattccgcaggaagagatgaacacaggtggaagggttagccttagaagagaacaaggacaactcattattaagaagaaaatgcagaacgatgggtgaataatatatttggaagtagaaaatacaaaatctgatagagttcatgcttgatggccttcttcactttctgacactgaaggcaatgttgctgccaagactgaaaactcatttagggatttaaacatggcaaatgtttggaacactgattgtggaaaactaagtaactcatttatcttacagctattcagcatgtaaratgtataacgcttagtatctgctacccggtaaaactccagaatatttcagctattgcaaacaatctccagaggagagtatagaaactggtggtactgcttgcctacagggagatgacttcatggctggaaggcacacaagggaaacttttcatcatatattctgtaccttgtaagttctgagccatttgaatatatcatctattttaaataactattttttttttgagacggagtctcgctctgttgcccaggctggagtgtagtggagtatagtgcccaggcacgatctcagctcactg

SEQ ID NO: 26584 - DNA, 601 bp, Human
taggtgcagcaaatgtggatgaacagtataagcagatgtgtggcttaacagaatcaaatcactgaggaggattaatgcctgacgttacaaaaggaaagaataatgtaacaaaattccgcaggaagagatgaacacaggtggaagggttagccttagaagagaacaaggacaactcattattaagaagaaaatgcagaacgatgggtgaataatatatttggaagtagaaaatacaaaatctgatagagttcatgcttgatggccttcttcactttctgacactgaaggcaatgttgctgcsaagactgaaaactcatttagggatttaaacatggcaaatgtttggaacactgattgtggaaaactaagtaactcatttatcttacagctattcagcatgtaagatgtataacgcttagtatctgctacccggtaaaactccagaatatttcagctattgcaaacaatctccagaggagagtatagaaactggtggtactgcttgcctacagggagatgacttcatggctggaaggcacacaagggaaacttttcatcatatattctgtaccttgtaagttctgagccatttgaatatatc

SEQ ID NO: 26585 - DNA, 601 bp, Human
caattaagaggagattactatgggagaaaaaaaaatcattatttaaaaataaagatttggccgggcacggtggctcacacttataatctcagcacttggccgaggcaggcagatcacctgaagtcaggagctcgagaccagcctggccaacatggcgaaaccccgttctctactaaaaatacaaaaattagccaggtgtggtggcacatgcctgtaatcccagctactcggaaggctaaggcaggagaatcgcttgaatccgggaggtagaggttgtatgagctgagaatgccccaatgcragactccgactcaaaaaaaagaaataaagacttcactttatgttaggaagaaatattgcttctctacagctttgctgggattagcaataagaatttcatcatacctcattaattaaaacagaacttttggagcagtgcctcttgaacagtaatgtgcctaccaattctttggggatgttgcagatctaattcaggtctagggcaaagcctatcattctctttctaacaagcacccagaaaatgccaaagctgctggtattcagaccatattgtgaactccaaggttctagaacagagctt

SEQ ID NO: 26586 - DNA, 601 bp, Human
caggtgaatttaaaagaaggaactaaaacttcatatatacctgttggattaaattttattctactcaaaaacaagctaaaatcagtaattctttaagctacttaactatagagttaagtaataactgtaagttattattttgaggacaggatgaaaatacttccttttctctactaagtaatcagaaaaaagaaaacttgattgcagcactagaaatttaactcagacacaaggtaaacatgttaacaccagggtaatgaaaaggttgaattagcttccaagagaaaataaaatttcctcrtctgaaaactttttgacagaggaatggtttagatgtgctctcatttagaggacctatttctactagggttctctcattcagtcattgatgactgatatatagtatacattattaaaaatcataaggcatcagagcttatattaggacatttggttctcctaaatcaaaaagtaaatgataaaccttgctgctgaaactacattgaaaatatatggttctattttatctatgagtacataaaatgatgggaaaacaattatagacagtctttaaatttacaaacagaagtagtaaaatggg

SEQ ID NO: 26587 - DNA, 601 bp, Human
atgaatcaatttacatatctaaggcttcaggttttattttaaaaaggtacaacaaagttctacgtatacaaacccacagtgacagtatgaggccgaagaactagactgcttaacttagtacttaacaacttttgaaacacggctgtaagaggtgttcatccataattacctttctagattctaggagttgatgaaggccaacaataaccagaagcccaagaccagcaaggaacatatacataaagattctggtacaaaaggagaaaatatgaactgtctttaattcagaggaaataccacrtctaattacaactataattataacacataatagaagctttccaaataacttgtggcgaaaaggaataaaatgctttgtattcaacttaaatccaggtagttaagttttataaattacctttaagagcaattagtcaattaaaaaaaactctatgattgaaaatagaattacaatttatgctctattcaaaagcttggtttataaaataattgcattagctttcatctccctggaatattacattattttgcacaatccaatttaaaaattaccttaagtgaattatatataagtttagag

SEQ ID NO: 26588 - DNA, 601 bp, Human
ttatttcactagttttgagggacagatggtgtttggctacatgggtaagttctttagtggtgacttctgagactctggcgcatccatcacccaagctgtgtatacgataacccatgtgtagtcttttatccctcacccccctcctacccttccccgagtcccaaaagtccattatatcattcttatgcctctgcgtcctcagagcttagctcctcaatgatttcctttcctccccacccccaccttttcttttgagacagagtctcactgtcacccaggctggagtgcagtggcaccatcrtggagcaatcacggacctaccaggctcaagcaatcctcccacctcagcctaggcgcacgtcaacacatgtatttttttttcattctttgtagagatggggtctcactatgttgccaaggctagtctcaaactcctgggctcaggcgatcctcctgcctcagcctcccaaagtgctgggattacaggtgtgaaccaccacgcctggccaaatattgtattttttatctgcttttggttgcagatgtggaacccaccaatataccgagggtcaattatattgaaaaaatctgtatataaagt

SEQ ID NO: 26589 - DNA, 601 bp, Human
aggggctcttcaacttacctaaaactgagctgtgagtacagacaaatgtttctgatgaagaaagtctacaacttttatcagattttcaaaaaggttagactaggaactactgcccttacagacaaccaatctctaaataaaactttttcaaataagcagtatgctgaacatagtcttttgaggattcaaaaagtactctaggatttaacagccatctgtgtgagcatcactgttatatgcagatgtgagctgggcatggtggctcacacctataatcccagcactttgggcggctgaggtrgacagatcacttgagcccgtaagttcaagaccagcctgggcaacatggtgaaaccccctccctacaacaaatataaaaattcagctgggcatggtggtgtgcgtctgtagtcccagttatttgggaggctgaggtgggcggattgagcccaggaggtcgaggatgcagtgagccatgatcacgtaactgcactccagcctgggtgacagagtgagatcctgtctcaaaagaaaaaaaaacagatgtgtagctcccatgacttgagctaccactgatgctatatgtcccaatgtttccaaa

SEQ ID NO: 26590 - DNA, 601 bp, Human
tcaattctataacttaaccaagtttatacatgcataagtaaacgcttaaaaactgctgattttgtatttacaaatgcagtcatgcagtttgcataatttttcaatttcataaatttacctggaataagcagcagaataaaggaaatcagtatttcaatgctaaaacaattctatgcacacaagctgtatctcccatatgtttgttagattctcagtagggtctatttaacagaaaatacatttgtggtgggtttttctacttccatttggtaagaggtgtcatttataagtttcctcaacmagtgaaaggctggatgtatgtaccttccctctattattgtcttgtcttactttctggggggtactttacatattaggaagattttagaataagttagaaattacttgtataattgtttttgtattgattttgattgattttgcattcattgatttcgtattgtttttttttggtatgtttgtatactgtagaataagttagaaataaaaatcattttttccagttaaaaaaagtgaagggctagaaagtgattttcaccaaagcatggggcttatctgtaagcatttcataaaatggaaa

SEQ ID NO: 26591 - DNA, 601 bp, Human
ctgggcaaccttcttggtgaagctttatctggaagaaaagagaaagttttaagcttgcctattataagtatattgaattcaaaagacatgttaaaaagtatttaccttcaactttaccactaagttacacacacacatgggtgaacaccatctaataatgaatgcctcctatctagctctaggttttaaaaacaatctttaacataatccttcaagaggtaaccccaattaaaatgaaagtgttttgcaattagggtgggtaagagatttaaacttggttattgtactgctgaagacaccrtgcaaaatcttcaattctataacttaaccaagtttatacatgcataagtaaacgcttaaaaactgctgattttgtatttacaaatgcagtcatgcagtttgcataatttttcaatttcataaatttacctggaataagcagcagaataaaggaaatcagtatttcaatgctaaaacaattctatgcacacaagctgtatctcccatatgtttgttagattctcagtagggtctatttaacagaaaatacatttgtggtgggtttttctacttccatttggtaagaggtgtcatttataag

SEQ ID NO: 26592 - DNA, 601 bp, Human
ggttaagtaaagaccgaattgttgcacaaaggaacatttactcatcagatcccactgatctcttctgtgcccgtttcctgggcaaccttcttggtgaagctttatctggaagaaaagagaaagttttaagcttgcctattataagtatattgaattcaaaagacatgttaaaaagtatttaccttcaactttaccactaagttacacacacacatgggtgaacaccatctaataatgaatgcctcctatctagctctaggttttaaaaacaatctttaacataatccttcaagaggtaacyccaattaaaatgaaagtgttttgcaattagggtgggtaagagatttaaacttggttattgtactgctgaagacaccatgcaaaatcttcaattctataacttaaccaagtttatacatgcataagtaaacgcttaaaaactgctgattttgtatttacaaatgcagtcatgcagtttgcataatttttcaatttcataaatttacctggaataagcagcagaataaaggaaatcagtatttcaatgctaaaacaattctatgcacacaagctgtatctcccatatgtttgttagattctc

SEQ ID NO: 26593 - DNA, 601 bp, Human
aaaatattagggcaggttaagtaaagaccgaattgttgcacaaaggaacatttactcatcagatcccactgatctcttctgtgcccgtttcctgggcaaccttcttggtgaagctttatctggaagaaaagagaaagttttaagcttgcctattataagtatattgaattcaaaagacatgttaaaaagtatttaccttcaactttaccactaagttacacacacacatgggtgaacaccatctaataatgaatgcctcctatctagctctaggttttaaaaacaatctttaacataatcyttcaagaggtaaccccaattaaaatgaaagtgttttgcaattagggtgggtaagagatttaaacttggttattgtactgctgaagacaccatgcaaaatcttcaattctataacttaaccaagtttatacatgcataagtaaacgcttaaaaactgctgattttgtatttacaaatgcagtcatgcagtttgcataatttttcaatttcataaatttacctggaataagcagcagaataaaggaaatcagtatttcaatgctaaaacaattctatgcacacaagctgtatctcccatatg

SEQ ID NO: 26594 - DNA, 601 bp, Human
cacacaagtaggagttgccttctatggtgacatggcttctctgcactaattcccatcaggccgaaaaatattagggcaggttaagtaaagaccgaattgttgcacaaaggaacatttactcatcagatcccactgatctcttctgtgcccgtttcctgggcaaccttcttggtgaagctttatctggaagaaaagagaaagttttaagcttgcctattataagtatattgaattcaaaagacatgttaaaaagtatttaccttcaactttaccactaagttacacacacacatgggtgaayaccatctaataatgaatgcctcctatctagctctaggttttaaaaacaatctttaacataatccttcaagaggtaaccccaattaaaatgaaagtgttttgcaattagggtgggtaagagatttaaacttggttattgtactgctgaagacaccatgcaaaatcttcaattctataacttaaccaagtttatacatgcataagtaaacgcttaaaaactgctgattttgtatttacaaatgcagtcatgcagtttgcataatttttcaatttcataaatttacctggaataagcagcaga

SEQ ID NO: 26595 - DNA, 601 bp, Human
atttcatgtttcacaatttgttgccagagagatccccaaattccttgaagccactgggaagttttctgaagatgcgcattaaacagcagcaaaatactgaaacaattctattgctaaaaagcagctacttctgcttctgcctttagaatactaattgtaatacagtaacaacaacaaaatgctgatttgtgccatcaattgaaatttgagctattccaaaaattgttttctttaaaactgttcaaggcaggacatcaataatcatagtgggtaaatattaactgagttttgggggaaaaaatcagaaaatgtcaaaaaggaagagacaacagcattatatttagtattctaaagacttgtttcaggtagttcaacaatgattctggtaagaccaactgctcacatacatacacacgcacacacatagattttaatggtttaaaaaaaaaccaaatttgttactttagaaaaatgaatgcagtgcattttcagcaatattatcgccacagactctgattgctcagtccacacacaagtaggagttgccttctatggtgacatggcttctctgcactaattcccatcaggccgaaaaatatta

SEQ ID NO: 26596 - DNA, 601 bp, Human; identical to SEQ ID NO: 23628

SEQ ID NO: 26597 - DNA, 601 bp, Human
taaaacacactcattctaggaaatcttgggctagaggaatgggataacataaggcctggaaggaaacctgaaaatggtccagtccagccattttgctttttacaaaggaaatctgagccccagggaagtgagatggcttgctctgggctacccagtgaaatctctgactgtgtttgggactgatttgaaatagatggagacttaaaatctgcattatgacatttaaccagagggcttttttttttttttttttttttaatcatggccaattgtgttgttgcacggtcatggtttcagccaratctgatgtcttaaaagcttgtttccagaaacttcaccattcccttcaggcttatggcaaaaaatggtcaatgaaagcacccagggatgctgcagatgaggctggctttctatgagctgcatgaaaagacttttcctataacagtagggaaaaaaaagcccaagctgcttaaactgtcacaaccaatcacaaacatatttttttcctgcaaaagctgggaagactgcaagctaaaataagagcatgactgtggcaatttaaccctccctcccagtctggctctgccagccagccacctgc

SEQ ID NO: 26598 - DNA, 601 bp, Human
ttggaaatatgccgtattatagatcatgatttgtcacagaatccttaaggatctaaattgtaatagtggctttgctaatgtacctctccccccacccctaactaccacacaaacacatactttgtccttagcccctgtctggctaagaattcttcatttcttttcctaatggtgaaggaagtctccaataattaatcagatctcccctccccaccctctgcacctgtttcctctgtgcaataagaatcttcctaggggaaatttaaaaccaagagttatatagagacagcccacttgagagaaatggttggatttttctgttctgaggaaaccatttagaaccccatgataaagtcacttccaaggactagagaagtgatttttacaaattgatttgtggttctgaagggcactcacctgtagttaagggtgaaaaagaaattttacacagcgtttgtgttaggcaccttagcctttccctaaggaggaactacttttttgttgcatgtatgtacatgactaaatcacttgtaagccccagagggacttggctgttgccactgtcttaagaagggtggtggcacctggctaggaaattaat

SEQ ID NO: 26599 - DNA, 601 bp, Human
atagaggctgggaaagcaggatgtctcaggaaggtgagcagcttcaatggagcaaagcaagcccagcatggaaccggacatttctacaatcctgagcaggaataatatagcctgttaaagtgaaatttttggagaaaggttgcatggaagattccggttttcaagggctggccacattttttttttctccaattgacctttcctaatgagtccctaagatgaaagagggagataagaagactttctttgtgaccattttctaaaggtgttgaaaataaggcactgattagaagaaataatrgcctggttaaaaatttactagtctcttcttagataaattgggacctctagtcgagtagctatatagttctgcctaaagacctctctgcctttctaatggaagatgctacttcagatgaaatagggagattagtatcgcctcaaaattggaaatatgccgtattatagatcatgatttgtcacagaatccttaaggatctaaattgtaatagtggctttgctaatgtacctctccccccacccctaactaccacacaaacacatactttgtccttagcccctgtctggctaagaattcttc

SEQ ID NO: 26600 - DNA, 601 bp, Human
gctcctggtccagtcacaggcttttggattctcccagccccaaatctcatgctagataagtcacaggaaggtggaatgaacctgtaactacttcctcttgcaattctgtgccaattggcactgacttagcgtgtgtctatggtgggatagaggctgggaaagcaggatgtctcaggaaggtgagcagcttcaatggagcaaagcaagcccagcatggaaccggacatttctacaatcctgagcaggaataatatagcctgttaaagtgaaatttttggagaaaggttgcatggaagattcyggttttcaagggctggccacattttttttttctccaattgacctttcctaatgagtccctaagatgaaagagggagataagaagactttctttgtgaccattttctaaaggtgttgaaaataaggcactgattagaagaaataatggcctggttaaaaatttactagtctcttcttagataaattgggacctctagtcgagtagctatatagttctgcctaaagacctctctgcctttctaatggaagatgctacttcagatgaaatagggagattagtatcgcctcaaaattggaaata

SEQ ID NO: 26601 - DNA, 601 bp, Human
gcttcccacagggttgaaagcatagtctgcaaattcaggcaggtggaaactccagctacctctttaccctctaggtgcatttctgtcatggaaaatccccttgttctggctcctggtccagtcacaggcttttggattctcccagccccaaatctcatgctagataagtcacaggaaggtggaatgaacctgtaactacttcctcttgcaattctgtgccaattggcactgacttagcgtgtgtctatggtgggatagaggctgggaaagcaggatgtctcaggaaggtgagcagcttcartggagcaaagcaagcccagcatggaaccggacatttctacaatcctgagcaggaataatatagcctgttaaagtgaaatttttggagaaaggttgcatggaagattccggttttcaagggctggccacattttttttttctccaattgacctttcctaatgagtccctaagatgaaagagggagataagaagactttctttgtgaccattttctaaaggtgttgaaaataaggcactgattagaagaaataatggcctggttaaaaatttactagtctcttcttagataaattgggacct

SEQ ID NO: 26602 - DNA, 601 bp, Human
accctgtctctactaaaaatacaaaaattagctgggcgtggtggtgagtgcttgtaatcccagctactctggaggctgaggcaggagaattgcttgaacccaggagatggaggttgcagtgaactgagatctcaccactgtactccagcctgggcaacagagcgatactctgtcaaaaaaaaaaaaaaaaaaaaaaaaaaagaagaagaagattcctttctttatctttatggaggatggaggagatgtgttggaaagacttggtggactaagtgttctgatcacccagcccgaaaggacstttttaattatgtttcttttttctcactttgaaaattccatccctgacctttttttttttgataaagaataagatcagatattctccatagctactgtttcagccatgcttacccaaatacacacatactgcctaggaacgttctgtgtgagggtttataaatagtcctttgtttcccttgatcaatattattcttctgtttcctgttccctatccatgccctagagagttggaagctttgtcagttttcccactctggatctgggttggtctaagtggttcccaagcctcgcaccgccc

SEQ ID NO: 26603 - DNA, 601 bp, Human
gacttagcaatcatcacctatttagtgagcaccttcttgtgctatggtcttatagttcctatagctattggtaggatgtgtccatccttttgggagagaaaggacgcaaatttaattgtggactaccacggtgcacatatattcaattgtgcttggtattctatttttgggttgtggctatttcctgcagattttgctggctgccatttttgaagtagaaatcaaatagcttggctcaaggccacatgagttctaagcccaacttagttattcacaagctgtgtgaccttcagcaggtcaytccactctctgagcctttattctttaatcagtaaaatgaggcagttagtctagttaacctcagcagtcatctccaactatgacattctatgtttctagggattcaatacacatttttcttctcaattttacaaaaaatagagcagctctgcttacatcccctcctttgcagtggtagttaggactgcttaagaagattcctttcttggctgggcatggtggctcatgcctgcagtcccagcactttgggaggccaagatgggtggatcacctgaggtcaggagttcaagaccagcccggc

SEQ ID NO: 26604 - DNA, 601 bp, Human
aattatatccagctgtggtcaaaactgggactctctggcacagaggaacattttccaactctttggaattacaaagcacatgagtcaaaggagatctcctttggatggggaaatgaggagaaaaccagttttggagaaacatagaataaacaactttgcaccagcagcttctgacatctacacacccatatagatctccaggcatcacctggctcttgggctctgctaggacctgggtctttggatggctgtgtctatttcagagggtgattagatcctggtgggtggtttctgatctccyatccctccaataaggactttataacttagaagttaacccttccatttctagaaagagctgttcatgccagatgagtccccagataggctggaaaatacaatctttccctagaaagggataaaaagaaatgctagttcttccttagaaggacttgaaagctcttgtctggacaaagaagtctagtacccttaaggtaattaagcttctgcagccagctttgcagcttcagggccatacatttccttcaggccccactttgtcagagtgcctgctcttttttggagggtttctacctttcta

SEQ ID NO: 26605 - DNA, 601 bp, Human
aacgtgggtaatgaggtgatatggtcacccttctgtggcccagcagaaggaagctggggactgagaggcaagtgcagtgtcttggttgctgacacaggcctggtgaaacccttccctccagggagaattatatccagctgtggtcaaaactgggactctctggcacagaggaacattttccaactctttggaattacaaagcacatgagtcaaaggagatctcctttggatggggaaatgaggagaaaaccagttttggagaaacatagaataaacaactttgcaccagcagcttctgacrtctacacacccatatagatctccaggcatcacctggctcttgggctctgctaggacctgggtctttggatggctgtgtctatttcagagggtgattagatcctggtgggtggtttctgatctcccatccctccaataaggactttataacttagaagttaacccttccatttctagaaagagctgttcatgccagatgagtccccagataggctggaaaatacaatctttccctagaaagggataaaaagaaatgctagttcttccttagaaggacttgaaagctcttgtctggacaaag

SEQ ID NO: 26606 - DNA, 601 bp, Human
tcttccgtgaaaagaaacctgtttatttttaactcaccaaacagtgcacaggatcaaacatctttctagaataacttaatcccccagagaggttatttcaaagatgtgtggtaaatagcatggaacgtgggtaatgaggtgatatggtcacccttctgtggcccagcagaaggaagctggggactgagaggcaagtgcagtgtcttggttgctgacacaggcctggtgaaacccttccctccagggagaattatatccagctgtggtcaaaactgggactctctggcacagaggaacattktccaactctttggaattacaaagcacatgagtcaaaggagatctcctttggatggggaaatgaggagaaaaccagttttggagaaacatagaataaacaactttgcaccagcagcttctgacatctacacacccatatagatctccaggcatcacctggctcttgggctctgctaggacctgggtctttggatggctgtgtctatttcagagggtgattagatcctggtgggtggtttctgatctcccatccctccaataaggactttataacttagaagttaacccttccatttctaga

SEQ ID NO: 26607 - DNA, 601 bp, Human
gagattagtagccattgtacatgcatgtgtaattattttgatgcttttttgtaattttcctttttttggtggtgtgtgggcacaggtgtgtgtgtgtgtgtgtgtatgcagatctgtgcatcttctgatgaaacttctgtctaaggccccctcttctgtgtgccatgcatttttctacaaaatctaatgcccttatcacatacttggacagccctgataaaagatattgactgactccatcttcagccctccttcaaaggtatattgtagtcagaaggccaaatcctaggcaagaagtctrtttaaatggaaatattggtggtttttaagggttcatgctactataattcatgaatccttcttctactataccagagtttgctaacctcttccctttttggatatttatagatctttgtttgccatcacataggccagcatttgatggttttgtgatggctttctttcgctgactagactgtaagcttactgaaggcaggatttgtgtccttctttgtattccttatggcccggtgccatcgtgctacattgcctgatcactgcacatttgttgatttattttgcagccactaaggaaatg

SEQ ID NO: 26608 - DNA, 601 bp, Human
agacagatcttcatgtttagagttgaggagatttagatcacactttgaagagcaggctgactgtggtgactgacatttttagaaacagaattacagagctagctgggaccacagagaccatttggtgactagttcaactctcattttgtagagaagaaactaaggtggatgaggtgaagcaaattagaatgaagtgagtccaatgctcatcactgagattagtagccattgtacatgcatgtgtaattattttgatgcttttttgtaattttcctttttttggtggtgtgtgggcacaggggtgtgtgtgtgtgtgtgtatgcagatctgtgcatcttctgatgaaacttctgtctaaggccccctcttctgtgtgccatgcatttttctacaaaatctaatgcccttatcacatacttggacagccctgataaaagatattgactgactccatcttcagccctccttcaaaggtatattgtagtcagaaggccaaatcctaggcaagaagtctatttaaatggaaatattggtggtttttaagggttcatgctactataattcatgaatccttcttctactataccagagtttgctaacc

SEQ ID NO: 26609 - DNA, 601 bp, Human
ttgaattaaaactacttctacccccttagttataaaaaaggccacaaggagcatttatgtggatatctggaagtgagatagttattccattcccaggaaaagaaaaataaagctaagttacaaaactaaatctatatgcaataaagttattatatactgctttgtttaagcagagtcctctggaatttatgtacagtacattagttttcagctatttatattccacagttagaccttaagattctctggttttaagacaattgttaaagatacttttaaagctctgagcagttacagtacrtaaagatgttagctttttgtttttcattagatgcaagaagatgcaggctcaaagtctggttggacagccaggctcaagcaatttggtaaatgtgtcggaaagaaaattagacattggaggatcaagaccataagacactagctcattagagatcaagaattcaaatgtgacattcatattcgtccatggccagcacagattcataacacgaattccatttaacatctttatgagcatttaagacatgcatttaaataaagtttccttatcagctaactctactggggcaaccgttctaaa

SEQ ID NO: 26610 - DNA, 601 bp, Human
gtaggggatgtcaagctgtggcaccttagtgacagcaggaagcatggggccttcagtgcttggggtgaagtgagggtggttctaggcccatcactagctcacatggtataatgagaataatctagcagatttgagttcattctctggctttgccacttacttgtgtgtgactttgggcaagttactcaactctaagtctccattttcttatctagaaagtcgcactaggccgggtgcagtggctcacacctgtaatcccagcactttgggaggccaaggtgggtggatcacgaggtcaggwgatcgagactatcctggctaacatggtgaaaccccgtctctactaaaaatacaaaaaattagccaggcgtggtggcaggtgcctgtagtcccagctactcgggaggctgaggcaggagaatggcgtgaacccgggaggtggagcttgcagtgagctgagatcgcgccactgcactccagcctaagcgacagagcgagactccgtctcaaaaaaaaaaaaaaaaagaaagtgacactaataatggaactgagttcttaaggttgttgtgaggactgaatgaggtattgtatgtaaagtatc

SEQ ID NO: 26611 - DNA, 601 bp, Human
tgaacccgggaggtggagcttgcagtgagctgagatcgcgccactgcactccagcctaagcgacagagcgagactccgtctcaaaaaaaaaaaaaaaaagaaagtgacactaataatggaactgagttcttaaggttgttgtgaggactgaatgaggtattgtatgtaaagtatcagaacagtagcagacacacagtagttgcttagtcagtgttagctcctttctcatttctttcattgcttacaagtagatagcattccagttcataggtttctttgagaaatagactgtagaaaagaygacaatgtttattctcattagtcagacgaactgcagcacaagtgtttcaaagaggaaccccaagaactcccaggcttgtaggaagcatctgattttacataagtttgcacagtaggaaactgaggtcctcggggaggaacaaagcaacttatgatcagacaaatgagtcactagtagagctgaaatgagaagccagatctcctaaccactcccacaccccatcacagtgcctcactgcgtctcttactggtgggcttgattgctttccaaggccagagaaggaagtagctgttcctgtat

SEQ ID NO: 26612 - DNA, 601 bp, Human
taaggttgttgtgaggactgaatgaggtattgtatgtaaagtatcagaacagtagcagacacacagtagttgcttagtcagtgttagctcctttctcatttctttcattgcttacaagtagatagcattccagttcataggtttctttgagaaatagactgtagaaaagatgacaatgtttattctcattagtcagacgaactgcagcacaagtgtttcaaagaggaaccccaagaactcccaggcttgtaggaagcatctgattttacataagtttgcacagtaggaaactgaggtcctyggggaggaacaaagcaacttatgatcagacaaatgagtcactagtagagctgaaatgagaagccagatctcctaaccactcccacaccccatcacagtgcctcactgcgtctcttactggtgggcttgattgctttccaaggccagagaaggaagtagctgttcctgtatgctcagacaggagtataaatcacactgtgatgtcagaagcttcttttctagctggagaaataaagctatgcatcagaaaagagcaccaatcttatagagtagtatagaattaagtgcttacttgtgggac

SEQ ID NO: 26613 - DNA, 601 bp, Human
cagcagaagagaaacaaagttccatttttcctaggtcattttcttgttcacaggctttctcttattaaagttatcactgacagtatgggtggaggtcataaaaaattacagtaattttattggaggtaacttgtattgcagtgactcaaatacaagctaacaggactaattccatttttgtcatcagtggttaattaaaattttttttccttttctatatttcatttcaatagcacattagcaggtttatatataatgacagtgagtttagattaggataattcataagtcccagaatcastgggtcatatgacatgacagtttgacctgggctgcacaggaaatgcatttataaatggtaggaggtggggaaaatatgtagaggataaaccctggaaggagaagcacaacagaaaatttagttgggtgtgggaatggtcacagacaggtaatccttagaggatagggtgcttagaagttggtggatatggggagagggctgaacaaattcttggtaaatgttatgtgtctctccatataccctgttgagacccaactggtatagactctgtgttctagagtgcagaggggagcaatcacc

SEQ ID NO: 26614 - DNA, 601 bp, Human
gagccaggtattgttaaatacttaaatgcattattacttttaatcactatggccctttgaagtaggtactattagagttggggaaatgaaggctcagagagggtaagtgctttgttcagggtcatatatcagtaagtagtgaactaggaattttgacactccagggtgctgcctctactgaggtagcagacttattggatttatttccatgggctgggcttctagggagcaagaggggtctgatctctaagctgattcctggctactttgctgggccccttgttcttgggccctttgccarttaggagctaactgctgctgtctgagcagtccccatacctcatttgtttgaaaaacatgtactgtttccattccaaaggcaaaagaatctaggcaggagacattccaagtttggggataaaactaagctcccagcactccctgctccctaaagcttccagagctaaatgaccactgtggcacttagaaagagacaaagacacccctccccttttccccctagagataggcttgcacacatgcacacatatatcctcctctgagtgtccagagcccacatgccacctggttcctccttgta

SEQ ID NO: 26615 - DNA, 601 bp, Human
ataattatttgaggcaggcaggaattttgattcccaaaacaggcaaaacttgctcatagtcacacaactgcttagagccaggactaattgcaatgctaattgttgttgccttggagtggggcagtgcttaattgtatacttatttgctcatttctacacccaacaatgattattgttctccatctctaacagaccttattggaactatgaaagggtgtcagtcttgattctactttaaaggagctcgctattattataaaggacagacatatcatagtattggcttttctcaagaggctgytttcataaaaggacagtatttcagtgaagaagtgaatccttaatggtgtaactttatatagttgggtcatggaagagtacagtaaaggaggatattcagcaagggaaggagatggcaggaaatggcgcctctgatttgtctttgcctatgcatatatcgccatctggtgttcattttcagggggttcaactccctttctcttcagggacaaattaggcagatcacaatttgcgggaagcttgcagcctaacatttcctcttcttacctccttgcttgttccatgatgtcttttgaagtct

SEQ ID NO: 26616 - DNA, 601 bp, Human
ccaagtctctctttctttccctgactcctttcaggcagagctgatgactccatcttttgggaagacccaagaccttatatatctatatctatctctttctattatagaatttgtcacactgaatacagttatctgtctacttgtctttgttggagtaaatcatgagctcctcagtggcagggagagctttctgatttatcgccacgtatttagggcttagcacagggcttggcacttagtaggcacttgaaagaactcggtgaatgaatagatgaatgaatgagtgtattaacatagatarccgtgtggaggaaagaagtgaagaagcgggaaggcttgtttagctggatggaaggttttgtcggtgaactgagggaatgtgtgtgacggtgcaagggtagacttacattataactcatgcccttgagatcttatccactaaggaagatacttaggaaaggaactcagggcctgggggcagcaggggactctcctgagtcctttggcataaatttaatttgttttgtgcttctgggaacagaagctcaggagtccaagaggactcctagctcaatagttccttcctcatcttccctaatcc

SEQ ID NO: 26617 - DNA, 601 bp, Human
agtgtattaacatagatagccgtgtggaggaaagaagtgaagaagcgggaaggcttgtttagctggatggaaggttttgtcggtgaactgagggaatgtgtgtgacggtgcaagggtagacttacattataactcatgcccttgagatcttatccactaaggaagatacttaggaaaggaactcagggcctgggggcagcaggggactctcctgagtcctttggcataaatttaatttgttttgtgcttctgggaacagaagctcaggagtccaagaggactcctagctcaatagttccttcctcatcttccctaatccacccctctgctaccaccccagtcatttctcagccattaggttttccctggatctttttgtcaagcttgcagggtattctacattcattgaactttctagataccactacataagaggaataattgtggcatttgaagtcacacagattggaattctagcctcagttcttcctacaagttgcaagactctgtatctgcctgtcccaggctgataatgataccaatatatcattatctgctgggaggacaaatgggaaataccttgtaaactggtacttgttat

SEQ ID NO: 26618 - DNA, 601 bp, Human
gagggaatgagggtgtaggggcattcctgcctgtcttctgggaaagatgaaacaagtggaggcaggcagagggaaagctctgccagccccaggctgccatggggacagaggtcctcctggggcaaaagggctatcaaggacccctttgcttctcccctcgctttctctattttgtccccctcctttttcttctaccttgcctgcctttctctttttcctctttctcttccctttccttgtacagcctcagttgtgctaggaggagtgggccccagccataggggaaggcctttctcatttmttccattctcgaatccctgctcttttcgagctgggggcctcatctttgcaggctgagaagataaaaaagaagagaaacacactctttggcaccttccacgtggcccacagctcttccctggatgatgtagatcataaaattctaacagctaagtaagtaacaccagttatctactctggcaatgtccatatcatcctcagaatttgagggcatacagggcctccaacaccaattccatttcctcattggtggagggacagctctggtctcctgcctcagcctttatttatctcctgcctt

SEQ ID NO: 26619 - DNA, 601 bp, Human
catttattccattctcgaatccctgctcttttcgagctgggggcctcatctttgcaggctgagaagataaaaaagaagagaaacacactctttggcaccttccacgtggcccacagctcttccctggatgatgtagatcataaaattctaacagctaagtaagtaacaccagttatctactctggcaatgtccatatcatcctcagaatttgagggcatacagggcctccaacaccaattccatttcctcattggtggagggacagctctggtctcctgcctcagcctttatttatctccygccttgctcttaagtttgagtttattgtgtgttttattcacacatattctcaaaacttgttcctctgagaagaggcttcattcctattggggctcacaccaagtccatgcctgcagttctctttcctctgtcttcaggcaagcactgagcgaggtgacagcagcattgcgggagcgcctgcaccgctggcaacagatcgagatcctctgtggcttccagattgtcaacaaccctggcatccactcactggtggctgccctcaacatagaccccagctggatgggcagtacacgccccaac

SEQ ID NO: 26620 - DNA, 601 bp, Human
gggctcacaccaagtccatgcctgcagttctctttcctctgtcttcaggcaagcactgagcgaggtgacagcagcattgcgggagcgcctgcaccgctggcaacagatcgagatcctctgtggcttccagattgtcaacaaccctggcatccactcactggtggctgccctcaacatagaccccagctggatgggcagtacacgccccaaccctgctcacttcatcatgactgacgacgtggatgacatggatgaggagattgtgtctcccttgtccatgcagtgtaggtgacctctttgsggggatgaaggaaggagcctttgatgtacaggttgagaagtctgtggcctctgttgtgcttaaacagcagatggggcagatacccaggaagatagttcaactcatgaccttggtcaataaagcacaatttactcaggttatttctttatagttgtccttttggtgttctttccttgttgtatgctctgtgtgcccctttgggtctattgtgctaagtgtgtctcccttcattctttttcactttattgtccctaactaccactctatctacctttataaaaaatatgtcctttagtgaat

SEQ ID NO: 26621 - DNA, 601 bp, Human
gtttttgtgagaggccctataaagaaatagtcccttaaagtgatatagtcctaaatcctctaagctggaaaggcattcttgcccaggagggatctcctgcacaagcatgtctggctttccacctggactcttggatcctacccgctcttcctctgtcctggatcttccctctcccttttctcccctgcaagtgatgagagttgagtagagcagagccaaaaggaacaacactggaattcttcagtgaatgaagggagttttcccttactggcccacaattgaatttttctttggatcagawgctattttaagtaagtagaatagcccttatggtaaagctattgtcctaggcccatattctgccagttcagcgggagggcagaaggccggggctgggttaggggcttactttcagattctttaatcaggctggattcccactcgagacagaatttatttgtaattttatcaataatactttgcccctggccaagcctctttgttcttctaatctgataactcgttaggcctttaatcaaaggcttaacaaggacaggatcactgacaggcagagcttgatcctgacttgctgatctgaagg

SEQ ID NO: 26622 - DNA, 601 bp, Human
ctgcacaagcatgtctggctttccacctggactcttggatcctacccgctcttcctctgtcctggatcttccctctcccttttctcccctgcaagtgatgagagttgagtagagcagagccaaaaggaacaacactggaattcttcagtgaatgaagggagttttcccttactggcccacaattgaatttttctttggatcagaagctattttaagtaagtagaatagcccttatggtaaagctattgtcctaggcccatattctgccagttcagcgggagggcagaaggccggggctggrttaggggcttactttcagattctttaatcaggctggattcccactcgagacagaatttatttgtaattttatcaataatactttgcccctggccaagcctctttgttcttctaatctgataactcgttaggcctttaatcaaaggcttaacaaggacaggatcactgacaggcagagcttgatcctgacttgctgatctgaaggcttctgtgttctccaggctgggagggaccttaattagctctgagctacccaatccctgcccccagcccttcctttattacattgatggcaggccga

SEQ ID NO: 26623 - DNA, 601 bp, Human
ctacatccgccggctcggatgatcagtccctctggaaataccccggtttgaggagcccctttggggcattttgtttttctgactttcgggactaaatcaacactcttaccccatgggtcccttctcctgcctgcttcacgcccctgcctgctccctctatcccctcagcactgtccctactaactacagggaggggttcgggggtgagaagaatcagcttgcttggcaagagctggacagagaacacccatggtaatggaaggcttaggcttctccctttagcgcagctgtgcaggtaacytggtagcccttcttccatctgggctgggagggaaagagggaaggacaaatgacccctttcttttctctttttcatgtttctcccttttcttcccagtttcccccttctttctcccccttcccccccctattccagacttcctcatcctcttcagcctctctttcgtaccttgaaagctaccagcatagaagccctacctcctgaactctccatcactatggaattatgctgtctccctggtggtccttccaaggcttcgctcacccttgtaacctggccctttctctcatctttaggtag

SEQ ID NO: 26624 - DNA, 601 bp, Human
tcctgcctgcttcacgcccctgcctgctccctctatcccctcagcactgtccctactaactacagggaggggttcgggggtgagaagaatcagcttgcttggcaagagctggacagagaacacccatggtaatggaaggcttaggcttctccctttagcgcagctgtgcaggtaacttggtagcccttcttccatctgggctgggagggaaagagggaaggacaaatgacccctttcttttctctttttcatgtttctcccttttcttcccagtttcccccttctttctcccccttccccyccctattccagacttcctcatcctcttcagcctctctttcgtaccttgaaagctaccagcatagaagccctacctcctgaactctccatcactatggaattatgctgtctccctggtggtccttccaaggcttcgctcacccttgtaacctggccctttctctcatctttaggtagaatgcagggaagcttatctatcaggctagaggagaaagaataaaggtctgcactctcttttagctgggagtgagcccaaagggggatgcactagcatattcctaagttacttggtgcccatgta

SEQ ID NO: 26625 - DNA, 601 bp, Human
agggcagtggggaggaagggcggagaggtacctgtatccacctggcctgttcactacttaattttcttttgcaccacgcaccagaggatcatctctaaaggcaaacaggctctctagtaaggtcagtagcttgggatgggagtccgaggcagcccagcctttggggagggacctctggcctgattgttctcagtgattcagggagggaaggtgagcctgcctcactgggccttttccctcctatatctccctaggcttcctcccaggttcttatcttgctttggcagtcccaacttttagytgatgagagaggcatagaaggacaggaatcaggctgggtgcagtggctcacacctgtaatcctagcactttgggaggccgagagcggaggactgcttaagcccaggagtttgagaccagcctgggaaacaaagtgagaccctgtctctacaaaaaaaaaatcaaaaatttagttgggcatggtggcacatgcctgtggtcccagctacataggaggatcacttgagcctgggaggtcaaggctgcagtgagccgagatcgcgccattgcactccagcctgggcaacagagcaagaccctg

SEQ ID NO: 26626 - DNA, 601 bp, Human
cctatatctccctaggcttcctcccaggttcttatcttgctttggcagtcccaacttttagctgatgagagaggcatagaaggacaggaatcaggctgggtgcagtggctcacacctgtaatcctagcactttgggaggccgagagcggaggactgcttaagcccaggagtttgagaccagcctgggaaacaaagtgagaccctgtctctacaaaaaaaaaatcaaaaatttagttgggcatggtggcacatgcctgtggtcccagctacataggaggatcacttgagcctgggaggtcarggctgcagtgagccgagatcgcgccattgcactccagcctgggcaacagagcaagaccctgtcaataaataaataaataaaaagatggataggaatcaagatgaaataggggtctggtccaggagaagtgaggctgggagggccctaacctcctgatttctcctccttggtgttagagagggtaggatcccagaatcttcacttcctcagcttagaggaccctttttctcagtgtgattgcttcccagaacttccttggcaccttgctcattggtttataatagtgtttggagaaggcaa

SEQ ID NO: 26627 - DNA, 601 bp, Human
ctttctatgcctccctacattctccgtcagcagagttctgaaagagaccccacccttcctgccgcaccacagactttggtttgaactctgcaatacctatctatgacctcctttgaatcctatgagatggttagaagaggcagcatcctggccttttggggtgggtgaaggattatttgcaaggctgttctaaccttctcatctccagcctgggtcaggtccactgactgcatgtgccctgttccttggggcctggcccagactggataatatcctaaggtgtgacaggagtaagtggggraggaaggcatggaaaatggtgactcggagcaggctgtaggttctgtgttagcttgagtcccaggaaatacagccagctatgagaaggcagagattttattgaggatgccgcctgtggaatttaagcctatggctgcaccagttcagagccagagcattcaccactggtggggcccaggtattggaaaaccatttgccagacagatgatggtatgatgacatttgtttttgtttcttatctgtttcttccctccctatcacttttccctttcttgtctttctctcttggcccttctttcta

SEQ ID NO: 26628 - DNA, 601 bp, Human
cttccttcaagataactggccccaagagtggggcatgggaagggctggtccaggggtctgggcactgtacatacctgccccctcatccttgggtccttcattattatttattaactgaccaccatggcctgcctgccctgcctccgtcccaaccatgggctgctgctgtcactccctctccacttcagtgcatgtcttagttgctgttccctcagctcccagctccacctctggggttcagcttctgtctctgctgtcccagttttgaggtttggtttcttgtttctgtctcttgctttcrggctcctccctcccaccactccccaacttcccctagcagttgcagggaagataggacgagtagcttctgacatgtgtgcctcagatctgttccaccccactcacagtggttctgtttgctccagactggggctagggcctaatctttgaagtttgttctttggtattgatgtgggtcagaaggagcctcatcctaatctcactcaggcctccagggatccatgggggagtgaaaccaattctcagagaacaacccaccagagacttttaaagagaggccaggcttgggaatgggttggga

SEQ ID NO: 26629 - DNA, 601 bp, Human
tcagcctccccgcacttgagagggggtgtccaggacctagttccatcctaaagggataccctcttcctccacggccccacaggcatcccgctgacttctgcctcgtcctcgcccctccgcagggtctgaaccggaagcgggcgaaggcagacgtgggaaccagcagaccgcgttgcccagagcaacagccgggctcctctcaagcggggtgagagcaaagctggttgcccgggcaacgggttgttgccaggacaacgggcggggctgacgcacagacgcggagtcccggcggggcaggctygctccggggcccaccggtgcctgggaaccccccaatagcccgactgggatcctgaggtcccgcgaggtggggagcgggcagcctgtggtccgagcgcccacagccgactgctccctccgcacctggtcctgggagctgagacgcaggttccctcttccctctccccaattttgctggagggcgggtcgggggctgcccggtgcctgtgctgagccccctcatccttcttggcctgttggtctctccacgcatccgtgctgctctcgtgaccgcctcggtctccacgctgcctcttgaccc

SEQ ID NO: 26630 - DNA, 601 bp, Human
caccctagtcccccattcccaccccagacgtcctttgagccccacgcacaacaaagaactccaactcccatgaggcctttgcgcgaacagccgcgcagaaaccggacagccaccgcgagtcatgctgggagttgtagtatcagcctccccgcacttgagagggggtgtccaggacctagttccatcctaaagggataccctcttcctccacggccccacaggcatcccgctgacttctgcctcgtcctcgcccctccgcagggtctgaaccggaagcgggcgaaggcagacgtgggaaccrgcagaccgcgttgcccagagcaacagccgggctcctctcaagcggggtgagagcaaagctggttgcccgggcaacgggttgttgccaggacaacgggcggggctgacgcacagacgcggagtcccggcggggcaggctcgctccggggcccaccggtgcctgggaaccccccaatagcccgactgggatcctgaggtcccgcgaggtggggagcgggcagcctgtggtccgagcgcccacagccgactgctccctccgcacctggtcctgggagctgagacgcaggttccctcttccctc

SEQ ID NO: 26631 - DNA, 601 bp, Human
ttcagaccctgcagtgaccactttccattccaacggcctcatccaatgcaaatgtcttttatcctctccaggctgctgctgcactggcctcgtccctggatccctcgccgcagatctgtcctacacagggttccagaggagtcatcctaacaccatctgaccctgtccctctcatgctcaaaacatatttgtagccttcatcaccttcatgacatggatactgctgagttctccagacacttcactccagagtgcagctattgtgagaaatgactctttgttccccaaataagcctcagawtctggatatggggcctgaatctggatatggggcctcaacacatgctccaacttggactagaatgtccttctctctggtctcagttaactctgtccctcaggtctcagtgcagaagtcacctccaccacgaagcctcctctgtctgaccctctgttttaaactttttcctactgtaaatatgtcccattttctgaaaaaaatcagcatattttaaagtattctggcacaaagctggttttcagctttcagagccatttatttatttatctatttattggagacagagtctcgctctgtcac

SEQ ID NO: 26632 - DNA, 601 bp, Human
gagttctccaaggtcacacaaccaggaaatggtccttcttggttggaaacctagggctgtctggctcccaggcaaccactgcactctgcactgagagacttaattttcagaccctgcagtgaccactttccattccaacggcctcatccaatgcaaatgtcttttatcctctccaggctgctgctgcactggcctcgtccctggatccctcgccgcagatctgtcctacacagggttccagaggagtcatcctaacaccatctgaccctgtccctctcatgctcaaaacatatttgtagcyttcatcaccttcatgacatggatactgctgagttctccagacacttcactccagagtgcagctattgtgagaaatgactctttgttccccaaataagcctcagaatctggatatggggcctgaatctggatatggggcctcaacacatgctccaacttggactagaatgtccttctctctggtctcagttaactctgtccctcaggtctcagtgcagaagtcacctccaccacgaagcctcctctgtctgaccctctgttttaaactttttcctactgtaaatatgtcccattttctgaa

SEQ ID NO: 26633 - DNA, 601 bp, Human
caagttagtgaccacagacttgaggctcagagagggacagtgagttctccaaggtcacacaaccaggaaatggtccttcttggttggaaacctagggctgtctggctcccaggcaaccactgcactctgcactgagagacttaattttcagaccctgcagtgaccactttccattccaacggcctcatccaatgcaaatgtcttttatcctctccaggctgctgctgcactggcctcgtccctggatccctcgccgcagatctgtcctacacagggttccagaggagtcatcctaacaccwtctgaccctgtccctctcatgctcaaaacatatttgtagccttcatcaccttcatgacatggatactgctgagttctccagacacttcactccagagtgcagctattgtgagaaatgactctttgttccccaaataagcctcagaatctggatatggggcctgaatctggatatggggcctcaacacatgctccaacttggactagaatgtccttctctctggtctcagttaactctgtccctcaggtctcagtgcagaagtcacctccaccacgaagcctcctctgtctgaccctctgt

SEQ ID NO: 26634 - DNA, 601 bp, Human
tgaacatcactggtttaagggacagggatggggctggacaccaggaccctaaatagcatcctttacggatgctaattgaacagctccttattgagaaggaaggaggggaaataccaagttagtgaccacagacttgaggctcagagagggacagtgagttctccaaggtcacacaaccaggaaatggtccttcttggttggaaacctagggctgtctggctcccaggcaaccactgcactctgcactgagagacttaattttcagaccctgcagtgaccactttccattccaacggcctcrtccaatgcaaatgtcttttatcctctccaggctgctgctgcactggcctcgtccctggatccctcgccgcagatctgtcctacacagggttccagaggagtcatcctaacaccatctgaccctgtccctctcatgctcaaaacatatttgtagccttcatcaccttcatgacatggatactgctgagttctccagacacttcactccagagtgcagctattgtgagaaatgactctttgttccccaaataagcctcagaatctggatatggggcctgaatctggatatggggcctcaaca

SEQ ID NO: 26635 - DNA, 601 bp, Human
atgtgaacctgaattcccctgaatcctgtggcaaaatgtctgaggtcacctcttcagggattctgacttgataggtcaggtgctagtgccagaatttgcatttcaacaagtacccagtgtgattctgctgcagacggtctttgaacatcactggtttaagggacagggatggggctggacaccaggaccctaaatagcatcctttacggatgctaattgaacagctccttattgagaaggaaggaggggaaataccaagttagtgaccacagacttgaggctcagagagggacagtgagtkctccaaggtcacacaaccaggaaatggtccttcttggttggaaacctagggctgtctggctcccaggcaaccactgcactctgcactgagagacttaattttcagaccctgcagtgaccactttccattccaacggcctcatccaatgcaaatgtcttttatcctctccaggctgctgctgcactggcctcgtccctggatccctcgccgcagatctgtcctacacagggttccagaggagtcatcctaacaccatctgaccctgtccctctcatgctcaaaacatatttgtagccttca

SEQ ID NO: 26636 - DNA, 601 bp, Human
actagacatgtgcttgtcatgcttagattaaaacaagtgctgatagtgtcccattgcccacaggaataatgcaggttttatttcacatgctaatggatgtactggggtgctagtccaaactgccatgtttacttgtgatcttagcacagcaaaacatggaggagaaatggcatatttactgtgtacttgccattctaaagttgaatgaaaaagcagaaggtgtctccttaacctaggccagcaattcttaaaattcaatgtgaacctgaattcccctgaatcctgtggcaaaatgtctgargtcacctcttcagggattctgacttgataggtcaggtgctagtgccagaatttgcatttcaacaagtacccagtgtgattctgctgcagacggtctttgaacatcactggtttaagggacagggatggggctggacaccaggaccctaaatagcatcctttacggatgctaattgaacagctccttattgagaaggaaggaggggaaataccaagttagtgaccacagacttgaggctcagagagggacagtgagttctccaaggtcacacaaccaggaaatggtccttcttggttggaa

SEQ ID NO: 26637 - DNA, 601 bp, Human
ccttggtctcgtaccgcctccgtttgtccggcagcaggtagacccgcacataggggtccgaggagccaccaagatccaaggctgccaatcccattgcttgcagaatgcccaccagcagctgcagggcccaggcacagtgggggaggtggggaacactagtcttagcctcccttccatggctcctttcagaaggggttggaacccccgggatcctccctccaaagcttccccttcctccacacccacctggccactctggaagtcataatccagggagtactgcagtcgtcctagctcatgyttgtctgccacctgctgccctggcccggatggtgctggctccagctcctctacttctggctgcaccttaaggagccaggggtaagggtgggtgaagtcttcccctgatagcagtatccatcaggctcagaagccaagggaggctcacaggtcccttgggctatacctgagctctcacaggctaagcagattcagtatttgactagtgctgtctgccacaggcaggaaatagacgtggtaacacagatgcagtatgtttgtgaaggtttgattagtggtgtctgctatgggcaggaactag

SEQ ID NO: 26638 - DNA, 601 bp, Human
caccccactcccttgcttcccacacacctgacagtcctcctacgtccatcttcttcaggtttttagcctccaggacgatgacggtgagcttcccggccgtggggacatagcggagggagaagcagatgtccccaagcttctcctgctgaaaggagaggggcccatcaccagagccccggctccacatccatgcctcctcaggggtacaatccacgccgccctgagggtctggaaagcctatgatctgattggctcaggatgttgtgggcgggactgggcctgggggcgtggctcggggcgygaccgcgcatgctcacctcctcccgcggagccgcctgcagctcccgccaggcctgcactggccgccccaggtccacggagctcatagggacccgcacctccccgatggcgtcattgcgagagaagcggtcgaagtcgtacaccgccatgaccagcaccctgccccccagctccacgtaggggacctggagtgcacagagaatccgcagtagagagcaggaagtcagagatagggtgaggcacagcacaaccagaaggaaggcatggagtgaggcagcgagggtcgaagcgaacagttggg

SEQ ID NO: 26639 - DNA, 601 bp, Human
cgagaacccaccccacgccatccccacacaccccactcccttgcttcccacacacctgacagtcctcctacgtccatcttcttcaggtttttagcctccaggacgatgacggtgagcttcccggccgtggggacatagcggagggagaagcagatgtccccaagcttctcctgctgaaaggagaggggcccatcaccagagccccggctccacatccatgcctcctcaggggtacaatccacgccgccctgagggtctggaaagcctatgatctgattggctcaggatgttgtgggcgggrctgggcctgggggcgtggctcggggcgcgaccgcgcatgctcacctcctcccgcggagccgcctgcagctcccgccaggcctgcactggccgccccaggtccacggagctcatagggacccgcacctccccgatggcgtcattgcgagagaagcggtcgaagtcgtacaccgccatgaccagcaccctgccccccagctccacgtaggggacctggagtgcacagagaatccgcagtagagagcaggaagtcagagatagggtgaggcacagcacaaccagaaggaaggcatggagtgag

SEQ ID NO: 26640 - DNA, 601 bp, Human
gccaaaatccatgccttccacagcagccaggtcctccctgtccccgaagaaaccctcgaggctcagaaactgtcagaacgagaacccaccccacgccatccccacacaccccactcccttgcttcccacacacctgacagtcctcctacgtccatcttcttcaggtttttagcctccaggacgatgacggtgagcttcccggccgtggggacatagcggagggagaagcagatgtccccaagcttctcctgctgaaaggagaggggcccatcaccagagccccggctccacatccatgccycctcaggggtacaatccacgccgccctgagggtctggaaagcctatgatctgattggctcaggatgttgtgggcgggactgggcctgggggcgtggctcggggcgcgaccgcgcatgctcacctcctcccgcggagccgcctgcagctcccgccaggcctgcactggccgccccaggtccacggagctcatagggacccgcacctccccgatggcgtcattgcgagagaagcggtcgaagtcgtacaccgccatgaccagcaccctgccccccagctccacgtaggggacctggagtgca

SEQ ID NO: 26641 - DNA, 601 bp, Human
tatgccaaaatccatgccttccacagcagccaggtcctccctgtccccgaagaaaccctcgaggctcagaaactgtcagaacgagaacccaccccacgccatccccacacaccccactcccttgcttcccacacacctgacagtcctcctacgtccatcttcttcaggtttttagcctccaggacgatgacggtgagcttcccggccgtggggacatagcggagggagaagcagatgtccccaagcttctcctgctgaaaggagaggggcccatcaccagagccccggctccacatccatkcctcctcaggggtacaatccacgccgccctgagggtctggaaagcctatgatctgattggctcaggatgttgtgggcgggactgggcctgggggcgtggctcggggcgcgaccgcgcatgctcacctcctcccgcggagccgcctgcagctcccgccaggcctgcactggccgccccaggtccacggagctcatagggacccgcacctccccgatggcgtcattgcgagagaagcggtcgaagtcgtacaccgccatgaccagcaccctgccccccagctccacgtaggggacctggagt

SEQ ID NO: 26642 - DNA, 601 bp, Human
aacactgcctacacccttcgggtctccctagctctatgccaaaatccatgccttccacagcagccaggtcctccctgtccccgaagaaaccctcgaggctcagaaactgtcagaacgagaacccaccccacgccatccccacacaccccactcccttgcttcccacacacctgacagtcctcctacgtccatcttcttcaggtttttagcctccaggacgatgacggtgagcttcccggccgtggggacatagcggagggagaagcagatgtccccaagcttctcctgctgaaaggagagrggcccatcaccagagccccggctccacatccatgcctcctcaggggtacaatccacgccgccctgagggtctggaaagcctatgatctgattggctcaggatgttgtgggcgggactgggcctgggggcgtggctcggggcgcgaccgcgcatgctcacctcctcccgcggagccgcctgcagctcccgccaggcctgcactggccgccccaggtccacggagctcatagggacccgcacctccccgatggcgtcattgcgagagaagcggtcgaagtcgtacaccgccatgaccagcac

SEQ ID NO: 26643 - DNA, 601 bp, Human
ataggggttcagagtgttcttcttgatggtggttttcttcttccgcacctttttgccgccctgcagcaggtggaccttgacgtatggatctggggagaggaaggaggagtcttatagctccccactgctgggttgttggaccaacatagaaacactgcctacacccttcgggtctccctagctctatgccaaaatccatgccttccacagcagccaggtcctccctgtccccgaagaaaccctcgaggctcagaaactgtcagaacgagaacccaccccacgccatccccacacaccccaytcccttgcttcccacacacctgacagtcctcctacgtccatcttcttcaggtttttagcctccaggacgatgacggtgagcttcccggccgtggggacatagcggagggagaagcagatgtccccaagcttctcctgctgaaaggagaggggcccatcaccagagccccggctccacatccatgcctcctcaggggtacaatccacgccgccctgagggtctggaaagcctatgatctgattggctcaggatgttgtgggcgggactgggcctgggggcgtggctcggggcgcgaccgcg

SEQ ID NO: 26644 - DNA, 601 bp, Human
caccccgcgggactgtccgtcgcagtaagtgcccgcgcggtgctggccgcggctgcccgggtcaccccgccccgcatctgtccgaggtggccgcgctgggggcgccgctgcggcgagggacagtggggagactggcttcccaaacgccaacgcccctctttgtcttccacctgcagagtttcctggtttgaaggtgtgggttggtgggttagggggctgggggagttgggattcagggagaagagggttggagaatctttgggacgcgattctctcgcctaaccggtacaggtgagacttyagtccttatgtttttgatcttggttcatccgttgtggggcagaaaattctgttgctttaactcttggataaccacccctaatagatacattatttctctctttggtgtcttctcctcctaccccttcccagaaatccaacatgaaaatcctcgtggccttggcagtcttttttcttgtctccactcagctgtttgcagaagaaataggagccaatgatgatctgaattactggtccgactggtacgacagcgaccagatcaaggtgaggccccttcccaggacggcccgcacccttcttc

SEQ ID NO: 26645 - DNA, 601 bp, Human
ccctgtctgctcactccttcctggagtaccccagggtctctcgctctgaatagagatttccactccaagaggggtgtaattccccaggcgcgacattggcccacaccgcactaaggcacgcacgggcccgcggggggagggaaagatctggttcgcatgcctcactgtattcgagtgaagcgctcccttgactaaagatccaaactgacaaagggaaggcacgggcctccaggggtagtactgcggatgatccaagtgcatgtggaagaggattttatagcattccctgaggtgagagtasatttgtcttgggatagaaatatcgtttccttgaattcatcgcacggtcagtggaacatgtagttaatgacaattcgtctcttgtcagattcctcaattgaaaaacaagtggccctgttaaaggctctttatggtaaacattcctataaatctttattttactattgtgaaagcacatgtaggaaagtgaaataaaatcttttatgggctgaaatacaagatctgggtcatgcctgtttaataaagagatggatttgcgcactctctctcggtttctctctctctctgtcactctctctgt

SEQ ID NO: 26646 - DNA, 601 bp, Human
gttctggttataatagtttgtttcctcaaagatatacatattaaaatacccctaaatgtatttttccaggacataaaacagattcctttgttggactaatgggcaaaagagctttaaattctggtatgtatgaaattatgactgaaaatagacagtatctcaaatctatttctattttttctaagacatagttttaaaatattaaaaaggagtggtagatataaaaatgagtattatggtggaaaaatttaattgttgtacttgtaaccacaaatggatttatagctggttaagctaataytaccacagtatctgtctatttctctccaatcaccattcttaccagtgtctgccccatttaatcattaccaacctgaatctttgggttagtgctatattctttcctatagatctgttaaataagccgtgtttaaccttactgaactaagggggagtggggagtgcagggaagaatgagggtgattttcacttgttatcaaagtaatttgaaagttttacaagacattacatttggcgatcttccaatacaaaaataaattcacaaaacaaattctttatgcaaattaatcactttttatga

SEQ ID NO: 26647 - DNA, 601 bp, Human
ccacagtatctgtctatttctctccaatcaccattcttaccagtgtctgccccatttaatcattaccaacctgaatctttgggttagtgctatattctttcctatagatctgttaaataagccgtgtttaaccttactgaactaagggggagtggggagtgcagggaagaatgagggtgattttcacttgttatcaaagtaatttgaaagttttacaagacattacatttggcgatcttccaatacaaaaataaattcacaaaacaaattctttatgcaaattaatcactttttatgaagktgtagaaattcaaaatctaaacatcctgatggatgttggagaggacaaaagtgatacggtttattccagtactttcaaaaaggaacacaattaaatatccttgagtgttataaattggttctggctataaactccttagagagaaaggatgccacaattctcattttaattctgaacaactttttcgtatgatataaaggctgcaggtttccttctcttcaatttccatcttctttgtaaataccacgtacatatatctgaaaaccattattagttaactcattcatcacactgatttca

SEQ ID NO: 26648 - DNA, 601 bp, Human
agtttaaaataaattactatatgccctgaactttagttgtgtaactccctcagtgaattcacttaaaaaacactttatctcttctttgttttcagtggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtaytgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtt

SEQ ID NO: 26649 - DNA, 601 bp, Human
catgaagccaaggggacaggccccctctatgaggcctgtggagagaaagaatggaaaccctggggaggaaggctgtctcctccccaccaggcctgccttcagggttgagggtggaatcccacttcctaagactacagctgagtcttggaggctccccatgtcaggagaaacaggttcttgccatgacttttctttcaatatcccgtctcaggcctaggggtgcaatgcaagcacagagtcctaaggcccctttgtaaaacttttatttagaaatcttcccgatacatcctcacatatatakacacatcatcaccacatgggttttttttgctaaagagtcacacacccacagtgttggcctctgggctgtacaaaggtcaaggtacctggagcggttactcctcttctgcagaaaaatgcagagaccaacgcaattcatcacatacagtacaacgttgacggaaagtgctgggcccgcccacagaaacaatgcactatgtacacgggcagggggcaagtcttcagcagagggtcacgtaccatcgaaatcacaagtacggccagacccacccccaaaaggccgaaatagttgtcggctgac

SEQ ID NO: 26650 - DNA, 601 bp, Human
aaaataaaaattacagatcttctttagttcttacaaagacctaaagacttgccctttcctaccaggcttgttttgggtagttgcattacattttacacagtctgccagtgttcccatatctcttttccattcttattactgtccctggccttggaacaagatagaaattaagacaatctgggctgggtgcaatggctgacacctgtgatcccagtgcttctggaggcaaaggcaggagaattgcctgaagccaggacttcaagaccagcctgggcaatatagcaagactccatctctaccaaaaaaaaaaaaaagtaaaaattagccaggtgtggtggctcacacctgtggtcctccctactcgggaggctgaggtgagaggattgcttgagcccagagttcaaggctgcagacagcaatgatggcaccactgtactccagcctgagtgacagaacaagacaccgtctctcacacacacacacacacacacacaaatagataatctggagaaatgaggacaatctcaataactcaggccaaagcggtttacaatctaaattacccaaatgctgggcagtcaggcacaccggcctactgcct

SEQ ID NO: 26651 - DNA, 601 bp, Human
atctggagaaatgaggacaatctcaataactcaggccaaagcggtttacaatctaaattacccaaatgctgggcagtcaggcacaccggcctactgcctaggtcgtggactcaggctgcgaaaccccactgcaggattgagattgagggaaaagaaaaagttctttacgttctcaaaactgtctactttcatgatcccattcagtccacaccatagccctaggagataggccaagccagagtcacatggcaagtctgaaagaagagggagccagaagtttgagttcttaataaaatatgtgatccatctcataaaacccatccacccatccatactgtggctacttctcattcctaactcaagcgaatccacggtgaagcaaacagccttagatcctacagcaatgactctatctttagacagatggggctcctcacaggatcttccaaacgttggaaaggaaccaaccctaattttcaccaaaacatgatctggggagcctgaaattgaatggagagcctgagtgctacaaaggtgaacaatgttgccccaagctcgagaattggaccttacttaaaaggaaggggaaaggagcagacat

SEQ ID NO: 26652 - DNA, 601 bp, Human
tttacaatctaaattacccaaatgctgggcagtcaggcacaccggcctactgcctaggtcgtggactcaggctgcgaaaccccactgcaggattgagattgagggaaaagaaaaagttctttacgttctcaaaactgtctactttcatgatcccattcagtccacaccatagccctaggagataggccaagccagagtcacatggcaagtctgaaagaagagggagccagaagtttgagttcttaataaaatatgtgatccatctcataaaacccatccacccatccatactgtggctacgtctcattcctaactcaagcgaatccacggtgaagcaaacagccttagatcctacagcaatgactctatctttagacagatggggctcctcacaggatcttccaaacgttggaaaggaaccaaccctaattttcaccaaaacatgatctggggagcctgaaattgaatggagagcctgagtgctacaaaggtgaacaatgttgccccaagctcgagaattggaccttacttaaaaggaaggggaaaggagcagacatattctctgtctgtacatggctgaattagggccccatcatggtga

SEQ ID NO: 26653 - DNA, 601 bp, Human
gcagtcaggcacaccggcctactgcctaggtcgtggactcaggctgcgaaaccccactgcaggattgagattgagggaaaagaaaaagttctttacgttctcaaaactgtctactttcatgatcccattcagtccacaccatagccctaggagataggccaagccagagtcacatggcaagtctgaaagaagagggagccagaagtttgagttcttaataaaatatgtgatccatctcataaaacccatccacccatccatactgtggctacttctcattcctaactcaagcgaatccacrgtgaagcaaacagccttagatcctacagcaatgactctatctttagacagatggggctcctcacaggatcttccaaacgttggaaaggaaccaaccctaattttcaccaaaacatgatctggggagcctgaaattgaatggagagcctgagtgctacaaaggtgaacaatgttgccccaagctcgagaattggaccttacttaaaaggaaggggaaaggagcagacatattctctgtctgtacatggctgaattagggccccatcatggtgaggacaagccactaggctgaagcccaaac

SEQ ID NO: 26654 - DNA, 601 bp, Human
gccctaggagataggccaagccagagtcacatggcaagtctgaaagaagagggagccagaagtttgagttcttaataaaatatgtgatccatctcataaaacccatccacccatccatactgtggctacttctcattcctaactcaagcgaatccacggtgaagcaaacagccttagatcctacagcaatgactctatctttagacagatggggctcctcacaggatcttccaaacgttggaaaggaaccaaccctaattttcaccaaaacatgatctggggagcctgaaattgaatggasagcctgagtgctacaaaggtgaacaatgttgccccaagctcgagaattggaccttacttaaaaggaaggggaaaggagcagacatattctctgtctgtacatggctgaattagggccccatcatggtgaggacaagccactaggctgaagcccaaactataagggggggctttccagacagccacagtgatgagttcttgcatggcaggacagggccacaggctatctctcctctgacctcgaaggcagagcctagagggagagggctagggtgacttaagggtacaatgacagacatac

SEQ ID NO: 26655 - DNA, 601 bp, Human
tacaactttcagaggggagcacttctattgcattaaaccaacctcccagacgcacccttgatgaccaaaagctgcacaactgaggggtgtttaaggttctgctaagtgaatgtgcatatgtttgggtcttagccagggcctggtctctgattggatttcccataccctagaagtgaggctggatcctggtcctattgagcgctaaagattccaccaataactgaagtcaagcaaaaattccaaatgcaaagcattcataggacaggttttgtgctcaattcggaacatagaccagaccatyagcaaacagacatcttacagcaaagaaatccctctaagcatccaggagaatgcacagatggggctgcgcatctactcagcaccagcgtacgcccatcagcacactggcattcactcgccagcatgaacagtgatgtcgaggagttgaagcccacatgcccaaaatatctcttgctccatatcactctactatcattgtccctttctctgccttcacacaaagcccgacagggctttctcagggctgcagacattgtctccacagccacaggcttaggaaggcaagtctcattggggagaa

SEQ ID NO: 26656 - DNA, 601 bp, Human
tcataggacaggttttgtgctcaattcggaacatagaccagaccatcagcaaacagacatcttacagcaaagaaatccctctaagcatccaggagaatgcacagatggggctgcgcatctactcagcaccagcgtacgcccatcagcacactggcattcactcgccagcatgaacagtgatgtcgaggagttgaagcccacatgcccaaaatatctcttgctccatatcactctactatcattgtccctttctctgccttcacacaaagcccgacagggctttctcagggctgcagacatkgtctccacagccacaggcttaggaaggcaagtctcattggggagaaagcagaactttgatccccagggcaagaagtaagggcgactgggtttcctgaccctccggcccagctcatctagagcagactgtccactgatcatcttcttcaaccaggccctgaagaaggcacctcgaggcttgtgactctgcagcatctggcaagctggatggatcaacataggcctgggtgaagatggggctcacgaaatgggcagctattgggtacctataaatatggacagaagtggccacacaggccac

SEQ ID NO: 26657 - DNA, 601 bp, Human
acccctacctaaatgaatgactctgggcaagtgacataaaaacttgtgaagtgccttggcttcatcacctgcaaaatggaggtaatactactaagtcatgagttgttacatgggtctagtacctaacacaggtaaagaacttaagacaatgcctgcctcagcttagcagtcaataaatgttagctattattatccatgtatcagttttttgctaacaaccaggcactgtgctaggcactgaggaataatggtgaactaaattgagtgcctgccctcatggagcttacatgttaatggggamacgaatattaaaaaacaaacaaaccagggctgaattgtaatgaaaagaagctccatgtttagctccagtggctgggaaggcttgtctgaggctgtgaagaaacagccaggcacaagaaggggagaggaagaagagtatccaagccaagggaatgcacaggccctgcactagacaaggcctgaagccaggctggctggagtcctgtgcacaagatcagagtaggcagggtccagactccacagggccttgcagtaaggcggggggactttatcctaagggtgatggaaagcacagagtagg

SEQ ID NO: 26658 - DNA, 601 bp, Human
tcggcagtttgggtttggaaagtggcccgcccatctttgtgagatacctacggagtagtcccagatgttccctcctccagagggctctaaccagcgtgaggggcaggtacaacggtggggtggggcagactcaccatcagtaatctccatctcatagggggaaggtctcctcttcactcgattgttggtggtgaacatagggaaggcatccggctccccaaagaacccgctgtgggagggaacgggcagatcacaagatcccatgttgaggggaggggagaaagagcttccttagggatcstccccacatgtcttgagccccccacctctgggcaaccctggtcccttcacacttgagctgggaataggcacacacagacacacacacacacatacacacggaatgccctcactctgtctgtcataaaacaagcaaagggaggaaaagacacctaaccacacatccctccacacaaacacaggcacatatgcagaagcagaggtgaataacacatggaataaacacaaaaatgaacacacacacacacacacacacacttcacagatagaaacactctccattctcccgccccagaaacaa

SEQ ID NO: 26659 - DNA, 601 bp, Human
gaaacaagcacataatccacacacacctccactcccaaacacatgcccactcaggcaaatgtaaccttcacacctgatggtgtgcatcttggtcaccacaaaggggcacactgtcccctctccccacctcaccccacccataaggggctgtagatacacaacagacaggaaaccctgactcccctcagctgaaatgctccgcctagctctctgccctcacccaccctaagctccccatagctctgtctcgggtgcccgccaggttcattgactgccccacactctatccctgccccatctkccggtttctattccaaccctatggcttctctccctcatcatcacagtagcgccagcagggaaacggatgccctgacaccaaccggagtacaggctggggccagagaccacggctaggagcagaggggctgggagtggagggacaggtcagtcctcaggcgggccctccagcagagattcgggggagggtgcctctgccaccaccctcagatccttatctcttgcctgtccagctagcgctgagtttccgaatgaatttcacaccacaaacatctacctctgctcacagcaaagcacatgc

SEQ ID NO: 26660 - DNA, 601 bp, Human
aatttcacaccacaaacatctacctctgctcacagcaaagcacatgcaggcacactctttcctggtacccacgctcaggggactccttcctctccgtcccccacgacaccaccaccaagcacaccagccacatgcctgcacccgcgaaggtgtccacgtcctcctctcggcttccacacagccatgcaccccgcagccacacgcacactctctctcacagaaggcccctccctcactggcactcactcgggggctccagcttgaggctctagagccactgggtttaaaacgacctcctctscctgcgctccacccgctcggcccccagggcaggccgccgccgatgtgtagaaggaaaccccggtgggggtggtcgccctgcccacccgcccagcccctggcccctggcccctggcccctgacctgccgagagaggccagcggctggctgaggctgtagagcagcgcgcggccgggggcggcgggggcagccagcgcgggaggactcagctgcaccatgcggccgtcgccgggcagctccgctgtaaccgaggcgggcgcgggggccggggcgggcccgggaggtctgcacagctcggtgg

SEQ ID NO: 26661 - DNA, 601 bp, Human
gcatactccgagatgaccacagccactctacttcccacaggtgtgctggggctcttccatcacctggcttcatccagatagagctgggcaccagcaagaaccaaaacagaaaaatcaggagactcaagggccagagtttgtgagttgtgagttgtacatatatgatcaacaccacataagttgtttaaaataagctttctgctctctgaattatataattgggtatttaaaagaagaaaacaaatacaaaaaaacaatttacccccatgcagagtccatctaaatcatacatagcagccaytgagctcccatactgccactgcaatgctctggacaggagtcatcctaggaaccatccctcccaccccagaagggagaatggatcatctgcagcctcctctggagcttggctcaattgccactagacacccaggatgacagagagtcaagattcagactgctgtacaccttctttgggaatgccagccccccaggtctggcacagaaaccacaaaattccctaagtcctggtgtatacaagctgtaaaggcagtaggtccctgacacttcattggaagtgagtttatgattttggtggaga

SEQ ID NO: 26662 - DNA, 601 bp, Human
aagggccagagtttgtgagttgtgagttgtacatatatgatcaacaccacataagttgtttaaaataagctttctgctctctgaattatataattgggtatttaaaagaagaaaacaaatacaaaaaaacaatttacccccatgcagagtccatctaaatcatacatagcagccattgagctcccatactgccactgcaatgctctggacaggagtcatcctaggaaccatccctcccaccccagaagggagaatggatcatctgcagcctcctctggagcttggctcaattgccactagrcacccaggatgacagagagtcaagattcagactgctgtacaccttctttgggaatgccagccccccaggtctggcacagaaaccacaaaattccctaagtcctggtgtatacaagctgtaaaggcagtaggtccctgacacttcattggaagtgagtttatgattttggtggagacaataggtctctatccatagaatgcaaccaccaagacaccaaggccactggaaatgcaccagaagtatatcagccaggtcctcttgctcccagcagcagcgaaatgtgccagaaatataccaacc

SEQ ID NO: 26663 - DNA, 601 bp, Human
aatcatacatagcagccattgagctcccatactgccactgcaatgctctggacaggagtcatcctaggaaccatccctcccaccccagaagggagaatggatcatctgcagcctcctctggagcttggctcaattgccactagacacccaggatgacagagagtcaagattcagactgctgtacaccttctttgggaatgccagccccccaggtctggcacagaaaccacaaaattccctaagtcctggtgtatacaagctgtaaaggcagtaggtccctgacacttcattggaagtgagyttatgattttggtggagacaataggtctctatccatagaatgcaaccaccaagacaccaaggccactggaaatgcaccagaagtatatcagccaggtcctcttgctcccagcagcagcgaaatgtgccagaaatataccaacccctgggaaacatacaagcttcaaggtattggttccctacctcactgctctccgtcctgacacaccggtgtgagcccagtgatccatgcttaagccccagcttctaaccgagtgacagtgtgcactgcagttgcagactgagctcaagctctgttatg

SEQ ID NO: 26664 - DNA, 601 bp, Human
catttttaccctccaattaattcttaggctcctgctctagcggtggattcctgagaggcaatgggagtacatattccagatgaattgaccctggccacaaatgtcctctccagacacctataaatatcccatcgccaaggttccttgtaagaaatatatgattggatcccaggatctgtggaggacctctcccggctcctccccacattttaggaaaatcctgccggtttaggattaccagccagaggtccatgccccaaagaagccactcacaaacactgatggttgttggcgactaagstgcatcacttgatttggattacagaaaggaacgcccgagagattttgtttgtttttatttggggagaatgaaggaggagggagattttagactgaatcgttctagagtatttgacgactacagctcctctctctttgtactacggagaccctgcttatagcccccaacaggaaatcctcatctgcagttgccagacagccagaatatttccacctgtgccagaacaagacagaagaccccaggagattcttcctggggacaggtctcaagcagacccaatcccccatacagagaatttct

SEQ ID NO: 26665 - DNA, 601 bp, Human
aatgtcctctccagacacctataaatatcccatcgccaaggttccttgtaagaaatatatgattggatcccaggatctgtggaggacctctcccggctcctccccacattttaggaaaatcctgccggtttaggattaccagccagaggtccatgccccaaagaagccactcacaaacactgatggttgttggcgactaagctgcatcacttgatttggattacagaaaggaacgcccgagagattttgtttgtttttatttggggagaatgaaggaggagggagattttagactgaatcrttctagagtatttgacgactacagctcctctctctttgtactacggagaccctgcttatagcccccaacaggaaatcctcatctgcagttgccagacagccagaatatttccacctgtgccagaacaagacagaagaccccaggagattcttcctggggacaggtctcaagcagacccaatcccccatacagagaatttcttagatgaaaacagcctcaggcccttagacccagcctctggtctctcttctgggcccacaccagcacaacaccctggagaagccccaagcctgcacaagt

SEQ ID NO: 26666 - DNA, 601 bp, Human
ctctcccggctcctccccacattttaggaaaatcctgccggtttaggattaccagccagaggtccatgccccaaagaagccactcacaaacactgatggttgttggcgactaagctgcatcacttgatttggattacagaaaggaacgcccgagagattttgtttgtttttatttggggagaatgaaggaggagggagattttagactgaatcgttctagagtatttgacgactacagctcctctctctttgtactacggagaccctgcttatagcccccaacaggaaatcctcatctgcrgttgccagacagccagaatatttccacctgtgccagaacaagacagaagaccccaggagattcttcctggggacaggtctcaagcagacccaatcccccatacagagaatttcttagatgaaaacagcctcaggcccttagacccagcctctggtctctcttctgggcccacaccagcacaacaccctggagaagccccaagcctgcacaagtaccaaacccaccagggaacagcaccaccatcctcgcctctaccggagaagaggggtgttcctgcctccccaccctaggcctcaggcc

SEQ ID NO: 26667 - DNA, 601 bp, Human
cccagagaccagcctgggactctagtgggtgcagacgctacgctcgcggcgggagcggggggcaggaagcaggaagcggccgggaccgcgtgggtcggagaagtgggggatggtgggactcctggaaagtcggaaccccctttgggaaccatccattcataaattagggtggggccttgcagttcatctgtgggtccattctctttacagatgaggaaacagaccttgagtgagcgacttgttcagagcctcacatctacagtagttagacgcggagacagaatcagaatcttaggcttgrggcttccaaacttgcgtttatggcttactgtaagcgggaaacacattgcagagccttatttaatcaatctcctaagatcctgcgggggtaaagagctccattttaaggaaaggaaaaccgagtgcccgagatctgacccagcttgtccaagtttgggtggttaagtatacattttgcccggcactgatctgggcggtgcatgtgggaagatgaatagggcccagttccccgactttgagggcctcacaggctgatgtgtaagagacaggaaaacagccctagtgctttgtgatcaacctt

SEQ ID NO: 26668 - DNA, 601 bp, Human
gatgtttgaaacttgtattctatacatgaaggatcttaagcaggaagattgtatttgtaaaagtcacgctggcattgggatagaaggttaggccacatgcagaaggctgttgtaatagtccaagtgagaagtggtgacgtcttcagctaagggatcctctatcccaagtctgtgacaggacagttcacttaaaagccaaatttttttcttgattgtccactcgagattgaatggagaaactgcatacgggcacattctaactatgtaaatttaattctagatgataaatggtgactatacrtagatttttttcacataaaatgatatttttactgttttgtaacttttttttttttttttttttttgcttaatagaatgtggtcaacaactttccatgtccataaatattctcctgtgctattcttaattggacgtgatatgtatggttaacacatatgtaatttttccttcctgtaataattatacaatagttaatatttattttgagtactaaatacgagtttggcactgtattaatgcattccatgaattaactcattcagtcttcttttttttgagacggagtctcgctctgtcact

SEQ ID NO: 26669 - DNA, 601 bp, Human
gcgcccggcctcattcagtcttcttaataacgctgtgaagtgggttctgttattatctccattatacagatgagaaagcaggcgtaggaacagtaacttgctcaaacccagtatccccgtttttttccttcctcaaacccagtatcctatagccaatactaataacccctgtgctgttctgagtgagtcagggacagatcattcctgagaaaggtaattctgtagcttctcttcacaatccggttctgtttcccaacttttgggttgagattttagattacttgtatgtagatgtacatamcatatatactcagggaaatagagaacagttgcctactctcttcccagtgttgtagaaaaggggtcataggcctcagggttccagagagacctgttgtaatttcccagctctattacttaatgatacaaatgggcaagttacttctttgagccagtgttcttgtttgtaaaatggagccgtatttagaaccagaaaacctttgtggtgattccctctctctctctccctctctctctctctctctctctctctctctctctctctctcactacccctgttcatttggcaaatggtcaaaac

SEQ ID NO: 26670 - DNA, 601 bp, Human
ttctcttcacaatccggttctgtttcccaacttttgggttgagattttagattacttgtatgtagatgtacataccatatatactcagggaaatagagaacagttgcctactctcttcccagtgttgtagaaaaggggtcataggcctcagggttccagagagacctgttgtaatttcccagctctattacttaatgatacaaatgggcaagttacttctttgagccagtgttcttgtttgtaaaatggagccgtatttagaaccagaaaacctttgtggtgattccctctctctctctcyctctctctctctctctctctctctctctctctctctctctcactacccctgttcatttggcaaatggtcaaaaccaaaataatcttatcagaaatataaaacttattttatcatctttccattttaaacctgcacagacctgcaatttttctttctttttttttttttttttgttgtcgttgttgttgttgaaatggagtcttgctctgtctcccaggctggagtgcagtggcgcgatctctgctcactgcaagctccgcctcccgggttccagccattctcctgcctcagcctcccgag

SEQ ID NO: 26671 - DNA, 601 bp, Human
atgggcaagttacttctttgagccagtgttcttgtttgtaaaatggagccgtatttagaaccagaaaacctttgtggtgattccctctctctctctccctctctctctctctctctctctctctctctctctctctctcactacccctgttcatttggcaaatggtcaaaaccaaaataatcttatcagaaatataaaacttattttatcatctttccattttaaacctgcacagacctgcaatttttctttctttttttttttttttttgttgtcgttgttgttgttgaaatggagtctygctctgtctcccaggctggagtgcagtggcgcgatctctgctcactgcaagctccgcctcccgggttccagccattctcctgcctcagcctcccgagtagctgggactacaggcacccgccaccacgcccggctaattttttttgtattttttagtagagacggggtttcaccgtgttagccaggatggtctcgatctcctgacctcgtgatctgcccgcctcggcctcccaaagtgctgggattacaggcatgagccaccgcgcccagccgcaatttttctttttacccagtatacttg

SEQ ID NO: 26672 - DNA, 601 bp, Human
gggtttcaccgtgctagccaggatggtctcgatctcctgaccttgtgatccgtccgcctcggcctcccaaagtgctgggattacaggcgtgacccaccgcgcccagccaaaaatgattcttaaatttttaaatagttggaaaaaataaaacaactaagaatatacaacagagaccatgtttggcctgcaaagtgtaaaatatttgtgtggccttttacagaaaaagcttgccaatcttggtcttaaacacttcaacttaaaatatgtgaatatgtatgtattcactaactttatatacatacataaaacagtgaatatatatatgtatggcaaggtttgggggatagcgagtgctaattagagttcttacattatcttaacacatacgagaagtagtctgagcacagaatccttgcagattttcatgtagttgtagagttacacctaacttgacagtgtttttgtgtgtgtgacttggatttatcaagccttctcaaacattcaacttggttttcatagaatccataattcccttattgtgttattttataattatatatttttgaagtttatttataagtgttatgtattgaattgaacc

SEQ ID NO: 26673 - DNA, 601 bp, Human
atttatcaagccttctcaaacattcaacttggttttcatagaatccataattcccttattgtgttattttataattatatatttttgaagtttatttataagtgttatgtattgaattgaaccatttggaatcaccatatgaattgtcatgtggttgattatcatcaattttgtattgttgaaccaaacacgtaaaagaacaagcacaaaaacagtttggggaaccaacgtggctgattcttggtaagcgtattatacaactagtagaagcagaaccagttaggcctatgagccatgagcrtctactgtaccacagacattagttagtactttttacaaagtgaatggagtgtttccattcatttgacaagtgcttctacctacaagttcttctaccttactccaaaggaagtaaaaagttgtaataccatgcaagtttctatgtgagagcatagagaactggatagacctttacgtatcagttcaacctttcattttagagataattttgaaggtcaggttgattaatagattcctctgttgtcacacaatgagattgtagccgtgtcattaaaatttaggcttctgttagtttgggaac

SEQ ID NO: 26674 - DNA, 601 bp, Human
taagtcactgatctgcactgagaatactttatgaaatttttacaaaagtccagaataactttttgttctgtgaaaaattataacattgataacaggctatttaaagattcacataattagtggtgaatatgaaagggaaggacaaaaaagacatgttccatttgcgtcaaaaggtttttctttgaagttttgttataaatcttttttttttttttttgagacggaggagtctcgctctgtcgcccaggctggagtgcattggcgccatcttggctcactgcaagctccgcttcctgggttracgccattctcctgcctcggcctcctgagtagctgggattacaggcgcccgccaccacgcctgcctaatttttgtatttttagtagagacggggtttcactgtgttagccaggatggtcttgatctcctgacctcgtgatccacccgcctcggcctcccaaagtgctgggattacaggcgtgagccactgcgcctggccgttttgttacaaatcttaaagattattttacccttctttgaaaaattgaaatgatccagtatggcccatgtgtaatctacattttcagagtaactctattc

SEQ ID NO: 26675 - DNA, 601 bp, Human
catgttccatttgcgtcaaaaggtttttctttgaagttttgttataaatcttttttttttttttttgagacggaggagtctcgctctgtcgcccaggctggagtgcattggcgccatcttggctcactgcaagctccgcttcctgggttgacgccattctcctgcctcggcctcctgagtagctgggattacaggcgcccgccaccacgcctgcctaatttttgtatttttagtagagacggggtttcactgtgttagccaggatggtcttgatctcctgacctcgtgatccacccgcctyggcctcccaaagtgctgggattacaggcgtgagccactgcgcctggccgttttgttacaaatcttaaagattattttacccttctttgaaaaattgaaatgatccagtatggcccatgtgtaatctacattttcagagtaactctattcttagaatcttggggctccatattggatcataagataaaagtcatgttcttcccaaagaatatagagaatatgattatcctttttatcagttctttaatctcctgaaaactgttttacaccaatatgatgaaatacatttctctctgccaaa

SEQ ID NO: 26676 - DNA, 601 bp, Human
taatttttgtatttttagtagagacggggtttcactgtgttagccaggatggtcttgatctcctgacctcgtgatccacccgcctcggcctcccaaagtgctgggattacaggcgtgagccactgcgcctggccgttttgttacaaatcttaaagattattttacccttctttgaaaaattgaaatgatccagtatggcccatgtgtaatctacattttcagagtaactctattcttagaatcttggggctccatattggatcataagataaaagtcatgttcttcccaaagaatatagasaatatgattatcctttttatcagttctttaatctcctgaaaactgttttacaccaatatgatgaaatacatttctctctgccaaattcatgttatgttttgtgaaatgcatgtatttattttattgactccatctgatctcaggaggaaagaaaacattgtttataacctatggtaaagttagtaggagcattgaaaatagaaaggagtttgttgtttactttctgtttggttcttttctcttgatcctcagataggagttgtatacattttgttgtaaacccttagacatagagagcca

SEQ ID NO: 26677 - DNA, 601 bp, Human
atactttatgttcgatgttgtatattgggtgtgtaatgtttttactcacattatatggaaagttttattaaatagtctttcattttacctctatatttgttataaatattatcataggcatttgcagaatttattctgaggttagcattgtctgtcaaagaaaggatctggtgtacattttaagcaggaagaggaacagagaagttatttagtaggccttttttttttcctttggagtctacatagcttagctttgtagaaagagaaaggtgggtgtattaagagaaaactcggtgtggtsacttgtgccagttgtcccagctactctagaggctgatgttggaggattgcttcaggccaggaggccagcctgcgcaacatagcaagaccctgtcgctaaaaaattaaaaaaaaaaaaacttatttgttggagaaattaagattattcaaaccattggaaattgatagtgcttatttatcagagttgccatatctgcttaaacaggaggcattcaatgtcaaatgataatgttctgcattttcaggatcttccagttaggttcttaggtacatttttggaatttgttgtttttatcattat

SEQ ID NO: 26678 - DNA, 601 bp, Human
attctgaggttagcattgtctgtcaaagaaaggatctggtgtacattttaagcaggaagaggaacagagaagttatttagtaggccttttttttttcctttggagtctacatagcttagctttgtagaaagagaaaggtgggtgtattaagagaaaactcggtgtggtgacttgtgccagttgtcccagctactctagaggctgatgttggaggattgcttcaggccaggaggccagcctgcgcaacatagcaagaccctgtcgctaaaaaattaaaaaaaaaaaaacttatttgttggaraaattaagattattcaaaccattggaaattgatagtgcttatttatcagagttgccatatctgcttaaacaggaggcattcaatgtcaaatgataatgttctgcattttcaggatcttccagttaggttcttaggtacatttttggaatttgttgtttttatcattatatttcagaaaaatagagatacatcaatataaaaaaacaatatataataaaaatagtgtttattttcctgttttcaaattagattcgtgtgtacttatatatgtgtggactttttttttttttttttttttta

SEQ ID NO: 26679 - DNA, 601 bp, Human
tgttttgtcattgtgttgtggggtcgggttgtaccacctttgttttgggccagtaacaacatgtaatttctaagtgatgttccatagccagctaaaggccagatcacagtgtctgagacatggtgctgtgggcacattgactcaaaagaacctgggccattgcaatcaatgagttagtcacattgtgagtagcagttgttttcagagaacaaagtctatgtcatttaattagtgatgccaagtttagtttaatttgtttgaaaacagctaaaccagatgatttccaaaataaaaatacactagtaattggaagccttttgaattactttggctatggatagaaacagtagtttatagatttagaaatttaggattttatatattgggtttacttgtagtaaatattatcatctgtctctttcagacaaccacattaattggcaacttgtatgccaagactcagaccatgccatttttctttaaattttcaggtgtattggcactctagtgctcacataatgggtgaagccatggaaagagtctatggtggatgtttatgctacggtccgccaatagaaaatggattctattatgacatgta

SEQ ID NO: 26680 - DNA, 601 bp, Human
tttacaaatttgaatgttgtttcatggttaatccttgttttcagaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggtatgttcaagaacaatgatgtgtcttgactgagttttcttcaacttcatttgaagtttgaaattcagctgcatgaagtactaggaattttgttttgaagagatgttgtrgctttttagtaactggtgctatgtcctgtacaaactataaacacttactgattgtccacattatctgcctggagtatgctcagtaccgcacaaaaatgcatttgaactacttttattgagagcaaacactgatgatctacggttttctgtaaaagaagtataacagcttctcatagagctgggagaactatggaaaccctctagtttcactgactcatttaaaatgtggaaacagagtcccacaaagattaacctacttgttgcccaaggtttagcagcatgtcgcacatggatcctgtg

SEQ ID NO: 26681 - DNA, 601 bp, Human
ccttgttttcagaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggtatgttcaagaacaatgatgtgtcttgactgagttttcttcaacttcatttgaagtttgaaattcagctgcatgaagtactaggaattttgttttgaagagatgttgtggctttttagtaactggtgctatgtcctgtacraactataaacacttactgattgtccacattatctgcctggagtatgctcagtaccgcacaaaaatgcatttgaactacttttattgagagcaaacactgatgatctacggttttctgtaaaagaagtataacagcttctcatagagctgggagaactatggaaaccctctagtttcactgactcatttaaaatgtggaaacagagtcccacaaagattaacctacttgttgcccaaggtttagcagcatgtcgcacatggatcctgtgctatcatttcctctacccattatctctgttac

SEQ ID NO: 26682 - DNA, 601 bp, Human
ttggagctttaaggaatttaagaaccatgagaggtactgcagtggatagttaaagaactgaagggacccttattccctgccactgttggggaaacttgactggattgaggaatataacaggcagggcatgtgttacacgtctgccaaattgtaaatcagctgcaattctataacatcagaaacactgacatggtttctttgattcaggagtggcactgattgaaatatgggacatcatgaccatattctgagctcaagaacactgaaatttatgtatatatacacacacgtatacgtgacrtacataaacattcttttgcttttcttttacccaggaccaagaactatatttctttcatgaactcagccctggaagttgcttttttctgccaaaaggagcctacatttataatgcacttattgaattcattagggtaagtcatatttattgctttcttctttagatttaggatatgtgatcattttattaaataaggtctactaaaaggaaagataatctgtatttgagaagaaatatataagacgataagtaaaagtagaagtctgtggcctcataaatcatccctaatagttgattttg

SEQ ID NO: 26683 - DNA, 601 bp, Human
tttgattcaggagtggcactgattgaaatatgggacatcatgaccatattctgagctcaagaacactgaaatttatgtatatatacacacacgtatacgtgacgtacataaacattcttttgcttttcttttacccaggaccaagaactatatttctttcatgaactcagccctggaagttgcttttttctgccaaaaggagcctacatttataatgcacttattgaattcattagggtaagtcatatttattgctttcttctttagatttaggatatgtgatcattttattaaataaggyctactaaaaggaaagataatctgtatttgagaagaaatatataagacgataagtaaaagtagaagtctgtggcctcataaatcatccctaatagttgattttgcccatatacacatagaaactggtgagcttgaagggggacctgtggtccttgacataggagctctgtgccctctttgactttgatcatttatttgtattttctttgaaaaaacggtttttacattgcttttttcctttgtaaattatgaaatgtttcaagtataagtttatagagaatagtatatccaatatcttgta

SEQ ID NO: 26684 - DNA, 601 bp, Human
ttctgagctcaagaacactgaaatttatgtatatatacacacacgtatacgtgacgtacataaacattcttttgcttttcttttacccaggaccaagaactatatttctttcatgaactcagccctggaagttgcttttttctgccaaaaggagcctacatttataatgcacttattgaattcattagggtaagtcatatttattgctttcttctttagatttaggatatgtgatcattttattaaataaggtctactaaaaggaaagataatctgtatttgagaagaaatatataagacrataagtaaaagtagaagtctgtggcctcataaatcatccctaatagttgattttgcccatatacacatagaaactggtgagcttgaagggggacctgtggtccttgacataggagctctgtgccctctttgactttgatcatttatttgtattttctttgaaaaaacggtttttacattgcttttttcctttgtaaattatgaaatgtttcaagtataagtttatagagaatagtatatccaatatcttgtacttaactacccacatttaacaaatattcacattgggctatatttgctt

SEQ ID NO: 26685 - DNA, 601 bp, Human
gatcaacatttgtgattcatttctgtgaggttaagtaagtttttgtttccaagatacatggccacataactttcatcttaattcttaagcagttttttctggacccacagtgcatttgaaagcagcacagggttataaaagcacccgtgtgtagagccttccatattaatcatattgatttaaaacttttgtaaaatgacgtacattggtttaatcttacacattactgtcatttcagttttatttgaacttggttacttcagaaattaggacagtttctcattctgatcaatgatacaasataatctctagatttctcaaagtcagataaaatgtgagacacattctctgcaaggtatttcaagaattaagggagtcctcagctaattgctctgctaaacctgttttaggtggggaaaagtccatgattagggtagaatttagtgcctactttagccttttgcctgatacaacagaacaactgaaaatagaggaatgatggagaaaaacattagcctgatgtttgcagcatcagaagcatttgacacttgtattgcttcaaagggagaattggatgggcttattttttaataagtagtga

SEQ ID NO: 26686 - DNA, 601 bp, Human
gtttccaagatacatggccacataactttcatcttaattcttaagcagttttttctggacccacagtgcatttgaaagcagcacagggttataaaagcacccgtgtgtagagccttccatattaatcatattgatttaaaacttttgtaaaatgacgtacattggtttaatcttacacattactgtcatttcagttttatttgaacttggttacttcagaaattaggacagtttctcattctgatcaatgatacaagataatctctagatttctcaaagtcagataaaatgtgagacacaktctctgcaaggtatttcaagaattaagggagtcctcagctaattgctctgctaaacctgttttaggtggggaaaagtccatgattagggtagaatttagtgcctactttagccttttgcctgatacaacagaacaactgaaaatagaggaatgatggagaaaaacattagcctgatgtttgcagcatcagaagcatttgacacttgtattgcttcaaagggagaattggatgggcttattttttaataagtagtgaaaactctgatttttaccaagtgccataaccagttattatcaatt

SEQ ID NO: 26687 - DNA, 601 bp, Human
tgtgatgaatatgcccaaaaggtaagccttagatatgaattttctttcaatttaacatctgttgttcagcttttcaaatcacataagccctgtattcttggtgaatcgagctgttgtgataaagagaaatgttactatttttaatctttgttaagcctgaatagattatattacttctttaatgcttttctccatgattccataatcagaagacatatttggatagtgttttatgtacacttgtatattttattgtatttgttttaagagatgggatctttctcttgccccaactggagtrcagtagtacagtcatggctcactgtaacctcaaactcctgggctcacgcagtcctcccaccttggcctcccgagtagcagtgactacaggcaggagccaccatacccagttacacttgtatattttagtatttagtattttaaaaaaccagattagcagatatcaggtacttcagtatggtaggtaaattcccgttcaaaatacagtttaggctgctctttgactcagtgagtaattttgcttcattttaatgtaaatttcttcaggtagttgaaattttttcaggttaatagtatagca

SEQ ID NO: 26688 - DNA, 601 bp, Human
ccctgtattcttggtgaatcgagctgttgtgataaagagaaatgttactatttttaatctttgttaagcctgaatagattatattacttctttaatgcttttctccatgattccataatcagaagacatatttggatagtgttttatgtacacttgtatattttattgtatttgttttaagagatgggatctttctcttgccccaactggagtgcagtagtacagtcatggctcactgtaacctcaaactcctgggctcacgcagtcctcccaccttggcctcccgagtagcagtgactayaggcaggagccaccatacccagttacacttgtatattttagtatttagtattttaaaaaaccagattagcagatatcaggtacttcagtatggtaggtaaattcccgttcaaaatacagtttaggctgctctttgactcagtgagtaattttgcttcattttaatgtaaatttcttcaggtagttgaaattttttcaggttaatagtatagcagaccaatgtcttgcctctctaccaaaaaaactaacttaccaacaaatgtatagccattcataacttcactttaaagcattgttctgc

SEQ ID NO: 26689 - DNA, 601 bp, Human
aaatctagttaaaatgctaagacttgtgcacagtataggcaaagtcacttagattgtttcaaaaagtatgccttatagaaataaacatttgacatacataaataacccttggtttacacataactcgcatttgagaaatgaatgtgttgtagatcatttagaatctttttcaatcaaaaattgaaagaaatatttcgtcacccaggtcaaccagagattgctggttttactcatgatacttaagtagagtatgatagttactatttcaccttcagctgtacttaagatgttttcctggaaraattcattctgctttctgaccaggatttccagaaactctgacccttctaagaggtctgggtggaattgtgatggtgattctgctagtagacagtgtaacttctgcgtctacaaaaagaggataggccgtcactgctcacatggctttgcgtgaaagcccaatggtactgtctctatggcagagatgaggaaggaacaccagcgtcctccaactttcctgttcttcctttgggttaatggccactgtaaggaaacagttttctgccacgtgtggggtgatttgaatgtaaaatgcccaact

SEQ ID NO: 26690 - DNA, 601 bp, Human
gtcactgctcacatggctttgcgtgaaagcccaatggtactgtctctatggcagagatgaggaaggaacaccagcgtcctccaactttcctgttcttcctttgggttaatggccactgtaaggaaacagttttctgccacgtgtggggtgatttgaatgtaaaatgcccaactctcatagcaggctgaacagaaacattttttatactcattgttaatttgttctaatctaaattacttttagactattaaatattattctattttaaagttaagggactaatgcctctgataacctgatwaaaaaaaaaaactttctgatactcagaagttaagatttattcagttgaagatcatttctttcaggtgttgatcgtgtgatatttttcacatctgtaatctgaggttcatatgaaatgatagtgaaataaaattgttcatttaggtctttttgtcatgttaatatgttatcaggttaatgggaagtttaatctagttaatgtaaaattaataaattgtaatctagtttattgcttttttggaaaagaatactgaaaacattgtttacttaatacacatgacctgaggtaataaagaggagc

SEQ ID NO: 26691 - DNA, 601 bp, Human
ggaaaatctactgaaaccttgagacaggtttaagtgaattgtaatcaagaatttatttagttccttccagtcctgattttttttctattatatattttaatatataataactataaaaataggctcatgcatacatactgggtttttttttttttcacttaaatcatggatgtctgtgagaaaatattttgctattataacaagaatgaagacgcattgcttttaaacacatctattggattactttctcaagataatgccttatgtgggattacttgaaaaaagatattcatgatgtttrgggttttattatttggttgttacgttgtctagattgactccataagcacagtagttttagatattgcaaagagtttcttttaaatatcaacacatggtcacttgtaccttttaatgtatcagaagctatggggtaggttttgggtcctaggatcatttcttttcagatgttcagtgtgaattcttccatatctttagattaagtctgacaaagctttgtgtgtttgttttagttgttggtgaaaaagagaaaatcagtggcactgttaatatccgcacaagagacaataaggtccacggg

SEQ ID NO: 26692 - DNA, 601 bp, Human
gattaagtctgacaaagctttgtgtgtttgttttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtcygaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattcacataagtttcaagactgctctgtccctcacatgtacac

SEQ ID NO: 26693 - DNA, 601 bp, Human
cagggaaggaagtggtgaggtgctggggaggggctgagagctccagattatcaggatccaactccacattcctgagttctcaaggcaggtgggaaccaagatactggcaggaatgcggagtagctcaggacgccggaccctcctcttctggagaggagatgcgcgtgtgtgtgcttggcagacttttcatttacaaggtgaccttggagaagctatttaacaggtgagcactgatttcctcagacataaatgagaataatgagatatttacctcccttatgcaacagaaccattgtcgggraaaaaaataacatgattaccccgaagaagcatagtttaattaatatatgtctaatattatttttttcatcacaagcagccttttaatctcatttccacttgagcctttcacttctcagtttctcagattcatagggaacacttcaacctcacttttcagtcttagccccaactccttaagaatcagaaaatgtttccacaaagacttaaacagttcatgaagaaaagtcacaactattaaagtggcaaatgaacctacaaatcagccagcaaagcaaggacaggaaactgtaatgtcaaa

SEQ ID NO: 26694 - DNA, 601 bp, Human
aagcaaaaattccaccacattgaaaaagacttttgcaactttcctttcaggacatggtgagaccacagccatgggtaaaaggcgactttcactagggacattcactgctcaaggagagcataaaaacatccttgagcagggaaggaagtggtgaggtgctggggaggggctgagagctccagattatcaggatccaactccacattcctgagttctcaaggcaggtgggaaccaagatactggcaggaatgcggagtagctcaggacgccggaccctcctcttctggagaggagatgcgcrtgtgtgtgcttggcagacttttcatttacaaggtgaccttggagaagctatttaacaggtgagcactgatttcctcagacataaatgagaataatgagatatttacctcccttatgcaacagaaccattgtcgggaaaaaaaataacatgattaccccgaagaagcatagtttaattaatatatgtctaatattatttttttcatcacaagcagccttttaatctcatttccacttgagcctttcacttctcagtttctcagattcatagggaacacttcaacctcacttttcagtctta

SEQ ID NO: 26695 - DNA, 601 bp, Human
aagagcaattaaaaacaagcaaaaattccaccacattgaaaaagacttttgcaactttcctttcaggacatggtgagaccacagccatgggtaaaaggcgactttcactagggacattcactgctcaaggagagcataaaaacatccttgagcagggaaggaagtggtgaggtgctggggaggggctgagagctccagattatcaggatccaactccacattcctgagttctcaaggcaggtgggaaccaagatactggcaggaatgcggagtagctcaggacgccggaccctcctcttcyggagaggagatgcgcgtgtgtgtgcttggcagacttttcatttacaaggtgaccttggagaagctatttaacaggtgagcactgatttcctcagacataaatgagaataatgagatatttacctcccttatgcaacagaaccattgtcgggaaaaaaaataacatgattaccccgaagaagcatagtttaattaatatatgtctaatattatttttttcatcacaagcagccttttaatctcatttccacttgagcctttcacttctcagtttctcagattcatagggaacacttcaacc

SEQ ID NO: 26696 - DNA, 601 bp, Human
tcataagagcaattaaaaacaagcaaaaattccaccacattgaaaaagacttttgcaactttcctttcaggacatggtgagaccacagccatgggtaaaaggcgactttcactagggacattcactgctcaaggagagcataaaaacatccttgagcagggaaggaagtggtgaggtgctggggaggggctgagagctccagattatcaggatccaactccacattcctgagttctcaaggcaggtgggaaccaagatactggcaggaatgcggagtagctcaggacgccggaccctcctyttctggagaggagatgcgcgtgtgtgtgcttggcagacttttcatttacaaggtgaccttggagaagctatttaacaggtgagcactgatttcctcagacataaatgagaataatgagatatttacctcccttatgcaacagaaccattgtcgggaaaaaaaataacatgattaccccgaagaagcatagtttaattaatatatgtctaatattatttttttcatcacaagcagccttttaatctcatttccacttgagcctttcacttctcagtttctcagattcatagggaacacttc

SEQ ID NO: 26697 - DNA, 601 bp, Human
cctgtccttcactcagagaaatggtagctataaaataaggaacagggaaaaggaaaattaaatgtagcccttcctccatttgtgatgttgccactctagcggagaataagccaggagcttggatattttggctcactgcttcccaaacatcttcatcccccaaaactggtaaatgtataattccaacgtaattgataacttcataagagcaattaaaaacaagcaaaaattccaccacattgaaaaagacttttgcaactttcctttcaggacatggtgagaccacagccatgggtaaaargcgactttcactagggacattcactgctcaaggagagcataaaaacatccttgagcagggaaggaagtggtgaggtgctggggaggggctgagagctccagattatcaggatccaactccacattcctgagttctcaaggcaggtgggaaccaagatactggcaggaatgcggagtagctcaggacgccggaccctcctcttctggagaggagatgcgcgtgtgtgtgcttggcagacttttcatttacaaggtgaccttggagaagctatttaacaggtgagcactgatttcctcagac

SEQ ID NO: 26698 - DNA, 601 bp, Human
tttttaagagaggaaacaggcacagagaggttaagtgacttacacaagctcacatagccagtaagcaaatcaggcagtttggcctcagagtcacctctctaagcacttactgtccctgtccttcactcagagaaatggtagctataaaataaggaacagggaaaaggaaaattaaatgtagcccttcctccatttgtgatgttgccactctagcggagaataagccaggagcttggatattttggctcactgcttcccaaacatcttcatcccccaaaactggtaaatgtataattccaaygtaattgataacttcataagagcaattaaaaacaagcaaaaattccaccacattgaaaaagacttttgcaactttcctttcaggacatggtgagaccacagccatgggtaaaaggcgactttcactagggacattcactgctcaaggagagcataaaaacatccttgagcagggaaggaagtggtgaggtgctggggaggggctgagagctccagattatcaggatccaactccacattcctgagttctcaaggcaggtgggaaccaagatactggcaggaatgcggagtagctcaggac

SEQ ID NO: 26699 - DNA, 601 bp, Human
ttaagttataataagagagggtatttttcaccttttaaatcatgctgctttaaattgtataaagctcaagcttatcccttcttgattaatttttcagattgttttcaaacttttctcatatttattcatctcaacaattttagtagttcagggatggaatgcgttctgttctacttgtattatcattcttaaaagcaacccaaaacttgcagagtgaatctctctttcttggacagcaaaaatcctaatgctgggtccagaatcatgacagccacagctccccaatgctgtcaatccctarcatgtctaatagccatcaaagctgtggtaggaggcccggtgcagtggctcacgactgtaatctcagtactttgggaggctgaggcaggcagatcacttgaggccaggagttcgagaccagcctggccaacatggtgaaaccctgtctctactaaaaatacaaaaattagccaggcatggtggtatatgcctataatcccagctacttgggtggctgaggcatgagaatcgcttgaacctgggaagtggaggtctcagtgagctgagatcataccactgcactccagcctgggtgacaaag

SEQ ID NO: 26700 - DNA, 601 bp, Human
catccgtcctactttcttctcccagtgtcttttgaaaatgtctacttctacttttattgttttcactttgcatctgaacctaatgtaaaatttcactatgaaaatgtgaaactaggatctatactttcttagttatacttaagttataataagagagggtatttttcaccttttaaatcatgctgctttaaattgtataaagctcaagcttatcccttcttgattaatttttcagattgttttcaaacttttctcatatttattcatctcaacaattttagtagttcagggatggaatgckttctgttctacttgtattatcattcttaaaagcaacccaaaacttgcagagtgaatctctctttcttggacagcaaaaatcctaatgctgggtccagaatcatgacagccacagctccccaatgctgtcaatccctagcatgtctaatagccatcaaagctgtggtaggaggcccggtgcagtggctcacgactgtaatctcagtactttgggaggctgaggcaggcagatcacttgaggccaggagttcgagaccagcctggccaacatggtgaaaccctgtctctactaaaaatacaa

SEQ ID NO: 26701 - DNA, 601 bp, Human
ggattccccaccattctctccatccgtcctactttcttctcccagtgtcttttgaaaatgtctacttctacttttattgttttcactttgcatctgaacctaatgtaaaatttcactatgaaaatgtgaaactaggatctatactttcttagttatacttaagttataataagagagggtatttttcaccttttaaatcatgctgctttaaattgtataaagctcaagcttatcccttcttgattaatttttcagattgttttcaaacttttctcatatttattcatctcaacaattttartagttcagggatggaatgcgttctgttctacttgtattatcattcttaaaagcaacccaaaacttgcagagtgaatctctctttcttggacagcaaaaatcctaatgctgggtccagaatcatgacagccacagctccccaatgctgtcaatccctagcatgtctaatagccatcaaagctgtggtaggaggcccggtgcagtggctcacgactgtaatctcagtactttgggaggctgaggcaggcagatcacttgaggccaggagttcgagaccagcctggccaacatggtgaaaccc

SEQ ID NO: 26702 - DNA, 601 bp, Human
ttagactagctaaccgcctccccccaccaaaaaaaacctaatccaaattcagagtttcgataactaaaactagcttgatatattacctagctaacttggggcatttgtatttctacgagaagtttctaggaatagcaccctgttttggcatctcaggctgaagaggtatttgtgggccagtatctccctgagcaaacctcagatcacacaatgttggcctcttggggagaaggatccagggagctgtgtttctctctgccttaattcttgtgctgagtcatcctaccacagcagaggctgytgggagggaagagctttgcaaacttcaagtgcagaaaccatttaaacaaggagggaatactctccctcagtaacactacccactggtagttacccaccctcctatttatatcttccatccactcattcatttattccatagacttaatagtgtggtgtaggagaaacagcacagacaaaaggtagacagatctgggtttgaagcccagggaagacatgccagctcctggggatctcccagctgccatcagaatgactcatctagaaaagcatgaaggagcaaccatcccatctaggcagc

SEQ ID NO: 26703 - DNA, 601 bp, Human
ctgtgaaacttccttaaagtttgttagactagctaaccgcctccccccaccaaaaaaaacctaatccaaattcagagtttcgataactaaaactagcttgatatattacctagctaacttggggcatttgtatttctacgagaagtttctaggaatagcaccctgttttggcatctcaggctgaagaggtatttgtgggccagtatctccctgagcaaacctcagatcacacaatgttggcctcttggggagaaggatccagggagctgtgtttctctctgccttaattcttgtgctgagycatcctaccacagcagaggctgttgggagggaagagctttgcaaacttcaagtgcagaaaccatttaaacaaggagggaatactctccctcagtaacactacccactggtagttacccaccctcctatttatatcttccatccactcattcatttattccatagacttaatagtgtggtgtaggagaaacagcacagacaaaaggtagacagatctgggtttgaagcccagggaagacatgccagctcctggggatctcccagctgccatcagaatgactcatctagaaaagcatgaagg

SEQ ID NO: 26704 - DNA, 601 bp, Human
catctcgtgtcagtaccgtgagcctgtgaaacttccttaaagtttgttagactagctaaccgcctccccccaccaaaaaaaacctaatccaaattcagagtttcgataactaaaactagcttgatatattacctagctaacttggggcatttgtatttctacgagaagtttctaggaatagcaccctgttttggcatctcaggctgaagaggtatttgtgggccagtatctccctgagcaaacctcagatcacacaatgttggcctcttggggagaaggatccagggagctgtgtttctckctgccttaattcttgtgctgagtcatcctaccacagcagaggctgttgggagggaagagctttgcaaacttcaagtgcagaaaccatttaaacaaggagggaatactctccctcagtaacactacccactggtagttacccaccctcctatttatatcttccatccactcattcatttattccatagacttaatagtgtggtgtaggagaaacagcacagacaaaaggtagacagatctgggtttgaagcccagggaagacatgccagctcctggggatctcccagctgccatcagaatg

SEQ ID NO: 26705 - DNA, 601 bp, Human
aaagtggctgaggttaagtcatatgagtaggatatttaacccccaaatatcccttgactattcccctcctggaatctgcctttccagactccaagcagtctaacttccccacaaaactcatctcgtgtcagtaccgtgagcctgtgaaacttccttaaagtttgttagactagctaaccgcctccccccaccaaaaaaaacctaatccaaattcagagtttcgataactaaaactagcttgatatattacctagctaacttggggcatttgtatttctacgagaagtttctaggaatagcrccctgttttggcatctcaggctgaagaggtatttgtgggccagtatctccctgagcaaacctcagatcacacaatgttggcctcttggggagaaggatccagggagctgtgtttctctctgccttaattcttgtgctgagtcatcctaccacagcagaggctgttgggagggaagagctttgcaaacttcaagtgcagaaaccatttaaacaaggagggaatactctccctcagtaacactacccactggtagttacccaccctcctatttatatcttccatccactcattcatttattc

SEQ ID NO: 26706 - DNA, 601 bp, Human
aggaactatgcaccgtgaactagtcattctgaattgacattgagatgtctggaaaagactgctagggccttggaccttccagaaacctgtggtgtattgtaataacaatttaatttattataataatttactgagtccccacaattgggctaagcactttatatgcactgcctcatatcatccatacagcaatccagttctttcttagtgttagaatcctcttttttcaaatgacaaaaccaaagtggctgaggttaagtcatatgagtaggatatttaacccccaaatatcccttgactrttcccctcctggaatctgcctttccagactccaagcagtctaacttccccacaaaactcatctcgtgtcagtaccgtgagcctgtgaaacttccttaaagtttgttagactagctaaccgcctccccccaccaaaaaaaacctaatccaaattcagagtttcgataactaaaactagcttgatatattacctagctaacttggggcatttgtatttctacgagaagtttctaggaatagcaccctgttttggcatctcaggctgaagaggtatttgtgggccagtatctccctgagcaaa

SEQ ID NO: 26707 - DNA, 601 bp, Human
ataaagtgctaaaggagatgtgaagagatgtgtttcctcatttgctccatgattttcacatttatgcaggcttgcccacacaaccaactctgtacagaaggaactatgcaccgtgaactagtcattctgaattgacattgagatgtctggaaaagactgctagggccttggaccttccagaaacctgtggtgtattgtaataacaatttaatttattataataatttactgagtccccacaattgggctaagcactttatatgcactgcctcatatcatccatacagcaatccagttcttycttagtgttagaatcctcttttttcaaatgacaaaaccaaagtggctgaggttaagtcatatgagtaggatatttaacccccaaatatcccttgactattcccctcctggaatctgcctttccagactccaagcagtctaacttccccacaaaactcatctcgtgtcagtaccgtgagcctgtgaaacttccttaaagtttgttagactagctaaccgcctccccccaccaaaaaaaacctaatccaaattcagagtttcgataactaaaactagcttgatatattacctagctaacttg

SEQ ID NO: 26708 - DNA, 601 bp, Human
tatagaaataccttattacaagacagaaagtgagccatgatatcagagcgataaagtgctaaaggagatgtgaagagatgtgtttcctcatttgctccatgattttcacatttatgcaggcttgcccacacaaccaactctgtacagaaggaactatgcaccgtgaactagtcattctgaattgacattgagatgtctggaaaagactgctagggccttggaccttccagaaacctgtggtgtattgtaataacaatttaatttattataataatttactgagtccccacaattgggctargcactttatatgcactgcctcatatcatccatacagcaatccagttctttcttagtgttagaatcctcttttttcaaatgacaaaaccaaagtggctgaggttaagtcatatgagtaggatatttaacccccaaatatcccttgactattcccctcctggaatctgcctttccagactccaagcagtctaacttccccacaaaactcatctcgtgtcagtaccgtgagcctgtgaaacttccttaaagtttgttagactagctaaccgcctccccccaccaaaaaaaacctaatccaaat

SEQ ID NO: 26709 - DNA, 601 bp, Human
agaaaataaaggcctacccaggcccccactcctgtgtaacttcagcagataccactcatgcaccatgcactgcagatgctgtcccctgatgttgcactgcctaacctgcccattgccatttggctggtaatccagaaagccagaattcagactccagagcccagcctcttaatcacagtgcctcacttagaggtagtccttggtgggcaattagacagtcttatttttaacatttctaatattattaataagataaccctgggaaactaagccagaaattttttcattttattcttcatgrtcagtcacaaggcagaaatctgtttagactggctaaaaagttaatacatggctagaaacctccctttgtcacgtccacacccactggattgaaaaccaaatagctctttcattgataaatggttatcactgaccatattcaatagagaattccttcttattcatttaaatcaaaggaatgtactttttttttttttcttagagatggggtcttgctctgttgcccatgctggatggcaggggtggaattacagctcactacaacctggaaccccctcggctcaagtgatcttcccacctg

SEQ ID NO: 26710 - DNA, 601 bp, Human
taagcaccgactacgccagcactgtgctgtgtgctttacagaccttaactcaattaatcctgccatcaaggtacgagtttttctattttataaatgagaaaataaaggcctacccaggcccccactcctgtgtaacttcagcagataccactcatgcaccatgcactgcagatgctgtcccctgatgttgcactgcctaacctgcccattgccatttggctggtaatccagaaagccagaattcagactccagagcccagcctcttaatcacagtgcctcacttagaggtagtccttggtrggcaattagacagtcttatttttaacatttctaatattattaataagataaccctgggaaactaagccagaaattttttcattttattcttcatggtcagtcacaaggcagaaatctgtttagactggctaaaaagttaatacatggctagaaacctccctttgtcacgtccacacccactggattgaaaaccaaatagctctttcattgataaatggttatcactgaccatattcaatagagaattccttcttattcatttaaatcaaaggaatgtactttttttttttttcttagaga

SEQ ID NO: 26711 - DNA, 601 bp, Human
agctaactggattaagcaccgactacgccagcactgtgctgtgtgctttacagaccttaactcaattaatcctgccatcaaggtacgagtttttctattttataaatgagaaaataaaggcctacccaggcccccactcctgtgtaacttcagcagataccactcatgcaccatgcactgcagatgctgtcccctgatgttgcactgcctaacctgcccattgccatttggctggtaatccagaaagccagaattcagactccagagcccagcctcttaatcacagtgcctcacttagagrtagtccttggtgggcaattagacagtcttatttttaacatttctaatattattaataagataaccctgggaaactaagccagaaattttttcattttattcttcatggtcagtcacaaggcagaaatctgtttagactggctaaaaagttaatacatggctagaaacctccctttgtcacgtccacacccactggattgaaaaccaaatagctctttcattgataaatggttatcactgaccatattcaatagagaattccttcttattcatttaaatcaaaggaatgtacttttttttt

SEQ ID NO: 26712 - DNA, 601 bp, Human
ccactatcaataattgcagtagctaactggattaagcaccgactacgccagcactgtgctgtgtgctttacagaccttaactcaattaatcctgccatcaaggtacgagtttttctattttataaatgagaaaataaaggcctacccaggcccccactcctgtgtaacttcagcagataccactcatgcaccatgcactgcagatgctgtcccctgatgttgcactgcctaacctgcccattgccatttggctggtaatccagaaagccagaattcagactccagagcccagcctcttaaycacagtgcctcacttagaggtagtccttggtgggcaattagacagtcttatttttaacatttctaatattattaataagataaccctgggaaactaagccagaaattttttcattttattcttcatggtcagtcacaaggcagaaatctgtttagactggctaaaaagttaatacatggctagaaacctccctttgtcacgtccacacccactggattgaaaaccaaatagctctttcattgataaatggttatcactgaccatattcaatagagaattccttcttattcatttaaatca

SEQ ID NO: 26713 - DNA, 601 bp, Human
tacattaagtagaatacacgttttgcaaaagaccatgttttatagaaaaaaatataaaggccaggatacttcattaatctcagtatttctttcaatccaattaactaaactgtaacagagattcagtatttctctaaataatattttagatgaatggactactccttcagcatcactcttatagtttccttttgccactatcaataattgcagtagctaactggattaagcaccgactacgccagcactgtgctgtgtgctttacagaccttaactcaattaatcctgccatcaaggtacragtttttctattttataaatgagaaaataaaggcctacccaggcccccactcctgtgtaacttcagcagataccactcatgcaccatgcactgcagatgctgtcccctgatgttgcactgcctaacctgcccattgccatttggctggtaatccagaaagccagaattcagactccagagcccagcctcttaatcacagtgcctcacttagaggtagtccttggtgggcaattagacagtcttatttttaacatttctaatattattaataagataaccctgggaaactaagccagaaat

SEQ ID NO: 26714 - DNA, 601 bp, Human
gtcaataacttcatatccagaaaacccaggttactttcttacaaaagcacaagtacttcttcatttctacattaagtagaatacacgttttgcaaaagaccatgttttatagaaaaaaatataaaggccaggatacttcattaatctcagtatttctttcaatccaattaactaaactgtaacagagattcagtatttctctaaataatattttagatgaatggactactccttcagcatcactcttatagtttccttttgccactatcaataattgcagtagctaactggattaagcacygactacgccagcactgtgctgtgtgctttacagaccttaactcaattaatcctgccatcaaggtacgagtttttctattttataaatgagaaaataaaggcctacccaggcccccactcctgtgtaacttcagcagataccactcatgcaccatgcactgcagatgctgtcccctgatgttgcactgcctaacctgcccattgccatttggctggtaatccagaaagccagaattcagactccagagcccagcctcttaatcacagtgcctcacttagaggtagtccttggtgggcaatt

SEQ ID NO: 26715 - DNA, 601 bp, Human
aataccaaatcctgggccgggtgcagcggctcatgtctataatcccaacactttgggaggccgaggtgggcagatcacctgaggtcgggagttcaaggccagcctggccaacatggtgaaaccctgtccctactaaaaatacaaaaattagccgggcatggtggtgggtgcctgtaatcctagctacttaggaggctgaggcaggagaatcgcttgaacccaggaggcggagattgcagtgagccgagatcacaccactgcactccagcctgggtgacagagtgaaactctgtctcaaaamaaaaacaagaaaacaccaaattctgttatcataaaagcttgcgctttatcaccttcagatatattacacattaaatgagagcgtgcttttcttagaaactatatgctactagaaaaaaatcagattttaaaaaggaaagttatcttcaatatgctggtataacttacaacaacagcatatccttggagaaacacttactgtagattaagagattacaaatgcaatagatacattagctgtatttctgtcttaatgataacaatattacatctcctaaaattatatacagagtaatatttc

SEQ ID NO: 26716 - DNA, 601 bp, Human
caataacagccttagaaacttgggcttcctctttaatgtgctaagttaatgtgaggatatcccaagagaatcagggtgccaggactcatagaactgagggctagatggactgagaaggtcatctgatctggcctcgttcataatacagcatccctgccaagtagtagttctgctcatatccagaagctctgtcagttctgatggacccagtgagcattctgcatggcaccagcaggaaacggtatatccaatcattactatgggtgtcctactacagcactagtaacttaacaatctccaygtatttttagcttatgactaagggtctctcattcccaggatttataaaggttttaggtgtcaaaattaaccttagacattgttcatctcaacatttacatgtgagtatcattatgacatgttactgttctaacagactgaagccactactgaaatccatactgctataccccatcaaaatgagaacagccctaatcagactgtggatgcactgctacacgaggtttctagctccacatcttggtttatttgttgaagaacattaatgcttttcaaagctgctgacagtgccacattaggc

SEQ ID NO: 26717 - DNA, 601 bp, Human
tgctattatagctggtttgtatttctgcctttctgaacgcacaataaatgccacagggattgaagccaggccagttctttgtattcctaccactgcataaactgggcactcaataatgctcatggaatcaaacattgaaatcatgacaacactgagaaattaatcagctttggctgtccattcctctacagtccacagtcctagagttttggctgacacatggctacccaagataaagaatgtttcccagctaggtgtggcaatgggaccaaattctaatcaaaggattctgtgtacaaakggggtgtgccatttttagatctcatccctaaaaggattccccatgggcatccttgacccccttctttctgcttccaggaagagagagactgctagagctggagcaaccagaggaaccactgcaggaatacccccagccccgggtcacccacctttcacctctgggttattacatgagactgaaataaatttctctctagtttaagtcactgtaacttttgggtccctttttacagcaggtcagactgtgcattcactaataccaaaccttaagacattaaaaaaaaaataaggaacaata

SEQ ID NO: 26718 - DNA, 601 bp, Human
gtatatatagagagagagagtctaagaaaaaaattacaataaactcttagaaaaatctaagattacttacttatggcaggtggggacaaaatataaaatttaatttccctcaaggtcaaaataatcacattaaacatgtatcagatgagaaagagaccaatgtattctaacttttgaaaagaagtgattgatcaattcgcatttactgagtgaccactaagaaaggactgtgttactaccaagtaataaggtgtgcttccatttatggctggtgaaattagtctcattacacgatagttaygacttatctacttctcactcaacacttgactcccacctacccactgcatgtcacacacatagagggaatacttacccatatttatctcttgctctccaccaatgaacatcattcttttctaaaatgagatactcttggcctctctctaatctgagatcatgtccttctgctgcttggaaatcatacatggctacaacgatttcttcactattatcttcttcttctagtggaattggtgggggaggccttcgctagacaaggaagataacatttgaaagtttagtcttctatatgaaactg

SEQ ID NO: 26719 - DNA, 601 bp, Human
gaaattggggctggggctgggaggtgagagggcaggtggaagaagagtgtgctctggcaggacaaaaagttctcctcttctcatccactggaactcagagtataagtgggattgcactgcagaggtaaacacaggatacagagtttgcttatgaagcctgcaagatactcatcccctacagttacccctatctgcccatatatttatcaatgatagggttgaaaggactgttttctttaaatcctaaattaacttgtacaaaaaaaagcttgctgtttaatttcctgcatgtacatatatrtattttatatatacatacacaaacacatatacacacatatagacacacacatatacatatatatatattctcttattcctccatatattcatggagagagagaaagaagtgagaagaggcttcattatactgtgtatgtgtatgcatacacacacgcacatacacatacgtatatatagagagagagagtctaagaaaaaaattacaataaactcttagaaaaatctaagattacttacttatggcaggtggggacaaaatataaaatttaatttccctcaaggtcaaaataatcacatt

SEQ ID NO: 26720 - DNA, 601 bp, Human
gaggctgaaggtgtggccatgatgcggggtagcttttgcaagccacgcagtaagagtgtgggtgtacaggttggaagatccatatggtacatgagagatagagccagggcaggagggaagaaagaagagaggtagcccccccagagccagctttccatgcactgcaacattctggcacagagctctaaatccaaaccgtgcctttcttgtcactatgaaagggtatttgtcaagttggaggataaagtttgctagcttgatttataactcctaaatacttagatatatgttatgtggattytcatttgtactcttcctccaggtacaaaaatattaagggaaagtctacagacgatcttatttaaaatactgttattaagaatgataatgacatggtggtgttttttttaagtctttagaatttagatttaggagtgaaataacatgatgacttgaatttacttttaaatattctagaaaaaaatggaaggattagactggcaaaatgttggtaatttttgaagtcaagcaaaaagagattctattatactattatatactttttggatgcttgaaaatttctacaacaaaaaaaaattaa

SEQ ID NO: 26721 - DNA, 601 bp, Human
tggctcattttagtgttaaatgacctgctttcatcaataaatcaaaaatgtagaataagagaaacataagagatatattaaccaaaatgcagtgtgtgggtcctgatttgaataaaccaacagtaaaaataagtattagagctaatcggggaaactggaattacataattggttccatccttagacctgggccagagaagctcttgctctaaccccacacttttgagagctctgcaaaagtgcgtgttccctctgacctgtgttcccatgctcctttctgggtaactaggaccccagaacwccctgctcatttccaaggtctacatgggccttctactgggtccatcttctaaaaaacaaattgtgctggctggccatgtgcattccctttcactgaggctgaaggtgtggccatgatgcggggtagcttttgcaagccacgcagtaagagtgtgggtgtacaggttggaagatccatatggtacatgagagatagagccagggcaggagggaagaaagaagagaggtagcccccccagagccagctttccatgcactgcaacattctggcacagagctctaaatccaaaccgtgcctttc

SEQ ID NO: 26722 - DNA, 601 bp, Human
atcaagcctctagctctactcgccagttcacaagaaatacaagaaacacaggcatattaagtgacaccacaagaaaacaatctgtttcatctagattatggctcattttagtgttaaatgacctgctttcatcaataaatcaaaaatgtagaataagagaaacataagagatatattaaccaaaatgcagtgtgtgggtcctgatttgaataaaccaacagtaaaaataagtattagagctaatcggggaaactggaattacataattggttccatccttagacctgggccagagaagctsttgctctaaccccacacttttgagagctctgcaaaagtgcgtgttccctctgacctgtgttcccatgctcctttctgggtaactaggaccccagaactccctgctcatttccaaggtctacatgggccttctactgggtccatcttctaaaaaacaaattgtgctggctggccatgtgcattccctttcactgaggctgaaggtgtggccatgatgcggggtagcttttgcaagccacgcagtaagagtgtgggtgtacaggttggaagatccatatggtacatgagagatagagccagg

SEQ ID NO: 26723 - DNA, 601 bp, Human
cccccaaaatgcagtatctgtaattcacttgacattttacaaagtactttcacttttggtctccataaaaattctgcggtaggcaggcattattgtacctattttctggtggggaaactaaagcttagaaaggttataggattttttttcccaaaggtcctaaagttagccagcaacagggccagaactcaaactctggacttgtgactagctcctgtgctcctccaacattccacaatacttctccagaattcacagttttgctgatatgtgttaaagaaaccattacttgagaaaagtyaaagtgttggattaaaaatacccaccactctaatacctcaatagttcttatagaatagtttcacaaaggataattcctggcctttcggtcagtatcatttggggcacctgttaaaacagcaaattcttgggtcataacccaataaatgtgaactgagaagacctatgtgaggtcaaaaaatgtccgattttaccccaaatgactttcacacacatcacaatttaagatgcactcttatgtaagtaggagctaaggttttcagcataagaaaacagatatacatataaaatttaaaaattg

SEQ ID NO: 26724 - DNA, 601 bp, Human
tttctttcccgttacgtaattacttgggatatatccttcattcctagaaataagaaaaatactttaggtaaacttactttactgggaggttattgaaagaaagaaagattattgccttttgaaataaagcatgacattgcttaaagcttataagaaagactagctgaccccccaaaatgcagtatctgtaattcacttgacattttacaaagtactttcacttttggtctccataaaaattctgcggtaggcaggcattattgtacctattttctggtggggaaactaaagcttagaaagsttataggattttttttcccaaaggtcctaaagttagccagcaacagggccagaactcaaactctggacttgtgactagctcctgtgctcctccaacattccacaatacttctccagaattcacagttttgctgatatgtgttaaagaaaccattacttgagaaaagtcaaagtgttggattaaaaatacccaccactctaatacctcaatagttcttatagaatagtttcacaaaggataattcctggcctttcggtcagtatcatttggggcacctgttaaaacagcaaattcttgggt

SEQ ID NO: 26725 - DNA, 601 bp, Human
agttaaggatattttagcacccccttcaaagaatcatgaaagatatccattaatcttcaaaatgccttacataattaggaaaatgaaaagtttctgattttccacattcacaaaataaacatttacttactcatattgatctaagttgtttgatttctttcccgttacgtaattacttgggatatatccttcattcctagaaataagaaaaatactttaggtaaacttactttactgggaggttattgaaagaaagaaagattattgccttttgaaataaagcatgacattgcttaaagcatataagaaagactagctgaccccccaaaatgcagtatctgtaattcacttgacattttacaaagtactttcacttttggtctccataaaaattctgcggtaggcaggcattattgtacctattttctggtggggaaactaaagcttagaaaggttataggattttttttcccaaaggtcctaaagttagccagcaacagggccagaactcaaactctggacttgtgactagctcctgtgctcctccaacattccacaatacttctccagaattcacagttttgctgatatgtgttaaaga

SEQ ID NO: 26726 - DNA, 601 bp, Human
aggaaaaatatattatagagattaattctcagtcttttaccacatcaggcaattgagttaaggatattttagcacccccttcaaagaatcatgaaagatatccattaatcttcaaaatgccttacataattaggaaaatgaaaagtttctgattttccacattcacaaaataaacatttacttactcatattgatctaagttgtttgatttctttcccgttacgtaattacttgggatatatccttcattcctagaaataagaaaaatactttaggtaaacttactttactgggaggttaytgaaagaaagaaagattattgccttttgaaataaagcatgacattgcttaaagcttataagaaagactagctgaccccccaaaatgcagtatctgtaattcacttgacattttacaaagtactttcacttttggtctccataaaaattctgcggtaggcaggcattattgtacctattttctggtggggaaactaaagcttagaaaggttataggattttttttcccaaaggtcctaaagttagccagcaacagggccagaactcaaactctggacttgtgactagctcctgtgctcctc

SEQ ID NO: 26727 - DNA, 601 bp, Human
attcaatcagttctccacgctatcgctttaaaaccaggcccaggttttcaccttttagcaccttccctaattctaaggattttataatttttccaaaaatctatttgacttaagggcagaaatgctactttatttatacattgtttatactctcttctacttctaaaattactttgagagatcacatccactgagcgctgtggctttttgaacttgttaaccctttcctagatgttaaggtacacttatggtatagcaagtgacatgaagagaggaacagcttgttgttgctattgttttyaaggaagtgaatgaagcatcaatacaccacctcagaatgaccataaaagagcgttcaatgtatatgagcctcacgttacaacttggccacacactgctagtgggtatataaataatacaagttatctggaaagcaatttgacagcatgcgttgggaaccctaacaatgttcacgtacagcctgtagcccagcacatagattttagagatccagtttaagataagaaacaagacgttatcccattttttttttaatatagcaaaggtacctaaaacaacctaaaccacacaaataaggaaa

SEQ ID NO: 26728 - DNA, 601 bp, Human
gagtgatgtaaccttgaagtgaaaccgcaatgatgaccagtgctcgatccccacttatcaaggtgttctgcagcaaggtgtttaaacaatgctttcataaagatgtttatctaacctcaccagtggtcatgtgtgttggtaagaaaggctgaagacatgtccagctgcacatgtttcaccctaaaagtttgctatataaagaataatgtccagagggcaggtgtggggataactgtcctgaggccacccatgattacttctgtttgtaagtccctattaaatatttatttctagaaactgratttgtcagcctctttcttcagcctctcagctccctcagcctctgggaatagttttgcatagacttgctcactgctgaacacatttagaaagagagatatgtggaactacttattatggactcattaaaattaatttgcccttaagccaaacccacaagtacaaacacttacttcactgcggaggagttgctctgccttgcttctattcatatttctgcaataccatctgaacagaaaaaacaatacatttcaggcctcaggtttttaggatatattttattcttttcagaattaataaa

SEQ ID NO: 26729 - DNA, 601 bp, Human
ccccaggggcttctctaagaattaagaatgaggtaaaccatctatgctcaggttttcatgggacttgataaagcaacttttactttcaggatgaaaaataaattgctacagggtatgctgtgctaacaaaagggaaaatgaaaactatctgaaagctggcagtgacaactccttatgaaagctgtaaggtttgctcctgtgtgcctgtatgcctatatgtctatatgtgttatgtgtgtgtgacatttctatgtgatctaagaaaacttttggtaaatgaaactagtttttaaattgttgrtaaaataaaatagaaacatcttcagaatttaattcagacattttgcctagacctactggtcagacaggtttaggttgtctctgattaaggtcataaaactgctgcttctgtgaccttcttgacacttgcttgacttgcatgtgagcttaattaaaattaatcacttcctagattttttactggaaattagtactactaagaattacaatagtagttagtgtatgtaattaaaactaccacatgtaagagaaacaattctatatacacagtgtataaagaaaggaagatgagtttttggtg

SEQ ID NO: 26730 - DNA, 601 bp, Human
atttaacaacagttggaagtcttaaaatagctattagcagctactgctttttgttcctgctgttgcataaacttacaaatgtctagaacacttaaatcaccaatagtgaataaattagacttttaaatattcaacttgagggacctttctagagcacagatcttctctagtcctctcttgctaaaaatactttcaagatgactcctgttgctcttagggtaaagctcagagtcactgacattgacatgaacttgcctctgcttcaactctgaggcttctctctcctcccttcactctgtgytcccattctacctgcagctacaacatacttttcagtgccttgaactcaccatatactctctcccgtctaggtccaggcaatttcctgggtcagaaacactccgtctcctccctccaagtttttcctgctcgcctatcaggtctcagcctggatatcacttgggagagcgttcatgactaactcaagatgtgcctgggctgtgtatgtaccatcccccatccccaaacccgccacacacacacattaccctcccacatggcacttactaccatcactctctgttactgggctgcagcatct

SEQ ID NO: 26731 - DNA, 601 bp, Human
ccacatgcacgtgtctttataatagaatgatttatattcctttgggtatatacccaagtaatgggattgctggcttgaatggtgtttctgtctttaggtctttgaggaatcatcacactgtcttccacaatggcggaactaatttacactgccaccaacagtgtataaatgtaatgtgaacatttactatataccactggaataactcatgtcctaaggtcaagacagagctttttataaaacttgatattatttctaaattttctttgtatatatcattcctttaatatgcagtaatttwaaatcaaccacattctacaatgaactaactataaaataaaactgctcaaggaattaatcacagtatctgatcattttaatcactaccttatatttgaagtaggttttcacagctcacttacctgctgcattgtgcttatgatattcaataatctcaggaatggagccaaaagcatgtttttcagctaggtaatacttctttggagatgttgttgtttcctttatatgataatgcctaaaacccgatgaaccttctctagaacaaaaatcaaaatgtgtcagaaccaagttgaaataatag

SEQ ID NO: 26732 - DNA, 601 bp, Human
catttaggttaattccatgtctttgctattatgaatagtgctgcaatgaacacccacatgcacgtgtctttataatagaatgatttatattcctttgggtatatacccaagtaatgggattgctggcttgaatggtgtttctgtctttaggtctttgaggaatcatcacactgtcttccacaatggcggaactaatttacactgccaccaacagtgtataaatgtaatgtgaacatttactatataccactggaataactcatgtcctaaggtcaagacagagctttttataaaacttgayattatttctaaattttctttgtatatatcattcctttaatatgcagtaattttaaatcaaccacattctacaatgaactaactataaaataaaactgctcaaggaattaatcacagtatctgatcattttaatcactaccttatatttgaagtaggttttcacagctcacttacctgctgcattgtgcttatgatattcaataatctcaggaatggagccaaaagcatgtttttcagctaggtaatacttctttggagatgttgttgtttcctttatatgataatgcctaaaacccgatg

SEQ ID NO: 26733 - DNA, 601 bp, Human
ggatcagtcaacttttatgtaaagggccagataacacatatttcagatctggcaggccatacagtccccgtgacaactacttgactctgcatctgtagcaggaaagcagtcacaggtaacacctaaatgaatgagcgaggctgtgtctcaatcacgctatttttatggacagcaacattggaatttcagatttttttttacatgtcataatattcttttcatttttttcatccatttaaaaatgtgaaacccaaatgaggtttgggtcagactgacagccacagtttaccagtatcgaccrtgctcgatcatgtaactttatcaggtcttctgattcaccctcttcctcaatgtaagctgcatgcgggcaaggacttgtaggtcttattctctatatggttcagcttatcattatgcctggcacagagcaggcacctgattttttatgggtggatgtatggatgaatgaatggatagacggagggagaagagagaaaaaataaactaaatacctttaaaaggtattttataatactattaaattataaaaattaagagaagaaaaacactgcagacatggacatactaagaacctcaccac

SEQ ID NO: 26734 - DNA, 601 bp, Human
tgaaagcctaacatatgaagattgaacagatgaaagcggcagacagcctgtcaaatatatagtatctgtatataaaagcaaataaagagcattgggtaattaatatcctaagagttggaagttctggtcccatttctgacagtaacagttttctaatctccctgggcctgagtttccttaggagttaaacttggccctacatggcctggtctttgcctgcatttatgagcattcctggcgctgcccgttggccagctaccctggcgctttttccgttccttgagcaggccagacgtgtccyagacttcaagctttttcactttttcttcctacctgaaatagtttatccttttattttcacctacactggctacttcctaccttttcgtctccagtcaaatctgcctatcacaaagaggtcatcctgaacatcagatcaagtagccaccctcactcttgccctgcatcatcattcagcaccaccccaaattatctctattacagggatcagtcaacttttatgtaaagggccagataacacatatttcagatctggcaggccatacagtccccgtgacaactacttgactctgcatctgta

SEQ ID NO: 26735 - DNA, 601 bp, Human
ttttgagtggttgatacaaaagtgcagattttctgaaagcctaacatatgaagattgaacagatgaaagcggcagacagcctgtcaaatatatagtatctgtatataaaagcaaataaagagcattgggtaattaatatcctaagagttggaagttctggtcccatttctgacagtaacagttttctaatctccctgggcctgagtttccttaggagttaaacttggccctacatggcctggtctttgcctgcatttatgagcattcctggcgctgcccgttggccagctaccctggcgctttttccgttccttgagcaggccagacgtgtcccagacttcaagctttttcactttttcttcctacctgaaatagtttatccttttattttcacctacactggctacttcctaccttttcgtctccagtcaaatctgcctatcacaaagaggtcatcctgaacatcagatcaagtagccaccctcactcttgccctgcatcatcattcagcaccaccccaaattatctctattacagggatcagtcaacttttatgtaaagggccagataacacatatttcagatctggcaggccatacag

SEQ ID NO: 26736 - DNA, 601 bp, Human
tcacattcaactagttcatctattgtgcgcagcagatcttcgaaagaaggccttccctctggtttctacaattaaaagtcaaagagaagctgtgggttccagaatccattccaaaaaacctctcactgctccaactcctaaacacagcatattacagagagacttcactgctttgggactaggacatacaggcatctccaaaggggtcttgtctctaccctaatttaccctgcatgtactgctgctaggctaacgtttctaagacactgctttcatgtctctcttcaagaccctgatagayctttttactgcctgtgaaatcaagtcctgcaaatttgtaggagcctctataatctgccacttcccgaccctcttgttacccaatcttgttccccacaaaatccctcacatgggctgtctgttaaatagggccactgtctccactgttgtgcacactgtgtttataaccacctccttacctttgctcaagctgttctctctccctttagcaccacttcctgcccagaatgtctctgcccatcccaatcaatgctcttgggaggcagtacagcaagtggttgagactctgggctttggaatc

SEQ ID NO: 26737 - DNA, 601 bp, Human
ttgtgcttgggaatctgggagccactggtcacacatcacttatcttccaaaagtttcttcacattcaactagttcatctattgtgcgcagcagatcttcgaaagaaggccttccctctggtttctacaattaaaagtcaaagagaagctgtgggttccagaatccattccaaaaaacctctcactgctccaactcctaaacacagcatattacagagagacttcactgctttgggactaggacatacaggcatctccaaaggggtcttgtctctaccctaatttaccctgcatgtactgctgctaggctaacgtttctaagacactgctttcatgtctctcttcaagaccctgatagatctttttactgcctgtgaaatcaagtcctgcaaatttgtaggagcctctataatctgccacttcccgaccctcttgttacccaatcttgttccccacaaaatccctcacatgggctgtctgttaaatagggccactgtctccactgttgtgcacactgtgtttataaccacctccttacctttgctcaagctgttctctctccctttagcaccacttcctgcccagaatgtctctgcccatcc

SEQ ID NO: 26738 - DNA, 601 bp, Human
attctgtctagaagcaagtctagacagaggctggtctagaagcaaattatgtgtttccactgtataagtaaaatgatctacatgtccaagtgctcaataaattaaaagccacaaaatgcccatccttccttgtgcttgggaatctgggagccactggtcacacatcacttatcttccaaaagtttcttcacattcaactagttcatctattgtgcgcagcagatcttcgaaagaaggccttccctctggtttctacaattaaaagtcaaagagaagctgtgggttccagaatccattccamaaaacctctcactgctccaactcctaaacacagcatattacagagagacttcactgctttgggactaggacatacaggcatctccaaaggggtcttgtctctaccctaatttaccctgcatgtactgctgctaggctaacgtttctaagacactgctttcatgtctctcttcaagaccctgatagatctttttactgcctgtgaaatcaagtcctgcaaatttgtaggagcctctataatctgccacttcccgaccctcttgttacccaatcttgttccccacaaaatccctcacatggg

SEQ ID NO: 26739 - DNA, 601 bp, Human
cccagatttctgtagaagtcaaagggaaaaagaagggttgcttggtcatgactctaatacccttccccttcccaaataccctggccttcaactggcatcagctaacatggtcccatgtgtgcacccctgaatggccaaaccctggggctacacacagtgcctggtaaacaactgtcactcaagtgcctgaggaatgaatagaaatgagtgattttaatcaccatttctaaggcaacatttccacactctgggagattctgtctagaagcaagtctagacagaggctggtctagaagcaaattatgtgtttccactgtataagtaaaatgatctacatgtccaagtgctcaataaattaaaagccacaaaatgcccatccttccttgtgcttgggaatctgggagccactggtcacacatcacttatcttccaaaagtttcttcacattcaactagttcatctattgtgcgcagcagatcttcgaaagaaggccttccctctggtttctacaattaaaagtcaaagagaagctgtgggttccagaatccattccaaaaaacctctcactgctccaactcctaaacacagcatattacagaga

SEQ ID NO: 26740 - DNA, 601 bp, Human
gtcagagtgaaggcgctgcccagagcagccagcctgtgtgttcacccaatgctccagagcagaccatcgtggcctgcagaggagacgcaactcctgaagggaaggcgctgtgtcttcctcggctagttaccccaccaacagcaagaataacgtgttgggcaataaacggtctctggatgactgatacagtttcttttcgctggcgctcacgtgaccgagatagtttcttttccttggcgctcacaaggcaaaaaggaaggccctaattccgttgatgtcttagtagagcttctaagggtgrgaaatccacacacacagtcttgacagcagggtctcctgagaggctgtacaacaatcccaccatccaggaacccaagtccaaccaggcctcctgaaaaacgtccgggaggcacggaacaccatgctggctgcttctctccgtagcttcctggatcctccgccacagctcaggctgcttccgggtcctatgtgaggtgggggcaaactttgttgcgaaggtcacctgatccttctgccccagagctcagcacttccaattatagtgtctgtgtcccagggaatattcttaaggcttagaagc

SEQ ID NO: 26741 - DNA, 601 bp, Human
tgcaggccctgcctgcccggccacccacacgtcctaggagggttggaggatgccacctctggcctcttctggaacggagtctgattttggccccgcagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggccygcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccct

SEQ ID NO: 26742 - DNA, 601 bp, Human
ccagggccgaggctgcgcgaattaccgtgcacacttgatgtgaaatgaggtcgtcgtctatcgtggaaacccagcaagggctcacgggagagttttccattacaaggtcgtaccatgaaaatggtttttaacccgagtgcttgcgccttcatgctctggcagggagggcagagccacagctgcatgttaccgcctttgcaccagctccagaggcttgggaccaggctgtctcagttccagggtgcgtccggctcagaccgccctcctctctgccttctctctctgcctcaaatcttccctygtttgcatctccctgacgcgtgcctgggccctcgtgcaagctgcttgactcctttccggaaacccttggggtgtgctggatacaggtgccactgaggactggaggtgtctgacactgtggttgaccccagggtccagctggcgtgcttggggcctccttgggccatgatgaggtcagaggagttttcccaggtgaaaactcctgggaaactcccagggccatgtgacctgccacctgctcctcccatattcagctcagtcttgtcctcatttccccaccagggtctctagctccgaggag

SEQ ID NO: 26743 - DNA, 601 bp, Human
ggcattgctttcactgcagagaaactcagcttgcctgagccacagtgaaaatggccattccctggagcgtttgtgcacgtgatttatttaaggcgccctgtgaggtcctgcacattcatcctctcactttgttctcctaaccacctgagaggtagaggaggaaaggctccaggggagcagccgcccttggtcacccagctggcaaagggcatgcatgattgcagcctggcctcctgctccggggcccttgctctgcccgaggaccccacacaagtcagacccataggctcagggtgagccrgagcccaaggtcgtgttggggatggctgtgaaagaagaaatggacgtctgatgcacacttgggaaggtcctaccagcagcgtcaaagaaatgcatgtgaaactgacagcgagacccatccctcaaagaaacgcacgtgaaactgatggcgagacctgtccccatccctcatgctggctccttttctgggcttgccaagagccagcatcaggttgaggcaagctggaaagacttttctggaaagcagcttgtttgcatggaagtcctcacaatgtcctgtgtcttcccagtaattccactt

SEQ ID NO: 26744 - DNA, 601 bp, Human
gctgagcagaaatgcatctttctgtgggagtgagggtgctcacaacgggagcagttttctgtgctattttggtaaaaggaaatggtgcaccagacctgggtgcactgaggtgtcttcagaaagcagtctggatccgaacccaagacgcccgggccctgctgggcgtgagtctctccaaacccgaaacacaggggccctgctgggcatgagtccctctgaacccgagaccctggggccctgctgggcgtgagtctctccgaacccagagacttcagggcccttttgggcgtgagtctctccrctgtgagccccacactccaaggctcatccacagtctacaggatgccatgagttcatgatcacgtgtgacccatcaggggacagggccatggtgtggggggggtctctacaaaattctggggtcttgtttccccagagcccgagagctcaaggccccgtctcaggctcagacacaaatgaattgaagatggacacagatgcagaaatctgtgctgtttcttttatgaataaaaagtatcaacattccaggcagggcaaggtggctcacacctataatcccagcactttgggaggccgaggt

SEQ ID NO: 26745 - DNA, 601 bp, Human
cgtccacctctgcttccgtgtggggcaggcgactgccaatcccaaagggtcagaggccacagggtgcccctcgtcccatctggggctgagcagaaatgcatctttctgtgggagtgagggtgctcacaacgggagcagttttctgtgctattttggtaaaaggaaatggtgcaccagacctgggtgcactgaggtgtcttcagaaagcagtctggatccgaacccaagacgcccgggccctgctgggcgtgagtctctccaaacccgaaacacaggggccctgctgggcatgagtccctcygaacccgagaccctggggccctgctgggcgtgagtctctccgaacccagagacttcagggcccttttgggcgtgagtctctccactgtgagccccacactccaaggctcatccacagtctacaggatgccatgagttcatgatcacgtgtgacccatcaggggacagggccatggtgtggggggggtctctacaaaattctggggtcttgtttccccagagcccgagagctcaaggccccgtctcaggctcagacacaaatgaattgaagatggacacagatgcagaaatctgtgctgtt

SEQ ID NO: 26746 - DNA, 601 bp, Human
gtctctgatgagtcggcagccatgtaacaggaaggggtggccacagggagctgggaatgcaccaggggagctgcgcagctggccgaggtcccagggccaggccacaggaagggcagggggacgcccggggccacagcagaggccgcaggaagggaaggggatgcccaggccagagcagaggctaccgggcacaggggggctccctgagctgggtgagcgaggctcatgactcggcgagggaacctccttgacgtgaagctgacgactggtgttgcccagctcacagcccagccaggtcccrcgcctgagcaggaactcagaaccctcccctttgtctaaagcacagcagatgccttcagggcatctaggagaaaacaggcaaagtcgttgagaaacgtcttaaaagaaggtgggatggtggcaatttcttgtccagattttagtctgccccggaccacagatgagtctataacgggattgtggtgttgccatggggacacatgagatggaccatcacagaggccactggggctgcacctcccatctgagtcctggctgtcccgggtccaggccaggttcttgcatgctcacctacctgtcc

SEQ ID NO: 26747 - DNA, 601 bp, Human
tcactcggggggagcccaggtcccaagcaactgagggctcaggagtcctgaggctgctgaggggacagagcagacggggaacgctgcttctgtgtggcaagttcctgagggtgctggccagggaggtggctcagagtgtatgttggggtcccaccgggggcagaactctgtctctgatgagtcggcagccatgtaacaggaaggggtggccacagggagctgggaatgcaccaggggagctgcgcagctggccgaggtcccagggccaggccacaggaagggcagggggacgcccggggcyacagcagaggccgcaggaagggaaggggatgcccaggccagagcagaggctaccgggcacaggggggctccctgagctgggtgagcgaggctcatgactcggcgagggaacctccttgacgtgaagctgacgactggtgttgcccagctcacagcccagccaggtcccgcgcctgagcaggaactcagaaccctcccctttgtctaaagcacagcagatgccttcagggcatctaggagaaaacaggcaaagtcgttgagaaacgtcttaaaagaaggtgggatggtggcaatttcttgt

SEQ ID NO: 26748 - DNA, 601 bp, Human
agggcctgcagggccgaggcggcagcctcctccccagggtgcacctgagcctgcggagagcaggagctgctgagtgagctggcccacagcgttcgctgcggtcacgttcctgcgtggggttgtttgggatcggtgggagaatttggatttgctgagtgctgctgtcttgaaccacggagatggctaggagtgggtttcagagttgatttttgtgaatcaaactaaaatcaggcacaggggacctggcctcagcacaggggattgtccaatgtggtccccctcaagggcgccccacagagcyggtgggcttgttttaaagtgcgatttgacgagggacgagaaaccttgaaagctgtaaagggaaccctcagaaaatgtggccgccaggggtggtttcaggtgctttgctgggctgtgtttgtgaaaacccatttggacccgccctccaagtccaccctccaggtccaccctccagggccgccctgggctgggggtatgcctggcgttccttgtgccgcagcccggagcacagcaggctgtgcacatttaaatccactaagattcactcggggggagcccaggtcccaagcaactgagggct

SEQ ID NO: 26749 - DNA, 601 bp, Human
agttgagccccccgtgtcctgcccctggcaccgcagcgttgtctctgccaagtcctctctctctgccggtgctggatccgcaagagcagaggcgcttggccgtgcacccaggcctgggggcgcaggggcaccttcgggagggagtgggtaccgtgcaggccctggtcctgcagagacgcacccaggttacacacgtggtgagtgcaggcggtgacccggctcctgctgctctttggaaagtcaagagtggcggctcctggggccccagtgagacccccaggagctgtgcacagggcctgcrgggccgaggcggcagcctcctccccagggtgcacctgagcctgcggagagcaggagctgctgagtgagctggcccacagcgttcgctgcggtcacgttcctgcgtggggttgtttgggatcggtgggagaatttggatttgctgagtgctgctgtcttgaaccacggagatggctaggagtgggtttcagagttgatttttgtgaatcaaactaaaatcaggcacaggggacctggcctcagcacaggggattgtccaatgtggtccccctcaagggcgccccacagagccggtgggctt

SEQ ID NO: 26750 - DNA, 601 bp, Human
cccaccaacagtgtaaaagtgttctggtgctggagaggatgtggacagcagttatttttttatgaaaatagtatcactgaacaagcagacagttagtgaaggatgcgtcaggaagcctgcaggccacacagccatttctctcgaagactccgggtttttcctgtgcatcttttgaaactctagctccaattatagcatgtacagtggatcaaggttcttcttcattaaggttcaagttctagattgaaataagtttatgtaacagaaacaaaaatttcttgtacacacaacttgctctggsatttggaggaaagtgtcctcgagctggcggcacactggtcagccctctgggacaggatacctctggcccatggtcatggggcgctgggcttgggcctgagggtcacacagtgcaccatgcccagcttcctgtggataggatctgggtctcggatcatgctgaggaccacagctgccatgctggtaaagggcaccacgtggctcagagggggcgaggttcccagccccagctttcttaccgtcttcagttatttttccctaagagtctgagaagtggggccgcgcctgatggccttcgttc

SEQ ID NO: 26751 - DNA, 601 bp, Human
aacatacgtgtgcatgtgtctttatagcagcatgatttataatcctttgggtatatacccagtaatgggatggctgggtcaaatggtatttctagttctagatccttgaggaatcaccacactgtcttccacaatggttgaactagtttacactcccaccaacagtgtaaaagtgttctggtgctggagaggatgtggacagcagttatttttttatgaaaatagtatcactgaacaagcagacagttagtgaaggatgcgtcaggaagcctgcaggccacacagccatttctctcgaagwctccgggtttttcctgtgcatcttttgaaactctagctccaattatagcatgtacagtggatcaaggttcttcttcattaaggttcaagttctagattgaaataagtttatgtaacagaaacaaaaatttcttgtacacacaacttgctctgggatttggaggaaagtgtcctcgagctggcggcacactggtcagccctctgggacaggatacctctggcccatggtcatggggcgctgggcttgggcctgagggtcacacagtgcaccatgcccagcttcctgtggataggatctggg

SEQ ID NO: 26752 - DNA, 601 bp, Human
acaaaggacatgaactcatccttttttatgactgcatagtattccgtggtgtatatgtgccacattttcttaatccagtctatcatcgatggacatttgggttggttgcaagtctttgctactgtgaatagtgccgcaataaacatacgtgtgcatgtgtctttatagcagcatgatttataatcctttgggtatatacccagtaatgggatggctgggtcaaatggtatttctagttctagatccttgaggaatcaccacactgtcttccacaatggttgaactagtttacactcccacyaacagtgtaaaagtgttctggtgctggagaggatgtggacagcagttatttttttatgaaaatagtatcactgaacaagcagacagttagtgaaggatgcgtcaggaagcctgcaggccacacagccatttctctcgaagactccgggtttttcctgtgcatcttttgaaactctagctccaattatagcatgtacagtggatcaaggttcttcttcattaaggttcaagttctagattgaaataagtttatgtaacagaaacaaaaatttcttgtacacacaacttgctctgggatttg

SEQ ID NO: 26753 - DNA, 601 bp, Human
gacgtcttcctacgcttcatgtgccaccacgccgtgcgcatcaggggcaagtgagtcaggtggccaggtgccattgccctgcgggtggctgggcgggctggcagggcttctgctcacctctctcctgccccttccccactgcccttctgcccggggccaccagagtctccttttctggcccccgccccctccggctcctgggctgcaggctcccgaggccccggaaacatggctcggcttgcggcagccggagcggagcaggtgccacacgaggcctggaaatggcaagcggggtgtggasttgctcctgcgtggaggacgaggggcggggggtgtgtctgggtcaggtgtgcgccgagcgtttgagcctgcagcttgtcagctccaagttactactgacgctggacacccggctctcacacgcttgtatctctctctcccgatacaaaaggattttatccgattctcattcctgtccctgtcgtgtgacccccgcgagggcgcgggctcttctctctgtgactagatttcccatctggaaagtgcggggttgaccgtgtagtttgctcctctcggggggcctgtggtggccatggggcag

SEQ ID NO: 26754 - DNA, 601 bp, Human
atgtttgagccgtgtcctgcccagctggcccctcagtgctgggtctgaggccaaaggaaacgtgtcccccttcttaggaggacgggccgtgtttgagccacgccccgctgagcgggcctctcagtgctgggtctgtccacgtggccctgtggccctttgcagatgtggtctgtccacgtggccctgtggctctttgcagatgcctgttagcacttgctcggctctaggggacagtcgtgtccaccgcatgaggctcagagacctctgggcgaatttccttggctcccagggtgggggtggrggtggcctgggctgctgggacccagaccctgtgcccggcagctgggcagcaactcctggatcacatatgccatccgggccacggtgggctgtgtgggtgtgagcccagctggacccacaggtggcccagaggagacgttctgtgtcacacactctgcctaagcccatgtgtgtctgcagagactcggcccggccagcccacgatggccctgcattccagcccagccccgcacttcatcacaaacactgaccccaaaagggacggagggtcttggccacgtggtcctgcctgtctcagcac

SEQ ID NO: 26755 - DNA, 601 bp, Human
gctttggtttaacttcctttttaaacagaagtgcgtttgagccccacatttggtatcagcttagatgaagggcccggaggaggggccacgggacacagccagggccatggcacggcgccaacccatttgtgcgcacggtgaggtggccgaggtgccggtgcctccagaaaagcagcgtgggggtgtagggggagctcctggggcagggacaggctctgaggaccacaagaagcagccgggccagggcctggatgcagcacggcccgaggtcctggatccgtgtcctgctgtggtgcgcagsctccgtgcgcttccgcttacggggcccggggaccaggccacgactgccaggagcccaccgggctctgaggatcctggaccttgccccacggctcctgcaccccacccctgtggctgcggtggctgcggtgaccccgtcatctgaggagagtgtggggtgaggtggacagaggtgtggcatgaggatcccgtgtgcaacacacatgcggccaggaacccgtttcaaacagggtctgaggaagctgggaggggttctaggtcccgggtctgggtggctggggacactggggaggggctgctt

SEQ ID NO: 26756 - DNA, 601 bp, Human
cgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggtggctgtgctttggtttaacttcctttttaaacagaagtgcgtttgagccccacatttggtatcagcttagatgaagggcccggaggaggggccacgggacacagccagggccatggcacggcgccaacccatttgtgcgcacrgtgaggtggccgaggtgccggtgcctccagaaaagcagcgtgggggtgtagggggagctcctggggcagggacaggctctgaggaccacaagaagcagccgggccagggcctggatgcagcacggcccgaggtcctggatccgtgtcctgctgtggtgcgcaggctccgtgcgcttccgcttacggggcccggggaccaggccacgactgccaggagcccaccgggctctgaggatcctggaccttgccccacggctcctgcaccccacccctgtggctgcggtggctgcggtgaccccg

SEQ ID NO: 26757 - DNA, 601 bp, Human
gcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcaggtactgtatccccacgccaggcctctgcttctcgaagtcctggaacaccagcccggcctcagcatgcgcctgtctccacttgcctgtgcttccctggctgtgcagctctgggctgggagccaggggcccygtcacaggcctggtccaagtggattctgtgcaaggctctgactgcctggagctcacgttctcttacttgtaaaatcaggagtttgtgccaagtggtctctagggtttgtaaagcagaagggatttaaattagatggaaacactaccactagcctccttgcctttccctgggatgtgggtctgattctctctctcttttttttttcttttttgagatggagtctcactctgttgcccaggctggagtgcagtggcataatcttggctcactgcaacctccacctcctgggtttaagcgatt

SEQ ID NO: 26758 - DNA, 601 bp, Human
gtccggatggtgcaggtccggggtgaggtcaccaggccctgcggttagctggatgtgcggtgtctggatggtgcaggtccggggtgaggtcgccaggccctgctgtgagctggatgtgctgtatccggatggtgcaggtccggggtgaggtcgccaggccctgcagtgagctggatgtgctgtatccggatggtgcaggtctggcgtgaggtcgccaggccctgcggttagctggatatgcggtgtcggatggtgcaggtccggggtgaggtcaccaggccctgcggttagctggatgtgyggtgtccggatggtgcaggtctggggtgaggtcgccaggccctgctgtgagctggatgtgctgtatccggatggtgcaggtccggggtgaggtcgccaggccctgcggtgagctggatgtgctgtatccggatggtgcaggtctggcgtgaggtcgccaggccctgcggtgagctggatgtgcagtgtacggatggtgcaggtccggggtgaggtcgccaggccctgcggtgggctgtatgtgtgttgtctggatggtgcaggtccggggtgagttcgccaggccctgcggtgagctgga

SEQ ID NO: 26759 - DNA, 601 bp, Human
gtgcaggtccggcgtgaggtcgccaggccctgctgtgagctggatgtgcggtgtctggatggtgcaggtccggggtgaggtagccaaggccttcggtgagctggatgtggggtgtccggatggtgcaggtccggggtgaggtcgccaggccctgcggttagctggatatgcggtgtccggatggtgcaggtccggggtgaggtcaccaggccctgcggttagctggatgtgcggtgtctggatggtgcaggtccggggtgaggtcgccaggccctgctgtgagctggatgtgctgtatccrgatggtgcaggtccggggtgaggtcgccaggccctgcagtgagctggatgtgctgtatccggatggtgcaggtctggcgtgaggtcgccaggccctgcggttagctggatatgcggtgtcggatggtgcaggtccggggtgaggtcaccaggccctgcggttagctggatgtgcggtgtccggatggtgcaggtctggggtgaggtcgccaggccctgctgtgagctggatgtgctgtatccggatggtgcaggtccggggtgaggtcgccaggccctgcggtgagctggatgtgctgta

SEQ ID NO: 26760 - DNA, 601 bp, Human
gaggtcgccaggccctgctgtgagctggatgtgctgtatccggatggtgcaggtctggggtgaggtcaccaggccctgcggtgagctggttgtgcggtgtccggttgctgcaggtccggggtgagttcgccaggccctcggtgagctggatgtgcggtgtccccgtgtccggatggtgcaggtccagggtgaggtcgctaggcccttggtgggctggatgtgccgtgtccggatggtgcaggtctggggtgaggtcgccaggcctttggtgagctggatgtgcggtgtctgcatggtgcakgtctggggtgaggtcgccaggcccttggtgggctggatgtgtggtgtccggatggtgcaggtccggcgtgaggtcgccaggccctgctgtgagctggatgtgcggtgtctggatggtgcaggtccggggtgaggtagccaaggccttcggtgagctggatgtggggtgtccggatggtgcaggtccggggtgaggtcgccaggccctgcggttagctggatatgcggtgtccggatggtgcaggtccggggtgaggtcaccaggccctgcggttagctggatgtgcggtgtctggatggt

SEQ ID NO: 26761 - DNA, 601 bp, Human
gtccggatgatgcaggtccggggtgaggtcgccaggccctgctgtgagctggatgtgcggcgtctggatggtgcaggtctggggtgtggtcgccaggccctcggtgagctggaggtatggagtccggatgatgcaggtccggggtgaggttgccaggccctgctgtgagctggatgtgctgtatccggatggtgcagtccggggtgaggtcgccaggccctgctgtgagctggatgtgctgtatccggatggtgcaggtctggggtgaggtcaccaggccctgcggtgagctggttgtgcrgtgtccggttgctgcaggtccggggtgagttcgccaggccctcggtgagctggatgtgcggtgtccccgtgtccggatggtgcaggtccagggtgaggtcgctaggcccttggtgggctggatgtgccgtgtccggatggtgcaggtctggggtgaggtcgccaggcctttggtgagctggatgtgcggtgtctgcatggtgcaggtctggggtgaggtcgccaggcccttggtgggctggatgtgtggtgtccggatggtgcaggtccggcgtgaggtcgccaggccctgctgtgagct

SEQ ID NO: 26762 - DNA, 601 bp, Human
gaggtcgccaggccctgctgtgagctggatgtgtggtgtctggatggtgcaggtctggagtgaggtcgccaggccctcggtgagctggatgtgcagtgtccagatggtgcaggtccggggtgaggtcgccagaccctgcggtgagctggatgtgcggtgtctggatggtgcaggtctggagtgaggtcgccaggccctcggtgagctggatgtatggagtccggatggtgccggtccggggtgaggtcgccagaccctgctgtgagctggatgtgcggtgtctggatggtacaggtctggrgtgaggtctccaggccctgctgtgagctggaggtatggagtccggatgatgcaggtccggggtgaggtcgccaggccctgctgtgagctggatgtgcggcgtctggatggtgcaggtctggggtgtggtcgccaggccctcggtgagctggaggtatggagtccggatgatgcaggtccggggtgaggtcgccaggccctgctgtgagctggatgtgcggcgtctggatggtgcaggtctggggtgtggtcgccaggccctcggtgagctggaggtatggagtccggatgatgcaggtcc

SEQ ID NO: 26763 - DNA, 601 bp, Human
ggtgaggtcgccaggccctgctgtgagctggatgtgtggtgtctggatggtgcaggtctggagtgaggtcgccaggccctcggtgagctggatgtgcagtgtccagatggtgcaggtccggggtgaggtcgccagaccctgcggtgagctggatgtgcggtgtctggatggtgcaggtctggagtgaggtcgccaggccctcggtgagctggatgtatggagtccggatggtgccggtccggggtgaggtcgccagaccctgctgtgagctggatgtgcggtgtctggatggtacaggtcwggagtgaggtctccaggccctgctgtgagctggaggtatggagtccggatgatgcaggtccggggtgaggtcgccaggccctgctgtgagctggatgtgcggcgtctggatggtgcaggtctggggtgtggtcgccaggccctcggtgagctggaggtatggagtccggatgatgcaggtccggggtgaggtcgccaggccctgctgtgagctggatgtgcggcgtctggatggtgcaggtctggggtgtggtcgccaggccctcggtgagctggaggtatggagtccggatgatgcagg

SEQ ID NO: 26764 - DNA, 601 bp, Human
ggtctggggtgaggtcgccaggccctgctgtgagctggatgtgtggtgtctggatggtgcaggtctggagtgaggtcgccaggccctcggtgagctggatgtgcagtgtccagatggtgcaggtccggggtgaggtcgccagaccctgcggtgagctggatgtgcggtgtctggatggtgcaggtctggagtgaggtcgccaggccctcggtgagctggatgtatggagtccggatggtgccggtccggggtgaggtcgccagaccctgctgtgagctggatgtgcggtgtctggatggtrcaggtctggagtgaggtctccaggccctgctgtgagctggaggtatggagtccggatgatgcaggtccggggtgaggtcgccaggccctgctgtgagctggatgtgcggcgtctggatggtgcaggtctggggtgtggtcgccaggccctcggtgagctggaggtatggagtccggatgatgcaggtccggggtgaggtcgccaggccctgctgtgagctggatgtgcggcgtctggatggtgcaggtctggggtgtggtcgccaggccctcggtgagctggaggtatggagtccggatg

SEQ ID NO: 26765 - DNA, 601 bp, Human
tggtgtctggatggtgcaggtctggggtgaggtcgccaggccctgctgtgagctggatgtgtggtgtctggatggtgcaggtctggagtgaggtcgccaggccctcggtgagctggatgtgcagtgtccagatggtgcaggtccggggtgaggtcgccagaccctgcggtgagctggatgtgcggtgtctggatggtgcaggtctggagtgaggtcgccaggccctcggtgagctggatgtatggagtccggatggtgccggtccggggtgaggtcgccagaccctgctgtgagctggatrtgcggtgtctggatggtacaggtctggagtgaggtctccaggccctgctgtgagctggaggtatggagtccggatgatgcaggtccggggtgaggtcgccaggccctgctgtgagctggatgtgcggcgtctggatggtgcaggtctggggtgtggtcgccaggccctcggtgagctggaggtatggagtccggatgatgcaggtccggggtgaggtcgccaggccctgctgtgagctggatgtgcggcgtctggatggtgcaggtctggggtgtggtcgccaggccctcggtgagctgg

SEQ ID NO: 26766 - DNA, 601 bp, Human
aggtatggagtccggatgatgcaggtccggggtgaggtcgccaggccctgctgtgagctggatgtgtggtgtctggatggtgcaggtcaggggtgaggtctccaggccctcggtaagctggaggtatggagtccggatgatgcaggtccggggtgaggtcgccaggccctgctgtgagctggatgtgtggtgtctggatggtgcaggtctggggtgaggtcaccaggccctgcggtgagctgggtgtgcggtgtctggatggtgcaggtctggagtgaggtcgccagacggtgccagaccrtgcggtgagctggatatgcggtgtccggatggtgcaggtctggggtgaggttgccaggccctgctgtgagttggatgtggggtgtccggatgctgcaggtccggtgtgaggtcaccaggccctgctgtgagctggatgtgtggtgtctggatggtgcaggtctggggtgaggtcgccaggccctgctgtgagctggatgtgtggtgtctggatggtgcaggtctggagtgaggtcgccaggccctcggtgagctggatgtgcagtgtccagatggtgcaggtccggggtgaggtcgccag

SEQ ID NO: 26767 - DNA, 601 bp, Human
ttcaccatgttggccaggctggtctcaaactcctgacctcaagtgatctgcccgccttggcctcccacagtgctgggattacaggtgcaagccaccgtgcccggcataccttgatcttttaaaatgaagtctgaaacattgctacccttgtcctgagcaataagacccttagtgtattttagctctggccaccccccagcctgtgtgctgttttccctgctgacttagttctatctcaggcatcttgacacccccacaagctaagcattattaatattgttttccgtgttgagtgtttctktagctttgcccccgccctgcttttcctcctttgttccccgtctgtcttctgtctcaggcccgccgtctggggtccccttccttgtcctttgcgtggttcttctgtcttgttattgctggtaaaccccagctttacctgtgctggcctccatggcatctagcgacgtccggggacctctgcttatgatgcacagatgaagatgtggagactcacgaggagggcggtcatcttggcccgtgagtgtctggagcaccacgtggccagcgttccttagccagtgagtgacagcaacgtccgctc

SEQ ID NO: 26768 - DNA, 601 bp, Human
tgcagacacgcaccgctacacctggctaatttttaaattttttctggagacagggtcttgctgtgttgcccaggctggtctcaaactcttggactcaagggatccatctacctcggcttcccaaagtgctgaattacaggcatgagccaccatgcctggcctaattttcaacacttttatattcttatagtgtgggtatgtcctgttaacagcatgtaggtgaatttccaatccagtctgacagtcgttgtttaactggataacctgatttattttcatttttttgtcactagagacccgyctggtgcactctgattctccacttgcctgttgcatgtcctcgttcccttgtttctcaccacctcttgggttgccatgtgcgtttcctgccgagtgtgtgttgatcctctcgttgcctcctggtcactgggcatttgcttttatttctctttgcttagtgttaccccctgatctttttattgtcgttgtttgcttttgtttattgagacagtctcactctgtcacccaggctggagtgtaatggcacaatctcggctcactgcaacctctgcctcctcggttcaagcagttctcattcctc

SEQ ID NO: 26769 - DNA, 601 bp, Human
cacggtgatctctgcctctgctctccctcctgtccagtttgcataaacttacgaggttcaccttcacgttttgatggacacgcggtttccaggcgccgaggccagagcagtgaacagaggaggctgggcgcggcagtggagccgggttgccggcaatggggagaagtgtctggaagcacagacgctctggcgagggtgcctgcaggttacctataatcctcttcgcaatttcaagggtgggaatgagaggtggggacgagaaccccctcttcctgggggtgggaggtaagggttttgcagktgcacgtggtcagccaatatgcaggtttgtgtttaagatttaattgtgtgttgacggccaggtgcggtggctcacgccggtaatcccagcactttgggaagctgaggcaggtggatcacctgaggtcaggagtttgagaccagcctgaccaacatggtgaaaccctatctgtactaaaaatacaaaaattagctgggcatggtggtgtgtgcctgtaatcccagctacttgggaggctgaggcaggagaatcacttgaacccaggaggcggaggctgcagtgagctgagattgtgccatt

SEQ ID NO: 26770 - DNA, 601 bp, Human
gtaggggcactgcgcgtggttcccaagcagctccagaaacaggggccgcatttgccagtagcgctggggcaggcggggcaacctgcggggagtccctggcatccagggcctggaacccagaaagatggtctccacgagcctccgagcgccagtcaggctgggcctcagagagctgagtaggaaggagggccgcagctgctccttgtcgcctgaggagtagaggaagtgcttggtctcggcgtacaccgggggacaaggcgtgtcccagggacgtggtggccgcgatgtggatggggggccygcgtggtgctggcggcccacggatgggtgggagtggcgcgtgccagagagcgcaccctccaaagaggtggcttcttcggcgggtctggcaggtgacaccacacagaaaccacggtcactcggtccacgcgtcctgcccgggtgggcccaggacccctgcccaacgggcgtccgctccggctcaggggcagcgccacgcctgggcctcttgggcaacggcagacttcggctggcactgcccccgcgcctcctcgcacccggggctggcaggcccagggggaccccggcctccctgacgcta

SEQ ID NO: 26771 - DNA, 601 bp, Human
cagagatcaccgtgtccactcgacgtcctgagcgaaaagccacgtgtgcccacgtgacgatggagacaggaggaccagggctctgcctgcccccttttctgagcccctactgcattcagctctggggcctgggccctcgacggccaccacctcctcacctgggctcctgcgcagccaagcgcagtcccgcacgctcatcttccacgtcagctcctgcagcgagagcttggcatgcttccccagggagatgaacttcttggtgttcctgaggaagcggcgttcgttgtgcctggagccccasaggcctgggggcaccagccggcgcaggcaggcccgcacgaagccgtacacctgccaggggctgctgtgctggcggagcagctgcaccaggcgacgggggtctgtgtcctcctcctcgggggccgccacagagccctggggcttctcccgggcacagacaccggctgctggggtgaccgcagctcgcagcgggcagtgcgtcttgaggagcaccccgtaggggcactgcgcgtggttcccaagcagctccagaaacaggggccgcatttgccagtagcgctggggcaggcggggcaacctg

SEQ ID NO: 26772 - DNA, 601 bp, Human
caactggcccaagtctaggtattgactgggaacttcagagtagccttaaggtggggacccccggggcagagggttgggcaggagtgtctacacgtgtgcagcaaccttccctccaggccggattctgcaggcgctagcgtccaccagcctgtgccacaccggcgggctcctcctccctcaatccccgcccagactgcctcgggcggcagagcacgtggctccagccctggggagccatttcgctcctggagcagcgcggcaggaaaggggccacaggtcccaaacttgcgcacgccgtagracgcccacctcccccacaccacgcccagggggtcgttcaaaatgcagatgtccgggccccagcgatcagagttccaggcatgtgcattttaagaagtgtgcggggtggtttggctgtgtgtggtccttgagtccatcaccctttgggtttagagcaacctaggaccaaagcttgcaaagtggcttctggggaggcctgcggacctcgggccacccacccggctgggggacccgacgctttcggtttacggcaggggggaggggcgttggatgggaaagtttgcagaggaaacccacgtgc

SEQ ID NO: 26773 - DNA, 601 bp, Human
atccctgctggtcactgagggatggagcaaagcccaccagcctgagatgaccctgagaagcaaatgcatctggccagaaggtcctgcctaatgaacacatttgatcccagactggcttcccacctcaccctgcaacccctactgaaggtaaacaaatccagggacccccaactccatgcctaatgcacagctgacaactgtcttgcaatggacgttgccatgtccaaccctggacgaaggccctacaccttcaagtccttggcctaccaagatccagctaccctgggggactgctggtatsctccaaaggaacgcttggggcagggataaattgaagccagaatctcagggggccctgagaggactcacccaaggcccaggcatggcagccagagggccccccaaccctgcccaggatcaggcccagaatgtcttctccagtaggcacagcggctcaactgcacctccgcgctgcccagcccagccctgcagcagcagcaaccccaggacaagggttcaagttccagttccaccacctgctgtagtggtcccttctccagtctctgtgtccgcctctttaagcggaatcaaaagacacttt

SEQ ID NO: 26774 - DNA, 601 bp, Human
aagatacagatggagagtccgggcacggtggctcacgtctgaaatcacagcactttgggaggacgaggcgggcagatcataagatcaggagatcgagaccatcctggccaaaatggtgaaaccccgtctgtactaaaaatacaaaaattagccggccatggtggagcgggcctgtagtcccagttacttaggaggctgaggcaggaaaattgcttgaaccccggaggcagaagttgcagtgagccgagattgcgccactgcactccagcctgtgcgacagagtgagagtccatctcaaaaaaaacaaacaaacaaacaaaacacaagatatggatggagactaccatatacctgcccatatacctgcttttaagactcagtggctgggcgcagttgctcatgcctgtaatcctagtactttgggaggccaaggtgggcagatcacctgaggtcaggggttcgagaccagcctggccaaccactatggtgaaaccccatctctactaaaaataaaaaaattagccaggcatgctgacacatgcctgtaatcccagctacttgggaggctgaggcaggaaagtcggttgaatctaggaggcgg

SEQ ID NO: 26775 - DNA, 601 bp, Human
gcacggtggctcatgcctgtaatcccagcactttgggaggctaaggtgggcagatcacctgaggtcagaagtttcagaccagccaggccaagatggtgaaaccccctctctactaaaaatacaaaaattagccgggtgttgtgggacgtgtctgtaatcccagctactcgggaggtcgaggcccaagagttagtttgcacccaggtgtccaggacaacccatgaaactcttagggggtctacaagaccttttaagaccacaaggctgtgagctgctgaggacaggagtcacatcctgttcrtggctgtatcctcagtcccggcagaatgttgttgcttcataaataaatcagggacccaataaacactccaaagccttcaattttcttgaactccttcttatgggagctttttaagttttattatttttttaatttatttttatttatttatttagaggcagggtctcactcccgtcacccaagctggagtgcaatggcatgatctcggcttactgtagcctcaacttcttgggcccaggtcgtcctccttcctcagcctcccaagcaactgggagtataagtgcacaccattcacacccg

SEQ ID NO: 26776 - DNA, 601 bp, Human
ccctgcactgggctcaagtgaaaaagtccagccttgccacttactagctgtgcaacaccaagcctcggtttcctccgtctgtaaaatatggaaacactgcttcacttcacagggtcatggtgaagtttaaaagagatcaagaaaggccaggcacggtggctcatgcctgtaatcccagcactttgggaggctaaggtgggcagatcacctgaggtcagaagtttcagaccagccaggccaagatggtgaaaccccctctctactaaaaatacaaaaattagccgggtgttgtgggacgtgyctgtaatcccagctactcgggaggtcgaggcccaagagttagtttgcacccaggtgtccaggacaacccatgaaactcttagggggtctacaagaccttttaagaccacaaggctgtgagctgctgaggacaggagtcacatcctgttcgtggctgtatcctcagtcccggcagaatgttgttgcttcataaataaatcagggacccaataaacactccaaagccttcaattttcttgaactccttcttatgggagctttttaagttttattatttttttaatttatttttatttattta

SEQ ID NO: 26777 - DNA, 601 bp, Human
atcagtgggaaccctgcactgggctcaagtgaaaaagtccagccttgccacttactagctgtgcaacaccaagcctcggtttcctccgtctgtaaaatatggaaacactgcttcacttcacagggtcatggtgaagtttaaaagagatcaagaaaggccaggcacggtggctcatgcctgtaatcccagcactttgggaggctaaggtgggcagatcacctgaggtcagaagtttcagaccagccaggccaagatggtgaaaccccctctctactaaaaatacaaaaattagccgggtgtygtgggacgtgtctgtaatcccagctactcgggaggtcgaggcccaagagttagtttgcacccaggtgtccaggacaacccatgaaactcttagggggtctacaagaccttttaagaccacaaggctgtgagctgctgaggacaggagtcacatcctgttcgtggctgtatcctcagtcccggcagaatgttgttgcttcataaataaatcagggacccaataaacactccaaagccttcaattttcttgaactccttcttatgggagctttttaagttttattatttttttaatttattt

SEQ ID NO: 26778 - DNA, 601 bp, Human
tcccctcggtcccagaacacaccatgcccaggctgttgccatcagaaacatccctgcctccctcccttccccaaagctcctccagcccatcagtgggaaccctgcactgggctcaagtgaaaaagtccagccttgccacttactagctgtgcaacaccaagcctcggtttcctccgtctgtaaaatatggaaacactgcttcacttcacagggtcatggtgaagtttaaaagagatcaagaaaggccaggcacggtggctcatgcctgtaatcccagcactttgggaggctaaggtgggcrgatcacctgaggtcagaagtttcagaccagccaggccaagatggtgaaaccccctctctactaaaaatacaaaaattagccgggtgttgtgggacgtgtctgtaatcccagctactcgggaggtcgaggcccaagagttagtttgcacccaggtgtccaggacaacccatgaaactcttagggggtctacaagaccttttaagaccacaaggctgtgagctgctgaggacaggagtcacatcctgttcgtggctgtatcctcagtcccggcagaatgttgttgcttcataaataaatcag

SEQ ID NO: 26779 - DNA, 601 bp, Human
ctgagactgacgctggcgtcccaaccagacacttggaggcatagggcatgcccttcaagtctagaaccctgccaggtacctatccctcctgcccaggccaaagtcaagtacccccaatccctctacacctgcctgcccagctccagcctcaaaccggccactgagaactttcatttcacactgccctgaagtcactcacatacctcagggtcacttaacatctacacagtcaacgtgggaaagtccacacgggattctcccaaacccaaaaaagcactaaggcactcatccttctctaacmtaatcagcccgaggttctcatccatgctccatccccgctgcttctacactactcacccatactctgtactctgacctggccagtctgctgcccttcccctcggtcccagaacacaccatgcccaggctgttgccatcagaaacatccctgcctccctcccttccccaaagctcctccagcccatcagtgggaaccctgcactgggctcaagtgaaaaagtccagccttgccacttactagctgtgcaacaccaagcctcggtttcctccgtctgtaaaatatggaaacactgcttcactt

SEQ ID NO: 26780 - DNA, 601 bp, Human
tcgaactgttgacctcaaatgatccatccgcctcggcctcccaaagtgctgggattataggcatgagccaccatgcccagccacaccaaggctctcttgcttcttgcaagccagcctcctgggtccaaacaggggctgccctagatttaggaataaggtcactgagcagccaatggccaaggaacaaaatttgggcaccagccttggatgctaaggcaagagccgccacacctaccaccacagcacccacagaatctgctgagactgacgctggcgtcccaaccagacacttggaggcatrgggcatgcccttcaagtctagaaccctgccaggtacctatccctcctgcccaggccaaagtcaagtacccccaatccctctacacctgcctgcccagctccagcctcaaaccggccactgagaactttcatttcacactgccctgaagtcactcacatacctcagggtcacttaacatctacacagtcaacgtgggaaagtccacacgggattctcccaaacccaaaaaagcactaaggcactcatccttctctaacctaatcagcccgaggttctcatccatgctccatccccgctgct

SEQ ID NO: 26781 - DNA, 601 bp, Human
ggagtttgcacggaccccggaggcagcacatctgcaacagctggaaacagccgtggccttcctggccccacccagcctgcccatctgtccagccttggctccctgtgggaccctggacgcatcgctgccccttccccggcctcggcttcctctcccaatagagaggtgtccaacgccggaagtctggatgcaaatcagcctccttccgtcctcatcaagccaagccccctcctccatcaggacccaaaggcccagggcctgcacccagggtacaagtctcttacagggtcttgaaatgtcmgcactgcaaaaggggcccgggccccccactttccatgagactttagggtgcagggcagagaggggatggttttagggtcggtcagctggatgtcagtgctctcacttctcccggttcccctgccctgaagtggaggtgatagggggactggagcaggcctgctgcacggctgtgtgtggcccagccttagggcggagtccaggctcccaggcctggcacaaactcagaccataccatgtctgagaggccagcaggccaaggggaccaggactgctctgcagtgggtggcttaaagctggg

SEQ ID NO: 26782 - DNA, 601 bp, Human
acctggaggcaggacaacctgggctcagggccaaggccgggagcacaccctgccctgtcagtctcacagcagctcattcactcctgctgaaaaccctagcacagggcgggcccccctcaacagaggccagaagcctttccagagcccttcagcccccggctcctctcgcctcccacctcggcctccactggaccatgctccctcctgcccgagtctttgcctatgctattccctctgccgggaacacctttctctgtcctttggttaactatgagactcaacttcccacttccatggagawgccgtggggcgtcccttgaaaaacccctcctgatgccacagctccagcctggccttcaatatggttttttgtttttgttttttggtttttttgagccatggtctccttctgtcactcaggctgcagtgtagtggcacaatcatggctcactgcagcctccacctcctgggctcaagcaatcctcccagctcagcctcctgagtaaccgggactacaggcacaccccaccacacctggctaatttttgtatcttttttggtagagacagagtctcactatgcttcccaggctgatctcaaa

SEQ ID NO: 26783 - DNA, 601 bp, Human
tccccttcccggtccccagagcccactcccgggcgcctcctgctcacctgggtccgcagctgctgctgttcccgctccagcttctcctggtgcagcagcctcacctgttcctgctgctgctgcagctgcacctgctgcgcaatcaccttgagcttttccgggtacatgtgggcctccagcgagcgcacctggaggcaggacaacctgggctcagggccaaggccgggagcacaccctgccctgtcagtctcacagcagctcattcactcctgctgaaaaccctagcacagggcgggccccyctcaacagaggccagaagcctttccagagcccttcagcccccggctcctctcgcctcccacctcggcctccactggaccatgctccctcctgcccgagtctttgcctatgctattccctctgccgggaacacctttctctgtcctttggttaactatgagactcaacttcccacttccatggagaagccgtggggcgtcccttgaaaaacccctcctgatgccacagctccagcctggccttcaatatggttttttgtttttgttttttggtttttttgagccatggtctccttctgtca

SEQ ID NO: 26784 - DNA, 601 bp, Human
aacaaaacaaaaacagaaagcaaaccaaaaagaaataaaaaaccaacaacaaacaaaacaaaaagagagagacagacatttttggggtggaagatgagacctggaggcagaggtgggggctggggggtgggagagtggcgaattctagtgccgagatggggaagggggaggggggcacagcagcagcaaaccccaaccaagaagcaacggagacctccgggcccccagaatgccccagcctagtcttacccccaaccatgtaagtgcttaaaggagaaagaagaaaacccaaaaagaggarggaaaggggattgaaggctgacaatcccaggctggctctgggcagggaagaaataacctggggttttgtttaattttccctgttcttaaaaaacatatttaaaggaaaaaatgctttttggcagagagaggccaggcatctccgtgtcagcttcctccagcccccggggccgaggccccgccctggggtgccgatgctcccacacgctctgcgacaccccagccccgggacctcgggttgagtggcttcgttcaaaggtcgatttacagtattgaaaaagaggtcataaaagagacccaa

SEQ ID NO: 26785 - DNA, 601 bp, Human
ttaaatatgtctttctgaaacccacatggcttccattgcctaaagaataaagacagctttcaacaggctctggcctccactttgtctctaagctggtctcctctctgtctccctggtgtagccacactgatctgcagtagcagatcccctgagcatgtgaggcctggaacaacctctctactccccctaactggtctaaccctaacacctgctctgggaagctttcttcgagtgaatttcttccccaacctggctgactgtggcagtcgctgtggctctgaactaatgtgattcccaggtyccactcctggagattctgattccgtaggtcagagcagagttcagtaatacttcgagaagccccccaaggaggatgatgctcagccaggtgtggagaccaccatgcatgtcctgcatctttatttctaagtcgcttctggttctgttaccatttatgtacactagcccttcgcctgcacttctggcttgttttatgagctggattgtgaagatgctagagggcagagaccacatcttagagactttggccactcaaagttatccatcccagtgccttgtgctccagaaattctaagttgtg

SEQ ID NO: 26786 - DNA, 601 bp, Human
cacagctgcacctcagacagaggaaagccctgaccacaccgcctactgcagcaggctctcctggtccccaggctcctgggctgatgcatctgatggccttaagcatcatggctaagaactcagcttcaggagccaaagaggctggcttgagtccaggccctgctatgcgggctgggtatagcctctctttcttcttcatggggtcagtatgattaaatgagttagcacacggattgtacttcaaacagtacttgacatgaagccaaaaccttaataggtgccagtttttattaatgattartatgaaactgccaatcctcaaccatattttacctacaaaaatggcaatttcatatggatccatgactcttaactggggggcaattttgccctgcagaggacatttgacaatgtctggagatatttttgattggcacggccagggatagtagtgctattggcatctagtagatagaggccagggataccgctgacttccttcagtatacaggtcagtttccacaacagaatgacccagctccaaatgtaatagtgccaaggttcaatataggtccccctaatagtattctattatagacag

SEQ ID NO: 26787 - DNA, 601 bp, Human
taagagtttgtggtcagggaactgggcttggggatgaccctggcctttctcaggaggagggttaatttgcagggggaaaatgcctggaagcaaaagagctgagtggtttgaggtgaattttgccaagcagaggcacagcaccctctgggcagcagctgggagcatgggttctggtgctggaatgatgggactgaactccacctctgccggttactagctctgggactctgggcaagttgctcaacttctctgaaccccagctttctcacttatacaacaagggtaataatccctacttgasaggggagttgtgagggatccatggttgcggtatgcagagtgctgggtaccatgcctgccatgaactaagcttttattgagcacttactattattattaatagtaacgtgtatgatgtgaatgtggagagatggccaatcaccctgattagcaaagtgtaagggtgtgtgaatgtgatggacagttcccttgggccaagagcaaggcttgggactgaggggaatgggagagcagtcacccaccccagcgttcagaaggcttctaacagctgaagagggggctcttctgccacacaggtggc

SEQ ID NO: 26788 - DNA, 601 bp, Human
gctgtcgggaattttggggagaggtggagaatgaagggctggagagcgcgagccctatctggggcggcacacctgagtgagtccgagctgaggggctgtgtttggaagttcaggcccggtgttgccattctgcttattcaagaggagctggatgtctgcatggaaatgtgaaatctcccttctaaaatgctgacaactgattaaagccatctaagaacagcgtggctcactatgtgttgccatgtaaagcatttctgcagactgaatactgtccctgggccatcaagatccaggggggaarctgaggtaaagaggtgtaattgcttgcatggccgtgcctcccccaagatggtcagcttttccaaatgcgagtgtgtctcagctgtctctgtagccccgcacttggcccataggaaaaacttgttaagagtttgtggtcagggaactgggcttggggatgaccctggcctttctcaggaggagggttaatttgcagggggaaaatgcctggaagcaaaagagctgagtggtttgaggtgaattttgccaagcagaggcacagcaccctctgggcagcagctgggagcatgggttctggtgc

SEQ ID NO: 26789 - DNA, 601 bp, Human
atatgtaaggctagttttcaccacctttggcagtctgtgactagttatttgtttaaacttttttttctttccttcattttatagcgtgagatgtcattttaggttctctggaaacctaaagactgttgttcttatggaggatggagtttaagacttacgatattttagaaagtgctccctctctcgagactagaatcctggctccctgtgggtttgcttgatgaggccatgatagatggggcctgacctcagggtatgtcaggcttattgaccaggatgtgtgtgtcagcttcccagggcygggcaagtcacaggagcagggacagagtgttctactttctctgcatgcactcaagagtttctggtctagtgggaattcattaattagaacattcttttgggtactgtaaatacaaaaagggataaggtgtggttctgtcttcccagagctcacaagccatcagggggtaaggagtgccgtcagaggggtctgcagaggaccctgtcccagggctgaacacatgcaagccccaaggggtcccacggatggcaaagtgagccaagtggcctagtgtaagcagagcagcagggcaacaggtga

SEQ ID NO: 26790 - DNA, 601 bp, Human
tctcttcgggtgtttaactctgttcagattccactggaagggtctgtggccagggccaggtggaatgtttcccttggctgacaggaatttgctttcatactttgctgtgggaaagttgtcagggagttgggtcaccgaggagcatttgggacaggtgagaaacttcaaactggttgccaggggtaaacttgtcacctgggtgtcttccttcaacggttttcctttgtttgaaggcttctgcaggcagcagaccaatggtgtggggaatctgcctcggggaaaaagtggtgagagtcctaascttgcatttctatagctttactgtctttgcaaattctcttcccattagttttctgatgtggttgggactaggggatttattaaagggagctgtaaaataccatctagggttcacttgaagcataaatatgtaaggctagttttcaccacctttggcagtctgtgactagttatttgtttaaacttttttttctttccttcattttatagcgtgagatgtcattttaggttctctggaaacctaaagactgttgttcttatggaggatggagtttaagacttacgatattttagaaagtgc

SEQ ID NO: 26791 - DNA, 601 bp, Human
ctgcctgacctcccatccatgcctttaactgtgctgtcctcctgcctggtgtgtgacccccactctgggaggacctgcactttctccagacctgtggatggcagtgatgtcatccttcttaaccctacccccaccacctgctgatggatctatgtaagggggctcgagtaccaacaagaaaactgcccccaatcctaatctctggggaggcgccaccttggtcacacaggcagccagttatgaactgatggtggtcaggtctcttcgggtgtttaactctgttcagattccactggaaggktctgtggccagggccaggtggaatgtttcccttggctgacaggaatttgctttcatactttgctgtgggaaagttgtcagggagttgggtcaccgaggagcatttgggacaggtgagaaacttcaaactggttgccaggggtaaacttgtcacctgggtgtcttccttcaacggttttcctttgtttgaaggcttctgcaggcagcagaccaatggtgtggggaatctgcctcggggaaaaagtggtgagagtcctaaccttgcatttctatagctttactgtctttgcaaattctcttc

SEQ ID NO: 26792 - DNA, 601 bp, Human
agtgagactgagaaactaaattttaatcaattaatttaagtagtcccactacttaagagtccagtggctcttgtcataggcagcaattgctctctatatattatcatccctgggtccccattacaatcctatgaagtattagtatcctcattttgtgcacaaagaaacagaggcttaaaggggccaagtcacttgtatgggagactcagctggactttacctcggtctgcctgacctcccatccatgcctttaactgtgctgtcctcctgcctggtgtgtgacccccactctgggaggacstgcactttctccagacctgtggatggcagtgatgtcatccttcttaaccctacccccaccacctgctgatggatctatgtaagggggctcgagtaccaacaagaaaactgcccccaatcctaatctctggggaggcgccaccttggtcacacaggcagccagttatgaactgatggtggtcaggtctcttcgggtgtttaactctgttcagattccactggaagggtctgtggccagggccaggtggaatgtttcccttggctgacaggaatttgctttcatactttgctgtgggaaagt

SEQ ID NO: 26793 - DNA, 601 bp, Human
tgagagccaccatgaagtttttaacagagaaaccaacgtttctcaactgtggctgcctattgaaattgcatgcagagctttcaaaaatcctgatgtccaggccacacctttagatcaattaaatcagaatctctgggagtcagtcctgggcatcaagatttttaaagctcctagctgattccagtgggcaggggagggcgatcctttctcttcctagttgtaataatggaaatgcttctcagctgctctttatgacggaaaaagaaaaaggtttggtgacatactttttttaaaaaaaaaacttcccaagcttctactaatattagacttaattatgctgattattttaggcacaagtcacagaaggagtgggaagagtcacctcacctggctgcaaatgaatcacacttgatccagctgctgttctctcctttgcctcaggtaggcgttggttctcacctggctgcacattccacagggctatgagacagtgggtgcactaggaccaagggcacgtgtattgggctcacacattctcagcctttcaagaaccagattcaccaagtcctataacctctgtgctctgggggctggtggggag

SEQ ID NO: 26794 - DNA, 601 bp, Human
atgcaccaagggagataaccccctgggctgggacacaccttgctgactttccatgctttttctaccagaggaacatttgccattcatgcatgctggcccctgcaaatcagctctgctttaaaaccgccccagcaggagccccagccccttaggaaagtcttcatgccaacaagaatgcctatcactctagtgttaatagctgcaaacgctcaactcccagtcccacacagtgagggaacccaacatgcttctgagcgaacacttccccaaggtgggaggcacctgggtaactgcctcatcrttgggactccaggtcatgacctagaagagctccaagaacagtgcgtcttagccccaagcagcccagtgggtctcacctacagttgggacctccccaatcaaaatctctctgcaaatggggcctgggcattttaaagaaagggccaaaaggtaattctgacactgccagagttgagagccaccatgaagtttttaacagagaaaccaacgtttctcaactgtggctgcctattgaaattgcatgcagagctttcaaaaatcctgatgtccaggccacacctttagatcaattaaatcagaa

SEQ ID NO: 26795 - DNA, 601 bp, Human
agccaagtgctaattacaacacataacattcactgcaagcattaggctaaactcctacatgaatcatctcttttaatcccagcaatcacaactgacctgtgaggttgcgactattatttaccttgtttgacagatgaagaaacaaaagcttctagaggtttgggaactaacaatctcacccagtaaggctacctttctgggttaatgcagactggtttggaagataccctgggctagtgatttagtgacaaacacaaatctgatcaggcacaagagatgggctactgattgtcctggagcraggtctccttgctcagtgtggcaaggggcaaaggtgcccccagacagtgccgtcttaatgcaccaagggagataaccccctgggctgggacacaccttgctgactttccatgctttttctaccagaggaacatttgccattcatgcatgctggcccctgcaaatcagctctgctttaaaaccgccccagcaggagccccagccccttaggaaagtcttcatgccaacaagaatgcctatcactctagtgttaatagctgcaaacgctcaactcccagtcccacacagtgagggaacccaa

SEQ ID NO: 26796 - DNA, 601 bp, Human
ataagcctgttgctgggcttctctcttggtatctggtgggcatttcacgattcccatcccagcccctgtcttggcactgtcctgcagtgagaagctgcaaaggttactggagcccctgaatctttggacagcagggctaaggaggaggctctgagaccttcctgcccaagctgcttatgttacaggtgaaaaccgggagcccagagcagtgtgcctgggcacgaggcccttctgagttgcagagtctgggctggaaacagtacatcccatgccagggggctctaaaggccttggttccagrgccatcaatgactactttctcacagtcagccagccaggtggacttgtccttgtcacttcccagataggagcatccccgggcaatgggatcaaggcctctagatccctccagcatgggacaagctggtcccaacttggaccctgcaactcaggagggccctaagcccaggaagccagcagcctggcaggagtgagagcttagtctctggctcatggattctgaacttggtctctggcagggagaccaaggctgggaagggacacaggagttgggactggccgcctccctggaaatgagaga

SEQ ID NO: 26797 - DNA, 601 bp, Human
cacagacgctaccagccatttcccttgggctatcgtggagaactttgtttccactcattctaaccctaattcgtatataatttatgtatccctgggctagggttggagttaggagaaatttcctaaggtgagccaggtggcagagatgaagaaataagcctgttgctgggcttctctcttggtatctggtgggcatttcacgattcccatcccagcccctgtcttggcactgtcctgcagtgagaagctgcaaaggttactggagcccctgaatctttggacagcagggctaaggaggagkctctgagaccttcctgcccaagctgcttatgttacaggtgaaaaccgggagcccagagcagtgtgcctgggcacgaggcccttctgagttgcagagtctgggctggaaacagtacatcccatgccagggggctctaaaggccttggttccagagccatcaatgactactttctcacagtcagccagccaggtggacttgtccttgtcacttcccagataggagcatccccgggcaatgggatcaaggcctctagatccctccagcatgggacaagctggtcccaacttggaccctgcaac

SEQ ID NO: 26798 - DNA, 601 bp, Human
gttcagacaaatgctacagaatctattacaaattttcttaaaagattaaaaacatttttctattggtgctaaaagaaaaaataaaaatatttaccttcattagctcaatagattagcccaaggtagctgaaaggagatgttgagagggggctttagaggccctggttctcatcctcactcccccactgattcccagtgggacccaagcaggctgtcatcagactcagtttacccacatcgctcatgagccatcctcttcctaagaccactgtaaggctgaatggatttgcatcctcaagarctgtggctcctaaatctcaagtgccgctcccgcactctctgtgtgctcccttactgtgcacgatgactatggttattgaaataaagaacaaacacatatgttcttggggcttcagctccctccagatgaccatgagctctaatgaatgcacatgtgtccagcctcccagaagccttcctccctaccctctccatggaccctggaacttctgaacgccaactgtttactagggaaggacacctctgggtggattcgctttaatgactgtctcttgacccactatgtcctcaagaagaactt

SEQ ID NO: 26799 - DNA, 601 bp, Human
aaacagtttcccctccttcactttcttccccagtaggcaaatgacagaaaacaataactatagaaatctcctgtgttgggcagaattctgttgtggggaggtggcccattaaaaagaaatatatagcctggaatccatggctggcagaagacaactgcacacatgtggactcagacaccaactgctgcacacacctcacctaggtgaacaggagtccgtctctttgcagttcttttttaacaagtcttgaaatcgtggtccgctgatttcttctctaggtcacactgaataaccccaagcmgacggagttcttgacagagttttgaaggcccacaaaaggctgcacaggtgattacaggccaagtaggaaggtctgtggcacacccaggcatctctggcagtgctgtcctgaagaagcctttctttattgatctgccacagtccacctggccaaactcctcctctgggctcttcagaccactggcaggaaggaaaaacaggttaagcactgtgggccacaccctggccacgttgggaaaataagcttaggaaagagacttggagatggcagagccaatgtcaccaagttctctcgggcagt

SEQ ID NO: 26800 - DNA, 601 bp, Human
ctatggttaattataggatttccacattttgcaaaagatcatctaatttttcctcatcattcatatttgcagagaaaagtcttcatttccttgagcaatatcctaatctcattaaagaaacactccagtcttgatttaggaaaaaaagattcattccttcatccttccaaataaggtacagtacaactcaataacaatgcacattactgaaaaacacaattgcgtcttatattgctcactactctttaagtataattcagatattaaggaaaataactgctaatcacattaacacattacwgaaatcaaaattaacttaccacacaaaataaattaaaacattaaatattaaccttttcagtgcaacatatacagacatcagagtaaggagttctaaaaaaaagcatcaggtttattataataaagataatgaaaagttgaccattttagtaaattattaagactaagaagaggagttgctttttcagtactctctctctctctgtgtgaaccactagatctttcagaaagcctggtaaatcaatggctagagagaacaggtcttatgttagaacatttaaaaatatacatgtttgtctta

SEQ ID NO: 26801 - DNA, 601 bp, Human
gtccacaagatctgggcagcgaatgctctttcccacccctctgagccagagaaagagaaagagcctgtcttttctctgctcctgtacacttgacagcctcaaggtctgagcagtattaacacccagagaaaaactttctgcacaaatggtaacaatagcccgaagttgaaattcaagctcatagacccagattccacacataatggacatggctggaatgagcttataatcaccccgaggggttgttgaggaagtcacagacaaggcaggaaggatcagaggcctggaaacaagcaaatgygctactgatcttcaggaaaggatgagtgagtgtttctggaaattgccatctggtgggcctgacgctggttcttagaaaattaatggaacagatgttaggaaaacaaatgtgtgaatgctgtctaatgaagccctgattaataattggctttgaaagaacagatactgccaacgattccctaaaccatttcagatagaaccaaggagagaaatcagtgatagttaagtaatgtgtaagtttacaagtttgtaatactctgaatgtggataagctacttgcattggcaaccctatcaaggac

SEQ ID NO: 26802 - DNA, 601 bp, Human
gaaagggcaagatgatagattggggtccacctgtcagactaaaaggttaaattttaacccattaacagtagggagtcactgaaagtgtttgagcagtgcagtgacatctcaaccttgtgttttagacccaataaagcagggcttatatagcaaagagcccacatcatgagcctggcagaaacacagatgcttcctctgaccaagctggtgtgtcaccattggctcctttctctttccttgacagcacgtgctatgccagacgctgtcacctgctggcctcttcatccctgtccacaagatstgggcagcgaatgctctttcccacccctctgagccagagaaagagaaagagcctgtcttttctctgctcctgtacacttgacagcctcaaggtctgagcagtattaacacccagagaaaaactttctgcacaaatggtaacaatagcccgaagttgaaattcaagctcatagacccagattccacacataatggacatggctggaatgagcttataatcaccccgaggggttgttgaggaagtcacagacaaggcaggaaggatcagaggcctggaaacaagcaaatgtgctactgatct

SEQ ID NO: 26803 - DNA, 601 bp, Human
cttttcttgaggtctggtaagggtctcctgcactatcctgtcccattaacttcccccccactcacccatcctaccatacacattcattttgttacctttgaatttgatttccatcacctcgtgaatgttttccaggatatctccattgggctgaaaggtgtgacatggacagtgaatgctgatttctagacctaagttggactctgcaaaataagacagaattagtgagaaaagcacctctgtgtgatggggaagtgtgcccaccacccatgcaagggtgagccagggcctctgctcctayagggactcataggaactgagttctattgagggtcacaggagacagaaagtgcctccagagctcagagtggaccttcaagcgcacgttgccacattccaggtattcctgttgtattatgaatcaccaaatgggggcatacactagtggccatcatgaaacagaagtggaataatcattccctttgaaaggatggtattaagagaaaattgtcacctacctacttggaggcaaaagtacacagatacagtaaggaaagcaaaaactcatgccatctacatggtttttgggagaggggatcgt

SEQ ID NO: 26804 - DNA, 601 bp, Human
ctgaaggagcttggtttcttttcttgaggtctggtaagggtctcctgcactatcctgtcccattaacttcccccccactcacccatcctaccatacacattcattttgttacctttgaatttgatttccatcacctcgtgaatgttttccaggatatctccattgggctgaaaggtgtgacatggacagtgaatgctgatttctagacctaagttggactctgcaaaataagacagaattagtgagaaaagcacctctgtgtgatggggaagtgtgcccaccacccatgcaagggtgagccagggcctctgctcctacagggactcataggaactgagttctattgagggtcacaggagacagaaagtgcctccagagctcagagtggaccttcaagcgcacgttgccacattccaggtattcctgttgtattatgaatcaccaaatgggggcatacactagtggccatcatgaaacagaagtggaataatcattccctttgaaaggatggtattaagagaaaattgtcacctacctacttggaggcaaaagtacacagatacagtaaggaaagcaaaaactcatgccatctacatggttt

SEQ ID NO: 26805 - DNA, 601 bp, Human
tttacatagctacaggagtggctcgggtctcaggaaggggcaccagatctgtaagataaatgagagacctggatcacaaatccctttttctgaaaatctttatgaacaagataagtattcactgaaatgggaaggtttcatcctaagctggcctgtaggtaaggactccaaaggtcctctgggctctaaggttctgtggttacagtgtcaaatctttggctttaagaaaaggctgtaaaatagagcccatgtggggtaagatcactgtccagcgctgagccaaaagaggcctgcacctttycccagacaagcctctgacctcaggcgttccgcagttacccaaaatgggaatatgaaaggaaaagagaacttccctgaactccagagatcatcaaggctgagttccttgcaaacataatggaaaaccagaaatgactctcaacgacttcgccatctctacccaaacaccccggggacaaacaccctgaggctcgaagcaatcatccaaacccagaggacccctgggcaaggtcaggtaggccctgcacatctggaaagctcagttgtctgggcactcatgttcaggacagccaaacttaat

SEQ ID NO: 26806 - DNA, 601 bp, Human
gagtctcgctctgttggccaggctggagtgcagtggccccatcttggctcactgcaacctctgcctccggggttcaagagattctcctgcctcagcctcccaagtagctgggattacaggtgcatgccaccatgcccagctatttttgtatttttagtagagacagggtttcaccatgttggccaggctggtctcgaactcctgacctcaagtgatccgcccacctcggcctcccagagtgctaagattacaggtgtgagccactgcacccagccctggattgtcactttagattctagasttagaatcttggggtgtgagtttcctcttaaaatgtgaatggaccaagataacgcagaagtcctaccaaaaatttaaggtgtcacaacttaagatagcctgaatgggagccaaagaaacaagactgtataattgttaacattcacattgcacttagagtctttgaagtgttttcactataaaattcagatgagataatgaagcatatgataaatagcaaataagctctggaaagaaaatctaaattcatcaacccgtttcatctgaaaaaaaaggaaaagactggagactgacttagaaa

SEQ ID NO: 26807 - DNA, 601 bp, Human
ggcttgtttatttgtttgtttgtttgttttgagacagagtctcgctctgttggccaggctggagtgcagtggccccatcttggctcactgcaacctctgcctccggggttcaagagattctcctgcctcagcctcccaagtagctgggattacaggtgcatgccaccatgcccagctatttttgtatttttagtagagacagggtttcaccatgttggccaggctggtctcgaactcctgacctcaagtgatccgcccacctcggcctcccagagtgctaagattacaggtgtgagccacygcacccagccctggattgtcactttagattctagacttagaatcttggggtgtgagtttcctcttaaaatgtgaatggaccaagataacgcagaagtcctaccaaaaatttaaggtgtcacaacttaagatagcctgaatgggagccaaagaaacaagactgtataattgttaacattcacattgcacttagagtctttgaagtgttttcactataaaattcagatgagataatgaagcatatgataaatagcaaataagctctggaaagaaaatctaaattcatcaacccgtttcatct

SEQ ID NO: 26808 - DNA, 601 bp, Human
gtgtgggggacaagtgcagcttaattctgatgtccaggtgcagaaaggggaagagcagatggagaagccagtatcaaaagaactcattattattgtaaggatgcccactgaaagatgccccgtgttcagatccccatacccttgtatagaaatcttccaaggggcagaaagcccttgctgagattcctaggaatcttcatggacctatgaagcatccctgttactaagtgggtacctaacacatatctccgggttgtcggcttgtttatttgtttgtttgtttgttttgagacagagtctygctctgttggccaggctggagtgcagtggccccatcttggctcactgcaacctctgcctccggggttcaagagattctcctgcctcagcctcccaagtagctgggattacaggtgcatgccaccatgcccagctatttttgtatttttagtagagacagggtttcaccatgttggccaggctggtctcgaactcctgacctcaagtgatccgcccacctcggcctcccagagtgctaagattacaggtgtgagccactgcacccagccctggattgtcactttagattctagacttagaa

SEQ ID NO: 26809 - DNA, 601 bp, Human
tgcagtctgcgagggaggtgtgggggacaagtgcagcttaattctgatgtccaggtgcagaaaggggaagagcagatggagaagccagtatcaaaagaactcattattattgtaaggatgcccactgaaagatgccccgtgttcagatccccatacccttgtatagaaatcttccaaggggcagaaagcccttgctgagattcctaggaatcttcatggacctatgaagcatccctgttactaagtgggtacctaacacatatctccgggttgtcggcttgtttatttgtttgtttgttttttttgagacagagtctcgctctgttggccaggctggagtgcagtggccccatcttggctcactgcaacctctgcctccggggttcaagagattctcctgcctcagcctcccaagtagctgggattacaggtgcatgccaccatgcccagctatttttgtatttttagtagagacagggtttcaccatgttggccaggctggtctcgaactcctgacctcaagtgatccgcccacctcggcctcccagagtgctaagattacaggtgtgagccactgcacccagccctggattgtcacttt

SEQ ID NO: 26810 - DNA, 601 bp, Human
tcatgggggtgatcatcttctcccttttagtagttggcatgcatactttatcctccctttataaatgagcagtgaaactgctcctgagtaagagaagctgggtcttttctatctctctattgtggctacccagtaatttctgaattcatttgttaatttctctagctccaactttccgttcaaatggagaccattctatttgcctccatccagtagcatccttggacccttcatagggaactaactgagcacttctttaatggaaactcctacattaatctcacacatacactctacaagygcttaaaacatggaaatcatggagaggctttgaccaagcatctccaatccaaactattttagcaacactcctcctcacagagttttcctcatttacttcagccagctccttccagagttagcctatggaaaaacagtgggactcccaggaaaacagaaagagatttcacagagaaaatctctgtgagagattttcagtcttcttcctggagatgtttgtgaatagtatcagggaccctctgttgagtgtggcttggctctggggcctgacctagccattgggcagtaggcaggcagtaga

SEQ ID NO: 26811 - DNA, 601 bp, Human
caactgaacatccctagtttcccaagcccaaccatcctcataagacatggtttccagatctaaatatttcccaattcgttctccccagcttcatttcggcatcctctgaggccagatggactcactcactcatgctccttcctttacctgcagtgcttcccctcctggatcccttcatccccaaacctcatccttgaagcctctgctcaaattccacacccttctgaagcctttcctgtgtccataggtgaactcattgctcccagttaaagcacttaatccttcggaccctctcatgggsgtgatcatcttctcccttttagtagttggcatgcatactttatcctccctttataaatgagcagtgaaactgctcctgagtaagagaagctgggtcttttctatctctctattgtggctacccagtaatttctgaattcatttgttaatttctctagctccaactttccgttcaaatggagaccattctatttgcctccatccagtagcatccttggacccttcatagggaactaactgagcacttctttaatggaaactcctacattaatctcacacatacactctacaagtgcttaaa

SEQ ID NO: 26812 - DNA, 601 bp, Human
ttcatacttgtctttatacctcagtctatgcgtctggggccaagtcactgtgtggcacatgtgcagcttccccgaatgcctcacatgttgtagcacctgcttccaggaacaccaaatgaacacagggtcttggaggggaagtgggggaagaacccataatgccccaaggctgcatggaaccacaatccagaaatgtgcatcctgacctggaaggcgtctaaccaagtgtccaaggggaaatatgatcgagggagaggtgagaggagggacccagagggcagacaggagagggttgatttcyaccctttcttctgcgttcagcatatccaaaaggcccaatacagttgatgggccaggaactgcatgacctggattttctccctgtagtgacccacgatgttaattgatgtagaggacagtttgcaaaagtaatagatttgcccttaatcccagacagtatgagatacaattctgggactttgtcttcgtaacctgtctttaaaaaaaaaaaaaaaatgcttgccttgtataacataatccagattccctagagcagatgtggtacagcaatgagcaaatccaacctcagatctgaagtgtc

SEQ ID NO: 26813 - DNA, 601 bp, Human
ctaaaaacaaaacaaaacaaaaagaaacttctttgacttttcttgcacagttgacttgaattttgtgcatagatatttggagtagttaaaaaaaaaagattctgaaatatactcctagatatccctctccattcatattaaacttacttattttacatcattttattttattttgagatggagtctcactctgttgcccaggttggagtgcagtggtgcaatctcagctgactgcaacctccacctcccaggtttagagattctcccacctcagcctcccgagtacctgggactacaggcrtgtgccaccacacctggctaatttttgtatttttagcagagacagggtttcaccatgttggccaggcttgtctcaaactccagacctcaggtgatctgcctgcctcagcctcccaaagtgctgggattacaggtgtgaatcaccacgcccagccaaacttaattatttaaatctaagttgttagctgttagatgaaccgtttctaaactaacaaactcaccgttttaacaacagtaacacttaaaatcactactaatgaaaattctaaatatgcaaactgtaatttcctaatgaaatagc

SEQ ID NO: 26814 - DNA, 601 bp, Human
acgtttgcagaacacaggtaagaggaagccacctgctgacccattcattctgccagctcttccactccatcagtcatcacctccttcccacaccctcagcttctcacctccacttactttttttgacttctgtgcatgggtgtcttctaaatcccacacaacaaccttctcctctctccccctgctcctccctgtgtttcacttggccataaccaggcctgcttccccaggaggaaaaaagaagggagggaatatggggggcggtggagaggcctggggccaaatgacccctcaggtcccytccaggtccaacattctgtaattctgtgattccttgccctaaccacctggtttcagaaaagaaaacaattgcctgtcataaatcagtcattaactgaagccacataaaatttaccttcccccactttaatataaatgtttcttgctatcttgagttcggtgaatgaagtaactgctccatactcttttcgggcccaatttaacagatgttcatttccatgggggaagttcctttcttctgtttctgctgtcaaggagaagtttgctgatgaaaactggaccacagaaccctcagacacct

SEQ ID NO: 26815 - DNA, 601 bp, Human
gtccttgtaatagtcatttgtactaaaaatatatttaaatacttttcctttgctattgtccaaaatgtaacctatgtctcagcaccacaaactgacacaggcttcaaacgtttgcagaacacaggtaagaggaagccacctgctgacccattcattctgccagctcttccactccatcagtcatcacctccttcccacaccctcagcttctcacctccacttactttttttgacttctgtgcatgggtgtcttctaaatcccacacaacaaccttctcctctctccccctgctcctccctrtgtttcacttggccataaccaggcctgcttccccaggaggaaaaaagaagggagggaatatggggggcggtggagaggcctggggccaaatgacccctcaggtcccttccaggtccaacattctgtaattctgtgattccttgccctaaccacctggtttcagaaaagaaaacaattgcctgtcataaatcagtcattaactgaagccacataaaatttaccttcccccactttaatataaatgtttcttgctatcttgagttcggtgaatgaagtaactgctccatactcttttcgggc

SEQ ID NO: 26816 - DNA, 601 bp, Human
ttcctagtaacttatgggggttccaaatatactcaactgaaaataatgacttttaaaaaaaggtctggccaggtgcggtggctcatgcctgtaatcccagcactttgagagaacaagggaggaggatctcttaaccagcagttcaaaaccagcctgggcaacacagcaagacctgtgtctacaaaaaattgtaaaaattagccaggtatgatggcatatgcctgtagtcccagcttcttgggagactgaagcaggagaatcacttgagccctgcaggttgaggctgcagtgagcactgatygcaccactgcactccagcctgggcaacagagcaagaccctgttgaaggaaggaagggagggagagagggagggagggagggagggaggaaaagaatgaaagaatgaaagaatgagaaagaaagagaaggttttttgtttttgtttttgttttaaaaaaggctttcaaaactgggtttctggatatttctatccctttgcaatgcaaggaaatttaaataggcaatctcttatcaagaccctacacttcttttctccaataatttgtccttgtaatagtcatttgtactaaaaatatattt

SEQ ID NO: 26817 - DNA, 601 bp, Human
cagccagctataacaaggacccattcacaagagttatttcctagtaacttatgggggttccaaatatactcaactgaaaataatgacttttaaaaaaaggtctggccaggtgcggtggctcatgcctgtaatcccagcactttgagagaacaagggaggaggatctcttaaccagcagttcaaaaccagcctgggcaacacagcaagacctgtgtctacaaaaaattgtaaaaattagccaggtatgatggcatatgcctgtagtcccagcttcttgggagactgaagcaggagaatcacytgagccctgcaggttgaggctgcagtgagcactgatcgcaccactgcactccagcctgggcaacagagcaagaccctgttgaaggaaggaagggagggagagagggagggagggagggagggaggaaaagaatgaaagaatgaaagaatgagaaagaaagagaaggttttttgtttttgtttttgttttaaaaaaggctttcaaaactgggtttctggatatttctatccctttgcaatgcaaggaaatttaaataggcaatctcttatcaagaccctacacttcttttctccaataatt

SEQ ID NO: 26818 - DNA, 601 bp, Human
cttctgcacgtagcatcctctccgacgtccacgtccacctttcctgcctctgtctctcacacactttaaagcagcccagatccaaataagagttgggatcaagtgttcactaacccacccttccctgtcttgtctatgaggaggtgacagctgctgtagaatttaacagaaagcagctggatgctgaagaccttaaacgcagtgttcacacaatcagccagctataacaaggacccattcacaagagttatttcctagtaacttatgggggttccaaatatactcaactgaaaataatgayttttaaaaaaaggtctggccaggtgcggtggctcatgcctgtaatcccagcactttgagagaacaagggaggaggatctcttaaccagcagttcaaaaccagcctgggcaacacagcaagacctgtgtctacaaaaaattgtaaaaattagccaggtatgatggcatatgcctgtagtcccagcttcttgggagactgaagcaggagaatcacttgagccctgcaggttgaggctgcagtgagcactgatcgcaccactgcactccagcctgggcaacagagcaagaccctgttgaagga

SEQ ID NO: 26819 - DNA, 601 bp, Human
gcaggttcacttagccctccactaagccctctgtaaaatggtggaaatgacatcttcctcctggggttactgtggggttaagtgggatgcacgtgaaggcccctgaaatggcttctgcacgtagcatcctctccgacgtccacgtccacctttcctgcctctgtctctcacacactttaaagcagcccagatccaaataagagttgggatcaagtgttcactaacccacccttccctgtcttgtctatgaggaggtgacagctgctgtagaatttaacagaaagcagctggatgctgaagrccttaaacgcagtgttcacacaatcagccagctataacaaggacccattcacaagagttatttcctagtaacttatgggggttccaaatatactcaactgaaaataatgacttttaaaaaaaggtctggccaggtgcggtggctcatgcctgtaatcccagcactttgagagaacaagggaggaggatctcttaaccagcagttcaaaaccagcctgggcaacacagcaagacctgtgtctacaaaaaattgtaaaaattagccaggtatgatggcatatgcctgtagtcccagcttctt

SEQ ID NO: 26820 - DNA, 601 bp, Human
aggggtaatcaacattctttcatgctactagaattctgcttcagaaacgcggcccgctggccagggcttagagtctttattaaaagaaatttttcattttgtctcaatgggatttgacctctgttattagctacctatcatgagagtacagaaacaaacttagactttttgagcccagccctcctctaagtccccttctctctgcctcaactaaacaaggatgttcatccaggtggaccacttccctttttgagttatgcttatttggctaggacttaaagtacagctcaggcaacaagcrttaaactcaagagtcaggaagcctgggtttgtgttctggctttgtcacttgttagtaacttggatgtgagcaggttcacttagccctccactaagccctctgtaaaatggtggaaatgacatcttcctcctggggttactgtggggttaagtgggatgcacgtgaaggcccctgaaatggcttctgcacgtagcatcctctccgacgtccacgtccacctttcctgcctctgtctctcacacactttaaagcagcccagatccaaataagagttgggatcaagtgttcactaacccaccc

SEQ ID NO: 26821 - DNA, 601 bp, Human
cagttcccaaacgtcagcaagcatcagatctcctaaagggctgattgaaacactgactgctgggtcccacccccagagttcctgattcagttggtctgggttgggcctgagaactggcatttccatcaagtccccaagtgatgcggatgctgctggggcaaaaaccacactctgagaactgctcgggttagagcaaccaggcctcatggcctgcgatcgctgggtacaagaaaggtagagccaggtcggattctgggaagtgggggatgaagcttgctcagtgcagtctgagccgtggtgrtaaacatatcactttatggtccactgacctcaccaaggaacctcctttccctactgctcctctctccacggcatggcccggtgactcatactcaactggtggctggagtcaagtttcaggggttccgaaggtgttaccaaggagttaacagtttttactgcaccagacacaaggtcctttaagttggcttcccctacccagtgtgcacaggctgaaccagttaagtgacaacccgtggctctcagggtaagtgactactgtgcttagaaagaagctcatgcactgccgagagaacacagt

SEQ ID NO: 26822 - DNA, 601 bp, Human
tgtcactaagttgaataagctgaccacttttgttgtgtgtggtttctcccccgctccccaatgactttccgaatgcctggcatcaaaacttataccgagtgccaagtagaaaggaaaccacaaaggggaattcccgggtagaaacctggcaagtttgggggcagggggagtcacatgcttatttgtattttagggaaagattgacaaatgactttgagacacagaaggatatactctgagagcaggaatgaacctggggggtaatgcaaacacctcattttcctgctgtggaaactgaggmtctggtggtaagtcaatgttgcttgaagcctcgcagcaagaccagctgggataagagcaaaactcttaaattctttcattctgggtatatagatgagagcagttcccaaacgtcagcaagcatcagatctcctaaagggctgattgaaacactgactgctgggtcccacccccagagttcctgattcagttggtctgggttgggcctgagaactggcatttccatcaagtccccaagtgatgcggatgctgctggggcaaaaaccacactctgagaactgctcgggttagagcaaccagg

SEQ ID NO: 26823 - DNA, 601 bp, Human
aaaatattcactcatgtgaagccactaggaaaggtctaattgttcaaaagttgatgttattaagggctctagtcccagaagccattgtcactaagttgaataagctgaccacttttgttgtgtgtggtttctcccccgctccccaatgactttccgaatgcctggcatcaaaacttataccgagtgccaagtagaaaggaaaccacaaaggggaattcccgggtagaaacctggcaagtttgggggcagggggagtcacatgcttatttgtattttagggaaagattgacaaatgactttragacacagaaggatatactctgagagcaggaatgaacctggggggtaatgcaaacacctcattttcctgctgtggaaactgaggctctggtggtaagtcaatgttgcttgaagcctcgcagcaagaccagctgggataagagcaaaactcttaaattctttcattctgggtatatagatgagagcagttcccaaacgtcagcaagcatcagatctcctaaagggctgattgaaacactgactgctgggtcccacccccagagttcctgattcagttggtctgggttgggcctgagaactg

SEQ ID NO: 26824 - DNA, 601 bp, Human
gctgctttgggttgaaggtactcagcaaggtaattgagtgagagaaaattcttccctatgttgcactttggagggaacacttgatctgaaagaggcacaggacaatctgtcaaaccactgaggtactcggtaaccagattcaaaggaaggagggtgacagtgaaactgagcaaatggcagacacagggaaccacgagctcaaaggatggttcttcgtctgtgaagtccgcaaccactgccctgaaatgcatcctgttatggtcaccagtgaccgcctattgactagcccccaactaggggyctcttttggctaaatcttctccttgcatgttctctgtgatacttcctgtcctcgtctgtttcctctgacctatctttcacatctcttccactggttcctcctctgctcagaatctgtatagaccccaacccagagaatctgattcagaacacccaggcggggcctagggagctttcttttttgaaaagctcgtagtagattccaatataaaccaaggctaagaacttctcagctccttcctcaatcccctttctatctcattctttttctaggtgatctcaatcactcccatggtttcaa

SEQ ID NO: 26825 - DNA, 601 bp, Human
caagtcaaggaagatctttactttcatctcttgtcacactcacacacttagactcacttacctgtaggggttagagttgggggtgattagctcgatgatgtgtacttcctcattctggggctggctggacatcacacacccttctgctgctttgggttgaaggtactcagcaaggtaattgagtgagagaaaattcttccctatgttgcactttggagggaacacttgatctgaaagaggcacaggacaatctgtcaaaccactgaggtactcggtaaccagattcaaaggaaggagggtracagtgaaactgagcaaatggcagacacagggaaccacgagctcaaaggatggttcttcgtctgtgaagtccgcaaccactgccctgaaatgcatcctgttatggtcaccagtgaccgcctattgactagcccccaactaggggcctcttttggctaaatcttctccttgcatgttctctgtgatacttcctgtcctcgtctgtttcctctgacctatctttcacatctcttccactggttcctcctctgctcagaatctgtatagaccccaacccagagaatctgattcagaacaccca

SEQ ID NO: 26826 - DNA, 601 bp, Human
ggctctttggtatggcaccatgaagagccactccaccacacacgtgcatgcgcatacacacacacacacacacacacacacacacagatttaacgcaaacagctctgagtgcctaagcgctctaaggacaccacaaacagagctttattaaaaacagaaggttactaagatgataattatattaatagggcatattttgtaattttcctatcagggataaccttagtcagaggtgataaagatgaaggaagagtgactgtgtcctgtaattaacacccagaagtttggaacaggcttcagraattcatctgaaatatctgggatctagggacagatgcagaatataaaatataccactggtgcctttactctgttcttcaaagcttctgtgaaacacatctgatgaagcacacctgaagcatcaatggctaccttccctcctgcgtgaagcatcaatggctcccttccctcctgcgtaggggagggtgtaggacgggctacacctctccctgcctcaagtcaaggaagatctttactttcatctcttgtcacactcacacacttagactcacttacctgtaggggttagagttgggggtga

SEQ ID NO: 26827 - DNA, 601 bp, Human
cacacacacacacacacaccaagcacacaagggagaggcaagttctatcgaatggctctttggtatggcaccatgaagagccactccaccacacacgtgcatgcgcatacacacacacacacacacacacacacacacagatttaacgcaaacagctctgagtgcctaagcgctctaaggacaccacaaacagagctttattaaaaacagaaggttactaagatgataattatattaatagggcatattttgtaattttcctatcagggataaccttagtcagaggtgataaagatgaagsaagagtgactgtgtcctgtaattaacacccagaagtttggaacaggcttcaggaattcatctgaaatatctgggatctagggacagatgcagaatataaaatataccactggtgcctttactctgttcttcaaagcttctgtgaaacacatctgatgaagcacacctgaagcatcaatggctaccttccctcctgcgtgaagcatcaatggctcccttccctcctgcgtaggggagggtgtaggacgggctacacctctccctgcctcaagtcaaggaagatctttactttcatctcttg

SEQ ID NO: 26828 - DNA, 601 bp, Human
gggagaggcaagttctatcgaatggctttttggtatgtcaccatgaagggccactccagcatacacacacacacacacacacacacacacacacacacaccaagcacacaagggagaggcaagcgctatcgaatggctctttcgtatgtcaccatggagggccactccagcatacacacacacacacacacacacacacacacacacacacacacacaccaagcacacaagggagaggcaagttctatcgaatggctctttggtatggcaccatgaagagccactccaccacacacgtgcrtgcgcatacacacacacacacacacacacacacacacagatttaacgcaaacagctctgagtgcctaagcgctctaaggacaccacaaacagagctttattaaaaacagaaggttactaagatgataattatattaatagggcatattttgtaattttcctatcagggataaccttagtcagaggtgataaagatgaaggaagagtgactgtgtcctgtaattaacacccagaagtttggaacaggcttcaggaattcatctgaaatatctgggatctagggacagatgcagaatataaa

SEQ ID NO: 26829 - DNA, 601 bp, Human
aacacaacccaaacttctaagaattcgtaaaaaagagaattttttactaaacaataacatccctgtcattctgaatttaagggaacagtctttctttccatctcagctttacacacttgtaaagcataaaatgcatggtatactccaatgaagcctcaggcctgacgtcgaagcacattcaccagactgctcctattcccattcccttttcactttctacaaaattcttcaagtggccagagtggaatcttatcaaaacgatctgtagcttacacgctttgaaagtcaaaccccgattagmattttcacctcgaaatccctctacaatatacatttaaattttcaagtcactagtccagatgcaaaggaaggagggtgaaatgcaggctcatgtgggaaaagaacctactttttctcctttttctttaattccctaattattcttgatagggagggtcgaatttccaatccaggggtaggaagctgagagggagaacaagcgcacaagggagaggcaagttctatcgaatggctttttggtatgtcaccatgaagggccactccagcatacacacacacacacacacacacacacacacac

SEQ ID NO: 26830 - DNA, 601 bp, Human
actatctcccctcttccaagtcttcatgtttctagtgtctggccagttgattaaaaagctggagttgatcccaggccaatgacatgtgcaaaacagattgttactgcacacataacaaaattgttttacataacaatagaaacatatgcttgctgataattagtcactaaagtttttctcttctttgatggaaaagaggtggttacttaatgcagccactgtttgaagtggacttgaacgaaccagaagagtttacttttgaagcagtattgttgctttttcaaccttcaacaccttcgaygtacaggattcccatttggctaatatgctcaaattccttcaaaactgaagtaggtggcagtttggtgagttgggggcggggtgttgggataagggaagcatggtggtaaaaaaaaaaattaggaaacttcagagtaaaataagagacaaaaggctaaagaatttcttgatttatataaggtttgcttaagtcattaacaattgctacagaatcgtatctgcatttactttcccaaacttctggatataaggttattaaaataaagaaaacagatggtcaaccaagtgattactggaaaat

SEQ ID NO: 26831 - DNA, 601 bp, Human
gcccatagaagagatactaaagagataattatcttcttaaaaaatagggaggaggatttttctttaactttcaatataattcagtcaaatagttattgcctaagcatatttgagataagatttactttaccaagtttcaacattcaacttttgaggaaaccagctgctgtttgcccatcatgccaatgggctaagccttgtgcgtacatctctattaaatagagggccttgggaacaagctggagtagacttgtccagcatcatttcactgacttcgcacttactgtgattcttctatcaktgtttcacacttaggagttggaagcaagcaaaaagacatgccaatatttcgtatttaactcaaaaagaaaagtcaatgatgtgagctggggtcagcctaatagtccatactttctctaagtacctaactccaaaataaaagctgatattcggtactatgacactgaggtccttgtgggatgctcaatatgaaggcttaattgtgttcattactttacacttactattagtggaaagcatactaatgtatttcaggaatttcacaaatgagggagctggggttcagagaggttaggggact

SEQ ID NO: 26832 - DNA, 601 bp, Human
taaaaaaaaaaaaaacccacgggaaccagaaacgattactttaaaattaaaatatgtgtgctagtggttttgcctgctgcctctggtgagtgcttttacatgacgttgccaagggaactgttggctttgctcactgtggtatcacatggaaggtgccatgaatgaatgaataataccaaaaccaagggcatccctctcccaaaatactgaaaacataaaacccacttcagcttactcagtgcaggaactaaaagagagattggccaaaaaaaaaaaaaaaaaaaaaaaaaatttgagcccrtagaagagatactaaagagataattatcttcttaaaaaatagggaggaggatttttctttaactttcaatataattcagtcaaatagttattgcctaagcatatttgagataagatttactttaccaagtttcaacattcaacttttgaggaaaccagctgctgtttgcccatcatgccaatgggctaagccttgtgcgtacatctctattaaatagagggccttgggaacaagctggagtagacttgtccagcatcatttcactgacttcgcacttactgtgattcttctatcagtgtt

SEQ ID NO: 26833 - DNA, 601 bp, Human
catcatacccatttcacaggtgaccaaacagactccgtgttcatcagtcagactgcacaacatctactaggagtagtaattggaaatgggatttaaatctagccctgtctggcacaaagtcaagattctttcaatttcactatgctgtctctaaaggaaatactagaaacaaggtttctataaaccattgccccctttctaaatagtaatttaaacttttgtgggagcaggtacctttccctcacagcacagtcagaattcacatctgaaacagggaattagaaaatcacaaagcataaaytggttgggagaataaaaaagaacatcatgaaacattacctaattgtttagtaatgttgtcatgcattgtccaaaattggcctggaacaagcgtacagccaaggagaggaacataaacagatcttgcactgggatgagcaatctcatttctagcctttctgattcatatgagagatggggacattcaaagtgaactccaggactgccatggaccaggcacacatactcagggaaagagccatcgaagggtcaaggctgaaagaatatttacacaagaactccagcagggaattaaaatgta

SEQ ID NO: 26834 - DNA, 601 bp, Human
agggctagggaggaaagaaacaaagaggaaggaaggaaggaaagagctaaaatgagatcatgaaagatccaatttattcttagaactttttatgcattcagtcaacagtagtttcttaggtacagcttcttccagccttttagagctacatgtcattttgattggctggaatcacaacaattggcctaaacaacactgcttgccctcatctgccctagtctctttcatgttgttggacagctgagaaaatatcgtatttccagaacactatcatcataactgccacctgtccttttgcacyaatgtggaatgagctgtttgcacctttccacattaaatctaggagctgtcaatacatctcattttgattatgtctgggaacttaaaagactcaacatctatctacacatttgtaaagcagcaaggcttgggacaatggcagacaagttggttcccagctttgagcaaattctcacactgtacttctggaagtccctaggctttttccagctttagtggagctacgccaaatgcaggtgtacaaggaggtctccaaaaaccaccaccatctttcccagccatatcttcatgaaagataagg

SEQ ID NO: 26835 - DNA, 601 bp, Human
ctcactgactgaaccatattatatgctcaagactgtacttcagtgtggagactatcccatctatataaactattaaattccacatggtaaaacaaccaatgtttatatttcatctaaaatgtatgatcaattagtaattctataactgtattcatttgccaattctactaactgaatatacttgtatcttctattctaaatattaattaattaatttaggttactctccccttaagtatcactgttttatccagtaatacaagtaggtcttaagattagctttcagggatgggtgcaatasttcacacctataatactagcatttggggaggctgaggcggaaggactgcttgagcccaagagtttgagacgagcttgggtaacacaggaagatcccatctctacaaaaattttaaaattagccaggcatggtggcatttgcctgcagtcccagctactcaggaggctgaggtgggaggatcacctgagcccgtgagttagaggttgcagtaagctatagtcatgccactgcactctagcctgggtgacagagggagaccctgccttaaaaaaaaaaaaaaaaaaaaaaaaaaaagactag

SEQ ID NO: 26836 - DNA, 601 bp, Human
ctgaatactgtaggcagtagtaacatgatggtcggtatttgtgcatctaaacatagaaaaggtacagtaaaaatatggtattacaatctgataagaccactgtcgtatatgtggtccctcactgactgaaccatattatatgctcaagactgtacttcagtgtggagactatcccatctatataaactattaaattccacatggtaaaacaaccaatgtttatatttcatctaaaatgtatgatcaattagtaattctataactgtattcatttgccaattctactaactgaatatacttrtatcttctattctaaatattaattaattaatttaggttactctccccttaagtatcactgttttatccagtaatacaagtaggtcttaagattagctttcagggatgggtgcaatacttcacacctataatactagcatttggggaggctgaggcggaaggactgcttgagcccaagagtttgagacgagcttgggtaacacaggaagatcccatctctacaaaaattttaaaattagccaggcatggtggcatttgcctgcagtcccagctactcaggaggctgaggtgggaggatcac

SEQ ID NO: 26837 - DNA, 601 bp, Human
tattcctacgcccaggttgtaccccaaacaatttaaactcagactctctggggtggtacccaatcattaatatgttttagtctctccatgtgtaactgcaatgtgcacctaagactgagaaccaatggaatagacagtttctaaggctgtccaagctagaaaaatctgtgatttaagttacatgatgcaataatattccattgaaatgccactaaaatactttccttgaatcaagagagtcttttgaataatttctctaatgatgtcttgaaacaatattggtatgttaaaattacttcaycaccttctttttgacagctaaattttaacaggtatctgggcaccttggccttttggaacatattcccttgaaagataagaaatagctgcatagatacatttattccttcaaagggagagacgtatttccatacaatcaatactcaatattttgtcgtatttctaacaactaaaaaaataataatttccccagtattctttatatctactatctaaggccaactgatgtacacttgaggtcaaatccatctcagtggaagctggaagtgaagatgatagttggacattatctctcctttaa

SEQ ID NO: 26838 - DNA, 601 bp, Human
ctctgtgcctcaaatttgcttttccaattttttaaattaagtggttggaaatgatcagtggttcttaactttggctacacatgaaaatcacttgggagctttaaaaaatattcctacgcccaggttgtaccccaaacaatttaaactcagactctctggggtggtacccaatcattaatatgttttagtctctccatgtgtaactgcaatgtgcacctaagactgagaaccaatggaatagacagtttctaaggctgtccaagctagaaaaatctgtgatttaagttacatgatgcaatawtattccattgaaatgccactaaaatactttccttgaatcaagagagtcttttgaataatttctctaatgatgtcttgaaacaatattggtatgttaaaattacttcaccaccttctttttgacagctaaattttaacaggtatctgggcaccttggccttttggaacatattcccttgaaagataagaaatagctgcatagatacatttattccttcaaagggagagacgtatttccatacaatcaatactcaatattttgtcgtatttctaacaactaaaaaaataataatttccccag

SEQ ID NO: 26839 - DNA, 601 bp, Human
ggggtcgaactagcagccacagctcagccaccccatgtcaaagctggatatggcactaagaagacaccccccctcccaccccaacccaccctgtgtcaaaggtggacacagggatctctgagccttatttttaccattaaaagtaaaacccaaaatgcaaaatcagcactttaaagttcttttggaacttcacattttaaattcttttaatattcactgcctagtctctgcacccaagagaatgggtttaatctgaaaagattttgaccaactgagaagaaagatttctggaaaatgcagsttagctattgcaacggtttatcattgggggaaatctgtggaatctttctccaagtaacttcaaaagtaggagagtttcttcaatgtatggtctttcttagaggtggagagagacttaataattccttaaaggtcctttttgagttttaaattctctttttggatttttattcatgaaggagggagaagttctcctacttctggacgagactcaaatgaggccagagagaccacacatctggttaacccggctgtgcagaggtgctgctcgttcatatagcccagggccttaaaattttat

SEQ ID NO: 26840 - DNA, 601 bp, Human
tcacctgtgaaatgaagaagctgaataagctcatcttagggttatttgctgctccaacagtctaatattctctgaggaacaatatgcttgggttcatgggagagtcacttcccacaggaaccacgctgaccagagcacctgattgctagcctctcttctctggatggggtcgaactagcagccacagctcagccaccccatgtcaaagctggatatggcactaagaagacaccccccctcccaccccaacccaccctgtgtcaaaggtggacacagggatctctgagccttatttttaccrttaaaagtaaaacccaaaatgcaaaatcagcactttaaagttcttttggaacttcacattttaaattcttttaatattcactgcctagtctctgcacccaagagaatgggtttaatctgaaaagattttgaccaactgagaagaaagatttctggaaaatgcagcttagctattgcaacggtttatcattgggggaaatctgtggaatctttctccaagtaacttcaaaagtaggagagtttcttcaatgtatggtctttcttagaggtggagagagacttaataattccttaaaggtcc

SEQ ID NO: 26841 - DNA, 601 bp, Human
taacatccaggctttttcgaattatatcttcaaagtgatgaagaataaggagaaacccaatgcaggttcaagttaaaagctaaactaatatttgtatcttctcttgtgaaaaataaatatttatgttgtaaccatattgaataattacaaatgatttcaaatggtgggaaaacactagatactagaatggagttgaatggagttgtcaagagacttgcctataccgtgagaaggggcttccccttaagagtctttatattataaactctaagaactactagcagttggcgaatacaagaakctttggttatatatatcctttaagagttgtagaaagtttggttggagtcagcagcgaaggacctaatgtttggttatatatatcctttaagagttgtagaaagtttggttggagtcagcagcgaaggacctaatgtttactatggagcacatctcttcattgccgctcttgtacccctctaacttttgctcatttcttccctaagaaatctttctctatggtgtatggatgtggaaaagaatacgttttattccaggaatcttttttttccacctttttcgctatccacctgcagatata

SEQ ID NO: 26842 - DNA, 601 bp, Human
ctgccctgctgggggctaaggggactgtgcagggaaaaaaaaagaaataaaagataacatatgaggtggttttgaaatattccatggttaactctaacactgcaactactgaactactgttccaaaagcaaaggacagggctttaccagtagaattcacacttgccaatttttttttttgttaacattcatctacaaaatactgtcttcacttagcataatgtattaaatcttgaaatttcctgctttggtcagaagtcagtctggaagcgttctctgagccaatccctcatcagacctgktgaaggtctgtgaggtaggacaggaagaggtctgtacagggtattttagctgatgtctaaggaactatagcccagcactaacctaaaaggtcaaggctaactttcaggtctcacctcaacataaacgtgtccattctctggcacagagaagacgccctgggagggcaccaaaaagaggtcagtgttgtatagctccatgttgaaggtgatgtttccgtggggctgttcctggaagctgctggggttcctcacctgctgaaggctgcaattaaactggaaataacaacccacaggaagatt

SEQ ID NO: 26843 - DNA, 601 bp, Human
ggatttggctgccctgctgggggctaaggggactgtgcagggaaaaaaaaagaaataaaagataacatatgaggtggttttgaaatattccatggttaactctaacactgcaactactgaactactgttccaaaagcaaaggacagggctttaccagtagaattcacacttgccaatttttttttttgttaacattcatctacaaaatactgtcttcacttagcataatgtattaaatcttgaaatttcctgctttggtcagaagtcagtctggaagcgttctctgagccaatccctcatmagacctgttgaaggtctgtgaggtaggacaggaagaggtctgtacagggtattttagctgatgtctaaggaactatagcccagcactaacctaaaaggtcaaggctaactttcaggtctcacctcaacataaacgtgtccattctctggcacagagaagacgccctgggagggcaccaaaaagaggtcagtgttgtatagctccatgttgaaggtgatgtttccgtggggctgttcctggaagctgctggggttcctcacctgctgaaggctgcaattaaactggaaataacaacccaca

SEQ ID NO: 26844 - DNA, 601 bp, Human
catgatctagaaaaaaaaatgtcatgagttataatagcacatagcatttcacttaaaagtgagtgcaatttaaaagataacaagtcagtttcagtggcggcatggacccacagggatttggctgccctgctgggggctaaggggactgtgcagggaaaaaaaaagaaataaaagataacatatgaggtggttttgaaatattccatggttaactctaacactgcaactactgaactactgttccaaaagcaaaggacagggctttaccagtagaattcacacttgccaatttttttttttkttaacattcatctacaaaatactgtcttcacttagcataatgtattaaatcttgaaatttcctgctttggtcagaagtcagtctggaagcgttctctgagccaatccctcatcagacctgttgaaggtctgtgaggtaggacaggaagaggtctgtacagggtattttagctgatgtctaaggaactatagcccagcactaacctaaaaggtcaaggctaactttcaggtctcacctcaacataaacgtgtccattctctggcacagagaagacgccctgggagggcaccaaaaagaggt

SEQ ID NO: 26845 - DNA, 601 bp, Human
gaccctttaagcttctcacccctcccactatgaagctgagcttgcagctgagcaccaaaaccagctcattagatgaggaccttcccataagaccaacagatgatatgcccacttgaaacactaaggttgaaacatgaaaggttgtacccagggcacaagaaacagcagacatcctggtgccataaggacatttatcttttctagaatccactctctgaacctggatgtttgcattgataagacgttatgttttctcccctttcaaatggcactttggagataagtgatagtcgtatccagygaagatcagtcagagctctggagtcacacggcctatgagcactgaatctgaactccactagtaccagctgtgtggcctcagacaaatttgtgcctcaattttctcatccataaaatgaagatattattagcctcccttataggatggctctaaagagttaactaactgctgcaatacttacaactctgtttggcacataataaatctgcagcaaatgttagatgttgttatttcattattaccgccactgcctaatattgtgtagtcactccagattccagatttaggttgcacatgatt

SEQ ID NO: 26846 - DNA, 601 bp, Human
caagtaagccagcatttgaaggatgggggaaaaaacccaaaatatccagggtaaggtacaggaggaagattgaccactgattagcataaatcagcaaagccaggcatagatttggaaaagaacaatctgcaattatgcagcacccctgaaatccacagcgcaatagggtgctgttgaccaactgcccatgtgaactgtacagccagaaaagcaagagaaaaacagccatcttggcttaggaaaagcatgtagaaggcagtatattttccccaatggagaaagaaggtgtgctcaaagaaakagaactctcagaatgggggaggggcagaatccatatgatcaaggaaaacaacatctagcgccagcgggctctgtcccagagtcagtgcgaatgtgagagttatgtgtctttccaaaacagaaacacgtgcaccaaagtcacttttaacatatggaagtaccccactttgaccctttaagcttctcacccctcccactatgaagctgagcttgcagctgagcaccaaaaccagctcattagatgaggaccttcccataagaccaacagatgatatgcccacttgaaacactaaggttgaaa

SEQ ID NO: 26847 - DNA, 601 bp, Human
cagtaggcaaagtccctaatgttttaatagtacaacacttataagctaagctctttttaaagactgaccaaaaaatagagttcagcggcaaaatctatttaacctaggcaggaagactgagcttctaaattgcaaaaagtcagagtaagcctgatgagagtcctgcttcatcggcgagaaggcagagctggctccggcgctgggtgtcagtgacggtgcaacctggaggccatcatgggcctggtaaagtgtcccagctgctcacagatccaaatcagccttgccaagtactcccccttcrctccataagcccaggggtagtttaggggaaatctaatctggaaacgtttccgactcatttatacttccccctttgaaaacacttgtatgggctacgtccaaattttgttaaggttcttttccttagaaacaggaagtaatgtttagccaagtgtaaacagaattcaaacctcaactatcctgaacttagctaaaatccccagaccagaggagattctccatttggtgacacgtggatcactgcatgaactgcccctccctgctatgcctcattctttgactaaatttaggatcaaaataa

SEQ ID NO: 26848 - DNA, 601 bp, Human
attacaaaagtaacacacacacgttgaaagaaaaagatattttccacttcaatttgatatagatgatgacagtgaattatttctttcaaatattagtccattagattcaaatacaagatgagtaagtctcttccacctcccaatgagtcctctgagagctaaaaataaaaacatattttgcatttaaagtggattttccgaagtaaataaaacaccagtaggcaaagtccctaatgttttaatagtacaacacttataagctaagctctttttaaagactgaccaaaaaatagagttcagyggcaaaatctatttaacctaggcaggaagactgagcttctaaattgcaaaaagtcagagtaagcctgatgagagtcctgcttcatcggcgagaaggcagagctggctccggcgctgggtgtcagtgacggtgcaacctggaggccatcatgggcctggtaaagtgtcccagctgctcacagatccaaatcagccttgccaagtactcccccttcgctccataagcccaggggtagtttaggggaaatctaatctggaaacgtttccgactcatttatacttccccctttgaaaacacttg

SEQ ID NO: 26849 - DNA, 601 bp, Human
agcatctcactttcactttaggcacaaggaccatatgccaagacagcccttcagatgacacgctgctttatcttcataacatagttatagccttctttctaattacaaaagtaacacacacacgttgaaagaaaaagatattttccacttcaatttgatatagatgatgacagtgaattatttctttcaaatattagtccattagattcaaatacaagatgagtaagtctcttccacctcccaatgagtcctctgagagctaaaaataaaaacatattttgcatttaaagtggattttccraagtaaataaaacaccagtaggcaaagtccctaatgttttaatagtacaacacttataagctaagctctttttaaagactgaccaaaaaatagagttcagcggcaaaatctatttaacctaggcaggaagactgagcttctaaattgcaaaaagtcagagtaagcctgatgagagtcctgcttcatcggcgagaaggcagagctggctccggcgctgggtgtcagtgacggtgcaacctggaggccatcatgggcctggtaaagtgtcccagctgctcacagatccaaatcagccttgcc

SEQ ID NO: 26850 - DNA, 601 bp, Human
tatggagagataaagcacgtttggatggcaaatcccagttcttgttcagccttagtaacagatacctatgaaagaacagaaagatgaattaggaaatgagttagcatctcactttcactttaggcacaaggaccatatgccaagacagcccttcagatgacacgctgctttatcttcataacatagttatagccttctttctaattacaaaagtaacacacacacgttgaaagaaaaagatattttccacttcaatttgatatagatgatgacagtgaattatttctttcaaatattagtscattagattcaaatacaagatgagtaagtctcttccacctcccaatgagtcctctgagagctaaaaataaaaacatattttgcatttaaagtggattttccgaagtaaataaaacaccagtaggcaaagtccctaatgttttaatagtacaacacttataagctaagctctttttaaagactgaccaaaaaatagagttcagcggcaaaatctatttaacctaggcaggaagactgagcttctaaattgcaaaaagtcagagtaagcctgatgagagtcctgcttcatcggcgagaaggc

SEQ ID NO: 26851 - DNA, 601 bp, Human
agactccataaaactcacagttccctgctaatagtgactttaatatttcagttgggcagttccaaaacaaaaaacctcaacctgcaagaccttgggattaaacttttctgcctcacctaaaaatgccaaaataaccatccgaatggatgaaggcccacaaaccttaggcaacttctgggggtgcttctccatcttcgtacacagcgtcagctcacactgtagaaagagcagtgaggtgttgaagacaggcttgaagacaaagctgaatcgcttcttatccatgtcagcttgcgggataggraagtgcactctcttgggactgtagaatttcacagattcatctttaggacaaatattctcaataatggtgtaatgagacatcctatcagggttcgaatatggagagataaagcacgtttggatggcaaatcccagttcttgttcagccttagtaacagatacctatgaaagaacagaaagatgaattaggaaatgagttagcatctcactttcactttaggcacaaggaccatatgccaagacagcccttcagatgacacgctgctttatcttcataacatagttatagccttctttctaa

SEQ ID NO: 26852 - DNA, 601 bp, Human
gatgaactgatatgaaactgagaaaagctaaaatatttgttagtttcccctagaagtctccctgagacaagtcaaccttatatttcacacagaaaaggttaaaaaacaatgacaatgccagtcccagcaggacctggaaaaattaattctcacaatgaacttgtcctttcggcttgctgtatttttggcctgcaaactatctgaaaagcaaagataaagccagaaatctccctccatggaaaagcgtcttgatttatcactcgtaaggtactactaagtagcacgcatggaaaaaagaaamtcatgctgtcaggatttattatctaagactccataaaactcacagttccctgctaatagtgactttaatatttcagttgggcagttccaaaacaaaaaacctcaacctgcaagaccttgggattaaacttttctgcctcacctaaaaatgccaaaataaccatccgaatggatgaaggcccacaaaccttaggcaacttctgggggtgcttctccatcttcgtacacagcgtcagctcacactgtagaaagagcagtgaggtgttgaagacaggcttgaagacaaagctgaatcgcttct

SEQ ID NO: 26853 - DNA, 601 bp, Human
acagaataaatgcacatatgaaattatacataattatggcagatcacagaaacaaaactatggcagaagatacctttcatatacaagaccaacctagtgggtatcatagttaaccttgcagatctcccctatcaaatgcattccaccaaggtcaaatggttctgctttttgttatggcaatagaacattcaatctggagagtgacaggaggcaaatatgatgaactgatatgaaactgagaaaagctaaaatatttgttagtttcccctagaagtctccctgagacaagtcaaccttatawttcacacagaaaaggttaaaaaacaatgacaatgccagtcccagcaggacctggaaaaattaattctcacaatgaacttgtcctttcggcttgctgtatttttggcctgcaaactatctgaaaagcaaagataaagccagaaatctccctccatggaaaagcgtcttgatttatcactcgtaaggtactactaagtagcacgcatggaaaaaagaaaatcatgctgtcaggatttattatctaagactccataaaactcacagttccctgctaatagtgactttaatatttcagttgggc

SEQ ID NO: 26854 - DNA, 601 bp, Human
tgagaaaattccatacatacattattaataatactgcttgattcttagccttttagacattgatatatgactgcgaaaggactggaaatcagtttactctgtgtgagatagccacagaataaatgcacatatgaaattatacataattatggcagatcacagaaacaaaactatggcagaagatacctttcatatacaagaccaacctagtgggtatcatagttaaccttgcagatctcccctatcaaatgcattccaccaaggtcaaatggttctgctttttgttatggcaatagaacaytcaatctggagagtgacaggaggcaaatatgatgaactgatatgaaactgagaaaagctaaaatatttgttagtttcccctagaagtctccctgagacaagtcaaccttatatttcacacagaaaaggttaaaaaacaatgacaatgccagtcccagcaggacctggaaaaattaattctcacaatgaacttgtcctttcggcttgctgtatttttggcctgcaaactatctgaaaagcaaagataaagccagaaatctccctccatggaaaagcgtcttgatttatcactcgtaaggta

SEQ ID NO: 26855 - DNA, 601 bp, Human
gacttgaggtttagggttatatcccatcatgtcatcccctgaggcttagaactctctttacgattaattttcccagattaacacacatgaagctgggctgttccaggccaggtcagagagaagtaacagccaaagccacagcaaagatccctggtaactgctaggtctcccctccaagacctctaacccttaaacgttacccttctgcccacaggaagcagctggtcccacagccacacatgaagctcctcatggctctctaccactgtccactaagccccaaccctgatggtgaatgccyacaaggctaaggcatcaccgccgcaaaagcaaacctaggaatatagtctaaatcactgtatatgtgctccccaatgattatgatcatatctgctctattttcgtatgcaaacaaaattctcttgggtgttatcagagaaaaggatgcccaggggactataatgatgcaaggaattcagatcaattgtaatctatttggaaatggtggtttttcctcctacctccatacctaagacttaaaatctgtgagttaaatgagaaaattccatacatacattattaataatactgcttgattctt

SEQ ID NO: 26856 - DNA, 601 bp, Human
ctttaggccttgctgtcattgctgctctgagcaacatgccagtcagacacttcttataagacaaccctcactgccctactcttaccccctcaaaaagagaaaagcctttaacaagagccctcttgtaaagaaaaacaacaaattttctgtggagaggcatgatgactgaaaagagttgcattttgctttcctgttttagtttactgttactttcctattgagctcttcagttaagcaagagtctatgattccgcatttaactcagtggagtgtgaccctgggcaagacactctgctctccrggtctcggtttcatcagcaaagggcagggttggtctcaacaatctctgagatctcttcctagaagattctttggcgctctctattgtcacagaaagcactcagaaaataatagaaatgtgaaaatattacctataagcagcaaacagaaagacagtggtaacagctcatccaagcctctgccagataaagggctgtcattgtacatactgtcctatttgctcctctacccaggagggaagccaggtatgattataacagtttatgaggaaatacaggctctaaggggtccagagactggc

SEQ ID NO: 26857 - DNA, 601 bp, Human
acattttagtgttagtttgaaaaacagaaaaactatatgcctagtgttggtcctcaccaagctgggcttcatatacacggttcatgtttgtgattggtgattgtgggaaatttcccataaagacgctcctcaacttatgatgaggttacatcttgacaaacccactgtaaactgaaaatatcactaagttgaaaatgtgtttaatacacctaaagtaccgaacaacacagcttagtccagcctactttaaacatgctcagaacacttacgttaacctacagctggaaaaatcatgtaacayaaagcttatttcataacaaagtgttgaatagctcacataatttattgaatacttagattgaaaaacagaatggttgtatggggactgtctatactgcattatgaaggtgacagattttacatttttctccaataagataatcatgttgctgagtttgtttcatttttaatcctggtataggctcatgtaaaactaaactttccagggtcatctgcttttaatgtttcaaaatgcagatcctgggggctgtgcccaggttgtggaggccatgagattagccgcttcaaacctattaatgag

SEQ ID NO: 26858 - DNA, 601 bp, Human
agcacacagctgttcactacagaaaagcaagaaggtgggtgtttttcagagaacaccaaataacctgggagatatgacagcaggcccagtggatttttggttgtacctgaagatgcaaatatcactggatagcttctcaatattgtcctccccctccccttcttctcacaaaactaaacattttagtgttagtttgaaaaacagaaaaactatatgcctagtgttggtcctcaccaagctgggcttcatatacacggttcatgtttgtgattggtgattgtgggaaatttcccataaagaygctcctcaacttatgatgaggttacatcttgacaaacccactgtaaactgaaaatatcactaagttgaaaatgtgtttaatacacctaaagtaccgaacaacacagcttagtccagcctactttaaacatgctcagaacacttacgttaacctacagctggaaaaatcatgtaacacaaagcttatttcataacaaagtgttgaatagctcacataatttattgaatacttagattgaaaaacagaatggttgtatggggactgtctatactgcattatgaaggtgacagattttacatt

SEQ ID NO: 26859 - DNA, 601 bp, Human
cagaacaaagcacagaatcaggggccactcaaaagtgccttcaccagctctacctgcacagctgtcctgtggccttttatcagacagcacacagctgttcactacagaaaagcaagaaggtgggtgtttttcagagaacaccaaataacctgggagatatgacagcaggcccagtggatttttggttgtacctgaagatgcaaatatcactggatagcttctcaatattgtcctccccctccccttcttctcacaaaactaaacattttagtgttagtttgaaaaacagaaaaactatatrcctagtgttggtcctcaccaagctgggcttcatatacacggttcatgtttgtgattggtgattgtgggaaatttcccataaagacgctcctcaacttatgatgaggttacatcttgacaaacccactgtaaactgaaaatatcactaagttgaaaatgtgtttaatacacctaaagtaccgaacaacacagcttagtccagcctactttaaacatgctcagaacacttacgttaacctacagctggaaaaatcatgtaacacaaagcttatttcataacaaagtgttgaatagctcacat

SEQ ID NO: 26860 - DNA, 601 bp, Human
gaacgtcttcttattctgcatcatggcccagattatcgaggcgtccagcgaggtgcaggcttcgtcaggaggcacacactgcagacaggcagaacaaagcacagaatcaggggccactcaaaagtgccttcaccagctctacctgcacagctgtcctgtggccttttatcagacagcacacagctgttcactacagaaaagcaagaaggtgggtgtttttcagagaacaccaaataacctgggagatatgacagcaggcccagtggatttttggttgtacctgaagatgcaaatatcactrgatagcttctcaatattgtcctccccctccccttcttctcacaaaactaaacattttagtgttagtttgaaaaacagaaaaactatatgcctagtgttggtcctcaccaagctgggcttcatatacacggttcatgtttgtgattggtgattgtgggaaatttcccataaagacgctcctcaacttatgatgaggttacatcttgacaaacccactgtaaactgaaaatatcactaagttgaaaatgtgtttaatacacctaaagtaccgaacaacacagcttagtccagcctactttaa

SEQ ID NO: 26861 - DNA, 601 bp, Human
gcctcaatgccaatgaggcaggaatatttctgggtcagcattttcttctgcataaaataatgaaattggcctagacaatttccaagtccttattctgcagcaattggtgttgctttctctttcattcttacatgctcttcctggggcccccagcccttgcactacggattgtcttgaaagtatagcaatgagttcccttagcattacgcctctgagcagataaatattgttgataagacttaaagcaaaccacttccatggctgtatgtgaattcttgcaggttagaacagacataagcaygcaagtcattaacttgtctctctaaataagttactaccttcccattcaagccatacatgccaatggatcaacaaattaatattttaaagtggtaaaggtgaaagggaaaaagaaagcagggataaacaaaggacagaggaaaggaaaaaatatgagcaaaaaggggaaaggggaagggggaagggggaatgagagcagaagtctccttatcaaaactcaaagtttggcaaatgttcactaaccaactcattcttaggaaagcccaggaggttttatttcgaaatagttgcataaagactt

SEQ ID NO: 26862 - DNA, 601 bp, Human
aggttgaagtcctgcctcaatgccaatgaggcaggaatatttctgggtcagcattttcttctgcataaaataatgaaattggcctagacaatttccaagtccttattctgcagcaattggtgttgctttctctttcattcttacatgctcttcctggggcccccagcccttgcactacggattgtcttgaaagtatagcaatgagttcccttagcattacgcctctgagcagataaatattgttgataagacttaaagcaaaccacttccatggctgtatgtgaattcttgcaggttagarcagacataagcacgcaagtcattaacttgtctctctaaataagttactaccttcccattcaagccatacatgccaatggatcaacaaattaatattttaaagtggtaaaggtgaaagggaaaaagaaagcagggataaacaaaggacagaggaaaggaaaaaatatgagcaaaaaggggaaaggggaagggggaagggggaatgagagcagaagtctccttatcaaaactcaaagtttggcaaatgttcactaaccaactcattcttaggaaagcccaggaggttttatttcgaaatagt

SEQ ID NO: 26863 - DNA, 601 bp, Human
gaagagctccctggaggtgaagttgaaccgagccatcaacctatttaatctagtccttaaaactgatattagaagatgatttgcctttttatacccacagatgcaaaaattgaacatgattacaagtttttaatgaaactattctaaatctccaaagatagatatgtgtccatatgtgcctctgtttgagttcatattgttccataatttaaaaaaaataatccacttaagacaatggtttatgaagtgctttgtgaaaggaactttccagactgattgttaaatgtagtgaatcagccayggagactaatcctgggaatcttaggaaaggaaaaaaagcacagattcacaaattctcctcacaagacaacattatctagaagagctctgggtggacagctgggaagtccaggttgaagtcctgcctcaatgccaatgaggcaggaatatttctgggtcagcattttcttctgcataaaataatgaaattggcctagacaatttccaagtccttattctgcagcaattggtgttgctttctctttcattcttacatgctcttcctggggcccccagcccttgcactacggattgtcttgaa

SEQ ID NO: 26864 - DNA, 601 bp, Human
aaataatttagcatgataattcccccctggcattctttttttttttttttttttttaacaaggaggtatcactgagcttattttagctgcaaagtggcatcatattattccatttaatgaaattcacctcaagccctttttgacatattaaatatatgggatatatttaaggcaagagaagtaaggcaatccaaatgagtgcccttttccaatctcagcactgtcttggtggaattggtgacactattcagataaccaactggagaccgacaggatttgccatgcatttgcatcttgctasagtttggtttttatgaaagggcctatttttttttaagttgacatattttgagtggaaacactcaccctaccaaatatacttaagttgcaactctaaaagcataaggacattttcaaattttctcttcttcaactgagaaaatgaatgtgccaggtgacatattatatacttgtacttgcatacacatagaaatatatcactgtgcaaattcgtccttgactttataactgaatttcacctcaaattatacattaatttgcagaacaaaatattaggaatgggcacaaatctgtggttcct

SEQ ID NO: 26865 - DNA, 601 bp, Human
agacactgccctaaggttttaagcttcatcaggattacctactgaggttccattcacagacaaccaggcataacttccttattttaagggcagtgggatttgcttatgaatattttgggggtagaatctatcttgttctacttatggaattctaagttgtttgggggaaattctggaaaaagaataatttgcaatgaagctatcttcagcagtaaaataatttagcatgataattcccccctggcattctttttttttttttttttttttaacaaggaggtatcactgagcttattttagytgcaaagtggcatcatattattccatttaatgaaattcacctcaagccctttttgacatattaaatatatgggatatatttaaggcaagagaagtaaggcaatccaaatgagtgcccttttccaatctcagcactgtcttggtggaattggtgacactattcagataaccaactggagaccgacaggatttgccatgcatttgcatcttgctacagtttggtttttatgaaagggcctatttttttttaagttgacatattttgagtggaaacactcaccctaccaaatatacttaagtt

SEQ ID NO: 26866 - DNA, 601 bp, Human
ctcctcgcctctctcactctgacagcgccgaggtgcgccgagcaggagcagggaacaaaggagcggagaggggaggggagagagttgggcgagggagagcccccggccggctgccagaagatcccggcgggaggaagcccaagtgtcacttgaattccacccaaggagcgggcgcctgggatcagagcgtcctgtttagcaataacggctggagcacgtcctacaagttacgggagagtcggctgtgaaggagacgttcgcttatcccctgtgtccccgctcctggcccctccagaccccmgccttgcctcgcgctgggaggggagatccagaatgaaaggcaagaaaggtaaggcggccgcgggctgcgcgcaccagaagacgcgagtccggggaaacgtgctggccgggccgcgccgcgcggagtcacttggtggacttttccgcccaggggctctcatgctggagtggcggccgtgctctttgttgaggctgcgtctgaaacggcagcggctgttttcctgctagacacaacacgaggggctgttgtggggcgagcctctccacgctgctggcacgttgtcaagaaacacgctcagcg

SEQ ID NO: 26867 - DNA, 601 bp, Human
ttctagattaaaaaaaggaaggagataatagccttgagaagaatgtctggcttttcagacgttggagagtttaaacaaattgctttattcaaatttgctttagtcatttaattaacttaacactttttttaaaagttcgatttctttaattattaaagccaatgtgagacaggaactcagctataatttctttaagctattttattaatagttcttcacccaaatttcaatataggttttgaaagtctcatcttgccaatagtgaaagtagtttcagttttaaatgggcacttttaaaaamctttttaaaaacttaaatcatcaggggaggggaatttcaaatacatggcagttaaaacttaggattcttgtgcagtttatttgtagctgtttgttaagctgtgagctaaagtgaatttgcaagatcatccacctctttgttagaactttactttgtctttggagagttctgccttttgtaggaataccctgcagcaccttctgccccctgcagtccaaaactaaaaatgtgtcaccaagtcagagtcattaaaagggtgggaaaaattcctttaaaaaacacggtgtttagcttaagagg

SEQ ID NO: 26868 - DNA, 601 bp, Human
acgacttcagtgaggtaattcatgttatgtctgttgacacagtcatttgaactgggaaaaatcagttactgggaggagtggcccttttcataaggagaggttttcctgtagttgattaacttaaatgttggggcagtaggtgataggttaaaatggggagagttaaaaagtaaacctctctctcaaatcatttttaagcatttgagattgtatgtctttttcttcgtcctgaaaaggtttaagtatgaagagacaaaaaaggaaatttgtattagaaactagaaggcttatgacaggtggkagcttgctttcttggcggagctcagataccttgaaataacattgtaaattcagataaggcttttcatgctttctttaattcagagagcaagatcaattaggtaccccatagaacattctcagaacccgttggctgagtgaatgaggaaaatgttaaagcgtaccgatatgatttcaggtctgtaactggttcatcaacgcccgccgcaggctcctccctgacatgctgagaaaggatggcaaagatccaaatcagttcacaatttcccgccgtggggccaagatttctgaaacgagctct

SEQ ID NO: 26869 - DNA, 601 bp, Human
aatcagttactgggaggagtggcccttttcataaggagaggttttcctgtagttgattaacttaaatgttggggcagtaggtgataggttaaaatggggagagttaaaaagtaaacctctctctcaaatcatttttaagcatttgagattgtatgtctttttcttcgtcctgaaaaggtttaagtatgaagagacaaaaaaggaaatttgtattagaaactagaaggcttatgacaggtggtagcttgctttcttggcggagctcagataccttgaaataacattgtaaattcagataagscttttcatgctttctttaattcagagagcaagatcaattaggtaccccatagaacattctcagaacccgttggctgagtgaatgaggaaaatgttaaagcgtaccgatatgatttcaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttca

SEQ ID NO: 26870 - DNA, 601 bp, Human
tttcctgtagttgattaacttaaatgttggggcagtaggtgataggttaaaatggggagagttaaaaagtaaacctctctctcaaatcatttttaagcatttgagattgtatgtctttttcttcgtcctgaaaaggtttaagtatgaagagacaaaaaaggaaatttgtattagaaactagaaggcttatgacaggtggtagcttgctttcttggcggagctcagataccttgaaataacattgtaaattcagataaggcttttcatgctttctttaattcagagagcaagatcaattagktaccccatagaacattctcagaacccgttggctgagtgaatgaggaaaatgttaaagcgtaccgatatgatttcaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccact

SEQ ID NO: 26871 - DNA, 601 bp, Human
ataaggcttttcatgctttctttaattcagagagcaagatcaattaggtaccccatagaacattctcagaacccgttggctgagtgaatgaggaaaatgttaaagcgtaccgatatgatttcaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccrtttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactcca

SEQ ID NO: 26872 - DNA, 601 bp, Human
gcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttctttaaaaattgttgtaattcagagtatttctgttgagggaggtgcttcttaaaaataagtaggaatatagcaccccagtgagcaggaagctgggggggtagg

SEQ ID NO: 26873 - DNA, 601 bp, Human
agatcatgccactgcgctccagcctgggtgacagagtaagaccctatctcaaacaaacaaacaaaaattagccaagcatggtggtacatacctgtattcccagctactcaggaggctgaggcagggggattacttgaacccaggagcttgaggttacagtcagctatgatggcaccactgcactcaggcctgggttatagagcaagaccctgtttccaaaaatattcatccagaatatctaaacctagatcaacctgctcaaaagttgtaagttaagatgcaaaaagtcgtgatcaggcasagtggttcacacctgtaatcccaggactttgggaggctaaggcagagaatcacttgagcccaggagtgtgagaccagcctggacaacatagtgagacctcatctacacatacacacacacacacacacacacacacacacacacaggagccaggcatcgtgacacatgcctgtagtcccagctacttgggaggctgagctgggagaattgcatgagtccgttagttgcaggctgcagtgatctgtgattgcgccactgcacttcagcctgggtgacacagcaaaagcctatctccaaaaa

SEQ ID NO: 26874 - DNA, 601 bp, Human
agaccctgtttccaaaaatattcatccagaatatctaaacctagatcaacctgctcaaaagttgtaagttaagatgcaaaaagtcgtgatcaggcagagtggttcacacctgtaatcccaggactttgggaggctaaggcagagaatcacttgagcccaggagtgtgagaccagcctggacaacatagtgagacctcatctacacatacacacacacacacacacacacacacacacacacaggagccaggcatcgtgacacatgcctgtagtcccagctacttgggaggctgagctgggrgaattgcatgagtccgttagttgcaggctgcagtgatctgtgattgcgccactgcacttcagcctgggtgacacagcaaaagcctatctccaaaaaaaaaggcgaaaagtcaaagtgaattctttactttaatcctcttaaactaagtaattacccagaaatcctgtaacctttatttatttatttctatgtttcatggtttaggcatttcttgatctcttgacttttgagttggatatgtccatgctaatgagctagttacttggttaaaaatgtgaacaacttctcagctgcatgata

SEQ ID NO: 26875 - DNA, 601 bp, Human
ctcttaaactaagtaattacccagaaatcctgtaacctttatttatttatttctatgtttcatggtttaggcatttcttgatctcttgacttttgagttggatatgtccatgctaatgagctagttacttggttaaaaatgtgaacaacttctcagctgcatgataaatatccggggtgcatctgagagggcttttggaaagagctgagtcttagactgagcctggcaagaaaggagtaaggtgggcccagggaacttagtagccgagggagagtatggagaggaagtgagcctggaacaraatcttgaaaccaaatggcctggaagaggtgggattaaagccctggtgacttagaaggctgagtctctttggcctaggagagagtgggtgaggccagcggctcctgcagctgctgactcactcgcaccccagggccaaaccactttatcgtggagccaatttcctcagctgcacctcccagatgctctattcagacctcccagctgggctgggccatgaactaattatggcctgtgcggagctttgaagtgctcagctttcagccagagatgaccgtgctgatagccactttggaggctg

SEQ ID NO: 26876 - DNA, 601 bp, Human
tgaggccagcggctcctgcagctgctgactcactcgcaccccagggccaaaccactttatcgtggagccaatttcctcagctgcacctcccagatgctctattcagacctcccagctgggctgggccatgaactaattatggcctgtgcggagctttgaagtgctcagctttcagccagagatgaccgtgctgatagccactttggaggctggagcaccagtgactcaggagatggggaagggctgcgcaaccttccatctctaaggaggccctgtcttgcctgactctgccatgacagcycaggacctcctggaaggggtgcagaactcactactgcactgagggcctggcaaggctgggcatggcctgtcctgggcaaggatccctctgtgtccagactgtccattctcattggccttgccacttacaggcactccaaggagaaggggtaggacacacaggctggaggagccttcagagatcctggtccagcctctcattgcacagttcagataaacgacagccaaagtttcataaaccctgacccttgactacaaaagacacctcagagcacctttgtcctaactttcccttgaaaat

SEQ ID NO: 26877 - DNA, 601 bp, Human
ccaatttcctcagctgcacctcccagatgctctattcagacctcccagctgggctgggccatgaactaattatggcctgtgcggagctttgaagtgctcagctttcagccagagatgaccgtgctgatagccactttggaggctggagcaccagtgactcaggagatggggaagggctgcgcaaccttccatctctaaggaggccctgtcttgcctgactctgccatgacagcccaggacctcctggaaggggtgcagaactcactactgcactgagggcctggcaaggctgggcatggcytgtcctgggcaaggatccctctgtgtccagactgtccattctcattggccttgccacttacaggcactccaaggagaaggggtaggacacacaggctggaggagccttcagagatcctggtccagcctctcattgcacagttcagataaacgacagccaaagtttcataaaccctgacccttgactacaaaagacacctcagagcacctttgtcctaactttcccttgaaaattcccttccctattggaaggtgaagaactaaggcctagagaggtgaacagacctttgtgcaatcatca

SEQ ID NO: 26878 - DNA, 601 bp, Human
agctgggctgggccatgaactaattatggcctgtgcggagctttgaagtgctcagctttcagccagagatgaccgtgctgatagccactttggaggctggagcaccagtgactcaggagatggggaagggctgcgcaaccttccatctctaaggaggccctgtcttgcctgactctgccatgacagcccaggacctcctggaaggggtgcagaactcactactgcactgagggcctggcaaggctgggcatggcctgtcctgggcaaggatccctctgtgtccagactgtccattctcatwggccttgccacttacaggcactccaaggagaaggggtaggacacacaggctggaggagccttcagagatcctggtccagcctctcattgcacagttcagataaacgacagccaaagtttcataaaccctgacccttgactacaaaagacacctcagagcacctttgtcctaactttcccttgaaaattcccttccctattggaaggtgaagaactaaggcctagagaggtgaacagacctttgtgcaatcatcaagttggcaagtggcaaggtggggcttgtaacctcagtgtctccttc

SEQ ID NO: 26879 - DNA, 601 bp, Human
ggccatgaactaattatggcctgtgcggagctttgaagtgctcagctttcagccagagatgaccgtgctgatagccactttggaggctggagcaccagtgactcaggagatggggaagggctgcgcaaccttccatctctaaggaggccctgtcttgcctgactctgccatgacagcccaggacctcctggaaggggtgcagaactcactactgcactgagggcctggcaaggctgggcatggcctgtcctgggcaaggatccctctgtgtccagactgtccattctcattggccttgccrcttacaggcactccaaggagaaggggtaggacacacaggctggaggagccttcagagatcctggtccagcctctcattgcacagttcagataaacgacagccaaagtttcataaaccctgacccttgactacaaaagacacctcagagcacctttgtcctaactttcccttgaaaattcccttccctattggaaggtgaagaactaaggcctagagaggtgaacagacctttgtgcaatcatcaagttggcaagtggcaaggtggggcttgtaacctcagtgtctccttctctcttttaa

SEQ ID NO: 26880 - DNA, 601 bp, Human
gagacaggctttcaccatgttggtcaggctggtcttgaactcctgacctcaggccatccacctgcctcagcttcccaaagtgctgggattacaggcgtaagccactgcacccggccaaaatgttttatatatatttgggcatttatattcctaaccataagtatgccatgtgcacactatcaatacacacacacacgtaatttaatgatagatgccactggaagtaggaaatgtgtagacatatatctgtaactgcatagagcactagatagatagatattatatagataaaaatagacaytgttacaactgtttaaggttatatcatataccaagttattaccggatggcaattggcaatgatgtctatatctgtagatacacagagatatctatgtatctatataaagtacccatctatctattgttttaatccatttcaaaggctacacacacacataattgctcacatgcatgtatatggctagataatcgtatgacagatgtaatcttattttcagatgttcaattttgagatagtctacataaaatgtttgtattacttatcattcccagaataagtatatctaacttatctgaa

SEQ ID NO: 26881 - DNA, 601 bp, Human
agctgatggttgggggagccagccctggagggcatgaggacagggagtcccaagcactagctccagccctaccacccaattgctgtgaggcttgcgcaaggcaatttatcctcctggtcccaagtttcttcatatgtgaaatataagggttggcctaggactagatgatttcttaagtcctttgccagtttaaatgtttaaattctcgggagcttcagcccactccactttctataagggagctagccctcccaagggagccctgctgttccttcctccttgaatcccatgcaggggagagctaaaccaagagccagtttctgcctggcgtgaaattactaagctattcttataagggcaaccggagtttggacagaaaacctctgacatgaatctttgtatgttaccaaaaagtgttgaaagctttagaaccgtgcccagatttgcctaaagtaatagaatgtgagaatcaagggagattaagcattagaagtgcttagtaatagtaacagcagcaactaataatttgttgagcagttgttgtgtgccaggtactgttataagtgcttagatttcatcttcacaaatgacgtaggcattg

SEQ ID NO: 26882 - DNA, 601 bp, Human
cctggagatcatttttatgatgcccttttaaaaataattataaaaaaattcaaaatacatacagaaataaaaatcatttctgatcttattcacatatcttcaacacttggtagttttccattcatcttttctctatgagttattgttatttacagaattgggatgatacattttccaaggcatgagtagaagacggagcatataatagacacatcccactttttcccacacctcgaaaccaatcacttcaccattagttttagtcatgtgttttttactaaacattatatcatgagcattctccctatgtcattaaaaaatcttcaaaaataagatcatttcaaatacgtcgtaagtgcatcatattctattatatggaatggaacctatgtaaagtcaggttacataaaatggaatctactgttaacctgtttcccttttttaaccccagctgcctggattcaaatcccactctgcttaattactcactgtaagaccttctcaagtcacttaacttccctgaacctcagtttccagagttgttgaatggggaataataatcatttctgtcttttagggtgttgtaaggattaaataagtt

SEQ ID NO: 26883 - DNA, 601 bp, Human
aaaatcatttctgatcttattcacatatcttcaacacttggtagttttccattcatcttttctctatgagttattgttatttacagaattgggatgatacattttccaaggcatgagtagaagacggagcatataatagacacatcccactttttcccacacctcgaaaccaatcacttcaccattagttttagtcatgtgttttttactaaacattatatcatgagcattctccctatgtcattaaaaaatcttcaaaaataagatcatttcaaatacgtcgtaagtgcatcatattctmttatatggaatggaacctatgtaaagtcaggttacataaaatggaatctactgttaacctgtttcccttttttaaccccagctgcctggattcaaatcccactctgcttaattactcactgtaagaccttctcaagtcacttaacttccctgaacctcagtttccagagttgttgaatggggaataataatcatttctgtcttttagggtgttgtaaggattaaataagttaatatatgcaataacacaggactcaactttctgtgttaacactgtgttagctatgatcatccaacttac

SEQ ID NO: 26884 - DNA, 601 bp, Human
cccgggcctctgcttcctcctctggcctccctctgtctcctgccccatcaggggttgggtcccaggctctcctggagcctttcctcttcccttctctgacctctagagcatgacttgtctgttaccctcattttcagttgttctttgaaacattaaaaagtgatttatggggctgggagtggtggctcacacctgtaatctcagcactttgggaggccaaggagggtggatctgttgagatcaggagttcaagaccagcctgaccaacatggtgaaaccccgtctctagtaaaaatacaarattagtcgggcatgatagtacatgccttaatcccagctacttgggaggctgaggtgggagaatcgctggaactcaggaaacggaggtaaagccgtgagccgagatcatgccgtggcactccggcctgggagacagagcaagactccgtctaaaaaaaaaaaatgtgatatatgaagtaatatgtgcatgtagttgaaaaaaattcaaactattctaaaaggactaacaataaaacttaagtcttaccacacccccaacccctagctcctctaccagaatcagtgcacgttactagatttg

SEQ ID NO: 26885 - DNA, 601 bp, Human
acataaactatcaaggctcattagatatagttagactaggctgggcgcagtggctcacgcctgtaatcccagcactttgggaggccgaggtgggtggatcacgaggtcaggagatcgagaccatcctggctaacatggtgaaaccccgtctctactaaaattacaaaaaaaaaaaattagccgggcgtggtggcgggcgcctgtagtcccagctactgagagaggctgaggcaggagaatggcgtgaacccgggaggcggagcttgcaatgagtcgagattgcaccactgcactccagackgggcgacagagcacgactgcatctcaaaaaaacaaacaaacaaacaaaaaagatatagttagactaaagaccattgtcctgtgaaacttttgtttctgtatcatatgtgtgccaagatgtcaaatgtatttctttctaggggttgtggtgaaaaaagctgaaagtcactgacatctgtctatctatctatctaagcttcctatgctgagagctaagaagagggaagaaatggtcaggcttgggagctcagaggaacaagaggtccctgcaggctgcctgttcagggaagtcttcctggac

SEQ ID NO: 26886 - DNA, 601 bp, Human
cgcagtggctcacgcctgtaatcccagcactttgggaggccgaggtgggtggatcacgaggtcaggagatcgagaccatcctggctaacatggtgaaaccccgtctctactaaaattacaaaaaaaaaaaattagccgggcgtggtggcgggcgcctgtagtcccagctactgagagaggctgaggcaggagaatggcgtgaacccgggaggcggagcttgcaatgagtcgagattgcaccactgcactccagactgggcgacagagcacgactgcatctcaaaaaaacaaacaaacaaasaaaaaagatatagttagactaaagaccattgtcctgtgaaacttttgtttctgtatcatatgtgtgccaagatgtcaaatgtatttctttctaggggttgtggtgaaaaaagctgaaagtcactgacatctgtctatctatctatctaagcttcctatgctgagagctaagaagagggaagaaatggtcaggcttgggagctcagaggaacaagaggtccctgcaggctgcctgttcagggaagtcttcctggactaggaaggtgatgagcttctaggccagaatgacttgcagaggtag

SEQ ID NO: 26887 - DNA, 601 bp, Human
cacacagtacccacaaagtaagccctgaatctctaagtgacggttggctaatggtgttggccgagtttacaaaaaaggaaagctgagcgcaggtgatggggtctgacttcaagtccaagtgggtgcccccccaggtgctggtatttgtgaacatttggaggcacagttttagggttatgagattggtggcctcaatttggccccagtcttcctctgcaggtcattcccaggactgagctcagatagacctttgctcagtcaataaacatattctgagccccatactgagtgcctgcttcaygctgggccttggggatgcaacagaggacactgtagatgggctggaggtgtggggatgtaggacaagtattttcaacaatgttatgacgtagaaacaagcatagggggccagggagcaaaaactcgggggcggaaggtgaactctagccctaccagccataattgtgtgacctcgagcaagtttcctctgatctctgagccctcgcttcctcacccgaagaatgagaagagcaatgcctgtcttcagcgggatttaaatgagctaaggtatacaaagtgccaagtgcaatgcctggcatat

SEQ ID NO: 26888 - DNA, 601 bp, Human
taagtgacggttggctaatggtgttggccgagtttacaaaaaaggaaagctgagcgcaggtgatggggtctgacttcaagtccaagtgggtgcccccccaggtgctggtatttgtgaacatttggaggcacagttttagggttatgagattggtggcctcaatttggccccagtcttcctctgcaggtcattcccaggactgagctcagatagacctttgctcagtcaataaacatattctgagccccatactgagtgcctgcttcatgctgggccttggggatgcaacagaggacactgyagatgggctggaggtgtggggatgtaggacaagtattttcaacaatgttatgacgtagaaacaagcatagggggccagggagcaaaaactcgggggcggaaggtgaactctagccctaccagccataattgtgtgacctcgagcaagtttcctctgatctctgagccctcgcttcctcacccgaagaatgagaagagcaatgcctgtcttcagcgggatttaaatgagctaaggtatacaaagtgccaagtgcaatgcctggcatatagtcaagacttgataaatagcagtggtgatctt

SEQ ID NO: 26889 - DNA, 601 bp, Human
taaacccaacacgccatttgccgcgacgtcttcaatgggtttggaaacagaggaacaggagcccagcatcatcgggaagctgaaggtcgctggcatgctggcagtaggcaaagaagtcaacctggtcctactgctcaaaaacctgagcagggatacgaagacagtgacagtgaacatgacagcctggaccatcatctacaacggcacgcttgtacatgaagtgtggaaggactctgccacaatgtccctggaccctgaggaaggtaacgcatcccgcagttggaggagatccacgaatccraggtagccaatggccttctggggctgcagggtgtctgctgggctccaggttagtcagctacgaatggagcagccagcggcccctgtggttaagccatgtattaatgctttggaagtttctgtctctatgaacagagtgatgccaaccaaatgtcagggtggtgccaaccaaaatccttttacgccccaagggaggaaggagggaggctttggcagttcatagctatggcacaatatcccttacaagtatataccacctcacacagtttgaccgtctaaaaaaaggcagattttcagtgtc

SEQ ID NO: 26890 - DNA, 601 bp, Human
atgggaagggaacaaggtggagcagataaaggttgtgctgtggaaggattagaatgcaggtgtgcccacattggtaaaatccttcaagctgtcatgaaaagtttggacttacaagccggattaacagggcagggtggttatttgcttcacataaggaactaatagaaactgattaattatactgcccatcttgaaagaattctgtctccagagaaactgagaggtgtcacacctgtcagaaagcagcatcccctagcaatctgtcttctggcagaattttagcagaaatcttttcaatatmagaagcaactgcctggctgttattgaccttagaaactcaaagaaagggctttttttgtttgtttgtttgtttttgtttatttgttttgtttttagacaggatcttgctctgtctgccaggctgaagtgatcatagctcactgcagcctcaaactctgggctcaagcaatcctcctgcctcagccccccaagtagctgtagtcccaagtaactaggactacaggcatgccattatgcccagctaacttttaaagttttttgtagagatagggtctcactatgttgcccaggctagtctcaa

SEQ ID NO: 26891 - DNA, 601 bp, Human
tgggaagggaacaaggtggagcagataaaggttgtgctgtggaaggattagaatgcaggtgtgcccacattggtaaaatccttcaagctgtcatgaaaagtttggacttacaagccggattaacagggcagggtggttatttgcttcacataaggaactaatagaaactgattaattatactgcccatcttgaaagaattctgtctccagagaaactgagaggtgtcacacctgtcagaaagcagcatcccctagcaatctgtcttctggcagaattttagcagaaatcttttcaatatcwgaagcaactgcctggctgttattgaccttagaaactcaaagaaagggctttttttgtttgtttgtttgtttttgtttatttgttttgtttttagacaggatcttgctctgtctgccaggctgaagtgatcatagctcactgcagcctcaaactctgggctcaagcaatcctcctgcctcagccccccaagtagctgtagtcccaagtaactaggactacaggcatgccattatgcccagctaacttttaaagttttttgtagagatagggtctcactatgttgcccaggctagtctcaaa

SEQ ID NO: 26892 - DNA, 601 bp, Human
aaattcacaggatggaaatagttaaaaaaaaaccgttttgcagaatggaatggaaaagagagagaaggcaggtgtagtggtcttagagtctggtcgtctgccaagtagttgctagatgaccctggttaagtctccctccctttctgaacctcggaggtcactgacggtgagggttggaccagctgatgcaagggcctgtcctctccacatttggggcagggatggcaaattccttcagtgctaaaagcagaggcagcttcctcctcacagtcttacctacaagagtatgtaatactgtgggtgctggggcatccccaggccacccagcatgacagcctgagggaagggagcacctaagcccatcagggtagggaaagggccccgcggcccacagggtcagaagagaggacttaaagcgtggggaaggagccggatgcatggagagaagccaggggaggcatttccatctgggggaaccatgtgagtcaaaatatgggggcgaaaaggtgcctgttttgtctgcagaacaagaagtgtggaaggttcttttaagggacaggtgatgcagggccaggttgaggggtctgaactttatctaagg

SEQ ID NO: 26893 - DNA, 601 bp, Human
agcaacaacaaaacccagcaacctccggtcatcctcaaaagaagaagaaatccaatagccataaaatgtccatttctatgtccaaaatgctttcttccccatccttgatctcatttgaccccttctgggagggaagagatgattgtccttctttaccagatgaggaagttgaggcgcaaagagatgacttgtctgcccagaatgaattacggctgtttcttggcagaaacacaacagctttcatcttttggtctgaataaatagtccaaattgcttttctgaccccaaacccagccttcayctgttctgatcactgagcaaggaccgtgtggtattagagctccgctcagactataaatggtgcacagggaacctctgggctctagaagtttagaaggacattggtagactggggtgtcagcagaggagagtagcctgggttgagctggggggacccaacccctggaaaaagagttaagggagctacagtgtgagccagggtgtgagcagctgtagggcctggggctgcccttttcaacacctgtggggcctcccagagacggaggttcaagctttaagggaagaaacaggacccataagc

SEQ ID NO: 26894 - DNA, 601 bp, Human
gaagttgaggcgcaaagagatgacttgtctgcccagaatgaattacggctgtttcttggcagaaacacaacagctttcatcttttggtctgaataaatagtccaaattgcttttctgaccccaaacccagccttcatctgttctgatcactgagcaaggaccgtgtggtattagagctccgctcagactataaatggtgcacagggaacctctgggctctagaagtttagaaggacattggtagactggggtgtcagcagaggagagtagcctgggttgagctggggggacccaacccctrgaaaaagagttaagggagctacagtgtgagccagggtgtgagcagctgtagggcctggggctgcccttttcaacacctgtggggcctcccagagacggaggttcaagctttaagggaagaaacaggacccataagcaggaaagccaaggaaagtaatattaaacccagcaagtggctgggcacagtgacttacatctgtaatcccagtgctttgggaggccaaggcaggaagatcacttgaggccaggagttcgaggccagcctgggcaacacagcaagaccctgtccttgcaaaaaata

SEQ ID NO: 26895 - DNA, 601 bp, Human
gtggtattagagctccgctcagactataaatggtgcacagggaacctctgggctctagaagtttagaaggacattggtagactggggtgtcagcagaggagagtagcctgggttgagctggggggacccaacccctggaaaaagagttaagggagctacagtgtgagccagggtgtgagcagctgtagggcctggggctgcccttttcaacacctgtggggcctcccagagacggaggttcaagctttaagggaagaaacaggacccataagcaggaaagccaaggaaagtaatattaaayccagcaagtggctgggcacagtgacttacatctgtaatcccagtgctttgggaggccaaggcaggaagatcacttgaggccaggagttcgaggccagcctgggcaacacagcaagaccctgtccttgcaaaaaataaattcagcatgaaaaatgtcctgaccctcacagagcccacagtggggttgggctgtcctgggaagcagggtctgaactggagtcggggcagggaagtaacagtgttgttggctgctgcagggggccccttccccctcaaagctgaggttctcatccacagcaca

SEQ ID NO: 26896 - DNA, 601 bp, Human
gctccagcacatccccctctcctctcccccaggttggggctgggtccaccctgtcctatgacttgatcacttttgcacattccctggccgcttctccccagagctgcctgctctgtgagccccacagccctgctcattcctcacgcccttcaatgctgcaggatggactggcccctgacccagggactctccaaacgggatacaggagagaagctggtctagactgtttgctgatccccaacctgcacggggcattcctgcttctctctcaggccaccacagagggcaggggatggttagycacctgccccagcactcacaccctaactcaaaataaatgttaaataagtgcgatcacacagcaccgactctacctgactgctgttgcacctaaggtggtgaaggagagaggaggctgtggccgtgaccttctggagcagggaataaatttgaggaggccatgttctctgtgtttcaatgtccaaagggagtgggcttgatctgcaaggctgtagatgcaaaactagggaaacatttcaagccagtttaggaaaactttctaacatgatgtccaaaaatagatgaggctgccttgggaggt

SEQ ID NO: 26897 - DNA, 601 bp, Human
ttcatacgactcgtagacaggacttagatgtagaaagtttgaatttagaaaaatatccagcctgacaaaaataatctgtgaacgcattttgtgtaaatatccagcaaaaaacagttatgcataacctaattaaatagaatgaatatcaactgtaaaaaaaagttacaaataaacttaatttggtgaattatacttacaaaacaacagaacacttgacttagccatcattttgaccctgcctctttattttcctgcaggcctgtttttccattcttggggattttaagttggcacagctcaktggaggctggccccgaagtcaggagatgtggtccaaagcccggctgggcgattaaccctgtggatctcagcttctcctcttccgggcgagcatgagcctgagggtcccagggctccccaggtcccttccagcaattggtcacaccctgctctaggttgaagggaagactgagaccccaattcttcccatatttagaatatcaaaggccgttaacttctcattgttaatccaaggactctccctctccagaaacaacatttggtaacctggaaatcctcaccttccaggaatagagaaaca

SEQ ID NO: 26898 - DNA, 601 bp, Human
agagcgaaggaggaaatttactcttcaagcaggattcttctaactataagatttgttgagctagcatttgccggcaagcactgcacatcacgttctaaatattcctattatttcatcttcataatagcctgggaggtatgtgctgctctaattgtcctcattttacagatgagcaaatggaagatgggcaagttcagcgcttgcctggagtaattctgttcatacgactcgtagacaggacttagatgtagaaagtttgaatttagaaaaatatccagcctgacaaaaataatctgtgaaygcattttgtgtaaatatccagcaaaaaacagttatgcataacctaattaaatagaatgaatatcaactgtaaaaaaaagttacaaataaacttaatttggtgaattatacttacaaaacaacagaacacttgacttagccatcattttgaccctgcctctttattttcctgcaggcctgtttttccattcttggggattttaagttggcacagctcagtggaggctggccccgaagtcaggagatgtggtccaaagcccggctgggcgattaaccctgtggatctcagcttctcctcttc

SEQ ID NO: 26899 - DNA, 601 bp, Human
gtgtgtgtgcatgtgtggtatgtgcacacgtctgtgaatgtgagtgcatgcatggtgtttatttgtgtatgtgcatgggtgcccacgtagggtgtgtgcacgtgtgtgcatgtgtgtgttcacatgtatgtctgtgtggtgtgcatgtgtgcacatgagtgtatgaatggtgtttatgtgcgtctgcatgtgcgtgcccatgtatggtgtttgtgtgcacatgggcatgcatatgtgagggtgtgttcacatgcatgtgtatgtggtgaggtgtgtgtgtgcgtgtctgtgtgtgtgtgttgcgtggtgtgtgtacatgtgtgatgtatatacatatgcgagtgtgagtgcatatgcagtgtttgtgtatatgtctttggatgtgtgttcatgtgtttgtgagcatgtgtgtttgtgtgtgtgtgtggtgtgtgtgcatgtgtgcacatgcctgtggctgcgtgtggtgggcagtgtgtgcatgtgcatgtggtgtgtgcacgcatgtgtgtgagcacatgccgggatgtgcagtgtgcttctctaaggccaggctctgcctgctcaagcatcgcatcaccagacgcattagcagatcagt

SEQ ID NO: 26900 - DNA, 601 bp, Human
tggtgtgtgtgcatgtgtggtatgtgcacacgtctgtgaatgtgagtgcatgcatggtgtttatttgtgtatgtgcatgggtgcccacgtagggtgtgtgcacgtgtgtgcatgtgtgtgttcacatgtatgtctgtgtggtgtgcatgtgtgcacatgagtgtatgaatggtgtttatgtgcgtctgcatgtgcgtgcccatgtatggtgtttgtgtgcacatgggcatgcatatgtgagggtgtgttcacatgcatgtgtatgtggtgaggtgtgtgtgtgcgtgtctgtgtgtgtgtgttgcgtggtgtgtgtacatgtgtgatgtatatacatatgcgagtgtgagtgcatatgcagtgtttgtgtatatgtctttggatgtgtgttcatgtgtttgtgagcatgtgtgtttgtgtgtgtgtgtggtgtgtgtgcatgtgtgcacatgcctgtggctgcgtgtggtgggcagtgtgtgcatgtgcatgtggtgtgtgcacgcatgtgtgtgagcacatgccgggatgtgcagtgtgcttctctaaggccaggctctgcctgctcaagcatcgcatcaccagacgcattagcagatca

SEQ ID NO: 26901 - DNA, 601 bp, Human
tgtggtgtgcgtgcattgcatggctgtgggtggtgtgtgcacacctgttttgtgcacacatgtataagtgcttacatatggttgtgtgcacatgtgcatgcatgagtgtgttcacatgtatgtgtgtggtgtgtgtgcatgtgtggtatgtgcacacgtctgtgaatgtgagtgcatgcatggtgtttatttgtgtatgtgcatgggtgcccacgtagggtgtgtgcacgtgtgtgcatgtgtgtgttcacatgtatgtctgtgtggtgtgcatgtgtgcacatgagtgtatgaatggtgyttatgtgcgtctgcatgtgcgtgcccatgtatggtgtttgtgtgcacatgggcatgcatatgtgagggtgtgttcacatgcatgtgtatgtggtgaggtgtgtgtgtgcgtgtctgtgtgtgtgtgttgcgtggtgtgtgtacatgtgtgatgtatatacatatgcgagtgtgagtgcatatgcagtgtttgtgtatatgtctttggatgtgtgttcatgtgtttgtgagcatgtgtgtttgtgtgtgtgtgtggtgtgtgtgcatgtgtgcacatgcctgtggctgcgtgtggtgggca

SEQ ID NO: 26902 - DNA, 601 bp, Human
gtgtacatgtgtggttactgtgtatgcatctatatgatgttcatgtgtttatgtgtgggggatgtgtgagtgtatgtatggtgtttgtgtaggtatgtaaatgtgatgtgtgtgactgtgtatggtacttttgtgcacgtgtgtatgtgtgtgttcacatgtgtgtggtgtgcgtgcattgcatggctgtgggtggtgtgtgcacacctgttttgtgcacacatgtataagtgcttacatatggttgtgtgcacatgtgcatgcatgagtgtgttcacatgtatgtgtgtggtgtgtgtgyatgtgtggtatgtgcacacgtctgtgaatgtgagtgcatgcatggtgtttatttgtgtatgtgcatgggtgcccacgtagggtgtgtgcacgtgtgtgcatgtgtgtgttcacatgtatgtctgtgtggtgtgcatgtgtgcacatgagtgtatgaatggtgtttatgtgcgtctgcatgtgcgtgcccatgtatggtgtttgtgtgcacatgggcatgcatatgtgagggtgtgttcacatgcatgtgtatgtggtgaggtgtgtgtgtgcgtgtctgtgtgtgtgtgttgcgtggtgt

SEQ ID NO: 26903 - DNA, 601 bp, Human
cccttggaaaagggcacctgctactttgctctcccatcatttcgctactaaagcaaacatttaggagtggttttggttgtgatcaaaaaagtctgggattgctagaaacatttgaatagggttgattccttgatcatcaaaccagcctcaatctcaactgacgataattagtgcagttagggaagcacacctggggcagccctctctgattaatcgtggtttagaaaggcgtgcgttgtgtgtgtgtgcgcttgtatgtggtgtttgcatgtgaaagggtgagtgcctgtgtgaaagtacrtatgtgctgacaactgcctgtggctctgcatgcattgtgtgtgcacgtgtgcctgtttgtatacacatgtgtgatggatgtatgtgcatgcatgagtttgcatgaggtgtttgtgtgtatgtatacgtgtgtatgagtatgtgtgcatttgtgcatgtgtatgtgtgtgtacatgtgtggttactgtgtatgcatctatatgatgttcatgtgtttatgtgtgggggatgtgtgagtgtatgtatggtgtttgtgtaggtatgtaaatgtgatgtgtgtgactgtgtatggtacttttgt

SEQ ID NO: 26904 - DNA, 601 bp, Human
gtcactcatgattagcgagtttctgcatttggcaaagaggctcacagagtcccactggtcctctcagagacacagaccctgggcctgcaggagcgccttccgcagctgagttatgacggggctgggccagtcctatatggtatggaactcctggacacccatgagaaattgactcaacaacaagctatgcatctctagaccttttactcaaattactgagtttaaccatgtacttatttccaaggccctacacgtccgggagggagcaatgtaccatacaccattgtgattctaaagaccygcagtttaagattcatttccaaacatattttaaccaaaatggacatgaaaccattccctcataaatcactagccctttcccttggaaaagggcacctgctactttgctctcccatcatttcgctactaaagcaaacatttaggagtggttttggttgtgatcaaaaaagtctgggattgctagaaacatttgaatagggttgattccttgatcatcaaaccagcctcaatctcaactgacgataattagtgcagttagggaagcacacctggggcagccctctctgattaatcgtggttt

SEQ ID NO: 26905 - DNA, 601 bp, Human
tggggctccttcgactggggacgccaggtgggactggggtgggaactaggtccccaggcagcagccataacgacaggcagggatacagccaagctcctgccctcgccaccctccctgccccggtctcctgccatcgaccccctccctgccccaggctcctgccctcgccgccctccctgccccggactcctgcccctgccgccctccctgccctgggctccatctcctggcatcatttacttcatgccctctgggtacgagtgacagtcagcatcactgcaccctggttagccatgtgtaygttgtggggcaccgtggcccggagcacctcattatgttcagtccctttctctaaactgcgagctgcccgtcctgagccccgcaggcatcgctctctcttcctggccgcgctgtgccgctcaaacccatttcactcctgccagcctcacaggaacttcccgtcctgcctcttcagctatgccaacatgcagtccttgaaataaaattattttcctctgcaggtgtgtgtgtgtgtgtatgtgtgtgtatgtgtgtgtgtgtgtgtacactcatacctacagatttaccaaggaggtaaatt

SEQ ID NO: 26906 - DNA, 601 bp, Human
atagctgaaccggtttcacacatcagcactgaacgctggcatttccaggcagtcaggttctgccaagtgtccgatggtggcctcttcccccaagagccgtgttctggggcctcaccttgcaggtacacgtggtgcagctgtccaccacccacgtttcattttccgcaaagaaccggccatcctgccagcaagctgacatgttccttgtcttaggagggccaccaatgagctcccagagaaactggttatcattcgactggaaaatcaagtgaaacatttaagtgtagacaataatactacmtatttagtcatcatgcttgtggatgaaaaacaaagttcctccttcattaaaaagctctaaagtcaagtaagacttgactcatccctgggtggaagttccggaagttgtcctccatcctcacggggctttctgagccacagcttcgtcactgcctgggcttctggggctccccatccacctgccttcctggagagcggaaatcgcgtggctcacatcacacctggaccagtgcagagcaacgctggggctccttcgactggggacgccaggtgggactggggtgggaactaggtccccagg

SEQ ID NO: 26907 - DNA, 601 bp, Human
tgacagcctaacaagaacagggcccccagatggctctttgcatccattccattcctttctcccttcactgagcagcaaggatgcaacagagagctccaagcttcctggaaggagggaagaaaagacgggcagcaggaactcctgttatctaaggtaatgctgaggccattgtcagcagaaatagagtaacattaaaagctaaattgtctgtctgtaagacttcaggcagtggcttgtatttcccccaaacgtttctgctgagcctcaggctctgttggaaccggatggaattaaatgcagrgtctagggccatgtctggcttctctgttcctcctgtttctaaccaactggggacgctggccaggttgctccccctctctgggctctggttctttatgtgcaaacaaagaggttgattcaagtcctaaatacggttcctggcccttctgtgtttcttacactgaaatttcctcacatagctgaaccggtttcacacatcagcactgaacgctggcatttccaggcagtcaggttctgccaagtgtccgatggtggcctcttcccccaagagccgtgttctggggcctcaccttgcaggtac

SEQ ID NO: 26908 - DNA, 601 bp, Human
ctagaaggggtcgacagaatggctgaatgttttccatcctacggaccatacattacagagatgtgaaaataagggcatctttttctcccattagtgctgacagcctaacaagaacagggcccccagatggctctttgcatccattccattcctttctcccttcactgagcagcaaggatgcaacagagagctccaagcttcctggaaggagggaagaaaagacgggcagcaggaactcctgttatctaaggtaatgctgaggccattgtcagcagaaatagagtaacattaaaagctaaaktgtctgtctgtaagacttcaggcagtggcttgtatttcccccaaacgtttctgctgagcctcaggctctgttggaaccggatggaattaaatgcagggtctagggccatgtctggcttctctgttcctcctgtttctaaccaactggggacgctggccaggttgctccccctctctgggctctggttctttatgtgcaaacaaagaggttgattcaagtcctaaatacggttcctggcccttctgtgtttcttacactgaaatttcctcacatagctgaaccggtttcacacatcagcac

SEQ ID NO: 26909 - DNA, 601 bp, Human
tcttctctgccaaaaccaaccaatgaataaataaacaaacaagcatggaattcctaaaaatgcaggatgcgcttgccggctggcgatactcacagtggaggcaggaagggcagcattcgccttccacaaaggatggactggcgcaggttgcaggcgggcaggtgatttggtggcaaatggttttaaatttctacaagtgaagaaaggcatgcatggaacactcatttaaaaggaggggacgctggtacaagggctgagactagaaggggtcgacagaatggctgaatgttttccatcctayggaccatacattacagagatgtgaaaataagggcatctttttctcccattagtgctgacagcctaacaagaacagggcccccagatggctctttgcatccattccattcctttctcccttcactgagcagcaaggatgcaacagagagctccaagcttcctggaaggagggaagaaaagacgggcagcaggaactcctgttatctaaggtaatgctgaggccattgtcagcagaaatagagtaacattaaaagctaaattgtctgtctgtaagacttcaggcagtggcttgtatttcccc

SEQ ID NO: 26910 - DNA, 601 bp, Human
acagatctacgtgtgttctctgactctcagctggggctccatcggggcctgctctgggctcacctgcgtgaccactgggctcagcttcctcgtctgagaagcatcaggactggccttcccacccccgcgttcccagggcttccacactcctttctagccatgagtcagtcctcagtggatgaccagtggcctggggtggccctctgattctctcacctgtactcagggggctgaacctcactcttctctgccaaaaccaaccaatgaataaataaacaaacaagcatggaattcctaaaawtgcaggatgcgcttgccggctggcgatactcacagtggaggcaggaagggcagcattcgccttccacaaaggatggactggcgcaggttgcaggcgggcaggtgatttggtggcaaatggttttaaatttctacaagtgaagaaaggcatgcatggaacactcatttaaaaggaggggacgctggtacaagggctgagactagaaggggtcgacagaatggctgaatgttttccatcctacggaccatacattacagagatgtgaaaataagggcatctttttctcccattagtgctgac

SEQ ID NO: 26911 - DNA, 601 bp, Human
agaccaaggtgaccagtggctccagccgccgtcctgccggactaacacaagaagcagagagagatcaggctgtgccgcctagaggggtatttgcctgtaagcggtgtgccttattaactgaggagcatctcacagctgctgaggagagggaaggagaacccctcccatcagctgggagaaagagcctcacctggctagaatccttgcaaaggcccagcacctcgtgagggcagctctgtcccttgcaaaggtcccgatgactgagagaaacgcggccccacccccacaggcacgcgggtgwcacctgcccgacactcactgcgggtgtcacacttgctcagactgcaagcccgtgtctggatggagggccccaagcaggtgttgctggtgacgtcacaggaccggcctctctgctgggtcccagagccacacgtcacggagcactgggtccactctgcccacggagaccagccctcctcaccgtccaccgctgccagaggaagcaaacacagtggcatcaggccctgcctcacagacgtgccacagaacagaacgggcacagggcagctggcgtggggccacagttcatgcatccaggaat

SEQ ID NO: 26912 - DNA, 601 bp, Human
tgcctgcaagcccgcccacccagggccccgccttcaccgtacttacttgggcatggggcgccctggcaggctttggtctcccggccactccctttgcaattcttgccccccatctggggcactggggagttgcagagacggatgcgtgtgatattgccaactccacaggtcacagagcatgaagaccaaggtgaccagtggctccagccgccgtcctgccggactaacacaagaagcagagagagatcaggctgtgccgcctagaggggtatttgcctgtaagcggtgtgccttattaacygaggagcatctcacagctgctgaggagagggaaggagaacccctcccatcagctgggagaaagagcctcacctggctagaatccttgcaaaggcccagcacctcgtgagggcagctctgtcccttgcaaaggtcccgatgactgagagaaacgcggccccacccccacaggcacgcgggtgtcacctgcccgacactcactgcgggtgtcacacttgctcagactgcaagcccgtgtctggatggagggccccaagcaggtgttgctggtgacgtcacaggaccggcctctctgctgggt

SEQ ID NO: 26913 - DNA, 601 bp, Human
ctgggctggaacaggccctgacaccccggatcccggctccagctgtggctgctcactgtgagctgcctgcaagcccgcccacccagggccccgccttcaccgtacttacttgggcatggggcgccctggcaggctttggtctcccggccactccctttgcaattcttgccccccatctggggcactggggagttgcagagacggatgcgtgtgatattgccaactccacaggtcacagagcatgaagaccaaggtgaccagtggctccagccgccgtcctgccggactaacacaagaagcrgagagagatcaggctgtgccgcctagaggggtatttgcctgtaagcggtgtgccttattaactgaggagcatctcacagctgctgaggagagggaaggagaacccctcccatcagctgggagaaagagcctcacctggctagaatccttgcaaaggcccagcacctcgtgagggcagctctgtcccttgcaaaggtcccgatgactgagagaaacgcggccccacccccacaggcacgcgggtgtcacctgcccgacactcactgcgggtgtcacacttgctcagactgcaagcccgtgt

SEQ ID NO: 26914 - DNA, 601 bp, Human
acacaactgcccacattccacaggccacgccacacaactacccacattccacaggccacaccacacaattacccacacaccacattccacgccacacaactacccacattccacaggccacgccacctggcatcttttttgtttttacattagaaatacaggaggactgaaacacagatgttaaaagtagttatctttgcgtgtgcaactaaaattgatttttcttttctgtgtttttcatctagtttcccaaagcgtttgtgcttttcatcagaatggaagcccgggtttcagtgccccygcttctacccctcactcacccacggggcagctcctcttgttgcacatctgacgctcctgcacatcccccacgcaggccttccctccgtactgaggctcagggctgttgcagacccgggtgcgctcccggatcccaccggcacaggtgacagtgcaggccgaccacggggaccaggggctccagcggccatcgactgcggggaaagccaaccagggggagctcagagcaagacccggggtggagaacgtgagttggctgagtgagagggaagagcaggtgggacatggtgttccctacaca

SEQ ID NO: 26915 - DNA, 601 bp, Human
ttccacactacacaactacccacacaccatgttccagaccatacaactaccacgtgccaccttccagaccacacaactgcccatgcaccaccttccacaacacacaactacaccccaggtgccacactgcacaactacctatgcaccacattccagaccacacaactacccatgcgtcactttccacaccacacaaatacctacgtgccatgttccagaccacacagctgcccacgcaccaccttccacaacacacaactacaccccaggtgccacaccacacaactacctatgtgccacrttccagaccacacaactacccacacgccaccttccacactacacaactacctacacaccatgttccagaccacacaactaccatgtgccacattccagaccacacaactgcccacgcaccaccttccacaacacacaactgcccacacgtcaggtgctataccacacaactacctacatgccacattctagaccacacaactacccatgtaccatgttccagaccatacaactgcccacgcaccaccttctacaacacataactacatgcaaggtgacacaccacactactacctacatg

SEQ ID NO: 26916 - DNA, 601 bp, Human
caacacacaactacatgtcaggtgccacaccacaaacctacctacgcgccacgttccggatcacacaactacccacgtgccaccttccacactacacaactacccacacaccatgttccagaccatacaactaccacgtgccaccttccagaccacacaactgcccatgcaccaccttccacaacacacaactacaccccaggtgccacactgcacaactacctatgcaccacattccagaccacacaactacccatgcgtcactttccacaccacacaaatacctacgtgccatgttccmgaccacacagctgcccacgcaccaccttccacaacacacaactacaccccaggtgccacaccacacaactacctatgtgccacgttccagaccacacaactacccacacgccaccttccacactacacaactacctacacaccatgttccagaccacacaactaccatgtgccacattccagaccacacaactgcccacgcaccaccttccacaacacacaactgcccacacgtcaggtgctataccacacaactacctacatgccacattctagaccacacaactacccatgtaccatg

SEQ ID NO: 26917 - DNA, 601 bp, Human
actctggtgtgattctggatgatcatcaagaggcatcatctccaagaccgcattgctcaggtggacacagtgcagcgggttgcagaagcacgtgtacattatgactacacgccacgggccacaccacacaactacccacacgccaccttccacaacacacaactgcctacgcaccaggttccacaacacacaactacatgtcaggtgccacaccacaaacctacctacgcgccacgttccggatcacacaactacccacgtgccaccttccacactacacaactacccacacaccatgttmcagaccatacaactaccacgtgccaccttccagaccacacaactgcccatgcaccaccttccacaacacacaactacaccccaggtgccacactgcacaactacctatgcaccacattccagaccacacaactacccatgcgtcactttccacaccacacaaatacctacgtgccatgttccagaccacacagctgcccacgcaccaccttccacaacacacaactacaccccaggtgccacaccacacaactacctatgtgccacgttccagaccacacaactacccacacgccacctt

SEQ ID NO: 26918 - DNA, 601 bp, Human
gaagcagatgtcggggaccagggcacactgtggggacaagcagacatgagaggccgctcccgacctcagggcgcccacagcccagggcggggtcacccacctcgtccaggtcctcacagtgggtgccattgcccaagaagcccacagggcaggagccgcatgaccaggacccatcggggaagctgctgcactgggctcccgggaagcaggggttggataaacagccatctgggtgggagaaggcggagcagagttcaccacgcgccctgcgcagcacagaaggaagcccgccctgtgggcygtcaaacactctgggatgtctttgtcatcgaattgtgtagtcaggaacactctggtgtgattctggatgatcatcaagaggcatcatctccaagaccgcattgctcaggtggacacagtgcagcgggttgcagaagcacgtgtacattatgactacacgccacgggccacaccacacaactacccacacgccaccttccacaacacacaactgcctacgcaccaggttccacaacacacaactacatgtcaggtgccacaccacaaacctacctacgcgccacgttccggatcacacaac

SEQ ID NO: 26919 - DNA, 601 bp, Human
gtgctcagcttccccgggccagcccctcccatgcctctcccgggccacgccaccccttcctctccttcctcctgctgcttttctgagctcatctgatttttccaaagccgctcgcaacacacaaggaaggccggccttgcgtacttgcttttccgtcttggctgcttccaggccgaccccgacgggctggttccctctgtatcggggcgggcagggcaggcagtggaagccaggctgagtgttgacacagcgaggcaccttgctggtggagaagcagatgtcggggaccagggcacactgyggggacaagcagacatgagaggccgctcccgacctcagggcgcccacagcccagggcggggtcacccacctcgtccaggtcctcacagtgggtgccattgcccaagaagcccacagggcaggagccgcatgaccaggacccatcggggaagctgctgcactgggctcccgggaagcaggggttggataaacagccatctgggtgggagaaggcggagcagagttcaccacgcgccctgcgcagcacagaaggaagcccgccctgtgggctgtcaaacactctgggatgtctttgtcatcg

SEQ ID NO: 26920 - DNA, 601 bp, Human
cgaggcggggcgtcgggcaccgcaggccccagcaggtccggtcccaagcggacccaagtcctgaagtgggaagggctttctggacacgcacttgaggtgctgttcgttcctgaggctccgtttgtgactcagccatcgtttctgagcctcggctgcagctcaccaagggctgcgctaacagcggagaggtggcggcctgaccctcacaggcccggctgagcacgccccgcaccccgcgcggagagcagcggcccagccgagcaggtgctcagcttccccgggccagcccctcccatgcctmtcccgggccacgccaccccttcctctccttcctcctgctgcttttctgagctcatctgatttttccaaagccgctcgcaacacacaaggaaggccggccttgcgtacttgcttttccgtcttggctgcttccaggccgaccccgacgggctggttccctctgtatcggggcgggcagggcaggcagtggaagccaggctgagtgttgacacagcgaggcaccttgctggtggagaagcagatgtcggggaccagggcacactgtggggacaagcagacatgagaggccgctcccgacctc

SEQ ID NO: 26921 - DNA, 601 bp, Human
tctttccaagtgacatagcctggccagacctgcctgagacacaatggcctctgcacagcctggagccgagcgtggagccggcgtcctccctctgctcagtttcaggcgttaacgatgcgcgcaattgcaaatatgggccgacgtgcccgaggttctctgtgcccagcagtgggcggcgccagagtgtgcctgtgtctactaaggacctccagagaggggaccagggggatgcattcaacctggtgatcaggcaagaggcctgagagaccctccttccaaattccctgtgctgcccccgccscccgtccgcgtagcgtccccggcgccaggaggagggctgaccgccgtggccccgtgtgccctgcgagccccgcgcctcaccttgatgcagtggtaggtggcgttggtggcgcagaccagattgaggttgggccagccgtccaggtccgagtcctccccgcagatgagcccgtcgcccgcgtagcctgtctggcactcgcacttgtacatggggtcgctgaagtggcccaggtagatgcactccgcgtgcttgtggcagttgtgtgtcttgtccttgcatgggttttcgggctcacacacc

SEQ ID NO: 26922 - DNA, 601 bp, Human
aaacaactgcagaaacaagaagagaatgacaaggtattgctctgagagaacatgggagagaaaagaggctttagtggtgctttccttcccacagacttcagctcataaatcaaaatgccaaagcttataaacgtttaaccctcaccagtcaaaaaatctcaaagaaaagagtctttcaaatatgtatgtgatatgttcagaaaccagggctgagaacttgaaattatctgctaactcagcttttcacggtgagtgggtaatgcatgtaattgggcaaaaaactcctttcatttcagtccarttataccataatttaaagctgagctgtgcagacactaacaacttgagggaattggaaatccaggaaaaggtagagagtagcgtgtccgtttcagtttcagtacaagagccccaagggtgtgtcatccccgtggctcaaagcacatcactcgttgaatcagaagacagaacctggggtcttgtgctggagcccagagtttcagcacttacagattaagaaaggagagcatgttgcttgtcatggaggacacggatcccagacgggggcccctggcaatggggaggatccagcacctgtgtg

SEQ ID NO: 26923 - DNA, 601 bp, Human
agcccagaatcccagtgaggttgccaaacaactgcagaaacaagaagagaatgacaaggtattgctctgagagaacatgggagagaaaagaggctttagtggtgctttccttcccacagacttcagctcataaatcaaaatgccaaagcttataaacgtttaaccctcaccagtcaaaaaatctcaaagaaaagagtctttcaaatatgtatgtgatatgttcagaaaccagggctgagaacttgaaattatctgctaactcagcttttcacggtgagtgggtaatgcatgtaattgggcaaaaaactcctttcatttcagtccaattataccataatttaaagctgagctgtgcagacactaacaacttgagggaattggaaatccaggaaaaggtagagagtagcgtgtccgtttcagtttcagtacaagagccccaagggtgtgtcatccccgtggctcaaagcacatcactcgttgaatcagaagacagaacctggggtcttgtgctggagcccagagtttcagcacttacagattaagaaaggagagcatgttgcttgtcatggaggacacggatcccagacgggggcccctggca

SEQ ID NO: 26924 - DNA, 601 bp, Human
tgtggacctcgctgctcctggaacccagggcaggtgcgcggcacaagctgctcctaccttctcatcggtcacaccgtcattgtcatcgtcatcatcacaggcatcgccaatcccgtccttgtcaaagtcttcctgcccagaatttggcagatgggggcagttatcctgcaattagagaaggaagaatacttggaaaaacatttaggaaagcgcctctttcaggaatgcaggtgaaatgaaaccagcatggcgccgaggaaggaagcgtgccccatcagtcctcgatctcaagcgggagctsagagaggagccaggaggccagaagcgcatgaatttcttctcaactcctgccctggaaattatgtcaccactactcacgagggagacaaaagaaacttgtgttcggagcccagaatcccagtgaggttgccaaacaactgcagaaacaagaagagaatgacaaggtattgctctgagagaacatgggagagaaaagaggctttagtggtgctttccttcccacagacttcagctcataaatcaaaatgccaaagcttataaacgtttaaccctcaccagtcaaaaaatctcaaagaaaaga

SEQ ID NO: 26925 - DNA, 601 bp, Human
gacaatggcagttacgttgacaagggctgtttggtataaagtggcctcctgtggacctcgctgctcctggaacccagggcaggtgcgcggcacaagctgctcctaccttctcatcggtcacaccgtcattgtcatcgtcatcatcacaggcatcgccaatcccgtccttgtcaaagtcttcctgcccagaatttggcagatgggggcagttatcctgcaattagagaaggaagaatacttggaaaaacatttaggaaagcgcctctttcaggaatgcaggtgaaatgaaaccagcatggcsccgaggaaggaagcgtgccccatcagtcctcgatctcaagcgggagctcagagaggagccaggaggccagaagcgcatgaatttcttctcaactcctgccctggaaattatgtcaccactactcacgagggagacaaaagaaacttgtgttcggagcccagaatcccagtgaggttgccaaacaactgcagaaacaagaagagaatgacaaggtattgctctgagagaacatgggagagaaaagaggctttagtggtgctttccttcccacagacttcagctcataaatcaaaatgccaa

SEQ ID NO: 26926 - DNA, 601 bp, Human
actgaggtaaaatccgcttttgcaaaggactgtctttatagtgacctttgggaactgcctatgcacaaacgcttgcaggacaatggcagttacgttgacaagggctgtttggtataaagtggcctcctgtggacctcgctgctcctggaacccagggcaggtgcgcggcacaagctgctcctaccttctcatcggtcacaccgtcattgtcatcgtcatcatcacaggcatcgccaatcccgtccttgtcaaagtcttcctgcccagaatttggcagatgggggcagttatcctgcaattrgagaaggaagaatacttggaaaaacatttaggaaagcgcctctttcaggaatgcaggtgaaatgaaaccagcatggcgccgaggaaggaagcgtgccccatcagtcctcgatctcaagcgggagctcagagaggagccaggaggccagaagcgcatgaatttcttctcaactcctgccctggaaattatgtcaccactactcacgagggagacaaaagaaacttgtgttcggagcccagaatcccagtgaggttgccaaacaactgcagaaacaagaagagaatgacaaggtattgctct

SEQ ID NO: 26927 - DNA, 601 bp, Human
cagtggctcacaccattaatcccagcactttgggaggccaaggcaggcgggtcacctgaggtcaggagttcgagaccagcctggccaacatggtgaaaccccatctctcctaaaaatacaaaaatgagccgggcgtggtggtgtgcgcctgtaatgccagttactcaggagactgaggcaagagaatcgcttgaacccagaagatggagattgcagtgagccaagatcatgccattgcactcaagcctgagcgaccaaaaaaaaaaaaaaaaagagttagccctcgccaaacactttttcmatatcaaatcattttatcattatttatgcatctgtcttttgttgaaaatttgtagattgctaaggcaaaaatggtatatcatacacttcatggtgaggagagatatgtaaatatcaaataaatgaatggattagtgagtcaatgtctcccatcaaagtcagatgtaaaaaagcagtgagtaaaatcttgatctattcttgctagagctgttttgtgtacaaatacattaaaccatttgtgtttgcagcaattttcttagaaaaatggtaatattttaaatgttgccataaaggcaagtct

SEQ ID NO: 26928 - DNA, 601 bp, Human
ggcagttgtcacagcggtccccaacctcatccttgtcatagtcagcctggcggggattgaagaggagctggcagttgtcctggaaaaccaagaaagggaagactttaacgaagatcataggaatgtgtgtcgggccgtttagcacttataagttatgtactcaaggttgatgaaaatcaatatagaaatcaaacaaacacaaaagccagttagggctggacggtggctcacacctttaatcacagctgggcactgtggctcacacctgtaatcccagcacttcaaaaagccagtcagggcrgggcacggaggctcacacctttaatcccagcactatgggaggctgaggcgggcggatcacctgaggtcaggagttcaagaccagggccgggcgcagtggctcacacctttaatcccagtgctttaaaaagccagttaggcccgggcacagtggctcacaccattaatcccagcactttgggaggccaaggcaggcgggtcacctgaggtcaggagttcgagaccagcctggccaacatggtgaaaccccatctctcctaaaaatacaaaaatgagccgggcgtggtggtgtgcgcctgta

SEQ ID NO: 26929 - DNA, 601 bp, Human
tgcgacccttaaaatgcatgcattgggccgggcgcggtggctcacgcctgtaatcccagcactttgggaggccaaggcaggcggatcacttgaggtcaggagcttgagaccagcctggccaacatggtgaaacctcgtctctacttaaaatacaaaattagctaggcgtggtggtgtgcacctgtgatcccagctactcaggaggctgaagcaggagactcacttgaacccaaaaggtggagatcgcagtgagccaagatggtgctactgccctgggcaacaatagtgaaactccatctcaaaaaaaaaaaaaagtgcacgcatgggaaggagcagaagcacccaccgtccccatcaatgtccacggagcaggcgtcaccctctccattgttgtctgtgtcgatctgggcagggttgtgcacgtaagggcagttgtcacagcggtccccaacctcatccttgtcatagtcagcctggcggggattgaagaggagctggcagttgtcctggaaaaccaagaaagggaagactttaacgaagatcataggaatgtgtgtcgggccgtttagcacttataagttatgtactcaaggttgatgaa

SEQ ID NO: 26930 - DNA, 601 bp, Human
tggggtcagagagaggaggataccaaatgcatagctttctctagggcggtcctgtggctggtgtcccctgaccttcaggaaaaggcaaggcagaataagcatgggtccctatgggaataactgaatgaatcatttaatcttatagtagtgtaaaaatgaaaggagcttatcaaaattcagaataaaacatgaaacttgccaatgcctccaattgcgacccttaaaatgcatgcattgggccgggcgcggtggctcacgcctgtaatcccagcactttgggaggccaaggcaggcggatcayttgaggtcaggagcttgagaccagcctggccaacatggtgaaacctcgtctctacttaaaatacaaaattagctaggcgtggtggtgtgcacctgtgatcccagctactcaggaggctgaagcaggagactcacttgaacccaaaaggtggagatcgcagtgagccaagatggtgctactgccctgggcaacaatagtgaaactccatctcaaaaaaaaaaaaaagtgcacgcatgggaaggagcagaagcacccaccgtccccatcaatgtccacggagcaggcgtcaccctctccatt

SEQ ID NO: 26931 - DNA, 601 bp, Human
tgaagggtgaacattagaaaagatgccatgaagaagcacgaggcccaggactgcaaggctggggtcagagagaggaggataccaaatgcatagctttctctagggcggtcctgtggctggtgtcccctgaccttcaggaaaaggcaaggcagaataagcatgggtccctatgggaataactgaatgaatcatttaatcttatagtagtgtaaaaatgaaaggagcttatcaaaattcagaataaaacatgaaacttgccaatgcctccaattgcgacccttaaaatgcatgcattgggccrggcgcggtggctcacgcctgtaatcccagcactttgggaggccaaggcaggcggatcacttgaggtcaggagcttgagaccagcctggccaacatggtgaaacctcgtctctacttaaaatacaaaattagctaggcgtggtggtgtgcacctgtgatcccagctactcaggaggctgaagcaggagactcacttgaacccaaaaggtggagatcgcagtgagccaagatggtgctactgccctgggcaacaatagtgaaactccatctcaaaaaaaaaaaaaagtgcacgcatgggaag

SEQ ID NO: 26932 - DNA, 601 bp, Human
agtggcagaggtaaccacaatacacccacgttattctaactcctagaagctcagtttgatgaaaacatgaaatggcttcttggaatttttgaatgaagggtgaacattagaaaagatgccatgaagaagcacgaggcccaggactgcaaggctggggtcagagagaggaggataccaaatgcatagctttctctagggcggtcctgtggctggtgtcccctgaccttcaggaaaaggcaaggcagaataagcatgggtccctatgggaataactgaatgaatcatttaatcttatagtagwgtaaaaatgaaaggagcttatcaaaattcagaataaaacatgaaacttgccaatgcctccaattgcgacccttaaaatgcatgcattgggccgggcgcggtggctcacgcctgtaatcccagcactttgggaggccaaggcaggcggatcacttgaggtcaggagcttgagaccagcctggccaacatggtgaaacctcgtctctacttaaaatacaaaattagctaggcgtggtggtgtgcacctgtgatcccagctactcaggaggctgaagcaggagactcacttgaacccaaaagg

SEQ ID NO: 26933 - DNA, 601 bp, Human
gagccccctggccaccacgagccctcagacagcaacccaccacattcccagagaacgagaggagggtggaggcagaaatcagtggaaaagatcagactgagaaacccgctgtgagacagaacagcaggttggggtggctcagaaagggggtggctggcgccgggctgggaagaggaccccacgaggcgaagtgtggaggagctggggccgagctccagcgtggaggcgagcctgcccccagctcttgctggttctacagaagcactcgcctggtctccaggcaccccaagagaagggatgrccatgcggtgacagtggcactgggttgcagagctcgcttaccaaggccagcgaactctccggataaagcagcaaccgggatcagtggcagaggtaaccacaatacacccacgttattctaactcctagaagctcagtttgatgaaaacatgaaatggcttcttggaatttttgaatgaagggtgaacattagaaaagatgccatgaagaagcacgaggcccaggactgcaaggctggggtcagagagaggaggataccaaatgcatagctttctctagggcggtcctgtggctggtgtcc

SEQ ID NO: 26934 - DNA, 601 bp, Human
aagagccagaactgagctgagacgctcgccttgctttggtcaggtgaggtctggagaagggaagtaaggaacacctaaaaaataaaaatggaagggactggagcttgagatctgcatccagcacatcacagacgccatcctggatggggagccgaggagccccctggccaccacgagccctcagacagcaacccaccacattcccagagaacgagaggagggtggaggcagaaatcagtggaaaagatcagactgagaaacccgctgtgagacagaacagcaggttggggtggctcagaargggggtggctggcgccgggctgggaagaggaccccacgaggcgaagtgtggaggagctggggccgagctccagcgtggaggcgagcctgcccccagctcttgctggttctacagaagcactcgcctggtctccaggcaccccaagagaagggatgaccatgcggtgacagtggcactgggttgcagagctcgcttaccaaggccagcgaactctccggataaagcagcaaccgggatcagtggcagaggtaaccacaatacacccacgttattctaactcctagaagctcagtttgatga

SEQ ID NO: 26935 - DNA, 601 bp, Human
gtccacaggaagagccagaactgagctgagacgctcgccttgctttggtcaggtgaggtctggagaagggaagtaaggaacacctaaaaaataaaaatggaagggactggagcttgagatctgcatccagcacatcacagacgccatcctggatggggagccgaggagccccctggccaccacgagccctcagacagcaacccaccacattcccagagaacgagaggagggtggaggcagaaatcagtggaaaagatcagactgagaaacccgctgtgagacagaacagcaggttggggtrgctcagaaagggggtggctggcgccgggctgggaagaggaccccacgaggcgaagtgtggaggagctggggccgagctccagcgtggaggcgagcctgcccccagctcttgctggttctacagaagcactcgcctggtctccaggcaccccaagagaagggatgaccatgcggtgacagtggcactgggttgcagagctcgcttaccaaggccagcgaactctccggataaagcagcaaccgggatcagtggcagaggtaaccacaatacacccacgttattctaactcctagaagctca

SEQ ID NO: 26936 - DNA, 601 bp, Human
agtccacaggaagagccagaactgagctgagacgctcgccttgctttggtcaggtgaggtctggagaagggaagtaaggaacacctaaaaaataaaaatggaagggactggagcttgagatctgcatccagcacatcacagacgccatcctggatggggagccgaggagccccctggccaccacgagccctcagacagcaacccaccacattcccagagaacgagaggagggtggaggcagaaatcagtggaaaagatcagactgagaaacccgctgtgagacagaacagcaggttggggyggctcagaaagggggtggctggcgccgggctgggaagaggaccccacgaggcgaagtgtggaggagctggggccgagctccagcgtggaggcgagcctgcccccagctcttgctggttctacagaagcactcgcctggtctccaggcaccccaagagaagggatgaccatgcggtgacagtggcactgggttgcagagctcgcttaccaaggccagcgaactctccggataaagcagcaaccgggatcagtggcagaggtaaccacaatacacccacgttattctaactcctagaagctc

SEQ ID NO: 26937 - DNA, 601 bp, Human
gttcccaggagtttatcatccatgcacatgagtaggaaaaaaacaatggcagagagtggcagggtttttagatgtcatatcttatcttaagaaatctgaaagtgatgagttgcattgatactgaagttacaaaaatataaactagcactgaactaaacaataccatcagtgacagtgtcacaaatgacagagcaaaatgttacacggcagcgagtccacaggaagagccagaactgagctgagacgctcgccttgctttggtcaggtgaggtctggagaagggaagtaaggaacacctaawaaataaaaatggaagggactggagcttgagatctgcatccagcacatcacagacgccatcctggatggggagccgaggagccccctggccaccacgagccctcagacagcaacccaccacattcccagagaacgagaggagggtggaggcagaaatcagtggaaaagatcagactgagaaacccgctgtgagacagaacagcaggttggggtggctcagaaagggggtggctggcgccgggctgggaagaggaccccacgaggcgaagtgtggaggagctggggccgagctccagcgtgg

SEQ ID NO: 26938 - DNA, 601 bp, Human
tgtgttgagttcccaggagtttatcatccatgcacatgagtaggaaaaaaacaatggcagagagtggcagggtttttagatgtcatatcttatcttaagaaatctgaaagtgatgagttgcattgatactgaagttacaaaaatataaactagcactgaactaaacaataccatcagtgacagtgtcacaaatgacagagcaaaatgttacacggcagcgagtccacaggaagagccagaactgagctgagacgctcgccttgctttggtcaggtgaggtctggagaagggaagtaaggarcacctaaaaaataaaaatggaagggactggagcttgagatctgcatccagcacatcacagacgccatcctggatggggagccgaggagccccctggccaccacgagccctcagacagcaacccaccacattcccagagaacgagaggagggtggaggcagaaatcagtggaaaagatcagactgagaaacccgctgtgagacagaacagcaggttggggtggctcagaaagggggtggctggcgccgggctgggaagaggaccccacgaggcgaagtgtggaggagctggggccgagctc

SEQ ID NO: 26939 - DNA, 601 bp, Human
atgtgctgtcgccgtgtaaatctgagcttgctaaattgcttatttctccctaatacccacttggaaagtatgtgttgagttcccaggagtttatcatccatgcacatgagtaggaaaaaaacaatggcagagagtggcagggtttttagatgtcatatcttatcttaagaaatctgaaagtgatgagttgcattgatactgaagttacaaaaatataaactagcactgaactaaacaataccatcagtgacagtgtcacaaatgacagagcaaaatgttacacggcagcgagtccacaggwagagccagaactgagctgagacgctcgccttgctttggtcaggtgaggtctggagaagggaagtaaggaacacctaaaaaataaaaatggaagggactggagcttgagatctgcatccagcacatcacagacgccatcctggatggggagccgaggagccccctggccaccacgagccctcagacagcaacccaccacattcccagagaacgagaggagggtggaggcagaaatcagtggaaaagatcagactgagaaacccgctgtgagacagaacagcaggttggggtggctcagaaa

SEQ ID NO: 26940 - DNA, 601 bp, Human
aagaatatagtaaaatataaagactattagattttagaagaacatatgacatatttcattacagttcaaatacctttcatttgaaatagaaccaacttttggagatttctgggtaatgttgcaggaggggtagttgaatgtgctgtcgccgtgtaaatctgagcttgctaaattgcttatttctccctaatacccacttggaaagtatgtgttgagttcccaggagtttatcatccatgcacatgagtaggaaaaaaacaatggcagagagtggcagggtttttagatgtcatatcttatyttaagaaatctgaaagtgatgagttgcattgatactgaagttacaaaaatataaactagcactgaactaaacaataccatcagtgacagtgtcacaaatgacagagcaaaatgttacacggcagcgagtccacaggaagagccagaactgagctgagacgctcgccttgctttggtcaggtgaggtctggagaagggaagtaaggaacacctaaaaaataaaaatggaagggactggagcttgagatctgcatccagcacatcacagacgccatcctggatggggagccgaggagccccc

SEQ ID NO: 26941 - DNA, 601 bp, Human
tgagagaaacagcagaggactgccagtttgaggaggtggagaggaaccagcaggacgcaagcctgagagccggcctcctcgtcctgcagcacaagccccagggccacgcaggggcggctggcccgaggtcacactgaccctgacgtcaggacaagcactggggccaggcctctcggtccaggaatctctccaccctctgccacctctccacagtaattcacttcactaaaggaagatgtgcttcttcgctggaaaagcatgaactaccaggtaattatgtctcttttttacaccatttgcrccatttacaccatttacatcataggataatatatcctatgagctgcatcaagataactgtcctcccttgtctctttcaaacgcaaacctggaaatgaagccaattcctatgttggcatcaggaaaatggggagagaattctgtgaagacacaacctcgctccagctgatgaggtgaaggcgtctattcatttggcctgtggccactgagatacaagaatagtgctgagatttgagttgaataaatgttttcaattgaaatcattgaaaactccatgttatcctgtctttgtggagctcat

SEQ ID NO: 26942 - DNA, 601 bp, Human
ttgctgtgctcactccatcccttcatgctgctcggggagaacacaggagctgcccttctgatcccagcatctcccacgtacttctgagtcatgctgtctcagatgcccctcaagtccttatctccctctgtcaaggacgtggcttccaaagagagcctgtgtcagccaggccccactccaagtgagggccactttctcacagcctccccggaagccccagagcacagctgtgcccttgtttattactcagggacgctgacttagaggactgcagcccatccagctccttccttgggccccygtggctatgggccacctattcatgctcactgctgagcaaagcagctcttcctctcatgcttcacactcgtgccacttttgttggctttgctttcaaaaaaatcctccttgtcccctgcctggccccatacaccaaattcccaattcatcctacgttcgtaacccgcattctttctaggagatcgtcaacaatctggaagttatatggaggcagggatttctcctcctcccgacgtgcacacacacttgaggcagcacacctgttgaagggcacacacacagccaagaatgtgttgagtgt

SEQ ID NO: 26943 - DNA, 601 bp, Human
aatgtctgttattacttttcttagtcatccttgccttttatagtctatttggcattaaagcggaactcacactaaaatggtttttcctagggagacatggacttccgctgtttagtgggtccttgtcaagttttcagcggggttgtggcatggtggggagtggggatgaggtgggcctggtgcaaacagggggaccacgaatttgccacatgtgtccagtctatcagtctacggcgatgacgataacctgacaggcagattgcaatgtactgaattagctatcacgtggcctgccgttttggaggaaaggcaagttggattgaatatctcatcatattcttcaactagtttccgttctgttcaagaacatactccagctaccacgtggcaggcacatagttggtatcagggcattctgaaatgctgaaatgctgctctgcctatcagcttctctctgtcccagtccctccctggggaaaggctgcatggggagcaagcccctgcatgcccgaacacggagtccagatgaggcttgctgtgctcactccatcccttcatgctgctcggggagaacacaggagctgcccttctgatcccagca

SEQ ID NO: 26944 - DNA, 601 bp, Human
agttttctgaatgtctgttattacttttcttagtcatccttgccttttatagtctatttggcattaaagcggaactcacactaaaatggtttttcctagggagacatggacttccgctgtttagtgggtccttgtcaagttttcagcggggttgtggcatggtggggagtggggatgaggtgggcctggtgcaaacagggggaccacgaatttgccacatgtgtccagtctatcagtctacggcgatgacgataacctgacaggcagattgcaatgtactgaattagctatcacgtggcckgccgttttggaggaaaggcaagttggattgaatatctcatcatattcttcaactagtttccgttctgttcaagaacatactccagctaccacgtggcaggcacatagttggtatcagggcattctgaaatgctgaaatgctgctctgcctatcagcttctctctgtcccagtccctccctggggaaaggctgcatggggagcaagcccctgcatgcccgaacacggagtccagatgaggcttgctgtgctcactccatcccttcatgctgctcggggagaacacaggagctgcccttctg

SEQ ID NO: 26945 - DNA, 601 bp, Human
aaacctgaatggctgtcaagtaatatcaacctgcatttccagctttgtgtttggatagttttctgaatgtctgttattacttttcttagtcatccttgccttttatagtctatttggcattaaagcggaactcacactaaaatggtttttcctagggagacatggacttccgctgtttagtgggtccttgtcaagttttcagcggggttgtggcatggtggggagtggggatgaggtgggcctggtgcaaacagggggaccacgaatttgccacatgtgtccagtctatcagtctacggcratgacgataacctgacaggcagattgcaatgtactgaattagctatcacgtggcctgccgttttggaggaaaggcaagttggattgaatatctcatcatattcttcaactagtttccgttctgttcaagaacatactccagctaccacgtggcaggcacatagttggtatcagggcattctgaaatgctgaaatgctgctctgcctatcagcttctctctgtcccagtccctccctggggaaaggctgcatggggagcaagcccctgcatgcccgaacacggagtccagatgaggcttgc

SEQ ID NO: 26946 - DNA, 601 bp, Human
atttgacttcacaggaacctcaactcttttcacaaaatttttgtgataaatacacagcaaaggccagcacagcaaattcacataaagccatttctcaccgtgttccaaactcaatgctgcaggtataaaacctgaatggctgtcaagtaatatcaacctgcatttccagctttgtgtttggatagttttctgaatgtctgttattacttttcttagtcatccttgccttttatagtctatttggcattaaagcggaactcacactaaaatggtttttcctagggagacatggacttccgckgtttagtgggtccttgtcaagttttcagcggggttgtggcatggtggggagtggggatgaggtgggcctggtgcaaacagggggaccacgaatttgccacatgtgtccagtctatcagtctacggcgatgacgataacctgacaggcagattgcaatgtactgaattagctatcacgtggcctgccgttttggaggaaaggcaagttggattgaatatctcatcatattcttcaactagtttccgttctgttcaagaacatactccagctaccacgtggcaggcacatagttggtatcag

SEQ ID NO: 26947 - DNA, 601 bp, Human
tgcctgtaatcccagcactttgagaggccgaggtgggcagatcacctgaggtcaagagttcgagactggtctgaccaatatggtgaaaccttgtctctactaaaaatgcaaaaattagccgggcatggtggtgggtacctgtaatcccagctactcaggaggctgaggcaggagaatcacttgaaccggggaaaaaaggttgcagtgaactgagattgtaccactatactccagcctgggggacaagagcaagactccatctcaaaaaaaaaaagaaaaaaaagaaaaaaaaaagaaacaggtttcaggcaatccccagcttggccctgtgaccatctgacagtggatgcccagcaggcagggcgggctcccctcatcatcccgatgggctcttttaccatgagattagtggaattgaaggtatttcttttagatccaacttacaagagttctgagaggattatgaggtcccatttcatagaccaagtctataaaataaaatggtttactgaaatttcagagacttcagagcggcaggtgcatgtacctgtcaaggttatttaggcagacagtttcacagaccatggaaggatgggggctt

SEQ ID NO: 26948 - DNA, 601 bp, Human
cgggagtagtgactcatgcctgtaatcccagcactttgagaggccgaggtgggcagatcacctgaggtcaagagttcgagactggtctgaccaatatggtgaaaccttgtctctactaaaaatgcaaaaattagccgggcatggtggtgggtacctgtaatcccagctactcaggaggctgaggcaggagaatcacttgaaccggggaaaaaaggttgcagtgaactgagattgtaccactatactccagcctgggggacaagagcaagactccatctcaaaaaaaaaaagaaaaaaaagaaaaaaaaaagaaacaggtttcaggcaatccccagcttggccctgtgaccatctgacagtggatgcccagcaggcagggcgggctcccctcatcatcccgatgggctcttttaccatgagattagtggaattgaaggtatttcttttagatccaacttacaagagttctgagaggattatgaggtcccatttcatagaccaagtctataaaataaaatggtttactgaaatttcagagacttcagagcggcaggtgcatgtacctgtcaaggttatttaggcagacagtttcacagaccat

SEQ ID NO: 26949 - DNA, 601 bp, Human
aactcgtcaaaacctggatgcaacgccataaggtttcgttagaaacacctttcaggtggccgggagtagtgactcatgcctgtaatcccagcactttgagaggccgaggtgggcagatcacctgaggtcaagagttcgagactggtctgaccaatatggtgaaaccttgtctctactaaaaatgcaaaaattagccgggcatggtggtgggtacctgtaatcccagctactcaggaggctgaggcaggagaatcacttgaaccggggaaaaaaggttgcagtgaactgagattgtaccactatactccagcctgggggacaagagcaagactccatctcaaaaaaaaaaagaaaaaaaagaaaaaaaaaagaaacaggtttcaggcaatccccagcttggccctgtgaccatctgacagtggatgcccagcaggcagggcgggctcccctcatcatcccgatgggctcttttaccatgagattagtggaattgaaggtatttcttttagatccaacttacaagagttctgagaggattatgaggtcccatttcatagaccaagtctataaaataaaatggtttactgaaatttcagagact

SEQ ID NO: 26950 - DNA, 601 bp, Human
tgcttccacatcaccacatagaagcggctgcttgactggtaaccaaagacgaagccggcatagtcgtcgtcccggtcagtgtttacgtagaatgtgccactgaagtccacagacccaaactcgtcaaaacctggatgcaacgccataaggtttcgttagaaacacctttcaggtggccgggagtagtgactcatgcctgtaatcccagcactttgagaggccgaggtgggcagatcacctgaggtcaagagttcgagactggtctgaccaatatggtgaaaccttgtctctactaaaaatrcaaaaattagccgggcatggtggtgggtacctgtaatcccagctactcaggaggctgaggcaggagaatcacttgaaccggggaaaaaaggttgcagtgaactgagattgtaccactatactccagcctgggggacaagagcaagactccatctcaaaaaaaaaaagaaaaaaaagaaaaaaaaaagaaacaggtttcaggcaatccccagcttggccctgtgaccatctgacagtggatgcccagcaggcagggcgggctcccctcatcatcccgatgggctcttttaccatgagatta

SEQ ID NO: 26951 - DNA, 601 bp, Human
tgctcactccctatctccagaagagggtaaaagaggtttaatttgtaaaaggattagcaactgtatttaactggtaattatcaactgtgttgagttgtaaccccaggcacagtgtctataataaagtaagattattaaaataactgtgcctggagttaaaattaataaagacaaaagtggggtctctggactgggctagtcctgctgaaacactctgcagccacagtggtgcagaggagatgtgtgggcctggccagccaacctcacctgccccggcgtgttccccgtgtgccacagcgcrttcctcaggtgctcgcccgtccccgtggtggagttcaccaccttgagggacacgccggagtagccataggcccgcgtgggctggtcctcccagtaggtctgcgtcacctgcttccacatcaccacatagaagcggctgcttgactggtaaccaaagacgaagccggcatagtcgtcgtcccggtcagtgtttacgtagaatgtgccactgaagtccacagacccaaactcgtcaaaacctggatgcaacgccataaggtttcgttagaaacacctttcaggtggccgggagtagtgactc

SEQ ID NO: 26952 - DNA, 601 bp, Human
tgtagccagtcttgggcctgtgagtcaggtgccacctataggccgtgtagtccttccagccaatgttcctggggtcgtgccataaggttcgcacctgagagagaacatagcactcttgagtgccatgggcacccggagccttaaccacagctctgtaacaccaagcaggaagcaaaaacatgactttgcaagttcatgcttaaggctcatggtgctccatatctctctgatgtgtttatcatccaaatctctactgtggattgaagcccatggacagagtgtggctcagggctgagagccwaggcacctgaccctcagattcctggattgaagagcccaggcacctgatcctcagattcctgggttcatgtctggatcttctctttccttgatatgggatgttgggcaaaattcttgaagttttgatattcaattctccctagcttcaatttttaaaatatttttttcatattatatctttgatcattatgtcctatgctcactccctatctccagaagagggtaaaagaggtttaatttgtaaaaggattagcaactgtatttaactggtaattatcaactgtgttgagttgtaacccca

SEQ ID NO: 26953 - DNA, 601 bp, Human
agcaggactggatacaccaagcccccgacaggaggatggggcatcaatatgaataaacaggaggccccctagggaaacgttccagcgaggccacgagcctgcacttcacccacacagatctgccctctattgccagggactcacacactcctggcatctgtgcagagtccagcctgatcttggtgcttattaactttgaaaaaacaaaaacaccttgattttaaattgaccacattttgtttgaataaaaatcaattataaatactgttaagccaagggaaaagattctgttgggctaacygtgtcaaaacttcatacaaccgtgttttaaattcagccatttatatcaggtacaaatctagtctccaataaagcacatgctaattctgcaaagatgcagttattttaattgcaggtgttctcccctgcctggggtattcattaggagaaaatatggttatcatcccaaaacaaagcagattgtatattctccttttcaaccattttttaaaaatacttaatatttagtagagatgcaggatagaaaagagaaagcagttaatgacgaagaatccagagtaaaacaaaaagttagaattca

SEQ ID NO: 26954 - DNA, 601 bp, Human
aggaaagaaagacaacatgaactctgtgaagcattcaccagtgatggaaggttggctccggacacaagctgtggatactccgcccagggcttcagtgccccagggggcattgctggctttctcctttggagctccagccacccctggtgcagcactgatccagggcacgccttccttcttgcaaccacactattgtcacaatctgtgagttcacttacagtcacccaggcaagggctttagaggagactctacctttggtggggtgaggaggaagcttcccacttcctgggaagatgcacyggactctccctacttcaccttgtgctaaaaccatgagctcaccggctctcctccccactgtggaagctgcgtgggagcaggactggatacaccaagcccccgacaggaggatggggcatcaatatgaataaacaggaggccccctagggaaacgttccagcgaggccacgagcctgcacttcacccacacagatctgccctctattgccagggactcacacactcctggcatctgtgcagagtccagcctgatcttggtgcttattaactttgaaaaaacaaaaacaccttgattttaaa

SEQ ID NO: 26955 - DNA, 601 bp, Human
cctttctgggtgccacatgccttccccactaacctgaagtgctcacactcacctctgcattcgtacttgaggtctgagaaatagaccatttcttgagagaagacaaatagacccagccgcccgccagcgtaggtttggtcatagataggtcctgagtctgccatgacctgttttccttcatgcactaagactctaaaaatggtgtttaaaaagaagaagaggaaagaaagacaacatgaactctgtgaagcattcaccagtgatggaaggttggctccggacacaagctgtggatactccrcccagggcttcagtgccccagggggcattgctggctttctcctttggagctccagccacccctggtgcagcactgatccagggcacgccttccttcttgcaaccacactattgtcacaatctgtgagttcacttacagtcacccaggcaagggctttagaggagactctacctttggtggggtgaggaggaagcttcccacttcctgggaagatgcaccggactctccctacttcaccttgtgctaaaaccatgagctcaccggctctcctccccactgtggaagctgcgtgggagcagg

SEQ ID NO: 26956 - DNA, 438 bp, Human
tgcacagtattcccttcaactccatatacacataaatacaataagtaattacattttatatgtaaacgtcattctttttaaacaaacaagaaaaagcaatgtaatggcatgcccaattttcactccacataaagtctcatatatcaccaaactggtttcctctagtgggttagatgttcatctctgagttccattgatatttatcctctgaaggcacttgggtttggggttgctggcaggaggtgaagaaccatcagagttaaggtcaagggacaggaggtgctgctagagagagaagccrcaaggaccacaatgaactgaggtgtctagggaccatggcatgcacagggcattgccggaaatgcagcaaatcttgtttaaatatctacaaaaagaaaaaaaaaagcaataaacaattagcataactgggccatgggt

SEQ ID NO: 26957 - DNA, 601 bp, Human
aagcaccgcactttgctctgctaaccttttacttaaatgaggttttgccaaatccacatctggaaccgcgtcacacccatttgcaaggatgtttgttctttgatgaaactgcatctctactgcacatgagggctttcattgtaggacaagaggagagttcgtttatttttgtaactgttttacatgttccgattagttaatcggtagcttatgtcatttgctatgcctgttgtcttctaatctctccttactaaaacattacttcaaatttgaattgacccttgtttataatttatttaaygggatttgtgtgtcattgtagagcaactctaattcaagaatagtgacaactttaagcaccaaaagtagttcagcaatatttttcatgcttaatttatcataatggcttatgcacagtattcccttcaactccatatacacataaatacaataagtaattacattttatatgtaaacgtcattctttttaaacaaacaagaaaaagcaatgtaatggcatgcccaattttcactccacataaagtctcatatatcaccaaactggtttcctctagtgggttagatgttcatctctgagttc

SEQ ID NO: 26958 - DNA, 601 bp, Human
aaagcaccgcactttgctctgctaaccttttacttaaatgaggttttgccaaatccacatctggaaccgcgtcacacccatttgcaaggatgtttgttctttgatgaaactgcatctctactgcacatgagggctttcattgtaggacaagaggagagttcgtttatttttgtaactgttttacatgttccgattagttaatcggtagcttatgtcatttgctatgcctgttgtcttctaatctctccttactaaaacattacttcaaatttgaattgacccttgtttataatttatttarcgggatttgtgtgtcattgtagagcaactctaattcaagaatagtgacaactttaagcaccaaaagtagttcagcaatatttttcatgcttaatttatcataatggcttatgcacagtattcccttcaactccatatacacataaatacaataagtaattacattttatatgtaaacgtcattctttttaaacaaacaagaaaaagcaatgtaatggcatgcccaattttcactccacataaagtctcatatatcaccaaactggtttcctctagtgggttagatgttcatctctgagtt

SEQ ID NO: 26959 - DNA, 601 bp, Human
ttctatagtcacttaataaatattaacaaaatatttataactggaaccttaatgaaatgtatcatcaaatcaggtaaaagcaacttgtccgcagttaccaaagcctagatacgcgttagatgcgccttttccggcctgtgcgtctgctctggttcctctcaggcagcaaagctggggaaggaagctcaggcaggagcctccccgacgccacaacggcacaagcagcagctaaagcaccgcactttgctctgctaaccttttacttaaatgaggttttgccaaatccacatctggaaccgcrtcacacccatttgcaaggatgtttgttctttgatgaaactgcatctctactgcacatgagggctttcattgtaggacaagaggagagttcgtttatttttgtaactgttttacatgttccgattagttaatcggtagcttatgtcatttgctatgcctgttgtcttctaatctctccttactaaaacattacttcaaatttgaattgacccttgtttataatttatttaacgggatttgtgtgtcattgtagagcaactctaattcaagaatagtgacaactttaagcaccaaaagtagt

SEQ ID NO: 26960 - DNA, 601 bp, Human
atacttattagatgtttgtttctagaaattatactacatatgtgttactaggcatatttaaaataagttactggtaaatggagttgcattctatagtcacttaataaatattaacaaaatatttataactggaaccttaatgaaatgtatcatcaaatcaggtaaaagcaacttgtccgcagttaccaaagcctagatacgcgttagatgcgccttttccggcctgtgcgtctgctctggttcctctcaggcagcaaagctggggaaggaagctcaggcaggagcctccccgacgccacarcggcacaagcagcagctaaagcaccgcactttgctctgctaaccttttacttaaatgaggttttgccaaatccacatctggaaccgcgtcacacccatttgcaaggatgtttgttctttgatgaaactgcatctctactgcacatgagggctttcattgtaggacaagaggagagttcgtttatttttgtaactgttttacatgttccgattagttaatcggtagcttatgtcatttgctatgcctgttgtcttctaatctctccttactaaaacattacttcaaatttgaattgaccct

SEQ ID NO: 26961 - DNA, 601 bp, Human
gattatatacttattagatgtttgtttctagaaattatactacatatgtgttactaggcatatttaaaataagttactggtaaatggagttgcattctatagtcacttaataaatattaacaaaatatttataactggaaccttaatgaaatgtatcatcaaatcaggtaaaagcaacttgtccgcagttaccaaagcctagatacgcgttagatgcgccttttccggcctgtgcgtctgctctggttcctctcaggcagcaaagctggggaaggaagctcaggcaggagcctccccgacrccacaacggcacaagcagcagctaaagcaccgcactttgctctgctaaccttttacttaaatgaggttttgccaaatccacatctggaaccgcgtcacacccatttgcaaggatgtttgttctttgatgaaactgcatctctactgcacatgagggctttcattgtaggacaagaggagagttcgtttatttttgtaactgttttacatgttccgattagttaatcggtagcttatgtcatttgctatgcctgttgtcttctaatctctccttactaaaacattacttcaaatttgaatt

SEQ ID NO: 26962 - DNA, 601 bp, Human
ccttctacccctttcccccccggtagaaaccctgctagttctttttaaaaaagggagagagatcatgtatagaaaaccttttttacaatttattttcctgttgttaatctttaaaaatgaggttctagctaagtgcagggtttcagtggtgaaattttgaccatgtgaacacataaataaatatttacagtctttggcaaaacacatgacgtttcatcaacctatacgataaatttgtttagaaaaacataaataatttacaaaaaatatggtacattctaaatactcacatcatcgtcaytcccacaccattgtacggttgaccccacaacacagaaacagaaaacctgcacgctgttgacagtcgctacatttaatgaagtatcccaacgcttcgttggtctcgggaatacagctccacacgcaaaaaagtaaaaagtgcagcaaaacaacaacacaacgatcaacctcaaaggaaacaacaaaattaattttatcaaaatgcaatgtgtacattaagactaaagttatggattgttcctgtttggcatagaaatgtgatgactattaacagaaaggggaaaaagatttgccccctatc

SEQ ID NO: 26963 - DNA, 601 bp, Human
agcaaaatgccaattccttctacccctttcccccccggtagaaaccctgctagttctttttaaaaaagggagagagatcatgtatagaaaaccttttttacaatttattttcctgttgttaatctttaaaaatgaggttctagctaagtgcagggtttcagtggtgaaattttgaccatgtgaacacataaataaatatttacagtctttggcaaaacacatgacgtttcatcaacctatacgataaatttgtttagaaaaacataaataatttacaaaaaatatggtacattctaaataytcacatcatcgtcactcccacaccattgtacggttgaccccacaacacagaaacagaaaacctgcacgctgttgacagtcgctacatttaatgaagtatcccaacgcttcgttggtctcgggaatacagctccacacgcaaaaaagtaaaaagtgcagcaaaacaacaacacaacgatcaacctcaaaggaaacaacaaaattaattttatcaaaatgcaatgtgtacattaagactaaagttatggattgttcctgtttggcatagaaatgtgatgactattaacagaaaggggaaaaa

SEQ ID NO: 26964 - DNA, 601 bp, Human
gaggctggtgtggggtggaggccggtggtcgtccatgttggtcggtggcccaggactggccagtgcacagagggtggcagctggggccctggtgccagtggcccctggtttccaaactccacagccctcaggaagttctgggtgtcctcatgcctgcaaggctcaggggagggtgctgtggctcgagccacaggggttgggtggggcgtgcaagccaccaggaagctgaagggctctgccactgtgtcgcccaccctggggtcggggtcagggccagggcacctgctgaggacagggaccrctctgggcttgaggcctgagcctgtggagctgccatgcccagtcctcctcccctacctacagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctggctca

SEQ ID NO: 26965 - DNA, 601 bp, Human
ggaccgctctgggcttgaggcctgagcctgtggagctgccatgcccagtcctcctcccctacctacagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctrgctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaa

SEQ ID NO: 26966 - DNA, 601 bp, Human
ccgcggcggcccacggccaccggcgactacgacaagaagaactacgtctgagggcgctgggcacggccgggcccctcctgccagccacgcctgcgaggcgttggataagcctggggagccccgcatggaccgcggcttccgccgggtagcgcggcgcgcaggctcctcggaacgtccggctctgcgccccgacgcggctcctggatccgctcctgcctgcgcccgcagctgaccttctcctgccactagcccggccctgcccttaacagacggaatgaagtttccttttctgtgcgcggcrctgtttccataggcagagcgggtgtcagactgaggatttcgcttcccctccaagacgctgggggtcttggctgctgccttacttcccagaggctcctgctgacttcggaggggcggatgcagagcccagggcccccaccggaagatgtgtacagctggtctttactccatcggcagggcccgagcccagggaccagtgacttggcctggacctcccggtctcactccagcatctccccaggcaaggcttgtgggcaccggagcttgagagagggcgggagtgggaaggctaagaatctgc

SEQ ID NO: 26967 - DNA, 601 bp, Human
agtacttgctgcatgtcaggccacagatcaggcactggaaccacaaagaagagataaaagacacatcatcccgcccctcagagaactggcagagtcggaggccgtcagcttccttcttaggattcagtcattggagaaaaggcccctcatggggggccgaatgtgatggaggccttgacatgaaagtgagatttctgcaggggtttccacgtcatatccaagccaggccatctgggtcagaggctttggattgaggctggcagtgaggacagggtgaggcttccaaggagctcttcagccrgctggccaccagtgctcctccttctccccctccttcctctcctcctctttccctatgccaggagggcaggctatttttagtcaggcatgggcaacagcagctggcctctgggatctagttactccttgaagtgaagtggggagggggatctcagaccaaaacaacagctccaaatcagaagccctctctaggagagcggagtctctctaactctggtctgtcatcttctgccccttcccatcatcctcagggctcccagagccctgcatctgagcaggccccacgccctgccggcctccc

SEQ ID NO: 26968 - DNA, 601 bp, Human
aattagcgtgccttcatcttttctctgtagcttttcagggatgagatatcaggggtgtgaaagggctttgtaaagggctagcaccattccagcactattttccagttttctgcagctcctaatggtgcccggtactttaatagttgctcaataaaatgtttgttctcaaataaataataatgcaacacaaagttattgagtacttgctgcatgtcaggccacagatcaggcactggaaccacaaagaagagataaaagacacatcatcccgcccctcagagaactggcagagtcggaggcygtcagcttccttcttaggattcagtcattggagaaaaggcccctcatggggggccgaatgtgatggaggccttgacatgaaagtgagatttctgcaggggtttccacgtcatatccaagccaggccatctgggtcagaggctttggattgaggctggcagtgaggacagggtgaggcttccaaggagctcttcagccggctggccaccagtgctcctccttctccccctccttcctctcctcctctttccctatgccaggagggcaggctatttttagtcaggcatgggcaacagcagct

SEQ ID NO: 26969 - DNA, 601 bp, Human
cgaaccccctaccttaggcgatctgcctgcctcagcttcccaaagtgatgggattacaggcgtgagccaccgcgcgcagcctgtgaccccagttttgagcaaaagagaggagacaacaagttaagcccaaggccttctcacttgtcaattgaaggccaagtcgggaaccccccccaccccccagtgaccttaggcacgtcaattagcgtgccttcatcttttctctgtagcttttcagggatgagatatcaggggtgtgaaagggctttgtaaagggctagcaccattccagcactatttkccagttttctgcagctcctaatggtgcccggtactttaatagttgctcaataaaatgtttgttctcaaataaataataatgcaacacaaagttattgagtacttgctgcatgtcaggccacagatcaggcactggaaccacaaagaagagataaaagacacatcatcccgcccctcagagaactggcagagtcggaggccgtcagcttccttcttaggattcagtcattggagaaaaggcccctcatggggggccgaatgtgatggaggccttgacatgaaagtgagatttctgcagggg

SEQ ID NO: 26970 - DNA, 601 bp, Human
tctaggattttacagtcctgagccaccacgcccccctgcctggtcattaattgataaactgcacagagtcgtggagcgcttctatacctgcccccaggagactatggggaacttggtgaagttacgcccagcccagcccacaaggccaaggacactgcaccggagccaggcaccagtgcccgccgtcctctggggctcccacccgctcttcccaagctcccgttggccctcaccgtcgaagtcaatgcggccgtcgttgttcttgtcgccgtctttcatcagagattcgatctcctcgtcmgtcacgtgctccccggaggccctgaaaatctcagccagctcctccgggtcgatgtagccgtctgcattccttcaggtccgagggacagggcagggctcagggccggggcgagctgccctggccaccacactcgacgccccgcttccgcactcccaacacggggaagcttccagcgctgccggccgggttctgactgctaagcccctccctcggctcccgggcccccagcgcacctgtcgaagatgcggaagcactcggccagctcctcctcgctcttccctttcgcgtcctctttcatct

SEQ ID NO: 26971 - DNA, 601 bp, Human
ccgccaagctgtgcacgcccagcgccagctgtcaggagccggctgcaaacctgcagagcgagtcagcgccatcgagcactcgcagccgccgcctcgggctccagggcccagctcccttccacatcccgccgctcagacagcctctcccggggatccccaagggtgctccgggtggtgccagccgggatggcgccctggaccacagcccttgcgacctgctgtcctcggctctcccctcattcaggccacgagttttggaacatttgcttttattccttccagacaaagacccacaaggggycgcgcctccctggtggggacccggcagggcggagtctcccacaccctagggacacgcgatcttggtagaggcgactgtccactccttactgcacgccctccatcatcttcaggaactctgagggaaaggagagggagagggtcaggggtcccactggggacgcagaggccaggccagggctccagccacacagaggggatgactttttgtttttgtttttgttgagacagagtctcactctgttgccaaggtcgccaaggtctgtcacccaggctagagtgcagtggcacaatcataact

SEQ ID NO: 26972 - DNA, 601 bp, Human
aatcttgagaagatgataaaagtctgccttgcattttggggctctagagagggatgctaaatttctttctttctttctttctttctttatttttttgagacggagtcttgctctgacgccaggctggagtgcagtggcgcgatctcagctcattgcaacctcgacctcccgggttcaagcgattctgctgcctcagcctcctgagtagctgggactacaggcacgcgccaccaggcccagctaatttttgtatttttagtagaggcagggtttcaccatgttgcccaggatggtctcgatytcttgaccttgtgatccgcccgcctcagcctcccaaagtgctgggattacaggcgtgagccactgtgcccggctacatattaagctttataattcctaggtgctgcattattctggagggtgttttttgtttgtttgtttttgtttttttgagatggagtctcactctgtcgcccaggctggagcgcagtggctagatctcggctcactgcaagctccgcctcccgggttcactgccattctcctgcttcagcctcccaactagctgggactacaggcgcccgccatcatgcccggctaa

SEQ ID NO: 26973 - DNA, 601 bp, Human
ttcaagtgattctcctgcctcagcctcccaagtagctgggaactacaggcgcgtgccaccacgctaactaattttgtatttttagtagagacggggtttcaccattttggtcaagctggtctcgaactcctgacctcatgtgatccacctgcctcggcctccaaaagtgctgggattataggcatgagccactgcgcctggcagtaagcctgtttcttttcagaatgttttggtcaacagggaaagtgttacaatagtcatgtgcttggatttggagagaatcgaaatagactgtttttcyttatgtgaaatcttgtagacttttagggtagtcaggaagatgcatttgacatgaagaaaaaacagtggctgcaggaatttgaatgtgatctgggtgtagttgaggtgtgtggtggcagcacaccgctctgcacctctctgcctgctggcggccttctggcagtgggatgagaatcgggaggtaagtaaagggaattttgttttgctgcctccctgaaggagctgaatgagcagcatgtgctcctagtacgtaattttagcatgtgctctgtcagatgtgttgagaggaaagtgatgctta

SEQ ID NO: 26974 - DNA, 601 bp, Human
gctaactaattttgtatttttagtagagacggggtttcaccattttggtcaagctggtctcgaactcctgacctcatgtgatccacctgcctcggcctccaaaagtgctgggattataggcatgagccactgcgcctggcagtaagcctgtttcttttcagaatgttttggtcaacagggaaagtgttacaatagtcatgtgcttggatttggagagaatcgaaatagactgtttttctttatgtgaaatcttgtagacttttagggtagtcaggaagatgcatttgacatgaagaaaaarcagtggctgcaggaatttgaatgtgatctgggtgtagttgaggtgtgtggtggcagcacaccgctctgcacctctctgcctgctggcggccttctggcagtgggatgagaatcgggaggtaagtaaagggaattttgttttgctgcctccctgaaggagctgaatgagcagcatgtgctcctagtacgtaattttagcatgtgctctgtcagatgtgttgagaggaaagtgatgcttattgtgtatattaaccatattaggttcctttttttaaaaaaagtggaaatttgtcagggtatg

SEQ ID NO: 26975 - DNA, 601 bp, Human
atttttttttttttaaggacggagtctcactctgtcgcccaggctggagtgcagtggcgtgatctgggctcactgcagcctccacctcctgagttgaagtgattctcttgcctcagcctcccgagtagctgggattacaggcgcacagcaccatgcctggctaatttttgtatttttagtagagacggagtttcaccacgttggccaggttggtctcgaactccagacctcaggtaatctgcctgcctcagcctcccatagtgctgggattacacgcaagaaagagtttttttttttttttgagactttttgctcttgttgcccaggctggagtggaatggtgcgatcttggctcactgcagcctctgcctcccaggttcaagtgattctcctgtctcagcctcccgagtacctggggttacaggtgcatgccaccacgcctggctaatttttgtatttttggtagagacggcctttcatcatattggtcaggctggtctcggactcctgacctcaggtgatctgcccgcctcggcctcccaaagtgctgggattacaggcatgagctatcgtacccggccaagaaagagaatttttaaag

SEQ ID NO: 26976 - DNA, 601 bp, Human
gattacacgcaagaaagagtttttttttttttttgagactttttgctcttgttgcccaggctggagtggaatggtgcgatcttggctcactgcagcctctgcctcccaggttcaagtgattctcctgtctcagcctcccgagtacctggggttacaggtgcatgccaccacgcctggctaatttttgtatttttggtagagacggcctttcatcatattggtcaggctggtctcggactcctgacctcaggtgatctgcccgcctcggcctcccaaagtgctgggattacaggcatgagcyatcgtacccggccaagaaagagaatttttaaagagaagctagtcatatatgagctgaagatactgagaactcattctaaagtggtaaagctttgaatgatgcccctttcagaggtcatgttctttttttttttttttttttttaaagacctgagaaagttcaagtcttcatgatcaggaatctttctgttgctcagttctaactacgttaagcacaaaagataatttaccttttggttcgtgtaactgactcttgccaaggtttggaactgacctcaggaacacaagtgttttcttaagg

SEQ ID NO: 26977 - DNA, 601 bp, Human
acgcaagaaagagtttttttttttttttgagactttttgctcttgttgcccaggctggagtggaatggtgcgatcttggctcactgcagcctctgcctcccaggttcaagtgattctcctgtctcagcctcccgagtacctggggttacaggtgcatgccaccacgcctggctaatttttgtatttttggtagagacggcctttcatcatattggtcaggctggtctcggactcctgacctcaggtgatctgcccgcctcggcctcccaaagtgctgggattacaggcatgagctatcgtrcccggccaagaaagagaatttttaaagagaagctagtcatatatgagctgaagatactgagaactcattctaaagtggtaaagctttgaatgatgcccctttcagaggtcatgttctttttttttttttttttttttaaagacctgagaaagttcaagtcttcatgatcaggaatctttctgttgctcagttctaactacgttaagcacaaaagataatttaccttttggttcgtgtaactgactcttgccaaggtttggaactgacctcaggaacacaagtgttttcttaagggtgttt

SEQ ID NO: 26978 - DNA, 601 bp, Human
acctggggttacaggtgcatgccaccacgcctggctaatttttgtatttttggtagagacggcctttcatcatattggtcaggctggtctcggactcctgacctcaggtgatctgcccgcctcggcctcccaaagtgctgggattacaggcatgagctatcgtacccggccaagaaagagaatttttaaagagaagctagtcatatatgagctgaagatactgagaactcattctaaagtggtaaagctttgaatgatgcccctttcagaggtcatgttctttttttttttttttttttttaaagacctgagaaagttcaagtcttcatgatcaggaatctttctgttgctcagttctaactacgttaagcacaaaagataatttaccttttggttcgtgtaactgactcttgccaaggtttggaactgacctcaggaacacaagtgttttcttaagggtgtttttttctgtcacctgtgtcactgtccatctgcctcctcctctctgcatatggaattctatgagtgcagacggtgcccggctgccaacagttccagcttctattgtccaagcccagactgagagccctgagggaaaagg

SEQ ID NO: 26979 - DNA, 601 bp, Human
ctgaatttggggagtgctgctttctcacttggccctgtccacgtggcttctctgaaacatacccttcaaggttggggtggctgtggaatgtttcccagaagacatgttcctatacaaagacagaacaggtcacatttcataaatctcacatatgagaggcccatgtttttgtcctaggacatcgtaagttttgaatcccaagggtgttttggagctgtgggctgtgcccttccagtcccccacagcagtgctgttgcccaagaatctcctagcgagagaccaggggctactgccaggtgayagaaaagggaacatcagttccgctatacccacagctcacctggcggcctggggcctgcacagggcctggttgaggcagtggaccccatttttgggccgtctgtggagttgatgttcctgccagctggtccctctctgtcttccctggaacttcacctgcagtttgatgcctgagttaaaattgttcttctaaataattcactgtagactttctgtttttagctatgtgaaaacttctgagaaacttggagagtggaatgagaaagtgacccagtcagacctgtgagtgcctgtatcatca

SEQ ID NO: 26980 - DNA, 601 bp, Human
ttctcacttggccctgtccacgtggcttctctgaaacatacccttcaaggttggggtggctgtggaatgtttcccagaagacatgttcctatacaaagacagaacaggtcacatttcataaatctcacatatgagaggcccatgtttttgtcctaggacatcgtaagttttgaatcccaagggtgttttggagctgtgggctgtgcccttccagtcccccacagcagtgctgttgcccaagaatctcctagcgagagaccaggggctactgccaggtgacagaaaagggaacatcagttcygctatacccacagctcacctggcggcctggggcctgcacagggcctggttgaggcagtggaccccatttttgggccgtctgtggagttgatgttcctgccagctggtccctctctgtcttccctggaacttcacctgcagtttgatgcctgagttaaaattgttcttctaaataattcactgtagactttctgtttttagctatgtgaaaacttctgagaaacttggagagtggaatgagaaagtgacccagtcagacctgtgagtgcctgtatcatcagcacctcctccttcctcctct

SEQ ID NO: 26981 - DNA, 601 bp, Human
gagcgagactttgtctcaaaaaaaaaaaaaagaaagaaagtgcatcctctggtaggccttgggccgggggcgggcatgagagagctgcgctgggatgcgctgccagggcacacttggtgggtcacacactcttgtcaactgtttgggggctggagagtagtagcactcagctcacacgggccttctgcagggagtggtgggagggcctgtgagtaagggctccggaaggcccatcattgggacctggtgccgccagtgggagcaggaggagcctgtgccttctctggcgccagtcatcccrgatgccactcagggcttggctgggtttgccagctctccaggttggcactggtaacgccaagatggtcctgggagcccatctccattcagcctcgagttccctggcttcactgagggaggagccgtgataaggtggctgtgggttcgcattttggactttgttatgtcagagtctgctgtgttttgtgtttatggtggcagctggatgagggccagcgacttcaggtgttgactgtcatggtgggcccaacagtatccctgcagccacagcatcctgcctgctgccctttgcctgtcctgc

SEQ ID NO: 26982 - DNA, 601 bp, Human
caggggttgtaggagtggatgatataggttgtcaccatcaacagcatcctggccccaacttctgggtgctgctgcccaccctgccctgacccctttcccattctcagaactggtcttctggcttttggatctcagggagtgcctccctgtagctctgacccaatcctggcaaagatgggtgcaggcttcctaaaggaccggtgtgtggagcacagtgctgaccccacccagccctcccctcttcccctcttgtggcccctgcaggattcagagatacgtacatctcctgctgggctgcctscctgcctgcctgcctgcctccctgcctgcctgccttaggttaggtgtgtcctgcctccccgcctgtggttgccaggtgggggtcgtcctgcgccagtgctttcccctgaccactaagccacaggccaggacacagacggccacacacacccagggacccaccctgccaagcagaggggatggccactgcccaggagctgtgcccacttttatttttgtttttttgaggtaatctaccttcccatccctgcaacttctatttcgagaagttttaaacctctggagaagctgcagtcatcag

SEQ ID NO: 26983 - DNA, 601 bp, Human
gggcctgactgagcacgagcagggggcctcccctggggctccccgaggagggctgtgagtgggtgctggcctcccttgcttacacttcgtttcctcttctctcctgctgccaccttccagggctcatccattttcacactcctttaggtaaggctgagcctggacacacctgtggaagacttttctctgaattggggcagggtggactccggcagggcccttgggcggctgtgctagtagagggcagtgaaagtgggatcaccccttccaggacagcagtgccagccaggtggttgctgcrtctcagggaacaaagcagcagcgtgggatcgacgcagaggccccccggaaccccccggcccttctgtgtcccctcctcgtgcttcccttcaggctcacagaccgcctgctgccgggtctgtgaataactggcctggcgtccaggcctgagtttactcctgaaaaggagcttttttttttttttagacggagtcttgctctgtcgcccaggttggagtgccgtggcgcgatctcggctcactgcaagctccgcctcccgggttcacgccattctcctgcctcagcctctccgagtagctgg

SEQ ID NO: 26984 - DNA, 601 bp, Human
ggcagggtggactccggcagggcccttgggcggctgtgctagtagagggcagtgaaagtgggatcaccccttccaggacagcagtgccagccaggtggttgctgcatctcagggaacaaagcagcagcgtgggatcgacgcagaggccccccggaaccccccggcccttctgtgtcccctcctcgtgcttcccttcaggctcacagaccgcctgctgccgggtctgtgaataactggcctggcgtccaggcctgagtttactcctgaaaaggagcttttttttttttttagacggagtctygctctgtcgcccaggttggagtgccgtggcgcgatctcggctcactgcaagctccgcctcccgggttcacgccattctcctgcctcagcctctccgagtagctgggactacaggcgcccgccgccacgcccggctaattttttgtatttttagtagagacggggtttcaccgtggtctcgatctcccgacctcgtgatccgcccgcctcggcctcccaaagtgctgggattacaagcgtgagccaccgcgcccggccttttttttcttttttttgttggagtctcgctctatcaccaggc

SEQ ID NO: 26985 - DNA, 601 bp, Human
gcagggcccttgggcggctgtgctagtagagggcagtgaaagtgggatcaccccttccaggacagcagtgccagccaggtggttgctgcatctcagggaacaaagcagcagcgtgggatcgacgcagaggccccccggaaccccccggcccttctgtgtcccctcctcgtgcttcccttcaggctcacagaccgcctgctgccgggtctgtgaataactggcctggcgtccaggcctgagtttactcctgaaaaggagcttttttttttttttagacggagtcttgctctgtcgcccaggytggagtgccgtggcgcgatctcggctcactgcaagctccgcctcccgggttcacgccattctcctgcctcagcctctccgagtagctgggactacaggcgcccgccgccacgcccggctaattttttgtatttttagtagagacggggtttcaccgtggtctcgatctcccgacctcgtgatccgcccgcctcggcctcccaaagtgctgggattacaagcgtgagccaccgcgcccggccttttttttcttttttttgttggagtctcgctctatcaccaggctggagcacagtggtgt

SEQ ID NO: 26986 - DNA, 601 bp, Human
gcatgagccaccacgcctggctaatttttgtatttttagtagagacggggtttcaccatgttggccagcatggtctcgatctcctgacctcgtgatccacccgccttggcctcccaaagtgctgggattacaggcgtgagccactgcgccgggccctcaaaggagccttttcacgtgggagggctgtgccgactctcaccaccttcctgttcaacatctgtcctgtttccttgttttccttcagatggagttttgtcttgtttactacccgagagcccataggtgtgcctcccaaagggcyctcctgcagaccagagcaagctcctctaggccaagccggggcgccgccagcacgtgcccttctgctggaaccgggaggtctagagccaggcccagaacaatctgtgatttcttgtgtttttacttgacttggtggtttctcttttgccaaaaggtccttacttgacttctgaaggctgtttgtaccaaatacttttcaaaagcccaagcctggtctcctcacagcttcctatggcagtgctctcccccctcccagtgctatgcgctgggcaacttggggtgccccccgtgaggccaaggg

SEQ ID NO: 26987 - DNA, 601 bp, Human
agttttgtcttgtttactacccgagagcccataggtgtgcctcccaaagggccctcctgcagaccagagcaagctcctctaggccaagccggggcgccgccagcacgtgcccttctgctggaaccgggaggtctagagccaggcccagaacaatctgtgatttcttgtgtttttacttgacttggtggtttctcttttgccaaaaggtccttacttgacttctgaaggctgtttgtaccaaatacttttcaaaagcccaagcctggtctcctcacagcttcctatggcagtgctctccccsctcccagtgctatgcgctgggcaacttggggtgccccccgtgaggccaagggaggaccctggggtcgagtttcctttgggggcattgtgtggaggggcaggcagctcgctccaactgctgggagtgggggaatcccagctctgcccatccctgccaagttggggttgtgtgtggatcttggtgttaactcttgcttccttctctgcttctgccatgcttccaagcagcagctactccatccgccactcaataagtatgccagccatgaggtaatgtatgcctgctcgctgcggctccaga

SEQ ID NO: 26988 - DNA, 601 bp, Human
ctcccaaagggccctcctgcagaccagagcaagctcctctaggccaagccggggcgccgccagcacgtgcccttctgctggaaccgggaggtctagagccaggcccagaacaatctgtgatttcttgtgtttttacttgacttggtggtttctcttttgccaaaaggtccttacttgacttctgaaggctgtttgtaccaaatacttttcaaaagcccaagcctggtctcctcacagcttcctatggcagtgctctcccccctcccagtgctatgcgctgggcaacttggggtgccccccrtgaggccaagggaggaccctggggtcgagtttcctttgggggcattgtgtggaggggcaggcagctcgctccaactgctgggagtgggggaatcccagctctgcccatccctgccaagttggggttgtgtgtggatcttggtgttaactcttgcttccttctctgcttctgccatgcttccaagcagcagctactccatccgccactcaataagtatgccagccatgaggtaatgtatgcctgctcgctgcggctccagagccgggtgtctctggtgggggttggggcagctcccgccgg

SEQ ID NO: 26989 - DNA, 601 bp, Human
tctaggccaagccggggcgccgccagcacgtgcccttctgctggaaccgggaggtctagagccaggcccagaacaatctgtgatttcttgtgtttttacttgacttggtggtttctcttttgccaaaaggtccttacttgacttctgaaggctgtttgtaccaaatacttttcaaaagcccaagcctggtctcctcacagcttcctatggcagtgctctcccccctcccagtgctatgcgctgggcaacttggggtgccccccgtgaggccaagggaggaccctggggtcgagtttccttygggggcattgtgtggaggggcaggcagctcgctccaactgctgggagtgggggaatcccagctctgcccatccctgccaagttggggttgtgtgtggatcttggtgttaactcttgcttccttctctgcttctgccatgcttccaagcagcagctactccatccgccactcaataagtatgccagccatgaggtaatgtatgcctgctcgctgcggctccagagccgggtgtctctggtgggggttggggcagctcccgccggttacaccttgcccttcccatattcctggattaattga

SEQ ID NO: 26990 - DNA, 601 bp, Human
tcagtacgagagcccggggtatccctgtaggggacagcagagaggggccgacagccccccaactgcgcagacttttcataacctcagtacgagagcccggggtgtccctgtaggggacagcagagaggggccgacagccccccaactgcacagacttttcataacctcagtacgagagcccgggatgtccctgtagggtatgacagagaggggccgacatctccccagctgcacagtcaaggggtttccagttgccttgtgtgacgtctggacctgtccctgtggttgttgggcatggccracctcacttttgacctggggagtctccggaatgacctggctgtctcacagttttgccatgagatcttgggatgttgttagggaccctttggaggctggccctaaccctgaggcccttccgagttaggagagcagcacaaccctctcctcttgacaccgacactcttccctctctctttaaaggaactctgcgaccttcaagtcgtttgaggaccgagttgggaccataaaggtaattgtacctggactgtttgatggtcttggcaaggtgtgacctgttacagcaacttgtttattatta

SEQ ID NO: 26991 - DNA, 601 bp, Human
tgacctggggagtctccggaatgacctggctgtctcacagttttgccatgagatcttgggatgttgttagggaccctttggaggctggccctaaccctgaggcccttccgagttaggagagcagcacaaccctctcctcttgacaccgacactcttccctctctctttaaaggaactctgcgaccttcaagtcgtttgaggaccgagttgggaccataaaggtaattgtacctggactgtttgatggtcttggcaaggtgtgacctgttacagcaacttgtttattattagtcatttagtyatggtagactcacatacagttgtgggaagtaatgcagagaggttccttgtgccttttacacagttctctcctgtgacgacatcttggaaaatcctgtagtgcagcctccccaccaggacattggcactgactcaggacacagaacgcctccacactgcccttcctggtccccactgcccttcctggtccccactgcccttcctggtaccttcttggccatgctgaccttcctcccgccctacccccggcaacccctagtccactctccctttgtataattgtgtcatttcaagaatgtca

SEQ ID NO: 26992 - DNA, 601 bp, Human
cctggggagtctccggaatgacctggctgtctcacagttttgccatgagatcttgggatgttgttagggaccctttggaggctggccctaaccctgaggcccttccgagttaggagagcagcacaaccctctcctcttgacaccgacactcttccctctctctttaaaggaactctgcgaccttcaagtcgtttgaggaccgagttgggaccataaaggtaattgtacctggactgtttgatggtcttggcaaggtgtgacctgttacagcaacttgtttattattagtcatttagttatkgtagactcacatacagttgtgggaagtaatgcagagaggttccttgtgccttttacacagttctctcctgtgacgacatcttggaaaatcctgtagtgcagcctccccaccaggacattggcactgactcaggacacagaacgcctccacactgcccttcctggtccccactgcccttcctggtccccactgcccttcctggtaccttcttggccatgctgaccttcctcccgccctacccccggcaacccctagtccactctccctttgtataattgtgtcatttcaagaatgtcacgt

SEQ ID NO: 26993 - DNA, 601 bp, Human
tgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcrcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaa

SEQ ID NO: 26994 - DNA, 601 bp, Human
tcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatrgtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtcca

SEQ ID NO: 26995 - DNA, 601 bp, Human
aaatccagtaataaaatttcaccgttattcaagatccatctcccagcatccctgactaatcctactgtatgctgatctctcgttgatcagcccctggctatcttatcctcctttctacactaaacactcatcctcctccccacaatgtcccttcccttctggatcctttatcgtgctttctgattattgaggtagcattttggaagtaacgagggggagtctggccgaatctgcttagaaacccctgggaatcttgattcctggtgtgtgttcttcagcaccactctggagtacagcacaycttttgtgaatcagaagaggatcaggtactgaattccctcccggtaactggagttatatagttgtcgttgtattaataacttaaagacttagaacaatgacagctatcaactcatttggggctttattacaaagtaataatgcttttcattcagctgtggagtgtgtttactttttataggatgagtgggaggaaaacagctgggataagtggttcaccggttcttttgtcaggataataagagggtcagaaaagtttggagaagtgctgcttggtagaatttgttggtagaatttccag

SEQ ID NO: 26996 - DNA, 601 bp, Human
ctggtcaggtttcacagaccagatggaacttggactagaccagaatatatgtatgcaatagccaggaggtctcccttccaccagtcttgtttctctttgatccatccttcacatttctagagttagattccttaaaaaaaaaaaaaaaccttgtattataccctcatttaaaacaaagccattttggaatctcaactgcttttgtgtaaaaattaaaaaaaaaaattgaatggtatatatgaggccatttgccatccaactctggcctccttatgtagcctcagttctcatcatttcttaygtccatagccccttcatccccacctttcatcctttgcctccccttgaacatttcattcttacactcacctagatgtttcaggtctttttgccaatacatgcctttgcatgtggcgtttcatcttccgtcaggcttctaccatccgtcatctgtaaactcctgcttcatcctttaagatccagtcgggtcttgacaccattatgttttggaaaatcaactgatttaattctgcgcgccccctccccccaccacctcgtatttatgtgtgtttgccattgtgttagggcctgcagcttcaga

SEQ ID NO: 26997 - DNA, 601 bp, Human
ttaaagtaagaaattcatggataggataattgcatgtataataatttgtaatgaaaatttgtgtgtgtaggagagagatccttgtaagtaaagcatgtggaaataggtgacaaataagccattaaatcccattaggcttttttcctttgctaatatattgataatgaggtttctaatgagagatctatctgacttgttagtgctctcttgttattcttgatctcaagtcactcaggtttgcttattgaggtgaagataggtgatttgggttcttagtgctactgtatatctttcaaatttygtattggaatacattttaaaataggtgattttcttatatgattagtacatgacctagctagttttaattttataaagtagtatcaactttattttgtttccatttttattttggtagattttcttacatttttctcttttttaattatatttttgagacatatagcctatctcttcagaatcagtatctgatttaagttttatagttgtatcagggtttggtatgattcccacagtgattttttttaattatgactttgagttttctgagtattagaattcttatttgttactattatag

SEQ ID NO: 26998 - DNA, 601 bp, Human
atcccattaggcttttttcctttgctaatatattgataatgaggtttctaatgagagatctatctgacttgttagtgctctcttgttattcttgatctcaagtcactcaggtttgcttattgaggtgaagataggtgatttgggttcttagtgctactgtatatctttcaaatttcgtattggaatacattttaaaataggtgattttcttatatgattagtacatgacctagctagttttaattttataaagtagtatcaactttattttgtttccatttttattttggtagattttctyacatttttctcttttttaattatatttttgagacatatagcctatctcttcagaatcagtatctgatttaagttttatagttgtatcagggtttggtatgattcccacagtgattttttttaattatgactttgagttttctgagtattagaattcttatttgttactattataggacagttcccaagaagtaaacatccaacttgagaattaccatacatgaaaataacagctgtgcctgggaggcctttatgaccccttcagctatcaggccctcagttgttccatggcaacaagatt

SEQ ID NO: 26999 - DNA, 601 bp, Human
ttttaattttataaagtagtatcaactttattttgtttccatttttattttggtagattttcttacatttttctcttttttaattatatttttgagacatatagcctatctcttcagaatcagtatctgatttaagttttatagttgtatcagggtttggtatgattcccacagtgattttttttaattatgactttgagttttctgagtattagaattcttatttgttactattataggacagttcccaagaagtaaacatccaacttgagaattaccatacatgaaaataacagctgtrcctgggaggcctttatgaccccttcagctatcaggccctcagttgttccatggcaacaagattgaaatgagatttggggtccaccaaccacccatttgctttgtccggtaaaggaaaaaaaaatgtgtgcttttgttttctccacatcgagaatttccctctccttcttcagggtataccttaattacagagcttggaggttattgcagaggaaatacttgtgttggggtgaggggcatgttggtcagaaagacccagagcagtggacattaagctttgtcgtaaagagtgtgaattctc

SEQ ID NO: 27000 - DNA, 601 bp, Human
cgagtattctgagtgctccatgaatacattgatgggcttaaaggagaggactgataaaatacagcttgttttaatacaggttgagtatcgcaaattcgaaagtctccaatgaacatgtcctttgaacttcatgtccatgattttggagcatttggaattttcaggttagggtcactcagcctgtattacttttgatggggccaagagtggaaactgagggaccacttaggaggtaattcacctcatggaggcaagagatggtggtggtttggaaagttaggatagtggtagtgaaaatgcratggatttgagctctcttctagacaaagaattaacaggatttcctgttagcttcgctgtgaggagtcaactgaagtaaagaatcagaggaggattgttaagtttccagtgtgaacagctgggcgtggggattcctgggttggcaaagcctggagaaaatcaggtggtggggggcatgttaagcttgaactttgttgcgtttgaggtgctagtgtggcatccaataatggtgccattaaatggtaccattactactaaacattttttccccctaaagctctaaacttgtccagcccacagc

SEQ ID NO: 27001 - DNA, 601 bp, Human
agttaattttcaccatctgacatgttcttttttttccctaatacccagtgtgatagcacatctgacatgttctttattttactttgttattaactgaactgctttctcgctataagatcgtcagggatttttgcgtatggatcactgccatatccccagcacctaaaatagggtgtggtctatagtaaatgctcagtaaatatttgtttattgaatatatgaaacgacttgaaggattctgtagtgtttccacgattaaattttcttactagtatttgttcaggcttttggcttaaaacarttcagttctcttttttaagtgaatgtagattttgtatatacacacacatatatatgtggatttgcattgtttaggaataaaaacctaaaatctaccattcatattttaattttcttaattttcaggttacaactgatggaaaaccaaaaatcgttgatatcattgatacaacaggaagtggcgatgtgaatactgctacagaagtagagccaaaggatggtgagattgttggcctttcaggaagagtgcttaaggtgagaccttttgtcttctttttgaatttttttttttttactcttg

SEQ ID NO: 27002 - DNA, 601 bp, Human
ttgatatcattgatacaacaggaagtggcgatgtgaatactgctacagaagtagagccaaaggatggtgagattgttggcctttcaggaagagtgcttaaggtgagaccttttgtcttctttttgaatttttttttttttactcttgcctcaaagcatctaatgtttttaccttacatttggtggtggtattagttatccattgccacatatcagattacctcagaacatcctggtttaaaatgacaaatatttattacctcggagtttctgtgagtcaggaatctgggtgtggcttaacggggttccagtcgccctggaggttgcaaatggttagccatggctgtgacttcagctgaaggctcagcttgggagaagaaggggaagtttgtttccaagcctactggtgggtcactggcaggccttggctccttgccattgggcctctccgcagtgctgcagtacctggcagcaccttccctgggggagtgagccgagagagtccccacgatgaaagccacaggctttttataaaagtgaccttctaagggaccacctatcacttgactatattgagctcattggaagtgagttaataaatc

SEQ ID NO: 27003 - DNA, 601 bp, Human
gatatcattgatacaacaggaagtggcgatgtgaatactgctacagaagtagagccaaaggatggtgagattgttggcctttcaggaagagtgcttaaggtgagaccttttgtcttctttttgaatttttttttttttactcttgcctcaaagcatctaatgtttttaccttacatttggtggtggtattagttatccattgccacatatcagattacctcagaacatcctggtttaaaatgacaaatatttattacctcggagtttctgtgagtcaggaatctgggtgtggcttaacggcgttccagtcgccctggaggttgcaaatggttagccatggctgtgacttcagctgaaggctcagcttgggagaagaaggggaagtttgtttccaagcctactggtgggtcactggcaggccttggctccttgccattgggcctctccgcagtgctgcagtacctggcagcaccttccctgggggagtgagccgagagagtccccacgatgaaagccacaggctttttataaaagtgaccttctaagggaccacctatcacttgactatattgagctcattggaagtgagttaataaatcta

SEQ ID NO: 27004 - DNA, 601 bp, Human
atatcattgatacaacaggaagtggcgatgtgaatactgctacagaagtagagccaaaggatggtgagattgttggcctttcaggaagagtgcttaaggtgagaccttttgtcttctttttgaatttttttttttttactcttgcctcaaagcatctaatgtttttaccttacatttggtggtggtattagttatccattgccacatatcagattacctcagaacatcctggtttaaaatgacaaatatttattacctcggagtttctgtgagtcaggaatctgggtgtggcttaacgggattccagtcgccctggaggttgcaaatggttagccatggctgtgacttcagctgaaggctcagcttgggagaagaaggggaagtttgtttccaagcctactggtgggtcactggcaggccttggctccttgccattgggcctctccgcagtgctgcagtacctggcagcaccttccctgggggagtgagccgagagagtccccacgatgaaagccacaggctttttataaaagtgaccttctaagggaccacctatcacttgactatattgagctcattggaagtgagttaataaatctag

SEQ ID NO: 27005 - DNA, 601 bp, Human
cattgatacaacaggaagtggcgatgtgaatactgctacagaagtagagccaaaggatggtgagattgttggcctttcaggaagagtgcttaaggtgagaccttttgtcttctttttgaatttttttttttttactcttgcctcaaagcatctaatgtttttaccttacatttggtggtggtattagttatccattgccacatatcagattacctcagaacatcctggtttaaaatgacaaatatttattacctcggagtttctgtgagtcaggaatctgggtgtggcttaacggggttcaagtcgccctggaggttgcaaatggttagccatggctgtgacttcagctgaaggctcagcttgggagaagaaggggaagtttgtttccaagcctactggtgggtcactggcaggccttggctccttgccattgggcctctccgcagtgctgcagtacctggcagcaccttccctgggggagtgagccgagagagtccccacgatgaaagccacaggctttttataaaagtgaccttctaagggaccacctatcacttgactatattgagctcattggaagtgagttaataaatctagcaca

SEQ ID NO: 27006 - DNA, 601 bp, Human
cacttaaggggaagggatttcacaagaaatgaatcattggagctgtcttagaagaagccattattttgttgtttgatgaggtaattagaattgggcggtatttttcagtgagcttgccaaattttatgttttgaatacaaagatagagaaagtaaccacatcatagctttgccttcatgttttactgtcccttcatagtattcccagttaacttgaccatgaagaaatacttaggctatagtagctgttaacttaaatggccagctttgtcttttttttttttttaaacttctttttttcttttttttttcgagacatagagtcttgctccgttgctcaggctagagtgcagtggtgcaatcttggctcactgcaacctccgcctcccgggttctagcaattctcctgcctcagcctcccaattagctgggattacaggtgcccgccaccacgtccagctaatttttgtatgattagtagagacagggtttcaccattttggctaggctggtctcgaactcttgaccttgtgatccgcctgtctcagcctcccaaagtgctgggattataggcgtgagccagggcactcggcctaccagct

SEQ ID NO: 27007 - DNA, 601 bp, Human
tcacaagaaatgaatcattggagctgtcttagaagaagccattattttgttgtttgatgaggtaattagaattgggcggtatttttcagtgagcttgccaaattttatgttttgaatacaaagatagagaaagtaaccacatcatagctttgccttcatgttttactgtcccttcatagtattcccagttaacttgaccatgaagaaatacttaggctatagtagctgttaacttaaatggccagctttgtcttttttttttttttaaacttctttttttcttttttttttcgagacataragtcttgctccgttgctcaggctagagtgcagtggtgcaatcttggctcactgcaacctccgcctcccgggttctagcaattctcctgcctcagcctcccaattagctgggattacaggtgcccgccaccacgtccagctaatttttgtatgattagtagagacagggtttcaccattttggctaggctggtctcgaactcttgaccttgtgatccgcctgtctcagcctcccaaagtgctgggattataggcgtgagccagggcactcggcctaccagctttgtcttattctatgtcct

SEQ ID NO: 27008 - DNA, 601 bp, Human
ttgaccttgtgatccgcctgtctcagcctcccaaagtgctgggattataggcgtgagccagggcactcggcctaccagctttgtcttattctatgtccttggtagaaaggcctgggtaagctaaacgtaaaaaataattataaagcaagcacagaggagctcatgagctaaggagcatgaaggatggatggcaagaatttgtgatcctgtactcttaagcagcattagtttggaacataaaattatggttatttagttagcttttcccaccttttgccatctatctgaattgttcttaggycttgtcttttaagtaagcttgttgtggcagcatattggctttctgtgccgtgtaataaagcaccacagacttagccgcctaaaaccttgtgtattcctgtatttattatatcactgattccatggggtaggagtccaggcatggctttttgtgggtctctgctcagggtctcacaagactgcagtcaagattaaaggctcagctgaggctcaggcttcttttccaagtttacatgattgttggaaaaattcatttcattgcagctgtaaaactcatgatagcttgcttcttcaaggccag

SEQ ID NO: 27009 - DNA, 601 bp, Human
gagcatgaaggatggatggcaagaatttgtgatcctgtactcttaagcagcattagtttggaacataaaattatggttatttagttagcttttcccaccttttgccatctatctgaattgttcttaggccttgtcttttaagtaagcttgttgtggcagcatattggctttctgtgccgtgtaataaagcaccacagacttagccgcctaaaaccttgtgtattcctgtatttattatatcactgattccatggggtaggagtccaggcatggctttttgtgggtctctgctcagggtctsacaagactgcagtcaagattaaaggctcagctgaggctcaggcttcttttccaagtttacatgattgttggaaaaattcatttcattgcagctgtaaaactcatgatagcttgcttcttcaaggccagtaagagaatctctgaccttggtgatgaccccagtctttcttttaaagaactcacctgattagttcaggcccgctgagaatcatgtcacttttgatttgctcagagtccttaattgcgtctgcaaaatccctacaccttctttacgtaccataacgcaatcatgggagtgaca

SEQ ID NO: 27010 - DNA, 601 bp, Human
agcttggttggtgaagtttgggcaggatgtgggatggggcaatgggagtgctcttatacaaattttccgccagtcttcttagtcagaactctcttctccatccatccataacatgtactcacacacatgttcagtttaatttttttcagggatgtgcaggtgtttagatattttgcagtagtcaataaaaggaagaattattaatcactgggattctgactagttgcatctctgcaactctttagtacatagttttcagaaagcagcacaatgaagtcttcaagtttctttgatgtagtcrtgcatttatttatttatttatttattcatttatttatttatgacagagtcttgctctgtcgtccaggctggagtgcagtggtgtgatcttggctcactgcaacctccgtctcctgggttccagcaattttcctgcctcagcctcccaagtcgctgggattataggcacccgccaccatgcccggctaattttttgtatttttagtagagactgggtttcaccatgctggctaggcaggtctcgaactcctgacatcaggtgatccacccacttcggcctcccagagtgctgggattacaa

SEQ ID NO: 27011 - DNA, 601 bp, Human
ataaactgctaacagacttttatttttctgtcagtttaagatcaactgttaagttaggtgctttgaacactttagtagcctcattctctaaggatgatattcctaggcttccttgagaaaccagtggtaagctacttatgacctatggtactcccatgagcagataaaagtacaaaagtgaatagaactttaaaaccttttattgcaaaatatacatacataaaatacataaaacacatatatacagttttatgaatagtatagctaacaccattgtacccacccagatcaagataaagartattgccgtacatcagaaacttcctgcatcctcctatatcacagcctatttcaacttttgtgataatcattcctttgcttttttgtgtgtagttttaccatatctgtgtggctacataaaatatattgtttagttttgaactttacataaacagtctcatttcattcataaaatttcatcatacgtcatttttcccttggtgttgtgagatttcagattcctgagacttgcccatgttgtcacgggcagcaatgatttattaagtttcattgctgtgcaatatgccatggtttgtaccta

SEQ ID NO: 27012 - DNA, 601 bp, Human
gaactttaaaaccttttattgcaaaatatacatacataaaatacataaaacacatatatacagttttatgaatagtatagctaacaccattgtacccacccagatcaagataaagagtattgccgtacatcagaaacttcctgcatcctcctatatcacagcctatttcaacttttgtgataatcattcctttgcttttttgtgtgtagttttaccatatctgtgtggctacataaaatatattgtttagttttgaactttacataaacagtctcatttcattcataaaatttcatcataygtcatttttcccttggtgttgtgagatttcagattcctgagacttgcccatgttgtcacgggcagcaatgatttattaagtttcattgctgtgcaatatgccatggtttgtacctactacattctatccattctgctgtgatgtgtgtgtatcctgtgcacatgtgtgtggatgtctccagaatgtgtgcataggagtagaattgctgaatcatggagatatgtcactaggtcatgccaaacagtttttccaagtgcgtgtttgtttgttttttaactggacaggacatcttcttgacca

SEQ ID NO: 27013 - DNA, 601 bp, Human
gagtattgccgtacatcagaaacttcctgcatcctcctatatcacagcctatttcaacttttgtgataatcattcctttgcttttttgtgtgtagttttaccatatctgtgtggctacataaaatatattgtttagttttgaactttacataaacagtctcatttcattcataaaatttcatcatacgtcatttttcccttggtgttgtgagatttcagattcctgagacttgcccatgttgtcacgggcagcaatgatttattaagtttcattgctgtgcaatatgccatggtttgtacstactacattctatccattctgctgtgatgtgtgtgtatcctgtgcacatgtgtgtggatgtctccagaatgtgtgcataggagtagaattgctgaatcatggagatatgtcactaggtcatgccaaacagtttttccaagtgcgtgtttgtttgttttttaactggacaggacatcttcttgaccaagtgtctgtattaaaggacatttccaggccgggcacggtggctcacacctgtaatcccagcactttgggaggccaagcactttggatcatctgaggtcgggagttcaagaccag

SEQ ID NO: 27014 - DNA, 601 bp, Human
cacttggcacccttcaaaatgtggtgagcttctgaagtctctttcgtattctctttgtcccttcgtttttggatgcttccccgacttcctttattctaattttagtagcattttggaaggaagcacagtacctttttcattttaccacatttaactggaagtcattttaaaaatcaacacttagtcttaaatatttttggtttttaaaaaaaataaaataaagataaatccaggcataatgaatgacttggccagattcagcatggtacttagatgcagtgacagccaaaggaaactgtgygtgtgccctggcctgtgtgatgaggctggcaagactgaaatcatttggaagcaaaagcctctaagagggcttcactgcatggtaccctaacactcagatgacacttagcccgttaagaaaaatgtttgatttgttaggcatcctctctttaagagagtcagagaaatgaggtgtaattggtaattaaaaagattacgtgtatcatatgacaatcagtcttaatacattgtagttactgtgttattagaaccatttttaagataccaacctaaaatggtcaaatgtaaagattttattctt

SEQ ID NO: 27015 - DNA, 601 bp, Human
acatccagttgatttggaagtgattaatggcacagaggccttcaaaaggtcactatttagtattagctccttgaagctctgtgaatgattgttttcctctatttagttgtgaggaaatttcatccaaaagttttctgcctgggaagtaattggatgaaggacatggggatgagttaaaggtattgcacaagtgaggattgatgaggctaccagctctgagtgtttcaaccttgtcatttatacatatttaaaagctggttttgatgaccacggttccatgattgcaaagaatatgaatacyctacattttcttgattgatcattcatgttggttgatgctcagttcacttttttgttcacaagaataaggtagagattttcttccttttacagatgaagtagaagcctgtgggttccttctagttagtgatagagtttggattcagagccagatttatctgactttaaatcccatatcctttatacagaatttttggtttccatgatagaactaggttccagttttcaactttcctcttgttcaggcaagtaatttgatttctctgctgctttgctttctctgtttgtaaactaggcgtac

SEQ ID NO: 27016 - DNA, 601 bp, Human
agttcacttttttgttcacaagaataaggtagagattttcttccttttacagatgaagtagaagcctgtgggttccttctagttagtgatagagtttggattcagagccagatttatctgactttaaatcccatatcctttatacagaatttttggtttccatgatagaactaggttccagttttcaactttcctcttgttcaggcaagtaatttgatttctctgctgctttgctttctctgtttgtaaactaggcgtactgtttgcatcgctctactaaaagtttaaagtgttttaaaayactttgagatcgtttaaaagattattacaagattttagcagtttattgagatagtgtatgttgaaagcactttttaaaccatgaagcattgtataaatgaaggtattattctagttgaattatttatggatgagaaaaaagaagtgataaagacattaagtaactacttagagtattaaacacgttgttgtacatgagcatccttatccaatttaagcttattagagtagaagtaatatacttttttgctcagtagtgtatcattggaattggaaagcatttagtgaatgaacaggttac

SEQ ID NO: 27017 - DNA, 601 bp, Human
atatcatattggcataaaaaatggctatgacttctatcctaaggcactcaaggaaaggatacaggtaatgtacaatctggtaccaatgagttgtattcttctgacttgtcttcttcctcagattttattcctactgaagaaaaagaaatatttcataaaatctcattaacttagttttttgggtggttggtggctttcaaacaatgactgcttaaagattctgctcaatggaatgtcatccgtgtaaacttgtgattcttgatcttgggtacatggataagtttagggaatctgtgaatayactgaaattatattcaggtttttgtgtttttctgggagatgggatatagctttcactggatttttgaaggacttttttttacttgaaaaaggctaaagacagtggattcaaaatccagaccaccttttcgtttctgttcctgtagtttctgtgataatgtccctcccctgtttaactagccttcttgctcccagttagtcatcatttagtattaaggtaagtgttaattcagtcctaaaactgctgaagtgtaagaagtaccagtgtgccattagaaaaataagagtggtaagcagaatg

SEQ ID NO: 27018 - DNA, 601 bp, Human
aaatggctatgacttctatcctaaggcactcaaggaaaggatacaggtaatgtacaatctggtaccaatgagttgtattcttctgacttgtcttcttcctcagattttattcctactgaagaaaaagaaatatttcataaaatctcattaacttagttttttgggtggttggtggctttcaaacaatgactgcttaaagattctgctcaatggaatgtcatccgtgtaaacttgtgattcttgatcttgggtacatggataagtttagggaatctgtgaatacactgaaattatattcagrtttttgtgtttttctgggagatgggatatagctttcactggatttttgaaggacttttttttacttgaaaaaggctaaagacagtggattcaaaatccagaccaccttttcgtttctgttcctgtagtttctgtgataatgtccctcccctgtttaactagccttcttgctcccagttagtcatcatttagtattaaggtaagtgttaattcagtcctaaaactgctgaagtgtaagaagtaccagtgtgccattagaaaaataagagtggtaagcagaatgataaagagcctgctttaa

SEQ ID NO: 27019 - DNA, 601 bp, Human
ttcctcagattttattcctactgaagaaaaagaaatatttcataaaatctcattaacttagttttttgggtggttggtggctttcaaacaatgactgcttaaagattctgctcaatggaatgtcatccgtgtaaacttgtgattcttgatcttgggtacatggataagtttagggaatctgtgaatacactgaaattatattcaggtttttgtgtttttctgggagatgggatatagctttcactggatttttgaaggacttttttttacttgaaaaaggctaaagacagtggattcaaartccagaccaccttttcgtttctgttcctgtagtttctgtgataatgtccctcccctgtttaactagccttcttgctcccagttagtcatcatttagtattaaggtaagtgttaattcagtcctaaaactgctgaagtgtaagaagtaccagtgtgccattagaaaaataagagtggtaagcagaatgataaagagcctgctttaaaacagttcaatagaactttctgtgataatggaaatgtttgaaatgttcagtttctgctctaaccattatggtagtcactagccatgttgctattg

SEQ ID NO: 27020 - DNA, 601 bp, Human
ttaaagattctgctcaatggaatgtcatccgtgtaaacttgtgattcttgatcttgggtacatggataagtttagggaatctgtgaatacactgaaattatattcaggtttttgtgtttttctgggagatgggatatagctttcactggatttttgaaggacttttttttacttgaaaaaggctaaagacagtggattcaaaatccagaccaccttttcgtttctgttcctgtagtttctgtgataatgtccctcccctgtttaactagccttcttgctcccagttagtcatcatttagtrttaaggtaagtgttaattcagtcctaaaactgctgaagtgtaagaagtaccagtgtgccattagaaaaataagagtggtaagcagaatgataaagagcctgctttaaaacagttcaatagaactttctgtgataatggaaatgtttgaaatgttcagtttctgctctaaccattatggtagtcactagccatgttgctattgagaatttgaaatatgtttagtgtgactgacgaattgaaattttatcttagtaatattttaaaatttaagtttaaatagtgtcatgtggctagtgacta

SEQ ID NO: 27021 - DNA, 601 bp, Human
tggaatgtcatccgtgtaaacttgtgattcttgatcttgggtacatggataagtttagggaatctgtgaatacactgaaattatattcaggtttttgtgtttttctgggagatgggatatagctttcactggatttttgaaggacttttttttacttgaaaaaggctaaagacagtggattcaaaatccagaccaccttttcgtttctgttcctgtagtttctgtgataatgtccctcccctgtttaactagccttcttgctcccagttagtcatcatttagtattaaggtaagtgttaattcagtcctaaaactgctgaagtgtaagaagtaccagtgtgccattagaaaaataagagtggtaagcagaatgataaagagcctgctttaaaacagttcaatagaactttctgtgataatggaaatgtttgaaatgttcagtttctgctctaaccattatggtagtcactagccatgttgctattgagaatttgaaatatgtttagtgtgactgacgaattgaaattttatcttagtaatattttaaaatttaagtttaaatagtgtcatgtggctagtgactaccgttttaagaatgctg

SEQ ID NO: 27022 - DNA, 601 bp, Human
atgttattttaaaatttcaggctggaatgcagtggcatgatcacagctaattactgcctcaacctcctgggcaatcctcccatgtagttgggactacaggcacgcaccaccacacccatctaatttttgtattttttgtagggatggggtttcaccatgttgcccaggctggtctcgaactcctgggctcaagtgatccgcctgcctcattctcccaaagtgctgggactacaggtgtgaaccattgcatgactgcattttatatagtatattaaatgtaatcagctgtgttgataagatrtgatttaatatgcaaatatagtgttgttgaagtggactgttcctttagctgcgttgggagttaccgtgagttaaagacactgaagataaaggttaaaaccaatttcagtgacatagaaccctatcaagtcaaagaggatggaaaaaaaaatagggaggacattgaggatgcctgcattgtctgtcaaaatgcagctgtagtcttactctagtcctctgcgtacactaggcttatggcatttcccaattttgtatgggcccagaatacaacattttcttccttttaatgactgggaattca

SEQ ID NO: 27023 - DNA, 601 bp, Human
ctgcctcaacctcctgggcaatcctcccatgtagttgggactacaggcacgcaccaccacacccatctaatttttgtattttttgtagggatggggtttcaccatgttgcccaggctggtctcgaactcctgggctcaagtgatccgcctgcctcattctcccaaagtgctgggactacaggtgtgaaccattgcatgactgcattttatatagtatattaaatgtaatcagctgtgttgataagatgtgatttaatatgcaaatatagtgttgttgaagtggactgttcctttagctgcrttgggagttaccgtgagttaaagacactgaagataaaggttaaaaccaatttcagtgacatagaaccctatcaagtcaaagaggatggaaaaaaaaatagggaggacattgaggatgcctgcattgtctgtcaaaatgcagctgtagtcttactctagtcctctgcgtacactaggcttatggcatttcccaattttgtatgggcccagaatacaacattttcttccttttaatgactgggaattcagtcagtattcttggagaagagaaggttttaaattggggaatatgatacataaa

SEQ ID NO: 27024 - DNA, 601 bp, Human
accattgcatgactgcattttatatagtatattaaatgtaatcagctgtgttgataagatgtgatttaatatgcaaatatagtgttgttgaagtggactgttcctttagctgcgttgggagttaccgtgagttaaagacactgaagataaaggttaaaaccaatttcagtgacatagaaccctatcaagtcaaagaggatggaaaaaaaaatagggaggacattgaggatgcctgcattgtctgtcaaaatgcagctgtagtcttactctagtcctctgcgtacactaggcttatggcatytcccaattttgtatgggcccagaatacaacattttcttccttttaatgactgggaattcagtcagtattcttggagaagagaaggttttaaattggggaatatgatacataaaaatacatctggatgtgtcttggtaaacttctcttaaaccctgggtgcaatgaattgactaaccagtttttagtaagtgatccatggctttatctgcttcattagaaactttttttttttttctctttgagacagagtcttactctgttgcccaggctggagtgcagtggctcaatctctgctcactg

SEQ ID NO: 27025 - DNA, 601 bp, Human
gtgacatagaaccctatcaagtcaaagaggatggaaaaaaaaatagggaggacattgaggatgcctgcattgtctgtcaaaatgcagctgtagtcttactctagtcctctgcgtacactaggcttatggcatttcccaattttgtatgggcccagaatacaacattttcttccttttaatgactgggaattcagtcagtattcttggagaagagaaggttttaaattggggaatatgatacataaaaatacatctggatgtgtcttggtaaacttctcttaaaccctgggtgcaatgaatygactaaccagtttttagtaagtgatccatggctttatctgcttcattagaaactttttttttttttctctttgagacagagtcttactctgttgcccaggctggagtgcagtggctcaatctctgctcactgcagcctcagcctcctgggttcaagcgattctcgtgccttagcctcccaagtagctgggattacaggcacctgccaccccacctggctaatttttgtatttttagtagagacggggtttcaccttgttggccaggctggtctcgaactcctcacctcaggtgatccgcc

SEQ ID NO: 27026 - DNA, 601 bp, Human
ttgaggatgcctgcattgtctgtcaaaatgcagctgtagtcttactctagtcctctgcgtacactaggcttatggcatttcccaattttgtatgggcccagaatacaacattttcttccttttaatgactgggaattcagtcagtattcttggagaagagaaggttttaaattggggaatatgatacataaaaatacatctggatgtgtcttggtaaacttctcttaaaccctgggtgcaatgaattgactaaccagtttttagtaagtgatccatggctttatctgcttcattagaaactttttttttttttctctttgagacagagtcttactctgttgcccaggctggagtgcagtggctcaatctctgctcactgcagcctcagcctcctgggttcaagcgattctcgtgccttagcctcccaagtagctgggattacaggcacctgccaccccacctggctaatttttgtatttttagtagagacggggtttcaccttgttggccaggctggtctcgaactcctcacctcaggtgatccgcctacctcagccttccaaattgttaggattacaggcgtgagccaccacacccggcc

SEQ ID NO: 27027 - DNA, 601 bp, Human
ttgtctgtcaaaatgcagctgtagtcttactctagtcctctgcgtacactaggcttatggcatttcccaattttgtatgggcccagaatacaacattttcttccttttaatgactgggaattcagtcagtattcttggagaagagaaggttttaaattggggaatatgatacataaaaatacatctggatgtgtcttggtaaacttctcttaaaccctgggtgcaatgaattgactaaccagtttttagtaagtgatccatggctttatctgcttcattagaaactttttttttttttctytttgagacagagtcttactctgttgcccaggctggagtgcagtggctcaatctctgctcactgcagcctcagcctcctgggttcaagcgattctcgtgccttagcctcccaagtagctgggattacaggcacctgccaccccacctggctaatttttgtatttttagtagagacggggtttcaccttgttggccaggctggtctcgaactcctcacctcaggtgatccgcctacctcagccttccaaattgttaggattacaggcgtgagccaccacacccggccaaaaatgatttttta

SEQ ID NO: 27028 - DNA, 601 bp, Human
tttcttttttcacaaattttcttttaagttggttaattttactaatttttcctttattatttatcctcaagtcaatgtacatatgtatgaatttttaaaatttaacacataatacacgtagggtaaaagtacataaattgtgtttggttatgaattctcccatgaaagctgcacctaggaatttctcttgtgccccttccttgtcactgctccctttttccttccgaaagacaaccaccaccttgacttctaacactgcagatgattttgcctattttgatttgtgtaaaatggaaccatrtagtatggttttgttttttgttttttgttttttttttttgagacggagtctcgctctgttccaggctggagtgcagtggtgtgatctcggctcattgcaacctctgccttccgggttcaagctattctcgcctcagcctcctgagtagctgggattacaggcacgtgccaccacacccgactagttttttttttttgcatttttagtagagacagggtttcaccgtgttggccaggctggtcttgaactcccaaccttgtgatacgcccaccttggcctcccaaagtgctgggattacag

SEQ ID NO: 27029 - DNA, 601 bp, Human
gaaagacaaccaccaccttgacttctaacactgcagatgattttgcctattttgatttgtgtaaaatggaaccatatagtatggttttgttttttgttttttgttttttttttttgagacggagtctcgctctgttccaggctggagtgcagtggtgtgatctcggctcattgcaacctctgccttccgggttcaagctattctcgcctcagcctcctgagtagctgggattacaggcacgtgccaccacacccgactagttttttttttttgcatttttagtagagacagggtttcaccrtgttggccaggctggtcttgaactcccaaccttgtgatacgcccaccttggcctcccaaagtgctgggattacaggcatgagccaccgtgcccggcctatgtattctctaattatatgtattattgtcacttttaaaaagggtttcaaaatacttcatttttcagttaatatattagacctcaaggtccttgtttcaaaacatgggagggtgtagtccttggttcccatatactgatttgtggaattgatactgatgaactgattatctctaagtcacctgaattattttaaaagtaatt

SEQ ID NO: 27030 - DNA, 601 bp, Human
atttattagtatgttgaccatccgtatatttggaaatgtttcctcatttgttaattgagatagtggtgcttacagggctttgtgaaaattaaatttgatgtttctagatatagtaagcaatcaatgtacgctgttgctgctgctgtttctattactaaaactaataataataatgcgatttataccaagttacccatcatgtacgttttttagtttcttttttagtgccttatatactgcatatgtgcttcttggagttgattagtctgccttcttgagttactatctgcatgaaaacagraagacattgttaatacagatatttagccatatgtgtgctttaggatttctgcaaaaaaaaaacaaacaaacagggactatttcttaaacttgtagtcaagaattacttgtagtctgcgtccctgcttatacacaaagaattgcatcacaaggtggggcacacacagatcatgccatgactgcttcctcactgctctcacaattgttcaccttcacagtgcacccttcttaaaggagggttctcctcccacgtgtgcaggtactaactcatctttcatcaaaggtgtatgcaatgttaagt

SEQ ID NO: 27031 - DNA, 601 bp, Human
gttttgtttgatgacgaatgtccagtctgtgctctccctgccacatttctgctaattgtttagcgcgtatctctgcacttaacgggtggcctcagatgactctgttctgagcatctgtcaggacgcagagcctcagactcattgtcactccaaatggaacaaaaactggttgagagaaacagtgtttacagaggattacataaaggagaagctattagttgatttctttacagtggattttgaccttgcttatgtcatgtttccttttagattcttgatgaaagctctagattctttccayagaaaattgagagatgtgtgaaaatgtcgagaaatacataaaacaaaagccttttctctcatcctccccacttacatgtaccctgctctgtgtatgagcctcattttgatatcctttctctgtattctagctgctacttgaattcagtcaactagaccttcagaaagttataaccttgcaccacattcatacttgtcttctgtcgtgttatttagagaagtcagtaataatttatgttttgatgtgttggttgtattgttgagtcattccaatgatggtggttataagaaactgacctgt

SEQ ID NO: 27032 - DNA, 601 bp, Human
cataaaggagaagctattagttgatttctttacagtggattttgaccttgcttatgtcatgtttccttttagattcttgatgaaagctctagattctttccatagaaaattgagagatgtgtgaaaatgtcgagaaatacataaaacaaaagccttttctctcatcctccccacttacatgtaccctgctctgtgtatgagcctcattttgatatcctttctctgtattctagctgctacttgaattcagtcaactagaccttcagaaagttataaccttgcaccacattcatacttgtcytctgtcgtgttatttagagaagtcagtaataatttatgttttgatgtgttggttgtattgttgagtcattccaatgatggtggttataagaaactgacctgtggaatgtgtcactgtatttgctgtgagaatgttgttaaggatgatgatttcgttaattccttaatcatgtggcagatgtttattgagtaccttctttgtaccaggttgacaccatagaagctactccatggactctagattccatggaagcaagtgttgggaacgtctgaaccagtctaggaagaatcgagaaagatt

SEQ ID NO: 27033 - DNA, 601 bp, Human
atgatggtggttataagaaactgacctgtggaatgtgtcactgtatttgctgtgagaatgttgttaaggatgatgatttcgttaattccttaatcatgtggcagatgtttattgagtaccttctttgtaccaggttgacaccatagaagctactccatggactctagattccatggaagcaagtgttgggaacgtctgaaccagtctaggaagaatcgagaaagatttcccaaaagtattaataacatcttacattgagacttgaaggatcatcacagtaaactaagcagagaggtagaargggtgggggaaagatccagaggatgttggaggaactgtgagaagtttggtgtggccacagaggatatgatgggagcaggaggtgagggaggtgagcagatgattattaggggcattgctctggagtttcaatgttaagagccgttggaagacatggaaggttttcagcaggagtcaaatgtaggggcagagcaggccatcagctcatcaggcaacagcggtaaggaagagacagtggaaataggcggacacattatggagatgggactgtgcggttagatgggctgggggaagaacagag

SEQ ID NO: 27034 - DNA, 601 bp, Human
ttttactgtctccatttctttttaattaatagagcctgcattgattctaatgaagatggggacttgagtaaatctaccgtgttgagaaactacaaagaagcccaagaatatggctcttttggcacagctgagatgttgaattactccgttaatatatacgatgatggaaacctgctctccattgtgaccagcggaggtatcccatttcagattgaccaatgagatatagatttatgaggtgataaagtggtacgttgcgatagctcacagcaaccttctagagaattttaagctagagatygtagctaaaggactaggtccagaatcataaaggtgatttgatttacctgcaagatgttgttttttaaggtcataaccatgtgggatccagtccaagaatataaaagcatgttccaacatcagaaaatccatcaataggctgggtgcagtggctcatgcctgtgatcctagcaccttgggaggccgaggtgtgtggatcacctgaggctgggagtttgagaccagcctgaccaacatggagaaaccccatctctactaaaaatatagaattagctgtgcgtggtggcacatgcctgtaatc

SEQ ID NO: 27035 - DNA, 601 bp, Human
aggcaggagaatcgtttgaacctaggaggcggaggttgcagtgagccgagatcgtgccattgcactccagcctgggcaacaagagcgaaactccatctcaaaaaaaatccatcaatagaatttatctcatgaacagcaattttgcctcgaaatcttaactcttgagaaattcacccatgagtacagagaatcagataaaagaatcctcactacggcactctgtgtgatttcaaaaaagttggaaactaaatacctattaacaaaaaaatatattttttaaacaactgtgtgttattcttaytgtgaaatacagtcatcctttggtatctggggggattggttctggaatgtccctcagatgctcaagtacctgatacaaaatgacatagtgtttgtgtataacctacacacatgctctcccatgtgctttcagcatctctacatgacttctaataccttatagtatgtaagtgctatataaatagttgttatactgtagttttttaatatttatatttttgatccgtggttggttaaattgcatgtagttggtgcggaacctgtggatacagagggccgaatgtattatatagcaatcaaa

SEQ ID NO: 27036 - DNA, 601 bp, Human
aactgtgtgttattcttactgtgaaatacagtcatcctttggtatctggggggattggttctggaatgtccctcagatgctcaagtacctgatacaaaatgacatagtgtttgtgtataacctacacacatgctctcccatgtgctttcagcatctctacatgacttctaataccttatagtatgtaagtgctatataaatagttgttatactgtagttttttaatatttatatttttgatccgtggttggttaaattgcatgtagttggtgcggaacctgtggatacagagggccgaatrtattatatagcaatcaaaatgctgtgtgtataaacccctaatacataaattatattgaaaaaatatgtactgatgataaaacttgtaaaattctaaaacatgccgaatagtactatgcagtgtttatagatatgtgtgtttatatcgtgaaaatgttaaatatatagatggaaagattatgcacaccagctccaggatggtggctacttctgggggaagttctccctcccagggtagggggaaaaaggagaatgaagtgggatgactttaactctttaacgtccccctcctacctcccag

SEQ ID NO: 27037 - DNA, 601 bp, Human
tctgttttctgtcactccagattatttcacactttccagaattttatgtaagtggaataaaaaatatggttttctttccttcactcagcataatgattttgagattcattaatgttatgattataaagctggctctttatttctgagtaatagttctttatatagctacaccacagtttgtttatccagcttcccattgatggacgtttagattgttttggtatctgtcgacatatatttttatttatttttgggctgatagctgagagaaccagttggatatggtaaacatgtacttaatttttttttttcctttttttttttttttttttttgagacagagtctcgctctgtcgcccaggctggagtacaggtggcacggtctcggctcactgcaacctctgcctcccaggttcaagttattctcctgcctcagcctcctgggtagctgggattacaggcgcgtaccaccacacctggctagtttttgtatttttagtagagacagggtttcaccatgttggtcaggctagtatcaaattcctgacctcgtgatccacccgccttggcctcccaaagtgctgagattataggtgtgagc

SEQ ID NO: 27038 - DNA, 601 bp, Human
tataacatgtacaaaaacagatacaaatcacaagttgtacaactctttgaattaccacaaagtggacacttctttgtaactacaactcaggtcaagaaatgaaacataatgaaactcccatcatgccccttcctaatcagtaatgtaccctcccacctcctacagttaactactatcctgatctccattgccacattagtttggaccatatgatgttgctgtttttgtgatcggaaatgataaaatagtggcagtttcagatggttcagcctttttttcatttatatgaaaattcaatatmcatttttgtatgtgacttctttagttcagccttatttttgtgagctttatctcatagtacatagtagtagtttattgctgtataattgtcagttctatgaattgatgtacatgtaaccatttactgttaatgaatcttgtggttgtttttaagtttttgaattttataaacagtgttgccatgaacatttttgtgggtgtcttagttacatgtgcacacattttgttattgtgtgtacctagaggtaggatggctggctcataggctgtggcagtgttcagctttcactccagccagcag

SEQ ID NO: 27039 - DNA, 601 bp, Human
gtaccctcccacctcctacagttaactactatcctgatctccattgccacattagtttggaccatatgatgttgctgtttttgtgatcggaaatgataaaatagtggcagtttcagatggttcagcctttttttcatttatatgaaaattcaatatacatttttgtatgtgacttctttagttcagccttatttttgtgagctttatctcatagtacatagtagtagtttattgctgtataattgtcagttctatgaattgatgtacatgtaaccatttactgttaatgaatcttgtggtkgtttttaagtttttgaattttataaacagtgttgccatgaacatttttgtgggtgtcttagttacatgtgcacacattttgttattgtgtgtacctagaggtaggatggctggctcataggctgtggcagtgttcagctttcactccagccagcagtgtatgatatgtacttccatccacacttgctttgtcagcctttaatattttggcaattctaaaaggtacgtagaagcatctttttgtggcttaatttgcgtttcctagatgacgaatgaaattaaacatcttttcgtgtgttta

SEQ ID NO: 27040 - DNA, 601 bp, Human
gtgatcggaaatgataaaatagtggcagtttcagatggttcagcctttttttcatttatatgaaaattcaatatacatttttgtatgtgacttctttagttcagccttatttttgtgagctttatctcatagtacatagtagtagtttattgctgtataattgtcagttctatgaattgatgtacatgtaaccatttactgttaatgaatcttgtggttgtttttaagtttttgaattttataaacagtgttgccatgaacatttttgtgggtgtcttagttacatgtgcacacattttgktattgtgtgtacctagaggtaggatggctggctcataggctgtggcagtgttcagctttcactccagccagcagtgtatgatatgtacttccatccacacttgctttgtcagcctttaatattttggcaattctaaaaggtacgtagaagcatctttttgtggcttaatttgcgtttcctagatgacgaatgaaattaaacatcttttcgtgtgtttatttgccctttgggtatcttcttttataaaatgctttttcaaatgtttgaaggggggattctccctttttttattgtgaattt

SEQ ID NO: 27041 - DNA, 601 bp, Human
atatgcaaattgaattgaataaactttcagtccatgagaatgttttgtcatttccccacctttgtgtctctaggagctcatgggacacatgtagctagtatagctgctggacactttccagaagaacctgaacggaatggggtagctcctggtgctcaaattctttccatcaagattggtgatacaagactaagcacaatggaaacaggcacaggcctcataagagctgtgagtgtttgtgagttgttgattcagaagattaatgattaatgatcttggatatttttaggtttataagtgstcctagtttaccaagaatacattgaactatatatagtgtacaggacttttaacaaagcaaaaatatttactaatttatttttaaattatttttattaaatattattaggatttggcctaacctttgtgaaaaaattacttacttcatactcgtcatttctagcaaatctcctaacaagcaattttgagatacttaaaaagaaagacctcttagccagctttctccatcagcctaagaggaatttaaaacctcagctaacattctgtacatcattttaacgtaggaaagtatatttaattt

SEQ ID NO: 27042 - DNA, 601 bp, Human
atgatcttggatatttttaggtttataagtgctcctagtttaccaagaatacattgaactatatatagtgtacaggacttttaacaaagcaaaaatatttactaatttatttttaaattatttttattaaatattattaggatttggcctaacctttgtgaaaaaattacttacttcatactcgtcatttctagcaaatctcctaacaagcaattttgagatacttaaaaagaaagacctcttagccagctttctccatcagcctaagaggaatttaaaacctcagctaacattctgtacrtcattttaacgtaggaaagtatatttaattttagtgattttttaacctaggaaggaccattccattccctctacctctgtccccctctaaccccactcttttctagaaatgctagttttttgtttttttttttaatgactacttttttatgtgtctcctcctacctttttgtgtttatgtgcttatatgtccaggtatatggtgatatgcctggaggtaacttataaattagaatatgattggctaagaaactataggattatatatatgcccttattttactggctaatctgtttctgt

SEQ ID NO: 27043 - DNA, 601 bp, Human
tttattaaatattattaggatttggcctaacctttgtgaaaaaattacttacttcatactcgtcatttctagcaaatctcctaacaagcaattttgagatacttaaaaagaaagacctcttagccagctttctccatcagcctaagaggaatttaaaacctcagctaacattctgtacatcattttaacgtaggaaagtatatttaattttagtgattttttaacctaggaaggaccattccattccctctacctctgtccccctctaaccccactcttttctagaaatgctagttttttgtttttttttttaatgactacttttttatgtgtctcctcctacctttttgtgtttatgtgcttatatgtccaggtatatggtgatatgcctggaggtaacttataaattagaatatgattggctaagaaactataggattatatatatgcccttattttactggctaatctgtttctgtaaattgctgcctaaactagagtcttaatctctttaatagatgatagaagttataaatcataagtgtgatcttgtcaactacagttacggagaagcaactcactggccaaattctgggtgagt

SEQ ID NO: 27044 - DNA, 601 bp, Human
tctttattttacttaactgtatttctttctctactttaactttcatcctcttgaagccctcttttgctaatattcttccctttctcagatactcacacttacaactttgaagggtcctgtgcatggctctgtacctttttaatgttaacttcattttcttcttcatggtataacctcatctcctctacttaatgtcagtatatttttcttgtttgctgtcaagctctaagcaggtttcttacactttaaaatcttgctcttaagttcttcctagtgccttagttaccttttccacaaaagwtactggttcttttggtcaatttctactcataattgtatgtacgaatcttctgaggtgtgtcttcaggactatgttaactgggggatggaaatagaaccacctattgcccgagtcactactaatattttactaccttgtagtatattttcccatatatattgttttgcacctagcattttccccacatttaatttggccttataactgcttccctaccctaaagcccaagtagggtatatcacttagaatggctgtatcatgttccaccaagggtggatgtaccaaaatttatgtagccat

SEQ ID NO: 27045 - DNA, 601 bp, Human
catctcctctacttaatgtcagtatatttttcttgtttgctgtcaagctctaagcaggtttcttacactttaaaatcttgctcttaagttcttcctagtgccttagttaccttttccacaaaagatactggttcttttggtcaatttctactcataattgtatgtacgaatcttctgaggtgtgtcttcaggactatgttaactgggggatggaaatagaaccacctattgcccgagtcactactaatattttactaccttgtagtatattttcccatatatattgttttgcacctagcaytttccccacatttaatttggccttataactgcttccctaccctaaagcccaagtagggtatatcacttagaatggctgtatcatgttccaccaagggtggatgtaccaaaatttatgtagccatatatttaaacaaggttttggtactatatacactttgggaatagaggctgattatatgttcaaaggaattctctctttttcaggagaatttgtgaagtaattaatgaagcagtatggaagcataatataatttatgtttcaagtgctggaaataatggtccatgcctgtctacagtt

SEQ ID NO: 27046 - DNA, 601 bp, Human
acttaatgtcagtatatttttcttgtttgctgtcaagctctaagcaggtttcttacactttaaaatcttgctcttaagttcttcctagtgccttagttaccttttccacaaaagatactggttcttttggtcaatttctactcataattgtatgtacgaatcttctgaggtgtgtcttcaggactatgttaactgggggatggaaatagaaccacctattgcccgagtcactactaatattttactaccttgtagtatattttcccatatatattgttttgcacctagcattttccccacrtttaatttggccttataactgcttccctaccctaaagcccaagtagggtatatcacttagaatggctgtatcatgttccaccaagggtggatgtaccaaaatttatgtagccatatatttaaacaaggttttggtactatatacactttgggaatagaggctgattatatgttcaaaggaattctctctttttcaggagaatttgtgaagtaattaatgaagcagtatggaagcataatataatttatgtttcaagtgctggaaataatggtccatgcctgtctacagttggttgtccag

SEQ ID NO: 27047 - DNA, 601 bp, Human
aatagatttgtttagaaacaagcaaacaaaaaacaatagttaatgaaatgttacctgtatctctgctacacgtaagacactgtacaccttaagtgtgtcctcaggaaacttatagtctggtaggggaaccagcacatctagaactgaccgtaatttaaagtggactgaaataagtggtttcatagaaatacacatgcatgcttttaggtgcattagcatatttagtctaaaatatcctgggataaataatcctgggagataggtattttgtatccaaaagcaaagttcttagtaaaatgtmtggtacatagtagactttcgttgtttccttattaaattttattcttccatcgtattagagagaggactggtgttgagagattaggcagtttactcaagtgaacagtggatttggaatcaggatccccgtttgttttcttttcttaatgattaaatccatcccacaggtgttggtgcttatgtttctcctgatatgatggttgctgagtattcactgagagagaaattacctgcaaatcaatatacttggtcttctagaggacctaggtaggtgcaggtagaacgcggaaccattacgtat

SEQ ID NO: 27048 - DNA, 601 bp, Human
agcaaacaaaaaacaatagttaatgaaatgttacctgtatctctgctacacgtaagacactgtacaccttaagtgtgtcctcaggaaacttatagtctggtaggggaaccagcacatctagaactgaccgtaatttaaagtggactgaaataagtggtttcatagaaatacacatgcatgcttttaggtgcattagcatatttagtctaaaatatcctgggataaataatcctgggagataggtattttgtatccaaaagcaaagttcttagtaaaatgtctggtacatagtagactttcsttgtttccttattaaattttattcttccatcgtattagagagaggactggtgttgagagattaggcagtttactcaagtgaacagtggatttggaatcaggatccccgtttgttttcttttcttaatgattaaatccatcccacaggtgttggtgcttatgtttctcctgatatgatggttgctgagtattcactgagagagaaattacctgcaaatcaatatacttggtcttctagaggacctaggtaggtgcaggtagaacgcggaaccattacgtatattcggttaaactttacact

SEQ ID NO: 27049 - DNA, 601 bp, Human
cattttctctaggtggtttcctctttaaaaaataaacttatcttagtagcttattataaagtgtcattgaaaacaaccaggccgtggatatccacatggatcagaaagctttgctttgcgctgtcattgtagactgcccctgccagcccagctaaagacactcaataagagtggcttaggagaagagccaaaagtcagcaaagcttgatgtgtttttgttcagttaataaaagtgtaaaattattaaacttattctcttctaaaactgagtttggaattttaagttttatcttattgtcartgtaaaaacaaagtattagagaatgtttaaaccagcctttgccgatactcgccatagagcatttaaagaattattttaagaaaacaccaaggagttcatgaattatgggggaagcttggattaaagtagatactgattcacaaagcagatgttctaagaattgaatttgtttcatttttcataaacatgaaataatattagaaataatttgctttaattattacattagatggtataaaatatgaaacattgattaatggtcactgaacagagcatgttctgtaatctttgaaaaacgct

SEQ ID NO: 27050 - DNA, 601 bp, Human
ggtcaggagttcaagaccagcctggccaacgtggtgaaatcccatctctactaaaaatataaaatttagctgggcatggtggtgggtgcatgtaatcacagctacataaacaggtcgtgaaattttattatatattgtaattgagaagaaaaatattaactggctttttttgaattttaaggaaacatttctgtttcatgagacttttttttttttctttcctgaaacagagtcttgctctgtcacccaggctggagtgcagtggcatgatctcggctcactacaacctccacctctcagsttcaaccaattctgcctcagcctcccaagtagctggaattacaggcgctcaccaccacaccgggttaatttttgtatttttagtagagatggggtttcaccatgttggccaggctggtcttgaactcctgacctcgtgatctgcccgcctcggcctccgaaagtgctggaattacaggtgtgagccactgagcccagctgagactcatttttagaatactgatttaaacatctagaaatgctttatcatttaccactttaacaagctagtggaaaattaataaagagcaataagtagtca

SEQ ID NO: 27051 - DNA, 601 bp, Human
ggtggtgggtgcatgtaatcacagctacataaacaggtcgtgaaattttattatatattgtaattgagaagaaaaatattaactggctttttttgaattttaaggaaacatttctgtttcatgagacttttttttttttctttcctgaaacagagtcttgctctgtcacccaggctggagtgcagtggcatgatctcggctcactacaacctccacctctcaggttcaaccaattctgcctcagcctcccaagtagctggaattacaggcgctcaccaccacaccgggttaatttttgtawttttagtagagatggggtttcaccatgttggccaggctggtcttgaactcctgacctcgtgatctgcccgcctcggcctccgaaagtgctggaattacaggtgtgagccactgagcccagctgagactcatttttagaatactgatttaaacatctagaaatgctttatcatttaccactttaacaagctagtggaaaattaataaagagcaataagtagtcagaattcatgactctttccagttattttttccaatgctatcaaataccaatgctcattctgaacaccattaggcaata

SEQ ID NO: 27052 - DNA, 601 bp, Human
ttttttttctttcctgaaacagagtcttgctctgtcacccaggctggagtgcagtggcatgatctcggctcactacaacctccacctctcaggttcaaccaattctgcctcagcctcccaagtagctggaattacaggcgctcaccaccacaccgggttaatttttgtatttttagtagagatggggtttcaccatgttggccaggctggtcttgaactcctgacctcgtgatctgcccgcctcggcctccgaaagtgctggaattacaggtgtgagccactgagcccagctgagactcayttttagaatactgatttaaacatctagaaatgctttatcatttaccactttaacaagctagtggaaaattaataaagagcaataagtagtcagaattcatgactctttccagttattttttccaatgctatcaaataccaatgctcattctgaacaccattaggcaatacagtgcaaacaagaaggtagaaaatcaccctaaaccttgttatctgtgatatgtgcaggtgacatattgatgaacatccttttagtcattcttccatgaattagtgggagatgacactgttcaggcacttt

SEQ ID NO: 27053 - DNA, 601 bp, Human
aagagtcagaacagtgacatttattttctctctctaaatatacctgacactgtggcctgtcacacatgcccagatatgtatatacacacagacatttctgtacacttacaaggaaaaaataaatgctgcctatgggaaaatggctctgctgggtgttttcccccattgattcttcatagtagtatctgtgtcactatttgtaatgagtgcagttagtacatagtgttatactattggatttaaccagtggtcgtcttaaaaatgcccatgtatgtttagctttcaccatcctaagcaaacwtcaatggctttccatttagtgctgacggggcccttggtgtgagtatcagtgcgccaggaggagccattgcttctgttcctaactggacactgagagggacgcagctgatgaatggaacatctatgtcttcccccaatgcatgtggaggcattgccctgatcctttcaggtaagcgtgttctttattgtccttacattattgcagaccaatatttttgttttctgaagctctcatggtaagaacatgtggtagaattgataattccctgggcacaaagtagagtttaaggtaacgaataac

SEQ ID NO: 27054 - DNA, 601 bp, Human
tggtaagaacatgtggtagaattgataattccctgggcacaaagtagagtttaaggtaacgaataacttatgtgataatgataatttgaatgtgtgtttattcagcagtatatttgttggctgtccgctgttaacgactgtcaagcagtattttagctctggggctaaattagtgaacaaagcatcaaaaatagctgcctatgtggaggttacatcattatatatattatagttgggataaacagactctgaacaaaataaaaaactgtagatgttgcatgttagaggttaatggatgccrtgagcaaaatgaggtagaaagagaaggagggatttctagagtggtgcacaggattaaatagagtggcactgggcttagccaggactcagatttagggtagccaggctgctgtgaagctccctcctcagaaacgtccctctttaagttgtctctcctctgcctcctttcttccccgcttttctcacccacaccacagtttcttctgctcaccacatctcctcagcatggcctgtccacactggtgctatcagcataagcctgtgatgatgtaccacttcaagtgctacatccttctctagg

SEQ ID NO: 27055 - DNA, 601 bp, Human
tacttaggtataagacagagctttctgttgaagaatgaaaagtagaagcagtctaggagaactgcagctcgattaggtgtgaacaaaaataatcatcgctattatctggctgtcttcatttcagttgaatactatgacctgtgtgcagtaatgaaaacattcacttaaactctttattttaaggtcataccagtgcttggtgaaagtataaatgaatcatgagtaatctaaattgtaaggaagattatttgactgttttatttaagctgtgttttggatgcattttacagccaaccaaacyaagtcgctaaatttttttggaaagatgtaacatttttaaatggaaaaaaggaaaaaaatactcatctttaatttttggtctttttcgtgccagaaaactctgaaaaaatatcccttcagcttcatttagctctgacttcaaattcatcttgggttcagtgtcccagccatttggaactcatgaatcaatgtagacacataaacatacgtgtggatcccaggggcttaagagaaggattgcattatacagaggtattgatgtatcttcatttttactttcttcactctttaaaatgtttaa

SEQ ID NO: 27056 - DNA, 601 bp, Human
attaggtgtgaacaaaaataatcatcgctattatctggctgtcttcatttcagttgaatactatgacctgtgtgcagtaatgaaaacattcacttaaactctttattttaaggtcataccagtgcttggtgaaagtataaatgaatcatgagtaatctaaattgtaaggaagattatttgactgttttatttaagctgtgttttggatgcattttacagccaaccaaaccaagtcgctaaatttttttggaaagatgtaacatttttaaatggaaaaaaggaaaaaaatactcatctttartttttggtctttttcgtgccagaaaactctgaaaaaatatcccttcagcttcatttagctctgacttcaaattcatcttgggttcagtgtcccagccatttggaactcatgaatcaatgtagacacataaacatacgtgtggatcccaggggcttaagagaaggattgcattatacagaggtattgatgtatcttcatttttactttcttcactctttaaaatgtttaaaaggttaaaaaaaaatccaaagtatatttgcaatatattgctttcttgctaagaaataactagacctatcc

SEQ ID NO: 27057 - DNA, 601 bp, Human
attgatgtatcttcatttttactttcttcactctttaaaatgtttaaaaggttaaaaaaaaatccaaagtatatttgcaatatattgctttcttgctaagaaataactagacctatccatctgccaggttattcagttcttctggtgtgtctatattcatttaagcagtgagtttctaaagaatcatattttgtccttgtatgaataagtaaaaggaaagaagaggtacagcagaacctttcaattagatctccctctaactggtgttttcttttgtcagctaaacaaagctgcagttgcgtgttgttgttgttgttgttgttgttgttgttgttttaagagacagagtcttgctctgttgcccaggctggagtacagtggtgtgatcgtggttcactgcagccttgaactcttgggctcaagtgatattcacaccttagcctcctgagtagctaggactagtggcgtgcaccaccaagcctggctaaatttttttatttttgtagagacaggatctctctatgttgctcagtcttgtcttgaactcttggcctcaagtgatcctcctgccttggcctcccagggctttgggattacaggt

SEQ ID NO: 27058 - DNA, 601 bp, Human
tctgttaaacaaatagttgtaaaccaggcatagaatagtatcacaacagtatctccacatctaaagttgtctgtagtactagtttgagctaatttttcagttgggagtaattaaaatgcacttattttgtacctgacgtctcattttcccatttcaactggtcaaatgttgctatacatttgtttgggctgtttgctattaattatgtgacctagtgtcaggaaattggtgtcaacctctggttaagaccttgattaaaagtagattgatttattctgtcagtagtttagaccttcccccsctcttttaaacatttgtttatggatattgacacttaccaattcttttttcaaggtatgtggctatgatatagcatcccctaacgcaggtccgctcttcagagttccgatcactgcagttatagcagcaaagtaagtaacaggttactcacagcttactggtacatctaagattttaatgactattcatggagtcttgtggacttttaatgatcactaatacagaaccaggtaatggggattttgtcttagttctgctcccagctagcatttttaggtgtcatgtagtcagccatactgac

SEQ ID NO: 27059 - DNA, 601 bp, Human
atcacaacagtatctccacatctaaagttgtctgtagtactagtttgagctaatttttcagttgggagtaattaaaatgcacttattttgtacctgacgtctcattttcccatttcaactggtcaaatgttgctatacatttgtttgggctgtttgctattaattatgtgacctagtgtcaggaaattggtgtcaacctctggttaagaccttgattaaaagtagattgatttattctgtcagtagtttagaccttccccccctcttttaaacatttgtttatggatattgacacttaccrattcttttttcaaggtatgtggctatgatatagcatcccctaacgcaggtccgctcttcagagttccgatcactgcagttatagcagcaaagtaagtaacaggttactcacagcttactggtacatctaagattttaatgactattcatggagtcttgtggacttttaatgatcactaatacagaaccaggtaatggggattttgtcttagttctgctcccagctagcatttttaggtgtcatgtagtcagccatactgactcttgtgtgctctgagagtaactgatggcacctggcatc

SEQ ID NO: 27060 - DNA, 601 bp, Human
gttactcacagcttactggtacatctaagattttaatgactattcatggagtcttgtggacttttaatgatcactaatacagaaccaggtaatggggattttgtcttagttctgctcccagctagcatttttaggtgtcatgtagtcagccatactgactcttgtgtgctctgagagtaactgatggcacctggcatctgccctacctctgcatcaaaactatttccaccacagtcactctgagctctgcattgcccagttcagaggataactcaggcttcgtctgacccgatcccactgyagtatttgacaatattacttcactcccctccattcctgccctttttgtctctgtcgtttttgggatttactctcttctcttaatgcttccacttttctagttatctactgtagaagcagaagttaagaaactcgtaacttcccatcttattcctctggaaaaatcagcagattatattacttcctgcttaaagtatatcagtggcacctccaaaggtcaagttcaagctccttaaaatagcaaacaatgctccctcacaattatagccctagccagtgtttcctgtcattccgtacacca

SEQ ID NO: 27061 - DNA, 601 bp, Human
gtgtcatgtagtcagccatactgactcttgtgtgctctgagagtaactgatggcacctggcatctgccctacctctgcatcaaaactatttccaccacagtcactctgagctctgcattgcccagttcagaggataactcaggcttcgtctgacccgatcccactgcagtatttgacaatattacttcactcccctccattcctgccctttttgtctctgtcgtttttgggatttactctcttctcttaatgcttccacttttctagttatctactgtagaagcagaagttaagaaactcktaacttcccatcttattcctctggaaaaatcagcagattatattacttcctgcttaaagtatatcagtggcacctccaaaggtcaagttcaagctccttaaaatagcaaacaatgctccctcacaattatagccctagccagtgtttcctgtcattccgtacaccaaattacacattttggccaactcactgattttggcacttgaggattctcaggatttgtgcatgtgcacagctgataacttggtttcaatttcctgtctcttcagttaatgaccaggtgcattcctggtcatccct

SEQ ID NO: 27062 - DNA, 601 bp, Human
ccctgtgtttatttccaatgaattgttattttgcgtttatccaatgaaatctagagtatctgtggtcttataataaatatatacatttaattacttttattaattttcagagtaaatgaatcatcacattatgatctagcctttacagatgtacactttaaacctggtcaaattcgaaggcattttattgaggttcctgagggtgcaacatgggctggtaggtaaaattaaaatctgtgtgaccgcttatctctgtttacgttctaatgactatagctgtatgaggttcgtttatctgtarcatgtatttccctggtactaatatatgtatttgggtaccttagactttctgtaaagttcaaaacgtttttaagatctagtacaattttgcattggcccatacaggaaattaagccatcttaagatgtttttaatatttaaggtttgagcttagtttagaataatgccttacctggtaataattttttttttttttttttttttttttttgagacagagtctcactctgtcgccaggctggagtgcagtggcatgatctcggctcactgcaacctccacctccccagttcaaacgattctc

SEQ ID NO: 27063 - DNA, 601 bp, Human
gttcagcattcctggggtcccattctcatagggcccctgggacttgtagagctccaggctctggtaaaatgtgcactggtaaattaaagaatacaaatctatggttaattaatactgaattgggtacttgtttagtgataaatggcactgatttatgattggtttaggttggtattgaaaataatttgtttttttaaataaaaattatcaaatgatctagaatgcaagtagttaagagaatttaacagtcttagttttatttcaaataattagaaatattgtcataacactagattttgtrttcttagcaactgactaggttctgagagctctctgcacacctggttttatgagccacggcattgcgccttgcttcagttcccttgaattagcttgggtgttctttagaaaagctgccaatctggcattgcggtgatcttggcttacctccagcgctggctcagagtaaagttaagcataagtagtcgtgccaggctttgtagacgcacacagtacacaagtagaccaagaagagagattaggaaaagttatcaatgaggaattgaggcatgataacaaatagaggtttccaaaaatataa

SEQ ID NO: 27064 - DNA, 601 bp, Human
aaaatataaccttccttactttatctggaattgactggttttcagctaaaacaaggagggattttaaaaggtacccgattaatgtaattgtgtatgcatctatggacagcttgctgtttccaggtgtttgcagcctcatggtggtggttcattttaataccagtttctttcgttcccatagaaaatcttctagtcttctacctttattaatattttgttgattctttgtttttatggaaatatgcagatttgagtgtacattttatttttgatccctattatgtccctacatgggaattattccctaagtgggcattattaaagccactttatgtcaattttaggtcttataagtttaaagctttgcttctttcttttattttagaagtgacagtgtgttcgtgttcttctgaggtgtcagcaaagtttgttctacatgcagtccagcttgtgaagcaaagagcatatcgaagccatgaattctataagttttgttctcttccagagaaaggaacactgactgaagcttttcctgtcctagtaagtttaattatagtttataatcctaacacaatttatttgcctttttggtatgggctaa

SEQ ID NO: 27065 - DNA, 601 bp, Human
atagtcaaagaaacatactagtctggtagattctcgtgccttgtagttaggaccctgatttagattattctttgttgtactatagattaatttctttaagacctgtttgcttgtcacttaacttattttactaatgctgtgttgttaagctatgaggctaatttgcattataggaaaactgctactgcttcatgtctaagttatctcagatgatggcagactgcattcttatctgtggtgttggaaatgatgactagtctttcttccatagaaggtgaaagtactgatgttcttccttcartgcgctcctttgtgttttcagttggttctgggattttcccagtatctcttggtttctggttactttcatttgtgttcttccatggatcagtgttgcttcatctttttaaacttttaaatcactgattactagaaaacttactttaaaactcagtgctaagagcaggtgtttttttttccttttccttatctttattttttaatagggagaaagatgtaaatgaccataatgtcattttgttttggttgccaggtagctgtgagcccaaactcaattgtgcctattgagtatgccttacaa

SEQ ID NO: 27066 - DNA, 601 bp, Human
actaatgctgtgttgttaagctatgaggctaatttgcattataggaaaactgctactgcttcatgtctaagttatctcagatgatggcagactgcattcttatctgtggtgttggaaatgatgactagtctttcttccatagaaggtgaaagtactgatgttcttccttcagtgcgctcctttgtgttttcagttggttctgggattttcccagtatctcttggtttctggttactttcatttgtgttcttccatggatcagtgttgcttcatctttttaaacttttaaatcactgattaytagaaaacttactttaaaactcagtgctaagagcaggtgtttttttttccttttccttatctttattttttaatagggagaaagatgtaaatgaccataatgtcattttgttttggttgccaggtagctgtgagcccaaactcaattgtgcctattgagtatgccttacaaagttgaagtatctttattgtgtcgttatacttgattatttttcttttggtcctaattttttatttcgcttcgaaataataaaatcacatttgctttattatatgtgctttcagaagctgcctaggatct

SEQ ID NO: 27067 - DNA, 601 bp, Human
catttgtgttcttccatggatcagtgttgcttcatctttttaaacttttaaatcactgattactagaaaacttactttaaaactcagtgctaagagcaggtgtttttttttccttttccttatctttattttttaatagggagaaagatgtaaatgaccataatgtcattttgttttggttgccaggtagctgtgagcccaaactcaattgtgcctattgagtatgccttacaaagttgaagtatctttattgtgtcgttatacttgattatttttcttttggtcctaattttttatttcrcttcgaaataataaaatcacatttgctttattatatgtgctttcagaagctgcctaggatcttttatgacaagaagcatagggttatgagtaaataactatgtatatttaaatacaccatatctctgcaaatgatttgtctaactcttacttagcatagctgttaaaatttttgagttttcttgctacaaacaggaaaagtttgaaaacatagaattgctctgaaacagctagtatttatattctgtaatttgagaaaaataagaaaagagatatattttatttacttttatttgcaggg

SEQ ID NO: 27068 - DNA, 601 bp, Human
acaaaatgtaattgagtggtgacctagccttaagccttagtttataaaatcactgatcactgtccattggtgccatctgacccaggggtgattagatggctcagaaataccatctgccttctggtgatggtgctgggcctgattgctttctgcgaagaaggcactggaacagggaaaggtcagagtagctcccaggtgggatgggtggcaaaagtaatggaggccagtgtaaatgctggaccaaagaattgttgtaagatcaatgagatttcaataaaactgttactgaaacacacatcartttggttataatgttagggaaatggattggtttcagtgaattttcacatttcagttttataaagtaattagaggtcctgaagtatgtatatgttgctttattaatgaatacacatagccaggtgtgtatttttaaaagtttgtaagagagcagtgacttttataagtgctaaaatactgtgtgttctatattttcaaaattttttaccacaagtatttttaatgttttttaaatgaaaaagtctcatgtcaataacaatattaaaaatttgtatcagaaattatatgcaaatcatgccaa

SEQ ID NO: 27069 - DNA, 601 bp, Human
ctgaaacacacatcaatttggttataatgttagggaaatggattggtttcagtgaattttcacatttcagttttataaagtaattagaggtcctgaagtatgtatatgttgctttattaatgaatacacatagccaggtgtgtatttttaaaagtttgtaagagagcagtgacttttataagtgctaaaatactgtgtgttctatattttcaaaattttttaccacaagtatttttaatgttttttaaatgaaaaagtctcatgtcaataacaatattaaaaatttgtatcagaaattatrtgcaaatcatgccaagtaatcttttttgttttttaatagcccaagagtggggaagtaactccaagctgcccactactttgtgaactattatatgaatctgaatttgacagccaactgtggattatttttgaccagaacaaaagacagatgggttcaggcgatgcctatccacatcaggtataaaattgatggtgatttttagaattaacggaagctgtttcctgaactaacaaaatcctggtttcttgttatggtaatgttcatactttaaaaaaaacaaaaattatagctttgtgttta

SEQ ID NO: 27070 - DNA, 601 bp, Human
gtacttttaaatttactacctcgttggacaactctgtaatgagcacttactacataccaggcactatgctttgtgctgttttattgaagggaaaaatcacataatttatagacattttatcccttagatattactgcaaagaaatgagatatttcctgtaatatgtataattttatgttgacaaatgaaaataatttatggagatttttttcaattagttgttaaaggaatggtatcgattttcctcaaagcaagtagcagtcacatctcattacagactggcctactgcagtgctattaytttggttactttttaaatctcagaaaaagtggctgacacaggatacagcatctcttcctcttgaacctgttaagtggataatagatttgtatcccttgatctctattggtttcctgtttttttcctgtctgtaataaaggagtgacattttggttgtaatttgaagatcaactgggcatggtggcacatgcctgtgatcccgtctactcaggaagctgaggtgggaggatcgcttgagccctggagctctaggctatggtgcactatgattgcaccagttaacagccactgcacttcagc

SEQ ID NO: 27071 - DNA, 601 bp, Human
tttatgttgacaaatgaaaataatttatggagatttttttcaattagttgttaaaggaatggtatcgattttcctcaaagcaagtagcagtcacatctcattacagactggcctactgcagtgctattactttggttactttttaaatctcagaaaaagtggctgacacaggatacagcatctcttcctcttgaacctgttaagtggataatagatttgtatcccttgatctctattggtttcctgtttttttcctgtctgtaataaaggagtgacattttggttgtaatttgaagatcarctgggcatggtggcacatgcctgtgatcccgtctactcaggaagctgaggtgggaggatcgcttgagccctggagctctaggctatggtgcactatgattgcaccagttaacagccactgcacttcagcctgggcaacatagtgagtccccctctctaaaaggaaataaggattaccagtagtcataagttacacgtgtgtgtgtgtgtgtgtgtgtgtgtgtgtgtgtgtgtgtgtatttgtcctagatattctatggtgcctcaattttgctcatttttttggtagtgtttcttatat

SEQ ID NO: 27072 - DNA, 601 bp, Human
gctctaggctatggtgcactatgattgcaccagttaacagccactgcacttcagcctgggcaacatagtgagtccccctctctaaaaggaaataaggattaccagtagtcataagttacacgtgtgtgtgtgtgtgtgtgtgtgtgtgtgtgtgtgtgtgtgtatttgtcctagatattctatggtgcctcaattttgctcatttttttggtagtgtttcttatatgtctctgagggacccatgaactagaaaatcactgcttttgtcattctcaagcagacactgagttttgctaaaagygtgggagtattctgtcgttctggaaagaatgagggctttgaagtcagacctgactccagctctcttatactttactctgtgtgatgttaggcaagtcacttgatgtccctgatcctgtctgctcaccagcgtactagggactttatgtgttatatgaacgtctggatagttagtgccttgcactgtacctcacatattatgaacaagtctgtgaatggtaactttcactttatcctctttcagtgatttccgttgacttggttaaacttaacttttcccaaatgttgtttttctttttca

SEQ ID NO: 27073 - DNA, 601 bp, Human
tgggcaacatagtgagtccccctctctaaaaggaaataaggattaccagtagtcataagttacacgtgtgtgtgtgtgtgtgtgtgtgtgtgtgtgtgtgtgtgtgtatttgtcctagatattctatggtgcctcaattttgctcatttttttggtagtgtttcttatatgtctctgagggacccatgaactagaaaatcactgcttttgtcattctcaagcagacactgagttttgctaaaagtgtgggagtattctgtcgttctggaaagaatgagggctttgaagtcagacctgactycagctctcttatactttactctgtgtgatgttaggcaagtcacttgatgtccctgatcctgtctgctcaccagcgtactagggactttatgtgttatatgaacgtctggatagttagtgccttgcactgtacctcacatattatgaacaagtctgtgaatggtaactttcactttatcctctttcagtgatttccgttgacttggttaaacttaacttttcccaaatgttgtttttctttttcagtattctttgaaactggagaaaggagattatacaattcgactacagattcgccatg

SEQ ID NO: 27074 - DNA, 601 bp, Human
tattctatggtgcctcaattttgctcatttttttggtagtgtttcttatatgtctctgagggacccatgaactagaaaatcactgcttttgtcattctcaagcagacactgagttttgctaaaagtgtgggagtattctgtcgttctggaaagaatgagggctttgaagtcagacctgactccagctctcttatactttactctgtgtgatgttaggcaagtcacttgatgtccctgatcctgtctgctcaccagcgtactagggactttatgtgttatatgaacgtctggatagttagtkccttgcactgtacctcacatattatgaacaagtctgtgaatggtaactttcactttatcctctttcagtgatttccgttgacttggttaaacttaacttttcccaaatgttgtttttctttttcagtattctttgaaactggagaaaggagattatacaattcgactacagattcgccatgagcaaatcagtgatttggaacgccttaaagaccttccatttattgtttctcatagattgtctaataccttgagcttagatattcatgaaaatcatagttttgcacttctagggaagaag

SEQ ID NO: 27075 - DNA, 601 bp, Human
tgtactttagacatatatgttacagttttataagtacctacctgtttttgttttttccttctatgttttcattacaaatttattatgagaatgatgtttatatagatctatcaccttttgtcataataatcattttagctcaatgccagtaaaagttgtcattcttaacagttttgcatttctctgtactattacttcttacagagctaagtaagcctgctacataaatgctgttatcaaaatgagtagttctcatacatcttaagaattatatttattttttgccactattgaaccaaargccatttatttactgtcattgaagcataattggggaaacttgtgcttagaaagttgcctaccctgacatttcttgggtctcatttcagtttatactgtttatacatacgtactttagtataatttgaagtaaatcaatagttaatggtttgtaattaatacatgcactgatttaagaaaccctggtagttttttttgtagatttcatttcacaggaagcatagctgcttcagctattgggcgtcagctgtgaattttcgttcagatgacagatgacactttgaagagtctgcttacttgt

SEQ ID NO: 27076 - DNA, 601 bp, Human
gctgttatcaaaatgagtagttctcatacatcttaagaattatatttattttttgccactattgaaccaaaggccatttatttactgtcattgaagcataattggggaaacttgtgcttagaaagttgcctaccctgacatttcttgggtctcatttcagtttatactgtttatacatacgtactttagtataatttgaagtaaatcaatagttaatggtttgtaattaatacatgcactgatttaagaaaccctggtagttttttttgtagatttcatttcacaggaagcatagctgctycagctattgggcgtcagctgtgaattttcgttcagatgacagatgacactttgaagagtctgcttacttgtgaagagtataacagaaaagcattattagtaaaagtgggcttttagcaattcagaaatagttactacttcccagttacattgttttaggagacaattgtgaaattaaattataaatatgtggtgttaactatggtagctatttatcaagggagaccttcctgggagaaagcagtaacttaaagctgttgagttcattataacttccatcacattgtttatgtaatctttt

SEQ ID NO: 27077 - DNA, 601 bp, Human
tttcatgatttctttttaaacagaaagaattacagtgggaaaatcagtaatgtcctaatgtatacttgttaattagtagtgatatggaactggggaatcaccattctataacagcttaaattcctttattaaaatgtcttctgaaatgtccatattattacataatagtaaataatttgtccaaacaaaatacagatactaggaatcatctttctggagaaagatctaaagatcagtatttctcaactgggtgtcttgaccgtttgggggccacgtaatgggataaaaacagcattttttwaaaataggaaatgtcagttcatcagactcataaaattgtaatttcattttatgtattaatgtgtatatctttgggacattgtaaaaatagtttgcaagttactgctttagagaacaaggaataggtattctaggaatctattaaaaatagaaggcacttatcacgaaggccatagccaattatttttcttcttatttttgttgaccttttgcaagtttgggtagattttgtttgaattaggttgtatagttaggaaaacactgaatgaataggaaggcatttacttggtgattagtaaag

SEQ ID NO: 27078 - DNA, 601 bp, Human
acttatcacgaaggccatagccaattatttttcttcttatttttgttgaccttttgcaagtttgggtagattttgtttgaattaggttgtatagttaggaaaacactgaatgaataggaaggcatttacttggtgattagtaaagcttcatttgaagaacttggcagctagagttatctctgctcgttcctttctgtcttcaatgcaagtacacaataaagctcttattttagaaataattagtattacagttttatagtcacattacaaagaaaaaaatacatgtataatttccggttgwttaagataaatagcattttgtatataattcttaatagattttttcctctgggtttcagtgacttgatttgaaaaggtatgtcaccctttttaaaattccttgtaaaatgcaataatatattttttgtttgtttgtatgtttttttaagagacagtctcactcaacactccaggctagagtacagtggcatgatcgtagctcactgttgcctccagctcctgggctcaagtgatcctcccacctcagcctccctagagtggctgggactacaggcgtgtgccactatgcctggctaatttt

SEQ ID NO: 27079 - DNA, 601 bp, Human
gtttgaattaggttgtatagttaggaaaacactgaatgaataggaaggcatttacttggtgattagtaaagcttcatttgaagaacttggcagctagagttatctctgctcgttcctttctgtcttcaatgcaagtacacaataaagctcttattttagaaataattagtattacagttttatagtcacattacaaagaaaaaaatacatgtataatttccggttgtttaagataaatagcattttgtatataattcttaatagattttttcctctgggtttcagtgacttgatttgaaamggtatgtcaccctttttaaaattccttgtaaaatgcaataatatattttttgtttgtttgtatgtttttttaagagacagtctcactcaacactccaggctagagtacagtggcatgatcgtagctcactgttgcctccagctcctgggctcaagtgatcctcccacctcagcctccctagagtggctgggactacaggcgtgtgccactatgcctggctaatttttactttttatagagagaggtcttactacgtatgttgcccaaggtggtctaaaactcccggcctcggacgatcct

SEQ ID NO: 27080 - DNA, 601 bp, Human
tttacttggtgattagtaaagcttcatttgaagaacttggcagctagagttatctctgctcgttcctttctgtcttcaatgcaagtacacaataaagctcttattttagaaataattagtattacagttttatagtcacattacaaagaaaaaaatacatgtataatttccggttgtttaagataaatagcattttgtatataattcttaatagattttttcctctgggtttcagtgacttgatttgaaaaggtatgtcaccctttttaaaattccttgtaaaatgcaataatatattttytgtttgtttgtatgtttttttaagagacagtctcactcaacactccaggctagagtacagtggcatgatcgtagctcactgttgcctccagctcctgggctcaagtgatcctcccacctcagcctccctagagtggctgggactacaggcgtgtgccactatgcctggctaatttttactttttatagagagaggtcttactacgtatgttgcccaaggtggtctaaaactcccggcctcggacgatcctcctggctcagcctcccaaaatgctgaaattacagacatgagccactgcac

SEQ ID NO: 27081 - DNA, 601 bp, Human
gcagctagagttatctctgctcgttcctttctgtcttcaatgcaagtacacaataaagctcttattttagaaataattagtattacagttttatagtcacattacaaagaaaaaaatacatgtataatttccggttgtttaagataaatagcattttgtatataattcttaatagattttttcctctgggtttcagtgacttgatttgaaaaggtatgtcaccctttttaaaattccttgtaaaatgcaataatatattttttgtttgtttgtatgtttttttaagagacagtctcactcwacactccaggctagagtacagtggcatgatcgtagctcactgttgcctccagctcctgggctcaagtgatcctcccacctcagcctccctagagtggctgggactacaggcgtgtgccactatgcctggctaatttttactttttatagagagaggtcttactacgtatgttgcccaaggtggtctaaaactcccggcctcggacgatcctcctggctcagcctcccaaaatgctgaaattacagacatgagccactgcacccagcctgaatattgtcacttttaacagatcataaatag

SEQ ID NO: 27082 - DNA, 601 bp, Human
gaagattcttcttgactgtctttttaaaccataatcaagatttctcaagaataaaggtacaaaattatttctattaaattggtactatgttaaccccttgagaattgtcataaaaatattaatatttattggcacaaagaagaaattattgtgatacagcaagtgaaaatagcgccatttttcttttgattagaaattaaaactaccaggtttataatttttactaataaaaaattccctgtcctgaaacatcttgtaggattacactaacatttataattgttaatttgatatatttaayatgtaaaatgctgattacaaaaccttgatttttgtttcactaagataattcatcataaactttctttgtctctttttttgcttttaatgatagtctaaggttactaggatatcttttttcccacttttgataggtctttgttagaattaattgtaaatcctaaattaattttaatagattgttcattttaaattcaattctcttttctcttctgtactaaaacaatagcaaatacctctgagtctgaggaggaagtgcctcacaacacataggctgcctgcctaagagcagcatacctct

SEQ ID NO: 27083 - DNA, 601 bp, Human
ctgtactaaaacaatagcaaatacctctgagtctgaggaggaagtgcctcacaacacataggctgcctgcctaagagcagcatacctctctccctgatatggtgaggaggtgtgggaagctcagggagaaagactggagaccactcttctagcacactgggtggcagagaagctcaattccatggagaatggagctatattaacagaaagtaaatattggaggccacttagcccctttaattcctagatgtgttgtctttgctgtacagatgacactgatgcagtctgtttccataagaasttggtggtagaagatcagctcagattttgtgcttaccttggctttgctcagggcagtgcctacccagagagtgaacctcaagaaggagaggagcaggacaggcagctgggtcctgaaagagctagcccaagcagtagacctgtttccttttcccagtctcatgtttcacgtaaggcctttgtttacaggttctggccccctgacctcagagggagaatgacagccagtggctacaaatggatttatatggttatctgacatcaaagtggttttctgtgctttaaatgagtcagtatggag

SEQ ID NO: 27084 - DNA, 601 bp, Human
tacctggcacatcgcggggactcagtaagtcctgttggttggactcagtaagtcctgttggttgaatgaaggcataagcgtccccttaaatttacttagagaatcttttcttagtttgaacttatttcatccccttctcagatttaaaatgtgaaaggtcagtgtacttttgtcatctgtctgccaagtaaagccaagaataccaaatatactcaaatggagaaaagtatgttcttatctcttttattttaaaggagatatttgaagtatcagtactcagcatcagtttgtgagaaaattrctgtgaccagagattggaatttttggtgtattgtgacccttagaatctagaatacagtgtagtacaacttaggtgcagcccatgttacatgacatgtagctgttgaagatgattttgatgtatgtaaaattaagcatattaatctaagaatctctctccacattcgtaggatgtaatccctgttcattactacttaatacctccaccaacaaagactaagaatggcagcaaagataaggaaaaagattcagaaaaagagaaagatttaaaagaagagtttactgaagcattacgagatct

SEQ ID NO: 27085 - DNA, 601 bp, Human
cgagatcttaaaattcagtggatgacaaagtaggtttttaaatgtattttaattctttaaatgtttagttctattttcccaactataacaatattgtgtatatatacatagaccgtatttaaaattattaacagcagttggtaggattataggtgcttttaaattttcctctttttatataaatgtgtaatttatttaaattataaatatataattttgtgattaaatgttttaatttttattttaatcactctaatttgttcttggaagataattttattggaaagtataaaaaagaaamatcacttttgcccacaattcataaatagtcattgtcctcttattattatttttttcctctgtgtttgtacatgtagcagtgtgaataaaattagtttccatttttcagttacttttttattatgatttaacagccgtataaaatactatttttaatgtctgtgttgtatatggttctatggatgcaacataatctatttaaacgttttattttgcatatatatgtttatagcttttcttcatgatgctgcgataaacatttttatacataaaggtgattttttaaaatttccatcatatt

SEQ ID NO: 27086 - DNA, 601 bp, Human
ttcccagagattgaaccattgtaatgtcagttcacttgcaaatatacctttcccacttaaaactaaattgtatctccactggaagtcaaagtcttcaggtctgtctctgcctgattttaggatgtcataaacagttgacaatataatataaattcttcaaaagtaaaattgcagagattgtcttctggcatgacagcctgaggagacccatgatgctggtccccagtaaaactagtgaaaattatttaaaaacaaaacaaaacaactttttaaagcctctggaaatggtccaaaggacatwgagcaaatgaagaagcatctattcaaaaatacctacaagaattggataagaaaagcaagagtctgtgatatttgaaccaagaccactgcctccctttcctctcccagttaatgagccagaaattttacttcagatcttgccttcaagagctccagctcctgggggagggaaggctttcctccttggaggaggaggacgtcatcatttctcatcctgacctactgccagttgcagcggctcagttccagctgagtgctctcaagaggtgggggctctcttgtaaagtactgttgggaacac

SEQ ID NO: 27087 - DNA, 601 bp, Human
tgattttaggatgtcataaacagttgacaatataatataaattcttcaaaagtaaaattgcagagattgtcttctggcatgacagcctgaggagacccatgatgctggtccccagtaaaactagtgaaaattatttaaaaacaaaacaaaacaactttttaaagcctctggaaatggtccaaaggacatagagcaaatgaagaagcatctattcaaaaatacctacaagaattggataagaaaagcaagagtctgtgatatttgaaccaagaccactgcctccctttcctctcccagttartgagccagaaattttacttcagatcttgccttcaagagctccagctcctgggggagggaaggctttcctccttggaggaggaggacgtcatcatttctcatcctgacctactgccagttgcagcggctcagttccagctgagtgctctcaagaggtgggggctctcttgtaaagtactgttgggaacactggggccccaatgcccaggaggctgtggttccataccacacgaggcaagctgagaagaccacaggagagtgctaagctccttaagtgggggtgtcactcaaagaaaaacat

SEQ ID NO: 27088 - DNA, 601 bp, Human
agtaaaattgcagagattgtcttctggcatgacagcctgaggagacccatgatgctggtccccagtaaaactagtgaaaattatttaaaaacaaaacaaaacaactttttaaagcctctggaaatggtccaaaggacatagagcaaatgaagaagcatctattcaaaaatacctacaagaattggataagaaaagcaagagtctgtgatatttgaaccaagaccactgcctccctttcctctcccagttaatgagccagaaattttacttcagatcttgccttcaagagctccagctcctgggggagggaaggctttcctccttggaggaggaggacgtcatcatttctcatcctgacctactgccagttgcagcggctcagttccagctgagtgctctcaagaggtgggggctctcttgtaaagtactgttgggaacactggggccccaatgcccaggaggctgtggttccataccacacgaggcaagctgagaagaccacaggagagtgctaagctccttaagtgggggtgtcactcaaagaaaaacatgccattcttccactccctgttccagagcttgggcttagtgattttgccag

SEQ ID NO: 27089 - DNA, 601 bp, Human
tttaaagcctctggaaatggtccaaaggacatagagcaaatgaagaagcatctattcaaaaatacctacaagaattggataagaaaagcaagagtctgtgatatttgaaccaagaccactgcctccctttcctctcccagttaatgagccagaaattttacttcagatcttgccttcaagagctccagctcctgggggagggaaggctttcctccttggaggaggaggacgtcatcatttctcatcctgacctactgccagttgcagcggctcagttccagctgagtgctctcaagaggtrggggctctcttgtaaagtactgttgggaacactggggccccaatgcccaggaggctgtggttccataccacacgaggcaagctgagaagaccacaggagagtgctaagctccttaagtgggggtgtcactcaaagaaaaacatgccattcttccactccctgttccagagcttgggcttagtgattttgccagtgtggcctaaggagttcataaaactgatagctcctaatttcttgctgaaggaattgacttcatttgcaacagaagatggagaagtccgtgtgccttaagggctctct

SEQ ID NO: 27090 - DNA, 601 bp, Human
ttatactggcacaagggtaagacatatatagatcagtggaatagaattaagagtccagaaataaaaccatgtgactatggtcagctaatttttagttttggcaagggtgctgatgcaaagaccatttaatgaggaaaggatagtatttgcagcaaagggtgctgggactggatagccatatagaaaaagaatgaagttggacccttgcctcacatcatatatacaagttaactcaaaatgtatcaaagagctgaaactacaaaactcaatgagacgtagtggtaaactttcatgaccttayatttggcaaaagatttttaaagataccaaaagcataagtaacataagaaaaaaaatagataatttggacttaatcaagattaaaagcttttgtgcttttagcatagcatcaagaaagtgaaaagaacggcctatttgcaagttacatatttttaaggagcttgtatgcaaaatatataaagaacgctaaccttttttttttttttttttttgagacagggtctctctctgtcacccaggctggactgcagtggcacgatcatagctcactgcagccttgaacccctgggctcaagggatc

SEQ ID NO: 27091 - DNA, 601 bp, Human
aagagtccagaaataaaaccatgtgactatggtcagctaatttttagttttggcaagggtgctgatgcaaagaccatttaatgaggaaaggatagtatttgcagcaaagggtgctgggactggatagccatatagaaaaagaatgaagttggacccttgcctcacatcatatatacaagttaactcaaaatgtatcaaagagctgaaactacaaaactcaatgagacgtagtggtaaactttcatgaccttacatttggcaaaagatttttaaagataccaaaagcataagtaacataagaaaaaaaatagataatttggacttaatcaagattaaaagcttttgtgcttttagcatagcatcaagaaagtgaaaagaacggcctatttgcaagttacatatttttaaggagcttgtatgcaaaatatataaagaacgctaaccttttttttttttttttttttgagacagggtctctctctgtcacccaggctggactgcagtggcacgatcatagctcactgcagccttgaacccctgggctcaagggatcttcccacttcagcctcccaagtagctaggactacaagtgcacgccacc

SEQ ID NO: 27092 - DNA, 601 bp, Human
caaagggtgctgggactggatagccatatagaaaaagaatgaagttggacccttgcctcacatcatatatacaagttaactcaaaatgtatcaaagagctgaaactacaaaactcaatgagacgtagtggtaaactttcatgaccttacatttggcaaaagatttttaaagataccaaaagcataagtaacataagaaaaaaaatagataatttggacttaatcaagattaaaagcttttgtgcttttagcatagcatcaagaaagtgaaaagaacggcctatttgcaagttacatatttktaaggagcttgtatgcaaaatatataaagaacgctaaccttttttttttttttttttttgagacagggtctctctctgtcacccaggctggactgcagtggcacgatcatagctcactgcagccttgaacccctgggctcaagggatcttcccacttcagcctcccaagtagctaggactacaagtgcacgccaccacccccagcttatttttttaagggatgggatctcactatgttgcccaggctagtctggaacccccggcctcaattaatcctcctgcttcagcttcccatagtgt

SEQ ID NO: 27093 - DNA, 601 bp, Human
tggttgcttagtgctggggaggctggggagatctgatagcaaaagggtatggcggtttctttttgtattgatgaaaaatgttttaaagttgactgttgtgatagttacatatatctgttactatgctagaaagcattgaaattcacacttaaaatgggaaaattgtatggagaaaaaattgaaaaggttgtttacctaataggtgttttagaagaaaacagcaaaaaattattagcattccctagcaaaactttaaaaaccttagaacattttttggaaaaaaaaatttataattaaggtkcagtagttttaaaatgtaaaacgaaagtgttgattttgcccttggataattgttagcgaaaagagaaaaacaggacttaattttttttgtactaagaattagtgtaaattttgttgtctacaagttaaatttattttcatagaaagttagttatagtatcaaaatcccggtcaaccttatttttatactactgtgcagttttgttaatatattaagtgactttaatgtaagttacccacttctggtgctagtttgtatgttaatttgtttttatcctgatacatataatcaggtagaatt

SEQ ID NO: 27094 - DNA, 601 bp, Human
aggagtgacatgtagtgtttcttggcacctcagtccaatgtgtgctgttactaaggaaccccactgagggtatgttacccccttccagccaagcagttactttattggaggctgggaaggtggtgtctgcccaggtaacagggcagaagaaaggcaaatctaaatgatgatcccaatagcgtgtagcaggtatgggttgcaggcagagtgagagaataagaagggttaatacccaaaagagttgcagtgtacaacggaaagcatagcaaggaacaaattatctggagtgaatggtgtctaygtccagagcaggattcattcagccttctgagttttcttcagcatctcccaggtaatgtctggggtttgtgtcgtctgaagaagctgcatcatccagggctatgggttccacagggtcattttcttcatttctggtaccgggttgggtcctagccacgctatggtatggtttgatgcctcgtgctggaatccaaagaggacctgagggggtgtgaacacaagcatgtcttcttcccagtgttaacaattcagttgaaccgcaccatacattactgtttatatctttccataaaactgcagg

SEQ ID NO: 27095 - DNA, 601 bp, Human
cgtgtagcaggtatgggttgcaggcagagtgagagaataagaagggttaatacccaaaagagttgcagtgtacaacggaaagcatagcaaggaacaaattatctggagtgaatggtgtctatgtccagagcaggattcattcagccttctgagttttcttcagcatctcccaggtaatgtctggggtttgtgtcgtctgaagaagctgcatcatccagggctatgggttccacagggtcattttcttcatttctggtaccgggttgggtcctagccacgctatggtatggtttgatgcctygtgctggaatccaaagaggacctgagggggtgtgaacacaagcatgtcttcttcccagtgttaacaattcagttgaaccgcaccatacattactgtttatatctttccataaaactgcaggtttatgtcttgagaggttttagcaaaatgctcttctatagctgattgaaatttatcgtttagattttaaaaagtaagggtaaataaggcttctgccagtagtgttgcagggtccttactcatattcacttttttgttgttttctgagcatatttttaagggtggattggacacgttcta

SEQ ID NO: 27096 - DNA, 601 bp, Human
tttgccataactgattaggttctagttctctagggttaacacctgttgaaggaggggacatgcctgtgagctggcaatttgggcattgcaggataatttgtttagtctttgggtaagttgaaatcgtttagataaatttctccaattttggtggaaacattgatgcgaatgggtggcttggtcaagcagtgatgtcataacctgcaggtctgcttgatcattgccataagctagggggccaggcagtgagctgtgggcccaaatgtatgtaataaaaataggatgtgtacattgatccacygattgctgaaatcaaagaaaaactgcacacagggtgggcttgagagtggacttaataagggctgtttcaaggttctgcaataaataaacagagtaagcagagtcactaaccatattgattggctgagcaggaaaggtctctagggccagtattaaggctccaacctcagctttcttgagtgttagtaaatccagaacaagtgagggaattgtgcagtctccaccaaataactacttttccatttttaccagagccgtcaataaaaagcattaaagaattaggtattgtgggtgggggggg

SEQ ID NO: 27097 - DNA, 601 bp, Human
gggcattgcaggataatttgtttagtctttgggtaagttgaaatcgtttagataaatttctccaattttggtggaaacattgatgcgaatgggtggcttggtcaagcagtgatgtcataacctgcaggtctgcttgatcattgccataagctagggggccaggcagtgagctgtgggcccaaatgtatgtaataaaaataggatgtgtacattgatccaccgattgctgaaatcaaagaaaaactgcacacagggtgggcttgagagtggacttaataagggctgtttcaaggttctgcartaaataaacagagtaagcagagtcactaaccatattgattggctgagcaggaaaggtctctagggccagtattaaggctccaacctcagctttcttgagtgttagtaaatccagaacaagtgagggaattgtgcagtctccaccaaataactacttttccatttttaccagagccgtcaataaaaagcattaaagaattaggtattgtgggtggggggggtgtggcggtgaaccacttttgtaggcataactacaggagtactagataataactgaagtagtttatcggcaggaagggca

SEQ ID NO: 27098 - DNA, 601 bp, Human
agggggccaggcagtgagctgtgggcccaaatgtatgtaataaaaataggatgtgtacattgatccaccgattgctgaaatcaaagaaaaactgcacacagggtgggcttgagagtggacttaataagggctgtttcaaggttctgcaataaataaacagagtaagcagagtcactaaccatattgattggctgagcaggaaaggtctctagggccagtattaaggctccaacctcagctttcttgagtgttagtaaatccagaacaagtgagggaattgtgcagtctccaccaaataacyacttttccatttttaccagagccgtcaataaaaagcattaaagaattaggtattgtgggtggggggggtgtggcggtgaaccacttttgtaggcataactacaggagtactagataataactgaagtagtttatcggcaggaagggcatgttctatatggcctgtgtaatcagagagtgctatttgcaggtctagagataaaggcaagactgctttgaattgctttttacttaaaggacttccgatgacatcatggtcataacctagaaactgattgcatcatctgcggcctaaatagat

SEQ ID NO: 27099 - DNA, 601 bp, Human
tcaaggttctgcaataaataaacagagtaagcagagtcactaaccatattgattggctgagcaggaaaggtctctagggccagtattaaggctccaacctcagctttcttgagtgttagtaaatccagaacaagtgagggaattgtgcagtctccaccaaataactacttttccatttttaccagagccgtcaataaaaagcattaaagaattaggtattgtgggtggggggggtgtggcggtgaaccacttttgtaggcataactacaggagtactagataataactgaagtagtttatyggcaggaagggcatgttctatatggcctgtgtaatcagagagtgctatttgcaggtctagagataaaggcaagactgctttgaattgctttttacttaaaggacttccgatgacatcatggtcataacctagaaactgattgcatcatctgcggcctaaatagatgattttactaactagctgggtacagggagatagagttttagttctggtatgtgagcaaaaaactcattttaggaagcatagccctggggacatctgtcctattaatcctgttggggaatgcttagtaggaaaaac

SEQ ID NO: 27100 - DNA, 601 bp, Human
agcagagtcactaaccatattgattggctgagcaggaaaggtctctagggccagtattaaggctccaacctcagctttcttgagtgttagtaaatccagaacaagtgagggaattgtgcagtctccaccaaataactacttttccatttttaccagagccgtcaataaaaagcattaaagaattaggtattgtgggtggggggggtgtggcggtgaaccacttttgtaggcataactacaggagtactagataataactgaagtagtttatcggcaggaagggcatgttctatatggcctktgtaatcagagagtgctatttgcaggtctagagataaaggcaagactgctttgaattgctttttacttaaaggacttccgatgacatcatggtcataacctagaaactgattgcatcatctgcggcctaaatagatgattttactaactagctgggtacagggagatagagttttagttctggtatgtgagcaaaaaactcattttaggaagcatagccctggggacatctgtcctattaatcctgttggggaatgcttagtaggaaaaacaaacaattgaactgaatattgaatatcgt

SEQ ID NO: 27101 - DNA, 601 bp, Human
tccaccaaataactacttttccatttttaccagagccgtcaataaaaagcattaaagaattaggtattgtgggtggggggggtgtggcggtgaaccacttttgtaggcataactacaggagtactagataataactgaagtagtttatcggcaggaagggcatgttctatatggcctgtgtaatcagagagtgctatttgcaggtctagagataaaggcaagactgctttgaattgctttttacttaaaggacttccgatgacatcatggtcataacctagaaactgattgcatcatctgyggcctaaatagatgattttactaactagctgggtacagggagatagagttttagttctggtatgtgagcaaaaaactcattttaggaagcatagccctggggacatctgtcctattaatcctgttggggaatgcttagtaggaaaaacaaacaattgaactgaatattgaatatcgtgggtctgtgcaatcctgttgcctctgaaaaatagcatgctctatttcctcaatttccctttttgctgcaggagttaaatacctgggagagtctagggctgtattgccctttaggatagaaaca

SEQ ID NO: 27102 - DNA, 601 bp, Human
ataagactataggtcaaactacaggaattgccgctggggaagggaggccctgttgtaggggcctcataggttgcaaattagcattgatagcccataagtcatgcaaaagtctccatttgccagactttttgggaatgaggaaaatgggcaaattccaagggctgtttgacagttgtatatggctggcttttaattgttcctcagctaattcatgggctctttgtaatttctctccctttaaaggtcactgttctacctaaataagattttgagagagcctcatcaggggtaggggagaaayaacagtggccattattagaaagagatctgcagagtgacctcaaccctcttgtaaatgggctagcggctccgttttctttaatgcttttccttatctctttataagcgttaaaagtaacgggttcatacacctgattgtgttgtcaattttgcgttaccaggcaggccaagagctccccttctaatgccgcttgcctaagacagggtcccatagctgtagcatattccttgtcttttctccaatttattggaggacggggctcaggcaaaacctccgtttcctctttgttatctttgcccg

SEQ ID NO: 27103 - DNA, 601 bp, Human
caattttgcgttaccaggcaggccaagagctccccttctaatgccgcttgcctaagacagggtcccatagctgtagcatattccttgtcttttctccaatttattggaggacggggctcaggcaaaacctccgtttcctctttgttatctttgcccggtaacagcggggctgagggagaagggggaggaaccatgggttatgggaaacaacagtttgcattaggtcccttaattgagcctgcgaaaccgagcctccactagctttaagcagctgtttcattacttttatatactgttgctsttgagctgataactgttgtcccatgatgaaaccctagcctgaacaattccctcgaacttggaaatcccaagcgggcaccagtgacttactgactgcgcagtctcttcaccttcattttcgagggttccattgtgatccattgcagcgttcctctcatggggcaccacctgccaagtctgtccctcagactatggccgagtgacagatgaaaggaaaggagtactcagacacaggtatccagtgaaacagcaggctagggactgccggcactaggggccgaagagagttagcagtccccct

SEQ ID NO: 27104 - DNA, 601 bp, Human
tttgttccacagctaagtgcctcaatcatcatcattttctcagtacttttagtcctcattgttttcacgtgtatctgacataagttggacagaatgcctcaaataagcacacattctagagactaacacttttccctggagtgtaggtggtggttgtatttcattcagcaatgatttattgagtttccattctgtgccgggcattgtcctaggcacatggaatgcattgaagaaaacaaagatgtctgccctggatcaaggcaatgtgccgtagtgattaagagcacagattacagatttmtactgctaagcttagaatcctggatctgccacttcctaactggcggaccttgaacaaattgcatagtctctttgggccacagtttcttcctttgcaacatggcagtaattaatagtctcttactcagaattgttttgaatgtgaatgaattaacatgttaaaatgctgagacagttgctggcacattcagagtaaagcattacatttatttgtcctagtcatgaactgaaagttttaagacataacctctgggtatacacatagacaaatgtgtaatgattactatttataagaaaactg

SEQ ID NO: 27105 - DNA, 601 bp, Human
acttttagtcctcattgttttcacgtgtatctgacataagttggacagaatgcctcaaataagcacacattctagagactaacacttttccctggagtgtaggtggtggttgtatttcattcagcaatgatttattgagtttccattctgtgccgggcattgtcctaggcacatggaatgcattgaagaaaacaaagatgtctgccctggatcaaggcaatgtgccgtagtgattaagagcacagattacagatttatactgctaagcttagaatcctggatctgccacttcctaactggmggaccttgaacaaattgcatagtctctttgggccacagtttcttcctttgcaacatggcagtaattaatagtctcttactcagaattgttttgaatgtgaatgaattaacatgttaaaatgctgagacagttgctggcacattcagagtaaagcattacatttatttgtcctagtcatgaactgaaagttttaagacataacctctgggtatacacatagacaaatgtgtaatgattactatttataagaaaactgaaaactcaaaagtcatttacctgattaagagttatatagctaaa

SEQ ID NO: 27106 - DNA, 601 bp, Human
gaatcctggatctgccacttcctaactggcggaccttgaacaaattgcatagtctctttgggccacagtttcttcctttgcaacatggcagtaattaatagtctcttactcagaattgttttgaatgtgaatgaattaacatgttaaaatgctgagacagttgctggcacattcagagtaaagcattacatttatttgtcctagtcatgaactgaaagttttaagacataacctctgggtatacacatagacaaatgtgtaatgattactatttataagaaaactgaaaactcaaaagtcrtttacctgattaagagttatatagctaaaaaaatttagaatagtgattaacctttcaactctgttgcttctggcattccgtttcaaccaggtgcagctaccctaactcatttaatctatatgtgtaatatagtagctcatttgatgtttattaataaggcatcatatttgatgtacaatacaattgtacgtacctggatatacagtatttctgcattataaatcttaggcaaaagaatacatgaatttaaattcagataagaatttacttttaaagacattttactgatatctgaaatat

SEQ ID NO: 27107 - DNA, 601 bp, Human
ccaacacagtacagtggtgcatttaaagaaggtactcagttactcagttatatttgggaaactgaaggagccagtattgcagcagaggtcaggaatttgaatctgaaattagagcccttgagtttggctcctgcctctaccacttttatgtatgaccttaggcaacttacaaaattttgataccttagtttcttatctacacgacctgccttaggctgtgatgaatgagtattaagtacatgcaaagtccccaacaatatttgctgttattgcaaacaattattgaaggcctatgtgccaracactacttactactggaaacataaagatgaataagaacctgctttctgtctttgaggaatgtaacagagattgacaaacacttgatgaacatataatgaaattgttatagatcattctatttttgcaatactactactatattaggggctatgcattctattacctgtttactgtgtttactgtgtccatggcaacaattgttaaatactttagttgcctttacaatacaaatcagtgtcaggattttctttgagtacattctccacattccaaagtagagaccaaaaatatatataaa

SEQ ID NO: 27108 - DNA, 601 bp, Human
aatctgaaattagagcccttgagtttggctcctgcctctaccacttttatgtatgaccttaggcaacttacaaaattttgataccttagtttcttatctacacgacctgccttaggctgtgatgaatgagtattaagtacatgcaaagtccccaacaatatttgctgttattgcaaacaattattgaaggcctatgtgccagacactacttactactggaaacataaagatgaataagaacctgctttctgtctttgaggaatgtaacagagattgacaaacacttgatgaacatataatraaattgttatagatcattctatttttgcaatactactactatattaggggctatgcattctattacctgtttactgtgtttactgtgtccatggcaacaattgttaaatactttagttgcctttacaatacaaatcagtgtcaggattttctttgagtacattctccacattccaaagtagagaccaaaaatatatataaatgattataagtatatttgacagatgcagtaattacaggtaaaaacttgtaccaaagaaaccatgtttatataatctaatacttgtttttttacttctat

SEQ ID NO: 27109 - DNA, 601 bp, Human
ttttatttctatcctgatttgcatctttgtaattatttatgttagctctggtttcttgtgcatgaagaggtatttttaagtggatttccacggctaataatttctcatattagttttcttcccaaaaaacagatggttcattctgtggaatactcagctcttttgaagacaccaactttctttttcaaagtttttaaaaatgtactctatgtaccatattcatttcaaaagctacacttctgttaaagccttaattttattgttaaagctaatgccttaaaatgtaaattattttataaamaagctttatcatgttttacattgtaggttttgacatttgcatataaacatgcattagtaaataaaatgtatgggagaggccttaaatttgcaactaaacttgtggaagaaaaaccaacaaaagaaaactggaaaaattgtattcaagtaagtgatatttaaaatgtcactgttaagcatcactttgatattgcatagtgacaagataactagaaaggattaggactgtgatatagcaatactggttttattgtgaccagttattacagtaattagcgtaatatgaactatagaataaata

SEQ ID NO: 27110 - DNA, 601 bp, Human
ttactcttagagctttttgtttaccttcaccagtcagtccaaattgtaagacattttaaattagctcctccagatctttgactagattaagagaactctttctggagccaggtgttgatatgtctaatgtggttctcatcatgtggaatctgatccgtgagcacttaggtttgtaaagccagtgatccctgccgacgttcacatcagggagtgtttcttaacttgtctgccctccactctgcccccccgctgcctgttctccacacagcagctggaaaagatgccttttgacacctgctgwtgaatctccatcacatttggaataaaatccaaactctccccagtggtccataaggcccctgcctacctctccagacttatttcatatcacacttgcccatacaaactctgcttctgccacaccagcatctctgcttagcacaaacagccacaccttttcctaccaaaggaccttagcactaactactctggctggatggaatgtctttcccagattttcgcacagatttcttgtcattcaaactcaactggagtatcacctccatagagatcctttcttaaccatctaactccccagtta

SEQ ID NO: 27111 - DNA, 601 bp, Human
ttctccacacagcagctggaaaagatgccttttgacacctgctgatgaatctccatcacatttggaataaaatccaaactctccccagtggtccataaggcccctgcctacctctccagacttatttcatatcacacttgcccatacaaactctgcttctgccacaccagcatctctgcttagcacaaacagccacaccttttcctaccaaaggaccttagcactaactactctggctggatggaatgtctttcccagattttcgcacagatttcttgtcattcaaactcaactggagtawcacctccatagagatcctttcttaaccatctaactccccagttagtttatattgtgtcaaatattatttctactgtacacctgataaatatcttattacttgtttattcatttattaatttgcttattatttgcttttcctgaaagtgggaggtgaatttgttcagtgctgttttcccagtgtttgacatgatagttactcagaaaaaatgaatgaaaggaacttaggttggtaggaaggaaaggaacaagtaagttggaaggaagaagggaggaacacaggttaataggaaagagggaa

SEQ ID NO: 27112 - DNA, 601 bp, Human
ggtgggaaggaggatcaatgggtgggtgacggttggtggaaggaaggttctatatgctactaccttactgttactatttaatacagaatttattctaaatactgagcttaaaaatctgtcacttcctttataataatatattattgtattttgttgtagctgatgaagttacttggatggacccattgtgcatcttttactgaaaactggctccccatcatgtatcctcccgattattgcgtattctaaaataggaaacaagactttaaattttaaaaaaggaagttttatagtgaatggrtataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaa

SEQ ID NO: 27113 - DNA, 601 bp, Human
tagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaattttttttttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatca

SEQ ID NO: 27114 - DNA, 601 bp, Human
aaactgttctacttggtaacttccttttgaaaaatcagcattttaaaaaatgtagcccttttctcccatggcttcctatgtaaagtgaatcaccagggcgtcctgaagctctgctggttgctgtgagccactgtgcagacctgaccataaagtgaatgctcccagaatctcctgagtcctctcaagaaagggacttccactctaatgcagtcacttgtgtttccctgcagctcttcaagtccaaaatgtacagcgtgtcaagagagcatcgttaaagataaggtattctggggtttttttwaatcattttgtcacatgttttcagctgggtaatacttttcacatagtttgcattcggcactctggcacaacacattctctcagttttggcagctgatgcggcaggctcccaggcaggacactgtgccatgtgatcacctgggcagacagtggattcagatccacttggccacttccctactgtgtgaactctgtgagctacttcaccccctcacctgtaataatcatatcacctgctaagaccgcagggagctggtgtgaggagtaaggggttgatgtgagcaaagtgctgagatgcctg

SEQ ID NO: 27115 - DNA, 601 bp, Human
aatgtacagcgtgtcaagagagcatcgttaaagataaggtattctggggttttttttaatcattttgtcacatgttttcagctgggtaatacttttcacatagtttgcattcggcactctggcacaacacattctctcagttttggcagctgatgcggcaggctcccaggcaggacactgtgccatgtgatcacctgggcagacagtggattcagatccacttggccacttccctactgtgtgaactctgtgagctacttcaccccctcacctgtaataatcatatcacctgctaagaccrcagggagctggtgtgaggagtaaggggttgatgtgagcaaagtgctgagatgcctgtctgtggcagggctgtctgtggttgggtcacttccgtcattgcaggtctttatcccagacagcttctactcaactcttacactaggttttaccttcagactcgctaggctgaggggttcatttgagtttgtgctccctgccccccaggccccctgtgatatctttaagtcattagacatgagtgagattagccccttctcgccccctgtggctgtcctcagctagagcccgtgggcgtctctgc

SEQ ID NO: 27116 - DNA, 601 bp, Human
ttgagtttgtgctccctgccccccaggccccctgtgatatctttaagtcattagacatgagtgagattagccccttctcgccccctgtggctgtcctcagctagagcccgtgggcgtctctgcacattcagaggatggggctgcccagcctgccaccagcttctctcctggggcctggtccttctcatggagactgacagtcatccatgtgctgctgtaccctgccaggtatacttggagtttgaaacaattcttttcttttctttctctctcctttctttcttctttttcttttttttttgcgacagagttcactcttgttgcacaggctggagcacaatggcacgatcttggctcgctgcagcctccacctcccaggttcaagcaattctcatgccgcagcctcccgagtagctgggattacaggcacgagccaccacgcccagctaatttttgtatttttagtagagacggggtttcaccgtgttggttaggccagtctcgaactcctgacctcaggtgatccacctgcctcggcctcccaaagtgctgggattacaggcatgagccaccgcacccagcaattcattcttaaagtgct

SEQ ID NO: 27117 - DNA, 601 bp, Human
gttaatttttttgtatttctagtagagatggggtttcaccgtgttggccaggctggtctcaaactcctgacctcaggtgatccacccacctcggcctcccaaagtgctgggattacagaggtgagtcactgttcccagtcaaccctgtctcttaaaaaaagagtgagaatgagaatacttgtgttttctaagggaaaaataaaattaaaagttgaaaggttttttcttcttcttttttttttttttaaagaaatgggggtctcccactgtcgcccagtctggagtgcagcagtgcgatcayggctcactgcatcctctacctgccaggctaaagcagtcctcttgcctcagcctcctgagtagctgagactgcaggcgcatatgctgccttgcccagctaattttttaaaaaaatttttgtagagatagggtctcattgtgttgcctaggctggtctcaaactcctggactcaagcaatcctcctgcctcggtttcccaaagtgctgggattttaggcttcagctaccacgcccagcctcgttttcattttcaaagggaaatcttttcattattagactaacttcagactgcaatatatgt

SEQ ID NO: 27118 - DNA, 601 bp, Human
ccaaagtgctgggattacagaggtgagtcactgttcccagtcaaccctgtctcttaaaaaaagagtgagaatgagaatacttgtgttttctaagggaaaaataaaattaaaagttgaaaggttttttcttcttcttttttttttttttaaagaaatgggggtctcccactgtcgcccagtctggagtgcagcagtgcgatcatggctcactgcatcctctacctgccaggctaaagcagtcctcttgcctcagcctcctgagtagctgagactgcaggcgcatatgctgccttgcccagcwaattttttaaaaaaatttttgtagagatagggtctcattgtgttgcctaggctggtctcaaactcctggactcaagcaatcctcctgcctcggtttcccaaagtgctgggattttaggcttcagctaccacgcccagcctcgttttcattttcaaagggaaatcttttcattattagactaacttcagactgcaatatatgtttaaagagagtgtttttcaaccacaggctaatgctgctttttttggtgaaaaatgagttttaacagcatgacctttagaaggaaccaacagttttaca

SEQ ID NO: 27119 - DNA, 601 bp, Human
taacagttaatgttatttaaattgtgtctcttagtgggggcagcttcttcattctacttctagaaatcaagatggtccttaatgctttctgaagttcacttaagagttcctctcttgttttttttttttaagtggttttgccttgtccaaagtagcagcatgtggagattaagaaatattaatcctccaaaataatgatctttcattttcaggtgtttaaggataattgctgcaagagagaaattctggctcttcagatctattgtcggaatgaaagcagaggttgtgcagagcagttaaygctgggacatctgctggtgagtagcaaagggacactggaaccttttacatgaaggaattcgagtcccttacatccagctgatgaagtggtcagtaggatgtggcactttaagaccatgttgacattagtttttcaaaacacagccaaataggaaagcagtcagaaccacttgagtataagttgttatttttatgacatcattggcagaattgtcaactggtttttaaacactcccccccctacttagaatagagaaaatctgaattggattttaattttggaaggcccattaaaaccttt

SEQ ID NO: 27120 - DNA, 601 bp, Human
catagataatctgttccacaggccttctgctcagctcataggtaatcccttccacaggccctccctcaactcatagataatccattccacaggccttccgctcagctcatagataatccattccacaggccttccgctcagctcataggtaatcccttccgcaggccctccctcaactcatagataatccgttccacaggccttccgctgagttcataaataatccattccacaggccttctgctcaattaatatatacttcttccactgtacagcttcttaaagactattctaataggamtaaagagaaaagataggaataaatagcactttttatctgactttatttcagaattaagctttgttttgcctattttgatttatgtagttaacattttccattgccttgattgactatcatttagtatgtcaaaaaatgaatagttattcaaaaaaggtaaaatttttatcttgtcctagggaattgcctcaaaatgttgatagattgcctggtcttattacagctctgtgacataaccatcacttacaacaggctaatttgtcctacagcattgaaatgcagctgtttatcttggagaga

SEQ ID NO: 27121 - DNA, 601 bp, Human
ggcagcccagaactgggagggtgagaggggccccggggcaaggcctggtgttgctggggtgggggaaggttgtactggggtgtgcctgagggtggagcggtaggattggccagcaggtggggtatgaggtaaaggtgactcccagtgcttgtggagaacctaggtgtcctgccgagggggtgcccagtgagtggagggtgatgggcttgggggagaatggggagtggagccatgcaggctgcagatgggggtgagtttggtggctcgcaggatcatggggctggagcgagtggagaggagracagagctcgtgggggcctgggcacaccctcagaggctgcctagaggctggggtgggcttggccatgaagtgactgaagggaggcaccagggcagctcagccagggcgtgggccatcatccagttcctggtagatattgtggaatggtttgttttgtttgagagagagtctcactctgtcatccaggcctggaatgcggtgacacaatctcagctcactgcagcctctttctcccaggttcaagtgatcctcccacctcaggaaccataggtgcatgctaccatgcctggctaatttttg

SEQ ID NO: 27122 - DNA, 601 bp, Human
cctccaggctgtgcataatggctcatgcctataatcccagaactctggaaggccaaagcaggaggattgcttgaggccaggagttcaaaaccagcctgggcaacaaagtgagaccccatctctagaacgaaaataataatttctccagttgttaaatttcagtgaatgagacacatgcctaattaacaagacttcaggctttacatatgttaatatgttgccatctcatgccagtcagaatggcgattattaaaaagtcaaaaaacaacagatgctggcaaggttgcagagaaaaaggaaygcttttacactgttggtgggagtgtaaattagttcaaccattgtggaagacagtgtgacgattcctcaaagatctagaggcagaaataacatttgaccaagcagtcctattactgggtatatacccaaaggaatataaatcattctattataaggatacatgcacatgtatgttcattgaagcagtattgacaatagcaaagacatggaatcaacctaaatgcccatcagtgatagactggataaagaaaatgtggtacatctataccatggaatactgtgtatccataaaaaggaagga

SEQ ID NO: 27123 - DNA, 601 bp, Human
aaggaaggaccagttacaatagcttagccggagtgtcaaggaaggctttagtgaggaggttgcctttcatttgatctgggccttgaatttgtcaactaaagacaagggagaaagagaatagatggaaagcacagaatgataatgagtttggggcctgatttgtgcaaacattccttataaattgcacttcatgcttgagatgaaacaagttgaaaaccgtttgagcagtgttgacagtagagtgcattttaaggtgtgtgtcagcttctctcagggcctgcagacatttcagcaagcacgsgtgtttggggtcctgccagtgcatctgcccctgcctctcagcctgaccaggggagagcagttgctggttggctgcctttgctccaggcctggttctgtgacttgcccttgccctaggccacctctcttttcagtgatgtgatttaattcccatgtattttgttttttttttttttcaatttgaacacccttattctcatcccctgaggccttcgttgagtttatttctaggaagaacagtcctgatgtagggagacctaaagcccaggtcattctaattctcctacactccctgtgttct

SEQ ID NO: 27124 - DNA, 601 bp, Human
gtgatgtgatttaattcccatgtattttgttttttttttttttcaatttgaacacccttattctcatcccctgaggccttcgttgagtttatttctaggaagaacagtcctgatgtagggagacctaaagcccaggtcattctaattctcctacactccctgtgttctgtggtgtgtcacaacatcaagtgttgataaaatgtgctgaggatgcatggaaaccctggaccattgcagttcatataaggatttcttttctacgtttaaactgtggtgtagacagtatgccagctattttcargttttattattactttttaaatttataggttagcataatttaaagtgtcaggaaacaaaccttttagatttaatctagaaattctggaccatcattctttaaacagctctgttaacttgtgaaggtcaggatgataaagatctcaccctatgggaaagcatacgtggtacaagtctgtaggtatgaccgctttggaaatcaactgtcagtatcctactaggttggacattcaggcactcagttaaccagcagttcttctcctggatgtgtaggagaaacacacacgccaggaaatgtggc

SEQ ID NO: 27125 - DNA, 601 bp, Human
tcactatgtagttatgctttttttttctttctttcttttttttcgaggcagtgtctcactctgccgcccaggctggagtgcaatggcacgatcttggctcactgtaaccttcgcctcccaggttcaagcaattttcctgcctcagcctcacgagtagctgggattacgggtgcccgccaccgcacctggctgatttttatattttcagtagcgacggggtttcaccatgttggccaggctggtttcaaactcctgcccccaggtaatccgcctgtctcggcctcccaaagtgctgggcttscgcacccggcctgtgcttttcaactcacacatgtgtgcacatatatgtttgtgtgatcagaattacatttaatttcatagataggactgatttcattaatagacaaatgaaaaaaaatcagcagcagattcagggttttttaaaaaatgaatgtgttattttcctttggcttctgtaacaaagtaacccaaagttggtggcttgcaaaaaacaaatttatcctgtcatagttctgggtctggaaatgcaaaaccaaggccctgctgtctcttgacaactgtagggaaggcttccctgccc

SEQ ID NO: 27126 - DNA, 601 bp, Human
gccaccagcagtccttggccttccttggctcatggctgcaccactccaacctctgccctccatgttcacgtggccgtcttcctagtgcatgtcctcacctcttctaagggtggcagtctttagatttagggtctgcccgacgccagggtgtcttcgtcttaactgacgccatcttcagaaatcttatttccaaataaggtcacattctgaggttccagatagacatgaattttggaggacattattgaactcactgtagtagtcaaaagctgtgaaaatgccttttcacaggaaaagaaayagaaatgattaatagagaaatagaaatgattaatatcaaaaatatgcttaagactgggtgcagtggctcacacctgtaatcccagcactttgggaggccgaggcaggtggatcatttgaggtcaggagttcgagaccagcctggccaacatggtgaaacccctcctctactaaaaatacaaaaaattagctgggcacggtgatgtgttgcctgtagtcccagctcctccggaggctgaggcaggagaattgcttgaacccaggaggcggaggttgctgtgagccaagattgcaccactgc

SEQ ID NO: 27127 - DNA, 601 bp, Human
tttttacctatcagattgccaaagattgtgcgatagaattggtgaggatgtggaaacgtgcatcccctgatactgggagtggagactggtgtgggcttgttgaaagtcgaacacagaaagttactgagtggccttctcttccctggccacagtgctgccctccactcccttctttctcagcctccctgccctgagccccatccctattctgccgcaaaaccactgtgggtgcctgcagagttgggccttagaaacatgccgaggaaagcaagctcctgggggagaggagcaaccacgttcygaggacgagcttccctcgggtgggccgctgccctcctcagccctcagacccgccagtcagactctggctctcagcaaatccctccccagttccttcagcagaacagcaacataactggaggccaaaagaggacctgaaaagatggatgggggaggattgaggcatcctgtggccactgggaaaccgctgccacagtcttctgctcagcagggactgttcagcgtggctccatctctggctcttcctcatcagtctctccccaggggccctgcagttgatgtccttgtggggagtccttgc

SEQ ID NO: 27128 - DNA, 601 bp, Human
ctgggcgacagaatgagactgtctcaaaaaaaaaaaaaaaaaggaatgggctttgttactgctgtgttagatacacagtagttgaacaggtctgcagcacatggttatccagcaggatggttgtggaccgtggtgtcatctggcagcctttcggggcctaatccctgtggggatttggctccttccttcctgttctgtgctcttttccccactgaaagtgaatggtttgcatcattggaaaccccaggacataccagagcagcctgcccacacacagtgcagcagtttctcactctgtcartgcctcatgtgtttaaactatctccagccaagtcacgatggaagccccgagagtgcaggatgcataactgtgcacttccctcttggacgttgccaaaggactgatctctcccggactctgtccatcagagcagagtcctcgccctgttgtcaggccagccagctcggctctgcacgttctcattgtgctcacgagaaggtgtatggtgccctttgctaggtccaaaagcaaaggctggacaaacagcagagatatttatgtttacttaaaatgggaatttatttcttattatagaattat

SEQ ID NO: 27129 - DNA, 601 bp, Human
cgccctgttgtcaggccagccagctcggctctgcacgttctcattgtgctcacgagaaggtgtatggtgccctttgctaggtccaaaagcaaaggctggacaaacagcagagatatttatgtttacttaaaatgggaatttatttcttattatagaattatttagttggaatttcttaggttattttgttcatctgtcttagaaaatagaatgtttgagcgggttcacaaagactgatcctcagctgggcgcggtggctcatgcctgtaatcctagcactttgggaggccgaggcgggcarattgcctgagctcgggagttcgagaccagcctgggcaacacggtgaaaccccgtctctactaaaatacaaaaaattagctaggagtggtggtgtgcgcctgtgatcccagctactcgggaggctgaggcaagagaatggcgtgaacccgggaggcagaggttgcagtgagccaagatcatgccactgcattccagcctgggtgacagagtgagactcgtctccaaaaaaaaagactgatcctcacattcatagtcaaactaaagaaaaactgcaaaatctggacttaaaaacacccattt

SEQ ID NO: 27130 - DNA, 601 bp, Human
acatgtcatctttttgcagggatatgagaataaagagtctgagaattctgtcccgtctttgacagatggaaatgaatgaattgttactttcagagggacacaactaccacgcgatgctgcatatggcccgctccacattcgtgcaggttgatcacttgtaggagttcatggacgtatgaggcaaggaaggaaggaaagcctttgcggagtaaaatcctaggaaagtgaagttatattttgcccatgagacattgcaagttttgtattccttagtaaatacatacttgttttaaaataagayggtgattgcttcaaaagatgtctcttgacttggccaactgtgccgaatatgaaaaggacacccatctttaggctggctaccctttagatggacagcatcgggagtcagctctttatcacatctggttttgtgccgagatgccctcgggccatcacctttgtgaccattggtccccacgcattggtggttttagagcgtacatcgttggagaggcacacatcggatctggcacagagcttagggtcttctggggtggagaccaccaccccaatggatagacagagacactcgttaatagat

SEQ ID NO: 27131 - DNA, 601 bp, Human
ttctgtcccgtctttgacagatggaaatgaatgaattgttactttcagagggacacaactaccacgcgatgctgcatatggcccgctccacattcgtgcaggttgatcacttgtaggagttcatggacgtatgaggcaaggaaggaaggaaagcctttgcggagtaaaatcctaggaaagtgaagttatattttgcccatgagacattgcaagttttgtattccttagtaaatacatacttgttttaaaataagacggtgattgcttcaaaagatgtctcttgacttggccaactgtgccraatatgaaaaggacacccatctttaggctggctaccctttagatggacagcatcgggagtcagctctttatcacatctggttttgtgccgagatgccctcgggccatcacctttgtgaccattggtccccacgcattggtggttttagagcgtacatcgttggagaggcacacatcggatctggcacagagcttagggtcttctggggtggagaccaccaccccaatggatagacagagacactcgttaatagatgggggatcaagatgccctttgtaaaaatcttgtgagaaagaaacc

SEQ ID NO: 27132 - DNA, 601 bp, Human
agacattgcaagttttgtattccttagtaaatacatacttgttttaaaataagacggtgattgcttcaaaagatgtctcttgacttggccaactgtgccgaatatgaaaaggacacccatctttaggctggctaccctttagatggacagcatcgggagtcagctctttatcacatctggttttgtgccgagatgccctcgggccatcacctttgtgaccattggtccccacgcattggtggttttagagcgtacatcgttggagaggcacacatcggatctggcacagagcttagggtcytctggggtggagaccaccaccccaatggatagacagagacactcgttaatagatgggggatcaagatgccctttgtaaaaatcttgtgagaaagaaaccctcgttggagttacccttgaacttttcatctttgagaccaggtgttaatttgtctttgggagctaattatctttcagaaagattttggaaaggtcaaatgtggggttggaaatgctcactcagcaagccctccctttggctgatgtgggttgcaggggctcttctgcgcttccgtggaagggtatcctcaggcatcagctc

SEQ ID NO: 27133 - DNA, 601 bp, Human
tgacttggccaactgtgccgaatatgaaaaggacacccatctttaggctggctaccctttagatggacagcatcgggagtcagctctttatcacatctggttttgtgccgagatgccctcgggccatcacctttgtgaccattggtccccacgcattggtggttttagagcgtacatcgttggagaggcacacatcggatctggcacagagcttagggtcttctggggtggagaccaccaccccaatggatagacagagacactcgttaatagatgggggatcaagatgccctttgtaaamatcttgtgagaaagaaaccctcgttggagttacccttgaacttttcatctttgagaccaggtgttaatttgtctttgggagctaattatctttcagaaagattttggaaaggtcaaatgtggggttggaaatgctcactcagcaagccctccctttggctgatgtgggttgcaggggctcttctgcgcttccgtggaagggtatcctcaggcatcagctctgcctctccgtgttgagggtgagcaggctggccccaagggtgtagcacccatgtaattttttgtattctcgtcacgctct

SEQ ID NO: 27134 - DNA, 601 bp, Human
gagctaattatctttcagaaagattttggaaaggtcaaatgtggggttggaaatgctcactcagcaagccctccctttggctgatgtgggttgcaggggctcttctgcgcttccgtggaagggtatcctcaggcatcagctctgcctctccgtgttgagggtgagcaggctggccccaagggtgtagcacccatgtaattttttgtattctcgtcacgctctcattatgttggcagagctgttcaaactgcagggtgtggcccctgggtggatgtgaaataatttagtaggttgtgaccarcattgtttatatttatggggtacagtgtaatgttttggtatatacacacacacattgcggaataattaaatcgagctaattaacatatccatcacatcactttgtttaaaatctgctcccccagcagtcttgaaacacacgttagtatgaatcacagtcaccatgctgttcagtgggctcaaaaacgtccgcccctctgtctaactgaggctctgtgccctttgcccagcagctccacaagcctacccccactacccacctccaccagcccgggtaaccaccattccctgcttctgtgag

SEQ ID NO: 27135 - DNA, 601 bp, Human
taatgttttggtatatacacacacacattgcggaataattaaatcgagctaattaacatatccatcacatcactttgtttaaaatctgctcccccagcagtcttgaaacacacgttagtatgaatcacagtcaccatgctgttcagtgggctcaaaaacgtccgcccctctgtctaactgaggctctgtgccctttgcccagcagctccacaagcctacccccactacccacctccaccagcccgggtaaccaccattccctgcttctgtgagcttgacttttttagatcccacgtctaartgagagtgcatcgtgtttgcctttctgtgcctggcttatttcagttagcataacatcctccagggactagtattttcttaaatgaaatggaataaaaaaaatcagggtgcattgtaaattattagggcaagtacagctttatgacatctgttttcagggatacacacacacgttggtataagtggggtgatacataagcatctgtttcttactatgttacctggtcaacaattgaaaaatactctgataaaagatttgctagtttttagcaaaaacttgaaaaagcatctgatttattct

SEQ ID NO: 27136 - DNA, 601 bp, Human
gcctgaacttagacggtgtgtccctagattatctggaagagaaactacttctaatagcacagagtcatggcatctttgagaatgccttttctccaatttttgacattggagatgagtcatagtgacttgaattgcgtagggatttattaaattaatttcatttttattatattttgtagttatccagagagagaaggagaaaacacaatgaaacattagattgtattagaaaaggcacaagtcattagcattaaatcaagccaaataaagtacaatgtttcttaaaacaccaagcctccckctggaagcccctagcattttgctgagggcccagtgatgtgtcagtcatcagactggccaaggcgactggtcaggccactgctgcggggccctggccatcctgtggcccgcctgcacctgcgctccctggcaagcagctctggctgttcatgagattattgctgtgttttgacctggggctcagagaggcactggaaaggccggggaaatcacctcttaaaatagccacaacagaaggaagaatgcacaagtactggattcatttacaacaaaaagttagaatatacacagtgatgtacca

SEQ ID NO: 27137 - DNA, 601 bp, Human
agatagcgccgctgcagtcaggcgtgggagaaagagcaagactccgtctcggaaaaaaaaaaaaaaaaaaaaaaagacagcctaggccggtaggccggacacggtggctcacacccatattcccagcactttggaaggccgaggcgggtggatcacgaggtcaggagttcaagaccagcctggccaagatggcgaaaccccgtctctactaaaaatagaaaaattagctgggcgcagtggcaggcatctgtaatcccagctactcgggaggctgaggcagaagaatcacttgaacccaggyggcagaggttgcagtgagcaaagattgcgccattgcactcgagactgggtgacagagcaagactgtctcaaagaaaaaaaagaagatagcataggtgcgagcatgacccaggcttctggtgtcagtggactagatgaactggtggttcttacagtcagggggtccacagggcacacgtagaggagcacgcactgggacagaaggcagggacgtccatccacgcggccttcactcaggctgccggcaccaccgggcttctcacagcgccgggcttgtgtgccagggtcgcagtggcctgag

SEQ ID NO: 27138 - DNA, 601 bp, Human
aaaaaaaaaaaaagacagcctaggccggtaggccggacacggtggctcacacccatattcccagcactttggaaggccgaggcgggtggatcacgaggtcaggagttcaagaccagcctggccaagatggcgaaaccccgtctctactaaaaatagaaaaattagctgggcgcagtggcaggcatctgtaatcccagctactcgggaggctgaggcagaagaatcacttgaacccaggcggcagaggttgcagtgagcaaagattgcgccattgcactcgagactgggtgacagagcaagrctgtctcaaagaaaaaaaagaagatagcataggtgcgagcatgacccaggcttctggtgtcagtggactagatgaactggtggttcttacagtcagggggtccacagggcacacgtagaggagcacgcactgggacagaaggcagggacgtccatccacgcggccttcactcaggctgccggcaccaccgggcttctcacagcgccgggcttgtgtgccagggtcgcagtggcctgagagtgaggcatcacagcaggtgacacggttgcagccctggcatgcaagtgtataaggctcacg

SEQ ID NO: 27139 - DNA, 601 bp, Human
ttgatacagatgaagtgcctgttttaaaaatagcccgagttcccttgctgctcatggagacgccttttatttagtcgtgctggtctgtgcatgcggtgcacgcatgttgtgtgttcctgactcgggggcccctgctgtgtgggggagtccttgctggagactccccgttctgtgcttgaggtcaggcgtgcccttgcgtagcacaatcgcggggaggggtggctcggtgccatccccctcttaacctcgggggcctgaggctcagcgtgaggcgcagcttgtcttgggccaccctgcctgrgactcatgcttcatttcggggtttgctaagttacaaagggcgtctctcagacctctgttgatcaggttttcattaactttcccctgccactcgcgagcacccctgccagctcagtgtgcgtgttagaaggtggagatgcgagaggcttccggtgctcactagaggagccgtgtatttggatgttcagtgtcgtcagtggtattgtcccccagcaaatagacttggtgagctaattaaatatccttctgaacatgtatgattgtgtaaaataaagggacagtgacagtgtcagtttaaagg

SEQ ID NO: 27140 - DNA, 601 bp, Human
cccttgctgctcatggagacgccttttatttagtcgtgctggtctgtgcatgcggtgcacgcatgttgtgtgttcctgactcgggggcccctgctgtgtgggggagtccttgctggagactccccgttctgtgcttgaggtcaggcgtgcccttgcgtagcacaatcgcggggaggggtggctcggtgccatccccctcttaacctcgggggcctgaggctcagcgtgaggcgcagcttgtcttgggccaccctgcctgggactcatgcttcatttcggggtttgctaagttacaaagggygtctctcagacctctgttgatcaggttttcattaactttcccctgccactcgcgagcacccctgccagctcagtgtgcgtgttagaaggtggagatgcgagaggcttccggtgctcactagaggagccgtgtatttggatgttcagtgtcgtcagtggtattgtcccccagcaaatagacttggtgagctaattaaatatccttctgaacatgtatgattgtgtaaaataaagggacagtgacagtgtcagtttaaagggacagtgacagtggaaagaggtgttctttagagaaattatc

SEQ ID NO: 27141 - DNA, 601 bp, Human
attacttaagctcaggagtttgatgccagcctgagcaacagagcaagaccttgcctctttaaaaattaaaaaatgaggccgggtgcagtggctcacgcctgtaatcccagcactttgggaggctgaggtgggcagatcacgaggtcaggagattgagatcatcctggctaacacggtgaaaccccatctctagtaaaaatacaaaaagttagccgggcatggtggcgggcgcctgtagtcccagctactcgggaggctgaggcaggagaatggtgtgaacccgggaggcggagcttgcagygagccgagattgtgccactgcactccagcctgggcgacagagcgagactccatctcaaaaaaaaaaaaaaaaaaagagccaggcacggtggctcacgcctgtaatcccagcactttgggagatcgaggcaggtggatcacctgaggtcagaagttcgagaccagcctggccaacatggcgaaaccctgtccctactaaaaatacaaaaattagccaggcgtggtggcaggcacctctaatcccagctgctcaggaggctgagacaggagaatcgcttgaacctgggaggcagaggttgca

SEQ ID NO: 27142 - DNA, 601 bp, Human
cttattttcaggagttttgactacatagaatgtataaagaatgatgagagaaattaaggcaaagaagtttttattcttaagttatgatttttatatagccagttcctggaaagccccattatatagaaagactaaccagtgggaaatcttcctgtttccccttcctttcagtttgggaaaaaactgaataaaaacattattttctgaagcccaacctcaagactatgactcataattatttatttctgacttcattcttaagttatgattaagcttagacataaagttaatgtaattgatwtttttttttttttttttttggagacccaggctggagggcagtggcaccattttggctcactgcaacctcccctcctgggttcaagcaattctccctgcctcagcctcctgagtagctgggattacaggcacctgccaccatgcctgactaatttttgtattttttagtagagacagggttttgccatgttggccaggctggtcttgaactcctgacctcaggtgatcacccgccttggcctcccaaagtgctggcattacaggcctgagccaccgcacccagccgtaattgatatttttt

SEQ ID NO: 27143 - DNA, 601 bp, Human
tagttgctacacaggtaagatcctttgtagtaggtacaaactttatagtgaagtttccatcttgtgttttgtctgtcacaggttggttttcattgatctggttataaatagccccttctatagtaatagtgatttctatttaaaaataaagtatcagatactatatttcctgattcctcttatttataattcattgtgaaactcaaaagtggagaggtacatgatatgataactaagttgaatctgacttttctggcatcatccctttctattaagagatatgcccatttctactccccaygcatacatatacatatgatccaggaacttgaatcaggaaaatatgcattttaaatttcatttttgagataattaactaaacagtgatattcatatgtagataataataatatctaattgatagtatgggatgttgataaatggtatttattaggtattacttctaagactattttcattgttaacatagatgtttaaataaaacttgcttatcaaatttatattattacaaaaatagggcctgaaatatataatgatagaaggccagatacaggacctttggtgctaagggcagaatttt

SEQ ID NO: 27144 - DNA, 601 bp, Human
taaaaataatgaggccaggcacggtggctcacacctgtaatcccaacactttgggaagctgaggtgggcagatcacttgaggccaggaatctgagaccattttggacaacatagtgaaacccgatctctactaaaaatacaaaaaattagctgggcatggtggtgggcatctgtaatcccagctacttgggaggctaaggcaggagaatcacttgaacttgggaggcggaggtttgtagtaagctgagatcacaccactgcattccagcctgggagatagagactgtcttaaaaagaaagaaaaaaaaaaaaaaagtctccctactatacccttagatatatgcccttccatagataaacatggttaacaatttcttatgtaaacttccagaaacttcctatgcatattaaagcatatctatattaaaatatgtatcttgtctatcctttaacaaaatagaaatgggggccgttctacatatacatactgttttataccctgctttttggatttactgtcttacagccatctttgtatgctagcacatgtagatgttcttcattctttttaaaaacaatgttgagtaatgttacagctctt

SEQ ID NO: 27145 - DNA, 601 bp, Human
gcctcataatgattttatgtttgtaaaatttaagaagccatgtaaatataagcatttatttctctttaagtttgagcagggtattttccttttatcccttgcaaattaggccttttcttaaatctccatatctctgcctctatctccataacaacaatgtcctctgaaaccctgatccaggttctaggaacgtgccatctaacactgatagtgttggtatgattagaatgactttttgttaggcagctggattttcgatgtttttaaaatgatctgtctcaaccagatgcaatagaagggrtggcctgtggattatgtgtttgtcttcttccttttgttgctgggtcatttatatttaatattttgtttttctgataatcttaatgaacacctgtgtaatatattccacagatttcaatgggacagatgttacaagattttggaaaatttcttgggatgtttcttcttgttttgttttctttcacaattggactgacacaactgtatgataaaggatatacttcaaaggagcagaaggactgtgtaggcatcttctgtgaacagcaaagcaatgataccttccattcgtgagtatctttta

SEQ ID NO: 27146 - DNA, 601 bp, Human
taaagctggtaaaggagcaagccacgaagaacatttctgggggaagagcatttacagagagagagaacggcaaaggcaagtgtccagaggtaggagcatgactggtatgttcaagaaaaagccaggcagccagtgtggatggaatgtgttgaatcagagggggagttgtaggaaatgaagtcagaaaggtaatggggatcatgtaggacttttttgcccttgtaaggattttgagttattgagattgagagttatttgaaggttttgagcagaggtgtgacaaaatccaattagatattarcaaatcatataggctgccttgttgagaacagacagaaatgaagtcagaagggtaatggggatcatgtaggacttttttgcccttgtaaggattttgagttgttgagattgagagtcatttgaaggttttgagcagaggtgtgacaaaatctaattagatgttaacaaatcatataggctgccttgttgagaacagaaagaaaggcagcaaggggttaaacagttacaaataatttatcttccttagggtctctttgtttaaatttaaagtaaggcatatcagtactgtggaagtcaacat

SEQ ID NO: 27147 - DNA, 601 bp, Human
gttaagaggatattaggtatataattctcttcttaaccgaatgtcagatggtcttacgccacagggtgcaggtaacccttggtctgtaagcaccaccgatccagggatcattgtctaaataggttactattgtttgtttcatcttgcttttgcatttttattttttaatttccaaattttaagtgttccctctttggggcaaattcttataaaaatgtttattgtaaagttatatattttgtctacgatgggattatgcacttcccaattgggattttacatctggatttttagtcattcyaaaaaacacctaattattaaaacatttatagagtgcctactgtatgcatgagttgagttgcttctgaggtacattttgaatgacagcatattgtaagaaaaaaaaaggtgaataaaatttgacattagattataaatggagtctgttcattgtattaccaattttaaaaagttgagatatacagtagtccccctttatctatctgcagtttcactttccatggtttcagttacccacagtcaatcataatctaaaaatattgaatgaaaaattccagaaataattcttgaagtttttttt

SEQ ID NO: 27148 - DNA, 601 bp, Human
ggagaccgaggttgcagtgagccgagactgcgtcactgaactccagcctgagcgacaaagtgggactccgtctcaaaaaacaagaagaaaaagaaacttcctttgtggacagtgagggctatttaaaaaaattttggaatatgaaagtagtcactggtgtctggaagcaggagctgtgcagaattgtacagttgcgaaaccatgtcgctggcagctggtgctggcggtggagacttccctgtgcggtgctcagtgcagctgcacccgtgggggagggagctctttctctggccctgcagtsacctgaggttgttaccattatgaacggccgctgggacccccgcatgtgcatgtactcccccagagtgtccgggggccccagccaagggacacagctcaggcagctgggaacatgtgcaggctgatgaagagaaccggatgagggcttcacatgaggaagcatgtggccaggtcctctcagaacatcagcctcatcttcctgtctctgatctatttcagcaaccaccccatgtgtctctagaaccccagtgtagcgagctggagagaggactgtcctgagggcagcaggcctggttgcagc

SEQ ID NO: 27149 - DNA, 601 bp, Human
tgtgcagaattgtacagttgcgaaaccatgtcgctggcagctggtgctggcggtggagacttccctgtgcggtgctcagtgcagctgcacccgtgggggagggagctctttctctggccctgcagtcacctgaggttgttaccattatgaacggccgctgggacccccgcatgtgcatgtactcccccagagtgtccgggggccccagccaagggacacagctcaggcagctgggaacatgtgcaggctgatgaagagaaccggatgagggcttcacatgaggaagcatgtggccaggtcytctcagaacatcagcctcatcttcctgtctctgatctatttcagcaaccaccccatgtgtctctagaaccccagtgtagcgagctggagagaggactgtcctgagggcagcaggcctggttgcagctggcgtgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaac

SEQ ID NO: 27150 - DNA, 601 bp, Human
ttaccattatgaacggccgctgggacccccgcatgtgcatgtactcccccagagtgtccgggggccccagccaagggacacagctcaggcagctgggaacatgtgcaggctgatgaagagaaccggatgagggcttcacatgaggaagcatgtggccaggtcctctcagaacatcagcctcatcttcctgtctctgatctatttcagcaaccaccccatgtgtctctagaaccccagtgtagcgagctggagagaggactgtcctgagggcagcaggcctggttgcagctggcgtgggggwctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaaggtaggctttctgctggtcagcctgcagttggcacgtggccacggaggtcaccgttgggcaggtcatagcttgaggctgtgacgacgggggtgggaaagggtctgctgaccttgggggctcctgcccaac

SEQ ID NO: 27151 - DNA, 601 bp, Human
gacctctgacttcttccttccgatcccacatggagtagctgatcaggccaagacccctcagggcctcagtgaagggtcactggagatacctctgtctccatacgaggcttagagtccacagagcatttccacctaacccttgcaagcctcctgtcggggacagttgaccctcatcctgcctcgcaggtgcagggaccaaagtgcagagtttaggtgacttgttcagggtcataagggcactgtcgcgcggcgaggcccagtggtgtgaacacagatgcatcctctaatcctctcatttccrcacctgcccccaccccaagagagagagtcccagggtccaggaactggaagggccttagggagagtccatggccagaagactgcccccctgcacagcttgccaaagccagaggcccgacttgcccccaggccccacagagccccctttgcccctcctccccacagagcccacgactcaggtgtggccaagacccccgcccaggcaacatggccactgtctctgagtggctggatatggccctccggagccgatggtgctccccgcagttggcgcccctttaggcacggacagagtgttgat

SEQ ID NO: 27152 - DNA, 601 bp, Human
catgtgcttaacaagggtggattattcatgagttttatgggaaaggagcggggatttcccagaactgatttcctctttctttcagaccatacagggtatttctgatgttgccatggcatctgccaactgtcatggtgctggtgggagtgtctcttacatgttaatatgttataattagcgtgtaatgggcagcgaggataaccagagcccactttcgtcgccatcttggttttggtgggttttacccagtgtcttgcaccctgttttatcagcagggtctttgtgacctgtgtcttctgcygacctcttgtctcatcctgtgacttagaatgccttaaccgtctgggaaggcagcccagcaggtttcagcctcatttcacccagcgcctattcaagatgggactcactctggtttgaacgccgctgacaccctgacctgctgtgtcctgagaagcctaggtgaggccccgtgggtctggggcctctgccagtcggctctgcgtgcttctcacatggaagtggaaacccttggggcagcagggcccagagaggaaggggtgctgacctggatcagatgtaagcaggacagacttgcttctgg

SEQ ID NO: 27153 - DNA, 601 bp, Human
cagcgaggataaccagagcccactttcgtcgccatcttggttttggtgggttttacccagtgtcttgcaccctgttttatcagcagggtctttgtgacctgtgtcttctgctgacctcttgtctcatcctgtgacttagaatgccttaaccgtctgggaaggcagcccagcaggtttcagcctcatttcacccagcgcctattcaagatgggactcactctggtttgaacgccgctgacaccctgacctgctgtgtcctgagaagcctaggtgaggccccgtgggtctggggcctctgccrgtcggctctgcgtgcttctcacatggaagtggaaacccttggggcagcagggcccagagaggaaggggtgctgacctggatcagatgtaagcaggacagacttgcttctggaggtccccaaagccatcccccatgctcaggggtttgctaggactcacagctgtgcacacagctaaggtttatcatggtgaaggcctacgtgatgggcttggcaagggagaaagacacaggccgagtctggagaatctgagggcaggctgctgcggctctcctgtgcaggcgccatgcatgctccttcct

SEQ ID NO: 27154 - DNA, 601 bp, Human
gggtctttgtgacctgtgtcttctgctgacctcttgtctcatcctgtgacttagaatgccttaaccgtctgggaaggcagcccagcaggtttcagcctcatttcacccagcgcctattcaagatgggactcactctggtttgaacgccgctgacaccctgacctgctgtgtcctgagaagcctaggtgaggccccgtgggtctggggcctctgccagtcggctctgcgtgcttctcacatggaagtggaaacccttggggcagcagggcccagagaggaaggggtgctgacctggatcagmtgtaagcaggacagacttgcttctggaggtccccaaagccatcccccatgctcaggggtttgctaggactcacagctgtgcacacagctaaggtttatcatggtgaaggcctacgtgatgggcttggcaagggagaaagacacaggccgagtctggagaatctgagggcaggctgctgcggctctcctgtgcaggcgccatgcatgctccttcctctagccgagaagcacgtggccacctgcaaagcccattcgaggctcagagcccagggcgtgcatcctgcgctggccacgtgggccc

SEQ ID NO: 27155 - DNA, 601 bp, Human
tcctgtgacttagaatgccttaaccgtctgggaaggcagcccagcaggtttcagcctcatttcacccagcgcctattcaagatgggactcactctggtttgaacgccgctgacaccctgacctgctgtgtcctgagaagcctaggtgaggccccgtgggtctggggcctctgccagtcggctctgcgtgcttctcacatggaagtggaaacccttggggcagcagggcccagagaggaaggggtgctgacctggatcagatgtaagcaggacagacttgcttctggaggtccccaaagccwtcccccatgctcaggggtttgctaggactcacagctgtgcacacagctaaggtttatcatggtgaaggcctacgtgatgggcttggcaagggagaaagacacaggccgagtctggagaatctgagggcaggctgctgcggctctcctgtgcaggcgccatgcatgctccttcctctagccgagaagcacgtggccacctgcaaagcccattcgaggctcagagcccagggcgtgcatcctgcgctggccacgtgggcccctctgcatggcaaccacccaaatcccagactcccagcagga

SEQ ID NO: 27156 - DNA, 601 bp, Human
tcggctctgcgtgcttctcacatggaagtggaaacccttggggcagcagggcccagagaggaaggggtgctgacctggatcagatgtaagcaggacagacttgcttctggaggtccccaaagccatcccccatgctcaggggtttgctaggactcacagctgtgcacacagctaaggtttatcatggtgaaggcctacgtgatgggcttggcaagggagaaagacacaggccgagtctggagaatctgagggcaggctgctgcggctctcctgtgcaggcgccatgcatgctccttcctcyagccgagaagcacgtggccacctgcaaagcccattcgaggctcagagcccagggcgtgcatcctgcgctggccacgtgggcccctctgcatggcaaccacccaaatcccagactcccagcaggaaagcagctgttcagcacaaacccattgcaggaacagtccaggcccggcaaagcactcctagcagtcaggggacggagagacgctccaaaagccccgttcccagacaccaccttgaaagcaggcccctctgagaaggcaacctgagatctgctgcaccgagtctgtcccgcacagaa

SEQ ID NO: 27157 - DNA, 601 bp, Human
acaaattccctagccttccttcaattaagaaggtccaaacttcctgtcttttctgaggtgttttttttgttttttttgaggagtctcccactgtctcccaggctggagtgcagtggcaccatctgggctcactgcaacttccatctcctgggttcaagcgagtctcctgcctcagcgtcccgagtggctggggttacaggctgctgccaccatgcccagctgattttttagattttagtagagacagggtttcaccatgttggccatgttggtctcgaactcctgaccttgtgatccaccygcctcagcttcccaaagggctgggattataggcgtgagccactgcgcctcgccgcttttaaaagtttttatttgtttttagtttttggaagtttaactgttgtgtgtcttggcatgtatctctttggatttatcctgtctggtgttcactcagattgtagcgtgtgtaggtttatgtcttttttgtcaaatatgggaaattttggccatgacttctttacatacattttcaggatcactgtctttttcttttccttctggaactctgagcatgaatgtatgatcttttgttatagtgctg

SEQ ID NO: 27158 - DNA, 601 bp, Human
gggtgactggtgctgtgtctttgcaggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaaggttggtttccatcactctcgctctgaactgtaggtggagctgcatggccccacagtgacacgcggtggtcggcatttcctggggcaagagcaggaggctggcaaarctccagggtgcatagagcccactgcacagcaagggaagcggcggggaggggctctgcaaggcaagcaagacatgcaccccactctcagagtgcttggccatctgcaaagcagggtggggcacagtgagctttctaggaaggtgcaagctgggagtggtgagtgaattctggctgggtgtccttgggcggcatttgtcagggcctgggagggagtagggaggaaggagagggatgcaggacacagatgcgctcagggtgtgctgggagaatggtaggaagggtgtggggagggagggaaaa

SEQ ID NO: 27159 - DNA, 601 bp, Human
gaggcccatgtggcaagtctggaagcaaacgcgagagtccttgcgaggagtctgggccaggcatggcgggatccaggctgagcctggcctgcaggagagcgctgtgagggtgcagactgctggagggaggcccaggtgcagggttaggttctctcgtgcacaacctcactgaggtccctggaccagccatctctgaccaattctcaggccccatcccaggcctgtggagtcagaggctcagccccttgcatgttgaccagccttctggagggttctgagactcgcgtgttgaccagccttytggagggttctgagactcgcgtgttgaccagccttctggagggttctgagactcgcgtgttgaccagccttctggagggttctgagacttgtgtgttgaccagccttctggaggttctgagacttgcgtgttgaccagccttctggagggttctgagacttgcatgttgaccagccttctggagggttctgagacttgagtgttgaccagccttctggagggttctgagacagtgattgggtgccactgtcctggaggtggggagggtggcactgatctctgtgctggcgtctggagccc

SEQ ID NO: 27160 - DNA, 601 bp, Human
ctctgtgctggcgtctggagccctgaacttggtacctgtcgagtgtgacctgtccactcaatgcatggtgttgccatgaggtggccaaagaggttgagtggggcaggtcccggagacggggtcatgtggccccaggcttcctggctggcacagcccctgagccaccctgtgtcaccatgacacgtgggtgttctccaggcccctggacccctctgtcgctgtggtcacggggacagtcctgttgttgggtttcagatgagggattgaggtatggggaggccctacctaccctttgtctgaygccaccgtggccgtggcagtggtgggtttgaatccagctgtgtctgagcctggggtctggctgcatccctcccccaaccccccggcttctcccagccccctccctgcagctgccgacaggggccggtggtgtgagggagaaatgcctgtggcctgacagtgagggacgccagggacacagaccctgtactgcagcaggtctgcctcgaagcccgggagcgtccaccatgcaggccacagccctgctcctcccagggagaccagcacctccagatgcctggtggacccggtgggacccacg

SEQ ID NO: 27161 - DNA, 601 bp, Human
tcctggtggatggtgtgagatcccaggtgccgtgacctggtgccccgccccaccctaattccatggggagggggccccaagtcctcaaggctccctgggcctccctggaggggactgtggatgaatagtgaggccctgaggtgactacttggcaatgttgcgtccggatgggcctagagtcaccctgctcttcctggggtctggggtctggtctttgcctcgcagtggagtcgtaactgagcctgacttggcctgcatggctcacagagtcctcagtttcattgtctgcctggtgagcgtsaggcacggctgcatcttttgacctgtgagtcccacagccctgcttgtaaaatgaccagaccttttctcagcctggtcacatgggactgggtttaacgcaggtcaccatcccacaggctctttctgaagctttgctgcctcaaataatgccatggatttgttcaggtctcacctgctccaggtcttgatgttgcatttttttagctttcaatatccgtgtccttgttgtccgcttcctggcccaaagccagtaccaccttttcaattgttatctttctatctatctatctccatccttcca

SEQ ID NO: 27162 - DNA, 601 bp, Human
cagccctgcttgtaaaatgaccagaccttttctcagcctggtcacatgggactgggtttaacgcaggtcaccatcccacaggctctttctgaagctttgctgcctcaaataatgccatggatttgttcaggtctcacctgctccaggtcttgatgttgcatttttttagctttcaatatccgtgtccttgttgtccgcttcctggcccaaagccagtaccaccttttcaattgttatctttctatctatctatctccatccttccatccatccatctatttatttttgagacagggtctcrgtctgttccccaggctggagtgcagtagcacgatctcagctcattgcagcctcgacctcttgggctcaggtgatactcctgcctccgcctcctgagttgctgggactagaggcgtatgccaccatgccaggctaatttttgtagagacaaggtctatgttgtccaggctggtcttgaactcctgggctcaagtaatcttcctgccttggcctcccaaagtgctgggataacaggcgtgagccaccatgcctggctgattggctgttttttttatttttttgttttttttttggagttgga

SEQ ID NO: 27163 - DNA, 601 bp, Human
gaggcggtgcgggacttcagcctgagcagcagctacaaggaaggcgagctcatcaccatcggagtcgccacctggggcactgtccaccgccgcgagggcctgatccatcccacggtgagtgcggccccctagggaggggagcctaagaccaggggtgtgggtgaggtctgactgggcgctgtggggagcaggtggagtgtacgggggccggggtgtgggtgacgtctgaccgggcgctgtggggagcaggcggagtgtgcgggggccggggtgtgggtgacgtctgaccgggtgctgcggsgagcaggtggagtgtgcgggggccggggtgtgggtgagttctgaccgggtgctgcggggagcaggtggagtgtgcgggggaggcggggtgtgggtgacgtctgaccgggtgctgcggggagcaggtggagtgtgcgggggaggcggggtgtgggtgacgtctgaccgggtgctgcggcgagcaggtggagtgtgcgggggccggggtgtgggtgagttctgaccgggtgctgcggggagcaggtggagtgtgcgggggaggcggggtgtgggtgacgtctgaccgggtgctgcggggagc

SEQ ID NO: 27164 - DNA, 601 bp, Human
ctgtggggagcaggtggagtgtacgggggccggggtgtgggtgacgtctgaccgggcgctgtggggagcaggcggagtgtgcgggggccggggtgtgggtgacgtctgaccgggtgctgcggggagcaggtggagtgtgcgggggccggggtgtgggtgagttctgaccgggtgctgcggggagcaggtggagtgtgcgggggaggcggggtgtgggtgacgtctgaccgggtgctgcggggagcaggtggagtgtgcgggggaggcggggtgtgggtgacgtctgaccgggtgctgcggsgagcaggtggagtgtgcgggggccggggtgtgggtgagttctgaccgggtgctgcggggagcaggtggagtgtgcgggggaggcggggtgtgggtgacgtctgaccgggtgctgcggggagcaggtggagtgtgcgggggaggcggggtgtgggtgacgtctgaccgggtgctgcggggagcaggtggagtgtgcgggggccggggtgtgggtgagttctgaccgggtgctgcggggagcaggtggagtgtgcgggggaggcggggtgtgggtgacgtctgaccgggtgctgtgaggagc

SEQ ID NO: 27165 - DNA, 601 bp, Human
tgggtgacagagcaagactctgtctaaactaaaccaaaccaaaccaaacaaaatgatcccctccaactacaaacctgttacagcagaaactccaagatcaaaatctcatgtaaatatcataagcttggccgagtgcggtggctcacacctgtcatcccaacactttgggaggccaaggcaggcatatcacctgaggtcaggagcttgagaccagcctggtcaacatggagaaaccccgtctctacaaaaaattagccgggcatggtggtaggcgactgtaatcccagctactgggaggccraggcaggagaatcgcttgaacctgggaggcggaggttgcagcgagccaaggttgtgccactgcactccagcccaggtgacagagcgagacaccgtctcaagcaaaacaaaacaaacaaacaaaaatatcatcagctcaaaagtcccaaatgtcatcatttaagtcagggacgctgaagactctgggtctgatccattctggggcagaatttctcttcatatgtgcacctgtgagaccagaaaacaagtcacctatctccaaaatacaagggaagagcaggtgtagcatcacagctgcaga

SEQ ID NO: 27166 - DNA, 601 bp, Human
tggagatctctgcggctaaatcttcaagttcatcatttacagttctgctctccacaaaactgcacagcacaattcagccaggctttctgtcactctgcagcaaagttggccttccctccagtctccagtaccacatttcccacttccttctgagccctcaccagaagaagcaactgtgatgttcatttttctgctaaaattctgttcatgccagtatatgtattctctctctctctctttttttttttttgagatggagccttgctcttttgcccaggctggagtgcagtggtgcgatctyggctcactgcaacctccaccttccgggttcaagcaaatctcccaccttagcctcccgagtagctgggattacaggcatgtgccaccatacccagctaatttttgtatttttagtacagacggggtttcaccatgttggccaggctggtctcgaactcctgacctcaactgatctgcccaccttggcctcccaaagtgctgggattccaggcgtgagccaccgtgcctggcccgtatatatattttctaaggcagcggtccccagcctttttggcaccaggaactggtttcgtggaagaga

SEQ ID NO: 27167 - DNA, 601 bp, Human
gcagctagacggtcccatcatctgggggtgatgggggacagtgacagatcattaggcattagattttcgtaaggggagtacaacctaggtccctcgcatgcacagttcacagtaaggttagtattcccatgagaatctaatgccgcggatctgacaggaggtggagctcggacagtcacacacacgatggggagcggctgtaaatagggatgaagcttcgctcgttcacccaccacccacctcctgctgtgagcagcccagatcctcacaggccacagaccattaccagtccatggcccasggggtgggggacccctgctctagggcaacaaagccctctctgccctgctcctcacttccttctgagcccttactgcgagttgttttttttctgagacagggtctcactgttgcccaggctggagtatgttggtgcgatcctcagccttgacctcccgggctcaagtgatcttcccatctcagcctcccaagtagctgggactacaggtgtgcaccaccatgcccggctaattttttcatttttgtagacatgagatccgctatgtcgtccaggctggtctcgaactccagggctcaggtg

SEQ ID NO: 27168 - DNA, 601 bp, Human
ctaatgccgcggatctgacaggaggtggagctcggacagtcacacacacgatggggagcggctgtaaatagggatgaagcttcgctcgttcacccaccacccacctcctgctgtgagcagcccagatcctcacaggccacagaccattaccagtccatggcccagggggtgggggacccctgctctagggcaacaaagccctctctgccctgctcctcacttccttctgagcccttactgcgagttgttttttttctgagacagggtctcactgttgcccaggctggagtatgttggtgcsatcctcagccttgacctcccgggctcaagtgatcttcccatctcagcctcccaagtagctgggactacaggtgtgcaccaccatgcccggctaattttttcatttttgtagacatgagatccgctatgtcgtccaggctggtctcgaactccagggctcaggtgatcctcccgccttggcctcccaaagtgctgggattccaggcgtgagccaccgcgcccgtctccgcaaggcctttaataccacattcccaccaacattctcttcaaggacgttgagacgttttccattcatggtgct

SEQ ID NO: 27169 - DNA, 601 bp, Human
gaaccagaatattcctccttggtcagaaaccctggccagagggcagctggcgacgtgcaggtgggcgcctgcctgtcacctgatgttagaggtatgagctcctttatttgtaactggaatccgagtgcagcctgtgtcatttttacctttgtagtggtcataatttctcataaaacttcagggtggaaagaaagagtgcagaagttgcctctctcaacttcctgcttgctggctgctttagctcctctacctctgatgcaggaaagagtgtagaggtagagcagggcctcaggaatggtgygatggacttgagctgtagtggctctctgtgtaacttctgttgcttagcctggcccattctccaggccacaaacatcactgtcctcttctcatgccacaggagagaaggcttatgcctctttgtcttacccagctggcacctgacactgggaagccttggtcttatatgtgctcctcccgcccgatgctgggcttctcaccctccagggtcggaggccccaggctgattctgaagggctcagcagagtgggcccaggctgggatcagcagggaacttttgtgataaaggccagactttcat

SEQ ID NO: 27170 - DNA, 601 bp, Human
atttgacaccctttcatggtaaaaacattcaacaaattaggaataaaaggaaactaccttgatgtaataaaagccatatatgaaaaactcccagcgaatatcatgttcaatggtgaaagactgggacatagcaaaaacagtgctaatggagaaatttatagctatacatgcttacattaaaaaataagatcttaaaccaacaacctaactttacagcttaagtaattagaaaaataagaacaaatgaaatcttttcctccaagatagaaataagggaaggatgcatactttcaccacttcyattcaacattgcgttggaagttcaagccagagcaattagacaagaaaaagaaataaaacttataaattgggaaggaagaagtagaattatttgttcacagatgatatgattttcgtatttgtccattttcacactgctataaagaaatgcccaagactgggtaatttataaaggaaagaggttaaattgactcacagttcagcatgccttggaaggcctcaggaaacttacaatcatggtggaagatgaaggggaagaaaggcactgtcttcacaaggtgacaggaagaagaggtgccaa

SEQ ID NO: 27171 - DNA, 601 bp, Human
caggcagttgaggcaggaaaggaaatgtgatggcttctgagtcctgagttttggatgttagtgtaagatgcctgccctccagagacctatgtcttcttaaaacagtgaggcccttttcttgcttactgcccacctgtcgcttaggggccagggcatggccaggaggagggcaggggaaacaggagtgagtggacgtgatgaccaaagccccaagattcactgattctgactccgaaatggaacatgcttttgcaaggctgtgtgtatgggaggaggtcactgggtgctgcgcctgtcactytgaattgttgagaggcaagggctcatgacacatccctgactctgacatcatttccctggagggaaatggctttgagctccagatcgaggcccaatatgcacctgttcatctgcagcctcacggagccaagaccactttggccacgagaactgggaccaccagctgaaactggcagtggcatggaatcgcgtggacattgcccgcagtgagatcttcatggatgagtggcagtggaaggtaagtcttccagagcaccccgtggaggggcctactgggcccacatgcattgcaccactgaag

SEQ ID NO: 27172 - DNA, 601 bp, Human
agtctccaaccttattcaagggaaccctgctctaatctccacccttatccaatgggaaccctgctctaatctccacccttattcaataggaaccctgccctagtctccaccctgattcagtgggaaccctgccgtaatctccaccctgattcaatgagaatcctgccctagtctgtttaccctttttcagtgggaaccttgcagtgactcaatgtcaggaatgatgctggattttgtatttgtatttcctcttgggagtatttatctctgattcattaaggttttacaaagcaaagcatcaatgcctttgagaagattgagctccttttcttctttgacctatgaatttggtgaattattttaatagattttctgatagtgaaacatgtttttatccctgttttgaatttcagcttggcctcagtgcaagtttaatatactggattctcttggcaacattttcaggatgtttgcatcagaatgcttaaggctttgattgcagttttatttggggggctatatttgtcaggctctgatatcaattttatgttagttttgtaaaaaccatttgggaagctttctttccttctccgctccagga

SEQ ID NO: 27173 - DNA, 601 bp, Human
gcccacccaaggctgggcttggggcaggctgggcctccctgtttgcagccattaaggtcatggccatgggcagggcgtcagcgggcatccctgtgtcctcactttgctgggctgtggggtccagccccaccccggtggctgtgtgtgaggctcccaggctgtgctgtgccggctccgcctgtagctgccgttatggccccggatccctgagtgcttttgcctctaaaagcacatctctctgaggggcacgggggatcacggggtggccaaagcctgtggaggtcaggaccctggccctggyggtcactgtctcctctctgctgtgacggccgcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcaggtacagccccacctgcttttccacgccccagcccggggccacccacttg

SEQ ID NO: 27174 - DNA, 601 bp, Human
cacatacatgcacatacacatatacacacatgcatacacatacaaatacatgcagacacatacagaatgcacacatacatacacacacacatatgtgcacacatacatattcacacgtatacacacatacatgcagaatatatgtacatacacatatatgcacacacaggtgctgagtgagcagggggccgaggtagctgctgccagcgctattctgcattgttcctccacgtcctgttcccatctccctcactgacccagctctcttcagatcagaaccaatgttcggatttgctgaccrtgatgatagtgatgatagtgatagtgatgatagtgacagtgatgatagtgacggtgatagtgatgatagtgacagtgactgtgattgtgatgatgatagtggatagtgatatgacagcgatggtgacagcaaggatagtgatgatagtgacagtgatagtgatgatagtgacagtgactgtgatgatagtggatagtgatatgacagtgatggtgacagcaagggtagtgatgatagtgacagtgatagtgatgatagtgacagtgactgtgatgatagtggatagtgatatgacagtga

SEQ ID NO: 27175 - DNA, 601 bp, Human
atggcgggcccgtctgaggcagccagccctgcaggggatgagcacaggccgggcccagaaccagccacaccgggtgaggctcagctcgtctgtgaaccctggattgtcatctgtccaatgggtgtccaggcaacagcgccccacctacccttgggattgttgagggagcacagaaggggcatgagagctcctggcagagctgagattgtccatgtgcaaggggccatagatggcaacctctggaattgtcccagctccacggacacgcggctgccgctttctccctctgcctccctactgkgggctcactgcactgcctgtgatgctctcgtgtctctgcgaggccgcggccccctttctcggaggcaatagggccctggctaactgctggctctccaggtgcccccatgccaggctgccctgtggggctgggcgtctgaagaaaagtgggaggctctattcctcaatctcatgccagctttgaacacctgggatgcagggcccaccagagccctttgcctccagggcccacctgggctaggacaggtggaggggcgacgggggacagctctgggggctgctgtgagcaggtggctgagat

SEQ ID NO: 27176 - DNA, 601 bp, Human
agctctaggagctttcctccttggtcacggttatgtctgaccgcactcattcctggcctctgattcagctctaggagctttcctccttgggtcacggttatgtctgacccctcttgcactttgtggtgctagcacaaagatgtcggcagtccacgagggtgtgggggcagccccaggactgctcctgggagcctcctgcatgccgtgtctgtgctgtgagtggcagtgctgtctccaccgctgctgggcctgcctctgggcccagtgagcatcgggggccaggagagtgtagcccacacamtctctgtcctgcagatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtaggagccgggcgccatgggagctcgggtggtgctgccgggaagcaggagagaggctggaaaggggccgcatgagtgggagtgaggccggctccatcagggggtcctgcggtt

SEQ ID NO: 27177 - DNA, 601 bp, Human
accttggttttagcccagtgagactcctgacctccaggactgagagaagagtctgattgctttaagctgccaaggccgtggcggttcactacagcagcatcaggagacccatgcagtagctgtttcttctctttgaaaatgtctaggattttctttaaatcctagtgtcttgaagtcttatcatagaacttttggaatgttatttgctattgttgcttttgaaacaaggagtacaaaataggtggctgtccatccggcccctggtggacgtggtcctctggggtcgtatctctgatcagcygcagcagctgtgggccccaggctttgggggttctgttttgctcttgcagcttttaaacttagaacaaattaaatgctgaggacctcacaccagaggcagcataaaaaagaactccagggaaccaggaggccacgcagaatgaaaacacaggtgtttggggtcctagtgggccccagggttggctctgggggttctgtggccaattcctagccctgacagtggagctgaggagcccagcacggctgcggagctgtcatggtccacagaaagcccagtctccccatgttgcccccataattc

SEQ ID NO: 27178 - DNA, 601 bp, Human
ctttcagaacgtgggttctgaacattgagagaacccgagcatgggccaggactgtcatctcgaggccaaggggctggtggcaggacactgtccctgcagcaagtatggcacccacacttccggctcccactgcggagggctctgtgcctgtcaccctgagacacaccaaggaggcccctgcagccctgccccttccacatgcacccctggagggtctggctcttgtgctcgtcagaatccacagatcaggtcctagagttcagtgccagacagtgtctgtctcctgataaacacccacttygtgttattagccagtgaggcttataatatcgaaagtctgtgtgcttctccttttttcttgctttggttcccaggaagcctggaattgtgaggtctgtgggctgagttctgtgcctggagctggcctcccgtgtggcgtggctctgctctctgtggcatcacagtgggcacgtgggcatggctctgctctctgtggcatcacagtgggcacgtgggcatggctctgctctctggcatcacagtgggcacgtgggcatggctctgctctctgtggcatcacagtgggcacgtgggtgtggct

SEQ ID NO: 27179 - DNA, 601 bp, Human
gcggccctgctatcctgggagatctacctgaaggagaactacctccagaaccgacagttccagcaaaagcagcggcccgagcagaagatcgaggacatcagcaataagtatgggggctccggtgggcctgggggcgggaagcctctgggggacctcctgcaggtccacaggcaccatgagtacatgtcccacctggggaggcccagcaatgcctcaccggtgagggagcgctgtatcccgtggcccctgcaatgctgcaggcatccgggcctgtgcccacagctgacccaggaccctctgyggtccttaggaaggctgggccccacagggcgcagggtcagaggctgggagggaagccttggcggctgggggaggggcaggttggcccgcaggatccggcttggaggcctgggggcatgtgcacacggggtccaggctggtttgggggtggtttgctctgtgagcttgttggtgcacagccttattatagcttctgcaggacctcggcagcccagccctcggggtcagccatgctcagcaccgtcctccctctcagctcctcccatcttgcttctttccaaggtgcgaggtcagtgttggg

SEQ ID NO: 27180 - DNA, 601 bp, Human
ctggatgttggttggttggctggtgggtttgtgggttgtgtcatgtctaactgccaggctccatgtgagagtagggacagagtcccacatgttccccatagtatcctgggatgtagagcaggcccagtgcctagaaggcactgaggaaatcctatgcaattctggaactgctgttagttcctggcctggcagggttgcaggaggctggggtcgctggtctccaggcctgctcagccctgacgtttggctctgatggtccacttacagaggaggggggcctggggccatgcagtgccctgamaaccttctcttacttgctgttgccaagtacagctttgatggatggcctcgtctgggactttgagcagtggccatgcccagggcccagatgctgggggaaggtgcttgggagagtttctgaaaggcggcctccgcatgtcaggatgaagctggaaggccacagctctgctgatgaccaacatagtcagggctggaatatgatggctggcatgtgttaagggctcattgaggaccacacccttcacctgcatcatctcgctcaacccttttgcagagggaggtatttttccttccactttta

SEQ ID NO: 27181 - DNA, 601 bp, Human
tggtgttcgacctgcatggccatttgggctcggggaggtggaggagcccagatgttttggcggaaggaccacagaggaagtccttgtcctgcgggcgggcacctgagcccgggctccgccttgcgtcacgtcttcctgactgtccccagcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccmtgggaggtgagcgcctgcccaagcccaaccaggcggagtggccgggcccctggggaggggagggcggccctgtccccatccatctggtattaatcctggctctcagccactgcagccacagggggatctgtgcgtctggcagcccctgtttgacatttgaggaaaccgaggcacagagaagtcaagtcacaggggcctcacagctggaggtggtggaggggcctgaggggggcacactgatccccacagagctcgaggcttaggctcctcccatgaccatcccagggcccagccccccgg

SEQ ID NO: 27182 - DNA, 601 bp, Human
gaagctgccgggggctcttgctgcccccattgggcaggaatgggattctggggcccaggcccagctgctgtgccctgtgctctctggggcctctgcctccacagctgggacctccccccagcggaggggcctttggcttcagggtcctcttgctgcccagccactctcacccagtggcttctctggccgtgcagacatggccctggggtgcgagtcactctctgctccccagtcctttggcctctccttggcctgcccaggtggcactcggcaccccacgtcacccccacgtcacccccgsgctgcactccgcaccccatgtgacccccaggtggcacttggcaccccacgtcacccccatgtcacccccatgtcaaccctgggctgcactcagcaccccatgtcacccccacatcacccccaggtggccctcggcaccccacatcacccccaggctgcactcagcatcccacgtcacccccgggaggcactcagcaccccacatcacctcactggattcccactggcattttctaagagtggtcaaactgcaaagctgggtcaaagggcaggtacctctctaaggattttaatgtttaaa

SEQ ID NO: 27183 - DNA, 601 bp, Human
ggggctcttgctgcccccattgggcaggaatgggattctggggcccaggcccagctgctgtgccctgtgctctctggggcctctgcctccacagctgggacctccccccagcggaggggcctttggcttcagggtcctcttgctgcccagccactctcacccagtggcttctctggccgtgcagacatggccctggggtgcgagtcactctctgctccccagtcctttggcctctccttggcctgcccaggtggcactcggcaccccacgtcacccccacgtcacccccgcgctgcactcygcaccccatgtgacccccaggtggcacttggcaccccacgtcacccccatgtcacccccatgtcaaccctgggctgcactcagcaccccatgtcacccccacatcacccccaggtggccctcggcaccccacatcacccccaggctgcactcagcatcccacgtcacccccgggaggcactcagcaccccacatcacctcactggattcccactggcattttctaagagtggtcaaactgcaaagctgggtcaaagggcaggtacctctctaaggattttaatgtttaaaaaattctcca

SEQ ID NO: 27184 - DNA, 601 bp, Human
ctctctgctccccagtcctttggcctctccttggcctgcccaggtggcactcggcaccccacgtcacccccacgtcacccccgcgctgcactccgcaccccatgtgacccccaggtggcacttggcaccccacgtcacccccatgtcacccccatgtcaaccctgggctgcactcagcaccccatgtcacccccacatcacccccaggtggccctcggcaccccacatcacccccaggctgcactcagcatcccacgtcacccccgggaggcactcagcaccccacatcacctcactggaytcccactggcattttctaagagtggtcaaactgcaaagctgggtcaaagggcaggtacctctctaaggattttaatgtttaaaaaattctccatgaaggctgggtctctttctagttctaccagctatgatggaagtgaagaaggacgtcccctaagtggttactatctcagtcttttccctggggatgaagaacttgaaaaagaacacggtttgagcctgcagtgggcctgacactgccccgccccaggcagggccagccccgccgcggcgcaggggagggtggaggccgcagcgggtc

SEQ ID NO: 27185 - DNA, 601 bp, Human
agggcaggtacctctctaaggattttaatgtttaaaaaattctccatgaaggctgggtctctttctagttctaccagctatgatggaagtgaagaaggacgtcccctaagtggttactatctcagtcttttccctggggatgaagaacttgaaaaagaacacggtttgagcctgcagtgggcctgacactgccccgccccaggcagggccagccccgccgcggcgcaggggagggtggaggccgcagcgggtcctgggcagccatggccgctctctccgcaggtggaggcggaacgaggayggagccatctgcaggaagagcataaagaagatgctggaagtgctggtggtgaagctccctctctccgagcactgggccctgcctggggtaaggctgccgcgtgtgggacctctgtccactgggctgtctgtgggtcactcgtccattcatccattctgcccacggactggacaccagccccctgcagccccctgcagcccctgggcagggagggttcgagaccccgcctgttttgtctgtagaagacactcctcctcccttttcctcatgttgcagttaggaaaacccaggatcagagga

SEQ ID NO: 27186 - DNA, 601 bp, Human
gctccccttgtggagttcagggtgttgggggcagaggtagctcttctcccgtgtctcagacaccaaccagctcctgaccttcagggccaggtgctgagccataaatataggacggtgtcatccaggggtaggggcaggtacaggagtaggggcaggggcagcgacaggggtaggtagggcccagggttgtgcacaggcccctcagctcaggggctggttgtggggctgaggctggagcgcaccccagcatcttgtggggaggggtgcacacaatcaggacagatggcctgggcctttcctrttcaagtgcctccaacagctcctgtttcctcccaggccagcctggcctccgcagccctccagcccgctcactgcaggggatggaagaggctggtcctgccaggaggtctgagtcctgccaggcctggccgtggcgcatggcctctggggtacagcctgccccgcagggcctctcctctgcacctgatccggggagtctgtgacttacaacaactcagcaagaagctgttgcatttctctgaccccgagctcacggcctggtggctgcctctgctgctgtgggagtgtgtgtgccaccacg

SEQ ID NO: 27187 - DNA, 601 bp, Human
gggccggggcaccgctcaggtgtccctcgctgtcgggcttaccctgccctgcccatccaggtgtacaaaggctacatggatgacccgaggaacacggacaatgcctggatcgagacggtggccgtcagcgtccacttccaggaccagaatgacgtggagctgaacaggctgaactctgtatgtgcctggcctccctggaggcgggagtggggaggcagggacgggtatgggcgtggcctccggggagggggttggcagggatgggggtctggattctggcaggctgaactctgtatgggcrtggcctccggggagagggaaggcggggaccggggtctggattctggacgtgcctcgagggcttccaagggagggacctggccgtgctcctggggcccagggccagaaactggaggctacagggtcagagtcttgcccagaaagtgacaaagggggcaccagggagaggccggggagccacctcaggtggccagagctcacagggctggccaggcgaccatgagggccctgtgtagttctgggacctgggtcctccagggaggcctcgaagatggcatccaggggtgaggctggcaaggcc

SEQ ID NO: 27188 - DNA, 601 bp, Human
cgggtatgggcgtggcctccggggagggggttggcagggatgggggtctggattctggcaggctgaactctgtatgggcatggcctccggggagagggaaggcggggaccggggtctggattctggacgtgcctcgagggcttccaagggagggacctggccgtgctcctggggcccagggccagaaactggaggctacagggtcagagtcttgcccagaaagtgacaaagggggcaccagggagaggccggggagccacctcaggtggccagagctcacagggctggccaggcgaccatgagggccctgtgtagttctgggacctgggtcctccagggaggcctcgaagatggcatccaggggtgaggctggcaaggccccctcagcccccggctgccggcttttagctctttatggggatgtggattcccagtacttggattaatcctgcatgctcctaattcagaactgggatgggaaattccataaataaccccgggctttaaatgcgggctaaatagctcccggcaaagctgcacctgcatcttcttcccctgaaggatcctcagggccttgtgggtgcatctctggtgcacctga

SEQ ID NO: 27189 - DNA, 601 bp, Human
agccctcgaaggctgcagtccgtagggctcagctgggcagaggcagggctggcggggagggtcagctgtgcccttgttcttccagaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggcygttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcg

SEQ ID NO: 27190 - DNA, 601 bp, Human
tgggggacggctcagcacagagctgccaaggccaggcctgtgaaaatgcactttattggctcccagggagtgggatgcaggatcagagtggacacgcgcagggggctggtgtggggagcaaagcgccgggcctgccccggaccctggtttccctgaggaccaacgtgaatgggggccccactggaaagatgcttggggctgcagagcggatggaatgcaggcccaggttgctgggtggtgccctcagctcctggcagggttgacgggtggtggccgctgggctctgccagccgatggtccrctggcacctgatcctgtcttccagcttcacttccgggcctgctcgtagttgtcagtgaaccaagcacaggtctccttcaccgctgcagaggcaggcaggtgagggccatggacagggagggtcggggccgcatgggaggaagtggggggaggaggcccagggacagggaagtcacccctcagagctttggtgtcccacctccagggcagtacaggctctgagggggcacctcacctctgccctggtagcgagcatgagggaggggctggggcaggcctccaccaagtggagggctgtggg

SEQ ID NO: 27191 - DNA, 601 bp, Human
ggtgaggccggcgcctgtaggctggcggtttccttcctcttggtctttgtagagacagtttgcagaacagcggagaaaatgggtattgtatcgtttcttacagagtccgagtcttgaaatgtagatgacaatgtgttgagtggactgacagatccttgagaatattaagaaagtataactatgtaagaatgcttctctaggaattttcacaccatttaatcctcagaaatcctgagacgttggcaaaacacatggggtctccatgtttttacaagtagggaaagcaaggctcagaaagatyaagtggcgtgcccagctggacacagactattaaatggggcggcgacgacgaccccagggcttcctcactctctcaggcagtacaggacagtgattaaacgcgtcgaccacattgcctgggtttgaatcctgccgctgcttttgagtagctccttgagcttggacaagtttcttagcttttctgtacctgtttccctgtctgtaagttgggcctggtaatacttacttgtagagtggttgtgaagttgaaatgtaaatatatgtgaagcagtatagacatgttagctactattattacaat

SEQ ID NO: 27192 - DNA, 601 bp, Human
tcccaagtcctatgactatgaccttatcatcattggaggtggctcaggaggtctggcagctgctaaggcaaggctccttgtgttgtctgttgtctgttgtctgggtggtgattagaatattaacatccctgacagggttctctcctctctctgtggaatttatttgatccactcctgtgacattttgcacattaacttgggcaggacatggacatcgtaagggaccactttataaatcatttttccagattaaaatatacattccttatattaaagtatagggcccagtattttggaacaygtttccgttcactttaagtttaattgatttttcagagataataagggtgttgtgcctggtgtggtgactcacgcctgtaatcccagcactttgggagtccgaggtgggcggatcacctgaggtcaggagttcaagaccagcctggccaatgtggtgaaactccatctctactaaaaatacaaaaattagccaggcgtggtggtgggcacctgtaatcccagttacttgggaggctgaggcaggagaatggcttgaaccttggaggccgagtttgcagtgagctgagatcgcaccattgca

SEQ ID NO: 27193 - DNA, 601 bp, Human
ccaagtcctatgactatgaccttatcatcattggaggtggctcaggaggtctggcagctgctaaggcaaggctccttgtgttgtctgttgtctgttgtctgggtggtgattagaatattaacatccctgacagggttctctcctctctctgtggaatttatttgatccactcctgtgacattttgcacattaacttgggcaggacatggacatcgtaagggaccactttataaatcatttttccagattaaaatatacattccttatattaaagtatagggcccagtattttggaacacgwttccgttcactttaagtttaattgatttttcagagataataagggtgttgtgcctggtgtggtgactcacgcctgtaatcccagcactttgggagtccgaggtgggcggatcacctgaggtcaggagttcaagaccagcctggccaatgtggtgaaactccatctctactaaaaatacaaaaattagccaggcgtggtggtgggcacctgtaatcccagttacttgggaggctgaggcaggagaatggcttgaaccttggaggccgagtttgcagtgagctgagatcgcaccattgcact

SEQ ID NO: 27194 - DNA, 601 bp, Human
ttctctcctctctctgtggaatttatttgatccactcctgtgacattttgcacattaacttgggcaggacatggacatcgtaagggaccactttataaatcatttttccagattaaaatatacattccttatattaaagtatagggcccagtattttggaacacgtttccgttcactttaagtttaattgatttttcagagataataagggtgttgtgcctggtgtggtgactcacgcctgtaatcccagcactttgggagtccgaggtgggcggatcacctgaggtcaggagttcaagascagcctggccaatgtggtgaaactccatctctactaaaaatacaaaaattagccaggcgtggtggtgggcacctgtaatcccagttacttgggaggctgaggcaggagaatggcttgaaccttggaggccgagtttgcagtgagctgagatcgcaccattgcactccagcctggtcaacaggagcaaaactctgtctttaaaaaatatatatatatatgtgtatatatatgtatatatacacacatatatatgggtattgtgtggaaatggtctgaaattaagcaaatatatttcttagt

SEQ ID NO: 27195 - DNA, 601 bp, Human
aatttttatcctggagtttaactaatcatcatggtgtgtgaagtacccaggtattaattattcgttatgctttaagctctatagcttaaaaaaaaatcatggatttttaacagcccatttccaatctgtcatgttaacctttccaactcactttaataattttattttccaggaggcagcccaatatggcaagaaggtgatggtcctggactttgtcactcccacccctcttggaactagatggggtaagcttttaagatactctagaagtgatgttgccgaagtagttttcccctggcartaatctaactggttcctaaagcctaatttaaaaaatcaaaaactaagttaaagaaaaaacagccccaaaacatatatatcttttatttgagccaagttaaaatggatcaggttaaatgctaaaaatttaggttctttggcacagagtcaagaagtaagaaccctgtctacaagctatgatttaaaggtaaatatttgagtaatctagcatatataggggcttaataactgaaaatttaaacttttcatatgtggatttgttttaaatctacctcctacattcaacaagagttggaatcag

SEQ ID NO: 27196 - DNA, 601 bp, Human
attctactcagaggacttactttgagctgtgaagtctgttgccatctttcactcttatgtcattttggtcacctgcctgtgttttgttctaatggaaacaagctgtcaccatattctttaagcttagggatactaaacctatttttagggagcaagggaagtcatgcatcctttaaaaaaccaagtgaatgctgtaggccacctccttaaaaaaatgcacatatacaccaaaatttttttcttttttttttttttttttttgagatggagtctcgctctgtcgcccgggctggagtgcagyggcgctatctcggctcactgcaacctccacctcctgggtacaagcagttctcctgcctcagcctccttagtagctgggattacagacacgtaccaccatgcccagctaattttctgtgcttttagtagagacagggtttcaccgttttggccaggctggtctcgaactcctgacctcaaatgatccacccgcctcggcctcccaaagtgctgggattacaggcgtgagccaccacgcccagccaatatacaccaaattttatatgcagtttaagacccactgcactctaatcatccccag

SEQ ID NO: 27197 - DNA, 601 bp, Human
ggccacctccttaaaaaaatgcacatatacaccaaaatttttttcttttttttttttttttttttgagatggagtctcgctctgtcgcccgggctggagtgcagcggcgctatctcggctcactgcaacctccacctcctgggtacaagcagttctcctgcctcagcctccttagtagctgggattacagacacgtaccaccatgcccagctaattttctgtgcttttagtagagacagggtttcaccgttttggccaggctggtctcgaactcctgacctcaaatgatccacccgcctcrgcctcccaaagtgctgggattacaggcgtgagccaccacgcccagccaatatacaccaaattttatatgcagtttaagacccactgcactctaatcatccccagcatagcaacccctttatcagttacctctgcatagattcaatggcaagtgcagatgctgcttgaattacaatgggggactacatcctgataaaatcctttgtaagttgaaaacaagtcaaaaatgcatttaatacacctaacctcccgaacatcatagcttagcctggtctaccttaaacatgctccgaaaacttac

SEQ ID NO: 27198 - DNA, 601 bp, Human
tcaatttctggcatctttatcagcagtcagttaattttgtatctttgaagtatacggaaattgtggaaatctgcccctctttttgttttgttttaggatgatgttaccgtgtttggtatgtaagggtctctgaacttatggatgttgtaagagttaggaataaactttattactgaccacattaagcaaatataatacaatatttcttagagttgtaataattgttgactttgttctttgaatgtttgtaaggcttggaaagcaggttataaactgatttctcaatgttgttgtaggtctyggaggaacatgtgtgaatgtgggttgcatacctaaaaaactgatgcatcaagcagctttgttaggacaagccctgcaagactctcgaaattatggatggaaagtcgaggagacaggtatgagagggaaaagctactcttctgtttgtgcttttgggggtttgagctgcaatttttgtgatgcgtcgtccattttcatgaagatagcaaatagcctagttgtttttattgtttacatttttgatggatataatcactggagttatcctttgtcaagtatttacatagttgttatggtaaca

SEQ ID NO: 27199 - DNA, 601 bp, Human
tattagttgtattccagacaagatattattaaggctgctgtacattgtgactttattatgaagatcgacactccgccgggcacagtggctcatgcctgtaatcccaatactttgggaggctgaggcaggcagatcaccaggtcaggagttcaagaccagcctggccaacatggcgaaaccccatctctactaaaaatacaaaaattagctgggcatggtggcgcatgcctgtaatcccagctactcaggaggctgaggcaggagaattgcttgaacggggaactgggaggcagaggttgcmgtgagccaagattgtgccactctactcctgccatggctacagagcgagactccatctaaaaaaaaaaattaaaaaaaaaaaaaagaaaattgacatcttggattcacattatgaataaaaagagcttgattaatcaagttttcagcactgttgttgaatagtgtactttatatccatatactctaaacagttgtattttatgtcaatttcatcattaccagtataaataaaatgttctgagtctttttatggcacttatctaggctataaaaggacttgaggatttaggtaatggtgtca

SEQ ID NO: 27200 - DNA, 601 bp, Human
gcctattataactccttacctccatttttaaacagtgtgactatgaaaatgttccaaccactgtatttactcctttggaatatggtgcttgtggcctttctgaggagaaagctgtggagaagtttggggaagaaaatattgaggtaagttcttttcctcttttctcctatgttatatcactacttttttttcttcagaatttaaaatatatagaagacttaaaaaatagtacaaagcattttcatatacccgttatccagattcatatattactaacattgtgccaatttattttatacayttttagtagtctctcattctgtgtgtgtgtgtgtgtgtgtttctgtgaatcatttgagagtaagttgaattctcctttacccctaaatactttattgtgtatttctatgaacgagggcattttcttatatagccgtagtgtagttaccactttcaggaaatttggtattggtgtaatatttttatctgatttaattttcattttctaattctgtcagttgacccaatcgtatttccttttactttttaaaatcacatttattgatttctctgggttaattataggaaaatgaaaagaaaa

SEQ ID NO: 27201 - DNA, 601 bp, Human
gttttattcattttggtagtcgcctaagatggttttaatgcatatggcattatctgaactgttccctgttacctcatttgctcaggcatctgaagatgttgtgctttctcttcccctgcaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcytgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaa

SEQ ID NO: 27202 - DNA, 601 bp, Human
tctgcccaggggagtctcagtcctgtgtgggttgtgctgactttagatctgttttgcccttgcttctccatgtgatctgaagaacgtttgttatcttctacctcagttggccttttgagaaactgggggtagtgctggagctcccctgcagaggacactgccagtaatatggtccgcagagcctctaactgagcctccctccccctcaggtatcccacctgaccagcagcgtctgatatttgccggcaaacagctggaggatggccgcactctctcagactacaacatccagaaaggtacyggggttggggttgctgggcagggacccaagatccccaggtcctaggaaaggagcattgatggcctcaggggttggggagcagttcaaatgacttgtgttttgtttaaaataatgggactgggcacagtggctcatgcctgtaatcccggcactttgggaggcttaggcgggtggatcacctgaggtcaggagttcaagaccagcctggacaacgtggtgaaatcccgtttctattaaaaatacaaaaatcagctgggtgcagtggctcaggcctgtaatcccagcacttcgggaggctga

SEQ ID NO: 27203 - DNA, 601 bp, Human
tggctgtctcctgcagagtccaccctgcacctggtgttgcgcctgcgaggtggcattattgagccttctctccgccagcttgcccagaaatacaactgcgacaagatgatctgccgcaagtatgtgtgctccgatgcttggggggctgtgggggctgccggagtcggggtatgccctcacccacccctcctgtctctgtgcaggtgctatgctcgccttcaccctcgtgctgtcaactgccgcaagaagaagtgtggtcacaccaacaacctgcgtcccaagaagaaggtcaaataaggtkgttctttccttgaagggcagcctcctgcccaggccccgtggccctggagcctcaataaagtgtccctttcattgactggagcagcaattggtgtcctcatggctgatctgtccagggaggtggctgaagagtgggcatctcccttagggactctactcagcactccattctgtgccacctgtggggtcttctgtcctagattctgtcacatcggcattggtccctgccctatgcccctgactctggatttgtcatctgtaaaactggagtaaaaacctcagtcgtgtaattggtgggact

SEQ ID NO: 27204 - DNA, 601 bp, Human
gatcatttaaaaaatctacatcacattctaacatatatgatatagtttgggtgtgtccccacccaaatctcatcttgaattgtagctcccataattcccacatgtcatgggagggacccagtgggaagtactgaatcatggaggcacatctttcccgtgctgttctcgtgatagtgtacaagtctcacgagatctgatggttctgtaaagggcagttcccctgcacacactctcttgcctgccgccactaagatgtgcctttgcttctcctttgccttctgccatgattgtgaggtctccmcagccatgtggaactgtgagtccattaaatctctttcctttataaattacccagacttgaatatgtctttattagcagcgtgacaacagactaatacaatatataacttaatttattcttgtgttaaaaacccaggttaagtcaaaattttcaccattacaaataacactatgacaaagattagcataaccccttctgagcacacacccatgtgtaaaacttcctccccagtgaagtagggtggctgggtcaaatggcatccggttttaggtgcctgttgtcttttatctatattaaact

SEQ ID NO: 27205 - DNA, 601 bp, Human
tgtgaatttctttttcaagaggaaattataacagtgctactgcttttcccagtcaatataacacaaatactactttgtatcattgattcttcttttagatcatttaaaaaatctacatcacattctaacatatatgatatagtttgggtgtgtccccacccaaatctcatcttgaattgtagctcccataattcccacatgtcatgggagggacccagtgggaagtactgaatcatggaggcacatctttcccgtgctgttctcgtgatagtgtacaagtctcacgagatctgatggttcygtaaagggcagttcccctgcacacactctcttgcctgccgccactaagatgtgcctttgcttctcctttgccttctgccatgattgtgaggtctccccagccatgtggaactgtgagtccattaaatctctttcctttataaattacccagacttgaatatgtctttattagcagcgtgacaacagactaatacaatatataacttaatttattcttgtgttaaaaacccaggttaagtcaaaattttcaccattacaaataacactatgacaaagattagcataaccccttctgagcac

SEQ ID NO: 27206 - DNA, 601 bp, Human
tttgtgcttacttttccagttatatatacatttacatgtgaatttctttttcaagaggaaattataacagtgctactgcttttcccagtcaatataacacaaatactactttgtatcattgattcttcttttagatcatttaaaaaatctacatcacattctaacatatatgatatagtttgggtgtgtccccacccaaatctcatcttgaattgtagctcccataattcccacatgtcatgggagggacccagtgggaagtactgaatcatggaggcacatctttcccgtgctgttctcstgatagtgtacaagtctcacgagatctgatggttctgtaaagggcagttcccctgcacacactctcttgcctgccgccactaagatgtgcctttgcttctcctttgccttctgccatgattgtgaggtctccccagccatgtggaactgtgagtccattaaatctctttcctttataaattacccagacttgaatatgtctttattagcagcgtgacaacagactaatacaatatataacttaatttattcttgtgttaaaaacccaggttaagtcaaaattttcaccattacaaataac

SEQ ID NO: 27207 - DNA, 601 bp, Human
gcactgtacccagagcgagccgtcagagatcattctggtcatgccactcccttggagtctttcaatggagttccgccactcccaggagaaaacatcaaaaccttcagtattgaccaaaaggcctgaggtagtttggccccggccttcctctcccgtcacttcctgcgctgggcctttgcacatgtgaagggcccctcctccccgaatcactcaggtaactcctgcttcactccctacagatggtccatccaaccaccacctctgcaaggtgctgcccagaacttcctgatgtgactttgcrttttgtttgtgtgattctcctatcaatgtccatccctgtccttggaatataagctcctgaaggtctgctattatttgctcaccactgtataccagcaactttcagtacgtgtgttgaattgtttttaaagtatttattgactagtttttatgatattggtagacctatagttctcaaagataatttttaaaaaatcaaaataatccaattacagtaaggcaaaaatttatattatctgagcattaaaaataattaccagaacattaaaaataataatcagaccacctgtagtacatagtc

SEQ ID NO: 27208 - DNA, 601 bp, Human
aaaggtttgaaaaaaaaaaaagatgccgtggttcttgcaagtctgccttgtttggtaccagcacagagcatcactgtcactaagtgtgccgggggagaatgctgagctgcttggcggtgtgtgtgcgcctgtgcgaggccaggtctcacagtcccagagacttctggacgatctgcttggcaatcttatagaactgctcccggtcatcgcgccacattttggacgcatccacgttagctccactttcgtcattgggctctgaaagaaaagggaacaccctccatgtaaaagggagtcttayacgtaagcagcctggcaaggtctcccatttatttaaaacactggcgggggctttcaagagctgtgtcccagaaacaaagaacctgagaactgcatggggtcggccccacctctagagtgctggccacgcaggtctcaacgaaagccactctcatgactcctgcgttctgagtgtctgaagacaccaggacaagttgtcatctgtcttgctgtggaacatgcgacaaccacctaagcacaggcccacacggcctcccacagcagcctcctgggccactgcacttctggcacccggacaagc

SEQ ID NO: 27209 - DNA, 601 bp, Human
agggagggagggaatccacaggaagccatgaactgctggtttcagcggggagaggtagtgctgacagctctgataatctacctgaagccctttgtgaggaatactgtaaaactgcagtaagctgtcaatattcgacattaagtcatcatttcagaagagaagcctgtttgaagtaggaaaggtttgaaaaaaaaaaaagatgccgtggttcttgcaagtctgccttgtttggtaccagcacagagcatcactgtcactaagtgtgccgggggagaatgctgagctgcttggcggtgtgtgygcgcctgtgcgaggccaggtctcacagtcccagagacttctggacgatctgcttggcaatcttatagaactgctcccggtcatcgcgccacattttggacgcatccacgttagctccactttcgtcattgggctctgaaagaaaagggaacaccctccatgtaaaagggagtcttatacgtaagcagcctggcaaggtctcccatttatttaaaacactggcgggggctttcaagagctgtgtcccagaaacaaagaacctgagaactgcatggggtcggccccacctctagagtgctgg

SEQ ID NO: 27210 - DNA, 601 bp, Human
cccctcaacactccagggagggagggaatccacaggaagccatgaactgctggtttcagcggggagaggtagtgctgacagctctgataatctacctgaagccctttgtgaggaatactgtaaaactgcagtaagctgtcaatattcgacattaagtcatcatttcagaagagaagcctgtttgaagtaggaaaggtttgaaaaaaaaaaaagatgccgtggttcttgcaagtctgccttgtttggtaccagcacagagcatcactgtcactaagtgtgccgggggagaatgctgagctgmttggcggtgtgtgtgcgcctgtgcgaggccaggtctcacagtcccagagacttctggacgatctgcttggcaatcttatagaactgctcccggtcatcgcgccacattttggacgcatccacgttagctccactttcgtcattgggctctgaaagaaaagggaacaccctccatgtaaaagggagtcttatacgtaagcagcctggcaaggtctcccatttatttaaaacactggcgggggctttcaagagctgtgtcccagaaacaaagaacctgagaactgcatggggtcggccccac

SEQ ID NO: 27211 - DNA, 601 bp, Human
gtgctgcagctacagggccccatttcttcagaaggagcgttctgggtattccatcgtcccctggaagtctggcaggtacaaccccctcaacactccagggagggagggaatccacaggaagccatgaactgctggtttcagcggggagaggtagtgctgacagctctgataatctacctgaagccctttgtgaggaatactgtaaaactgcagtaagctgtcaatattcgacattaagtcatcatttcagaagagaagcctgtttgaagtaggaaaggtttgaaaaaaaaaaaagatgccrtggttcttgcaagtctgccttgtttggtaccagcacagagcatcactgtcactaagtgtgccgggggagaatgctgagctgcttggcggtgtgtgtgcgcctgtgcgaggccaggtctcacagtcccagagacttctggacgatctgcttggcaatcttatagaactgctcccggtcatcgcgccacattttggacgcatccacgttagctccactttcgtcattgggctctgaaagaaaagggaacaccctccatgtaaaagggagtcttatacgtaagcagcctggcaaggtctccca

SEQ ID NO: 27212 - DNA, 601 bp, Human
caggatggtctcaatttcctgaccttgtgatctacctgccttggcctcccaaagagctgggattacaggcacgaaccaccgcacctggccaatcagcaataaatttcttttctatttaccccatttcttattaattcacacttcaaaaaagcatttcctggaagtatttctaagtgtgatggtttgtaatatataacaaatgaaaagatgtaattagattataagaaaagcatctgcctgtaaaatatgaaggaagaaaggaagtaatggactcctcatggggcccacagggaaccaggarggacccagaaagggtgccgggcccttcccctgtgctgcagctacagggccccatttcttcagaaggagcgttctgggtattccatcgtcccctggaagtctggcaggtacaaccccctcaacactccagggagggagggaatccacaggaagccatgaactgctggtttcagcggggagaggtagtgctgacagctctgataatctacctgaagccctttgtgaggaatactgtaaaactgcagtaagctgtcaatattcgacattaagtcatcatttcagaagagaagcctgtttgaag

SEQ ID NO: 27213 - DNA, 601 bp, Human
ctaataaattcccagtgcatccaaaatgtacaaaaaccctagaatttccagtttttagattgaaaaaaaaaaattttttctgtagatccagaagaaactttcattgaaactttaaagacctcacctgcacctgctctagtaatgcactagttactaatatacaaacgtaaatctttgatgagtatggtcgggaaaaaactgtctgtccttgtgatcagcaataaatttcttttttctttttgagactgagtctcgctctgttgcccaggctggagtgcagtggcgggacttcagctcactrctacctctgcctcccgggttcaagcgattctcctgcctcagcctcctgagtagctgagactacaggcgtgcaccaccacgcccagctaattttttgtaattttagcagacatggggtttcactgtattagccaggatggtctcaatttcctgaccttgtgatctacctgccttggcctcccaaagagctgggattacaggcacgaaccaccgcacctggccaatcagcaataaatttcttttctatttaccccatttcttattaattcacacttcaaaaaagcatttcctggaagtattt

SEQ ID NO: 27214 - DNA, 601 bp, Human
ctgtggcctcctggcctgtgctgctcagctggccctgttagagaacatgggaaccacatcaaaatcctaagtcacaaaacaagggctctgtccccagcctgggcccaggggcccacatgcccacctccacagcccagtcaagtgtggggataaggcactcctctgtgctctgagctaagatatggtagagtcccttctgaattttgagttgcaaagaatgattttgtgctaataaattcccagtgcatccaaaatgtacaaaaaccctagaatttccagtttttagattgaaaaaaaaaawttttttctgtagatccagaagaaactttcattgaaactttaaagacctcacctgcacctgctctagtaatgcactagttactaatatacaaacgtaaatctttgatgagtatggtcgggaaaaaactgtctgtccttgtgatcagcaataaatttcttttttctttttgagactgagtctcgctctgttgcccaggctggagtgcagtggcgggacttcagctcactgctacctctgcctcccgggttcaagcgattctcctgcctcagcctcctgagtagctgagactacaggcgtgca

SEQ ID NO: 27215 - DNA, 601 bp, Human
actgtggcctcctggcctgtgctgctcagctggccctgttagagaacatgggaaccacatcaaaatcctaagtcacaaaacaagggctctgtccccagcctgggcccaggggcccacatgcccacctccacagcccagtcaagtgtggggataaggcactcctctgtgctctgagctaagatatggtagagtcccttctgaattttgagttgcaaagaatgattttgtgctaataaattcccagtgcatccaaaatgtacaaaaaccctagaatttccagtttttagattgaaaaaaaaawattttttctgtagatccagaagaaactttcattgaaactttaaagacctcacctgcacctgctctagtaatgcactagttactaatatacaaacgtaaatctttgatgagtatggtcgggaaaaaactgtctgtccttgtgatcagcaataaatttcttttttctttttgagactgagtctcgctctgttgcccaggctggagtgcagtggcgggacttcagctcactgctacctctgcctcccgggttcaagcgattctcctgcctcagcctcctgagtagctgagactacaggcgtgc

SEQ ID NO: 27216 - DNA, 601 bp, Human
ttgtatttttagtggagacagggtttcactgttagccaggatggtcgcgatctcctgacctcatgatccgcccgcctcagtctcccaaagtgctgggattgcaggcgtgagccacagcacccagcctccaaattttaaatgagccccttgtgagaaggaaaagaatctgctgtccacagaagccaggcgtggagctacttcaaccagaaactgtcacccatgacactctgtgtgggttcagtcacacagaccacgatccattatggaagggagggagaaaaggatcacatcaaatctactrtatgcctcatagaccatcccttatttcaaaaatagaaattcctatttaaatgccgcccgtgtgcgacaggcctgatatttgcttctgcatgtggcagatctgttattgcttacactgtggcctcctggcctgtgctgctcagctggccctgttagagaacatgggaaccacatcaaaatcctaagtcacaaaacaagggctctgtccccagcctgggcccaggggcccacatgcccacctccacagcccagtcaagtgtggggataaggcactcctctgtgctctgagctaagatatggt

SEQ ID NO: 27217 - DNA, 601 bp, Human
ataaaaatactttattttgtcaagagactgcctctcctccctctcccgatctcacagaagcctccaggcaattgtgtgcccctccagggcctgcacccacagaccccgtctacttgcacaaatgactcttctttacagagagggctccatctcatttgcctgcaaatacaacataggtataataccgctcctttcccccatctccttccaaatacgagttcttgccctgcgttccattttttttttttttttttttgagacagagtctcactctgttgcccaggctggagtgcagtggcgygatctcagctcactgcaagctccgcctcctgggttcacgccattctcctgcctcagtcttcagagtagctgggactacaggcgcccgccaccacgcccggctaattttttgtatttttagtggagacagggtttcactgttagccaggatggtcgcgatctcctgacctcatgatccgcccgcctcagtctcccaaagtgctgggattgcaggcgtgagccacagcacccagcctccaaattttaaatgagccccttgtgagaaggaaaagaatctgctgtccacagaagccaggcgtgg

SEQ ID NO: 27218 - DNA, 601 bp, Human
gacaatacgacaaagggacacacactgcagggcagggaaaacacagaactttatttcaacagtcattaggttccaccacacaacagggacaccatgggattgttttttcatttaataaatacaaatgaataaaaatactttattttgtcaagagactgcctctcctccctctcccgatctcacagaagcctccaggcaattgtgtgcccctccagggcctgcacccacagaccccgtctacttgcacaaatgactcttctttacagagagggctccatctcatttgcctgcaaatacaacwtaggtataataccgctcctttcccccatctccttccaaatacgagttcttgccctgcgttccattttttttttttttttttttgagacagagtctcactctgttgcccaggctggagtgcagtggcgtgatctcagctcactgcaagctccgcctcctgggttcacgccattctcctgcctcagtcttcagagtagctgggactacaggcgcccgccaccacgcccggctaattttttgtatttttagtggagacagggtttcactgttagccaggatggtcgcgatctcctgacctcat

SEQ ID NO: 27219 - DNA, 601 bp, Human
gagtcctcaagtcgcagctgggctgctccacgtgggagtggagggtggaggaacgtgtggagtttcggagtccagcccagtgcggagacagccttgaaaccgtggttggcgggcgctccactccgctctgggctcgaaccctgcctgaccctagctgtgccccccactttctccctgtctggcccctggctccccgccccctcacttagaggagggcacggggaagggcaaacggtccagagggcgggcggcctgcgggctcctctgcatcatgtgaggagggcgtggggaaggacatccyggtggggcccgatctggggctgcctccagcccgggctgcctgtcttggacttagtcgtggacctggaggccagtgcccggctggcccctgtcaccctctcgctgtgacgccagcgcctgctgactggaggacccaggttccttcgcctgctttttctcaggctgccctgaggatctgtgtttggtgaaaaggagccaaattcacctgcagggcaggcggctctagcagcttcagaagcctggtgccctggcgacactggacctgccttggcttctttgatcccaaccccacccccgattt

SEQ ID NO: 27220 - DNA, 601 bp, Human
tggtcctgcccgaggccttgttccctccggcccatgccagcctctgggtttcgctctgaaactcacagcagctccggccccctgagctgagcagtcccagcaggactcagctttgcccgagacaggatgtggcttggatttgtcacttgtctgaggctctgctgagaacgtcccttgcccttcacgttacggcgaggcaggtgcgcgcgcggccccaaggaagacaggagtggtgtcgggttgtggggtggcaaaggcgcctcatccaggcgggacctggggcaggggcttgcagaacacmctggggtgagggcacaggtgtgctcttggcgctgccggccccagtgtgcggcactcgttgccccccagcccagcccccgacccccgtctcctcctctcctttccaggagggcctttccgactcactctctgggcatggcagaggtcctgaccgcccccttggtggggctggtccaggcttcaggctggtatgggagccgcctctgtcgggcctctggcccccggtgtcctcgcagtcctggaggttgtgtcctagaagcgatccccttcctcctgggccggcctgcggcaggcaagcagc

SEQ ID NO: 27221 - DNA, 601 bp, Human
cttgttccctccggcccatgccagcctctgggtttcgctctgaaactcacagcagctccggccccctgagctgagcagtcccagcaggactcagctttgcccgagacaggatgtggcttggatttgtcacttgtctgaggctctgctgagaacgtcccttgcccttcacgttacggcgaggcaggtgcgcgcgcggccccaaggaagacaggagtggtgtcgggttgtggggtggcaaaggcgcctcatccaggcgggacctggggcaggggcttgcagaacacactggggtgagggcacrggtgtgctcttggcgctgccggccccagtgtgcggcactcgttgccccccagcccagcccccgacccccgtctcctcctctcctttccaggagggcctttccgactcactctctgggcatggcagaggtcctgaccgcccccttggtggggctggtccaggcttcaggctggtatgggagccgcctctgtcgggcctctggcccccggtgtcctcgcagtcctggaggttgtgtcctagaagcgatccccttcctcctgggccggcctgcggcaggcaagcagcccatctcaccacggtt

SEQ ID NO: 27222 - DNA, 601 bp, Human
gaagcgccaccactccgagtctcactggagggtttatcttgccccacctcactgctcttcctgtgggctctcgcagtctctcccacccggggctgcgtctgcagccgggcaggcatagagcaggggagcagcagagaaggcgcgagaagaaagggctgaggccaggttcgacattgagcctacagctaagttagtgatctcagtcagttcagcaaaactcaggagagggaggagagggccgccacgtccctgccgtcccatagctggaaatcggcaggccctttctgtggtgagttccacscattaacacgtgcccagcacctagacagcgcctggccacggtgaggcgagagtgctgtgtaaaagcttccactgcaattgtcactcaagacacacaagtgttttccacagtggcagtgaccagaggagcttgaggactgctgacagcaccagctggtcgagacttgcttcatttttggattgtcctttgctgtttgattttttttttaaaccatgagcaggtattacttaagatgacttattttaattaagaaaaatataagaatgagacacagtagctgctttcattgattctgttcaa

SEQ ID NO: 27223 - DNA, 601 bp, Human
gattggttcaggacctctgtaccgaaaactgtagaatattgcaagggaaaccaaggccggcctgagcggtagctgagctctgccgtgtgtgtggaggggaacacacgacattgtacagacagcccttctctccaggctcgtctgcagattccatgtgatcccagttggagtcaagcacatcttgttggaaactgtcccatggacccaggaaatgcagaaacgtggaggccttggcttcttggtggggtggcgagacccaggctgaggctccgtgggtgcagagcacacccacccacccccmactagacctgccacgggacacggtgatggagactgcaggattgctgagaagacaggcaggcagacccgcggacagaacgaggagtccggaggccacgcatgtggtggtttgggctgtgacaccctgagggatattccagcaggagagacgagctctgcctcccaccatagagaaacagcttccagatggcttgtggtgcccaagcaggacagcgtggagaggaagacccgggatggtgtccgtgagccctgggcaggcagggatctcttcaccagggatgcagtgaagtgctggccggag

SEQ ID NO: 27224 - DNA, 601 bp, Human
cggccgggcgcggtggctcacgcttgtaatcccagcactttgggaggccgaggtgggcgaatcatgcggtcaggagttcgagaccagcctggccaacatggcgaaaccctcgtccctactaaaaatacaaaaaattagttgggcgtagtggtgggtgcctctaatcccagctacctgggaggctgagacaggagaatcacttgaacccgggaggcggaagttgcagtgagccgagatcctgccactgctctccagcctggcgacggaggaatgctgtctcaaaaaaaaaaaaaaaaaaaaagcacgtggttttggagagatgtgtttctccctggatgcgggcccagcccaggtgtctgcaaggtgccctccctggtggccgagggtggcacagaggccccaggcagggagcaagtatcacagcagccaccccaggctcagcctggctcccctgcatggtggtgcacacctgtagtcccagctatttgggaggctgaggtgggaggactgcttgagcccaggaggttgatgcgcagtgagttgagattgcagcaccgcaatccagcctgcttgacaaagcgagaccctgtctcaaaaaaaa

SEQ ID NO: 27225 - DNA, 601 bp, Human
caggggtggtggctcatgcctgtaatcccagcactttgcaaggccactgtgggacgttacctgagcccaggagttggagaccagcctgggccacatggcaagacctgctctctttaaaaaaaaaaaaaaaaaaaaaattaagccggggatgatggtgcatgcctgtagtcccagctatttgggaggctgaggtgggaggactgcttgagcccaggtggttgatgctgcagtgagccaagattgcagcctgggtgacaaagtgagaccctgtctcaaaaaaaaaaaaaaagcatgccgggcrcggtggctcacgcctgtaatcccagcactttgggaggccaaggtgggcagatcacgaggtcaggagattgagaccatcctggctaacacggtgaaaccccatctctagtaaaaataaaaaaaattagccgggcgtggtggcgcacacctgtaaccccagctactcgggaggctgaggcaggagaatggcttgaacctgggaggcggagcttacagtgagccgagatcacgccactgcactccagcctgggcaacagagccagactctctctcaaaaaaacaaaacaaaaggcaaatgttt

SEQ ID NO: 27226 - DNA, 601 bp, Human
ggggtggtggctcatgcctgtaatcccagcactttgcaaggccactgtgggacgttacctgagcccaggagttggagaccagcctgggccacatggcaagacctgctctctttaaaaaaaaaaaaaaaaaaaaaattaagccggggatgatggtgcatgcctgtagtcccagctatttgggaggctgaggtgggaggactgcttgagcccaggtggttgatgctgcagtgagccaagattgcagcctgggtgacaaagtgagaccctgtctcaaaaaaaaaaaaaaagcatgccgggcgcrgtggctcacgcctgtaatcccagcactttgggaggccaaggtgggcagatcacgaggtcaggagattgagaccatcctggctaacacggtgaaaccccatctctagtaaaaataaaaaaaattagccgggcgtggtggcgcacacctgtaaccccagctactcgggaggctgaggcaggagaatggcttgaacctgggaggcggagcttacagtgagccgagatcacgccactgcactccagcctgggcaacagagccagactctctctcaaaaaaacaaaacaaaaggcaaatgttttc

SEQ ID NO: 27227 - DNA, 601 bp, Human
tggctcatgcctgtaatcccagcactttgcaaggccactgtgggacgttacctgagcccaggagttggagaccagcctgggccacatggcaagacctgctctctttaaaaaaaaaaaaaaaaaaaaaattaagccggggatgatggtgcatgcctgtagtcccagctatttgggaggctgaggtgggaggactgcttgagcccaggtggttgatgctgcagtgagccaagattgcagcctgggtgacaaagtgagaccctgtctcaaaaaaaaaaaaaaagcatgccgggcgcggtggctsacgcctgtaatcccagcactttgggaggccaaggtgggcagatcacgaggtcaggagattgagaccatcctggctaacacggtgaaaccccatctctagtaaaaataaaaaaaattagccgggcgtggtggcgcacacctgtaaccccagctactcgggaggctgaggcaggagaatggcttgaacctgggaggcggagcttacagtgagccgagatcacgccactgcactccagcctgggcaacagagccagactctctctcaaaaaaacaaaacaaaaggcaaatgttttcctgccta

SEQ ID NO: 27228 - DNA, 601 bp, Human
aaaaccctccagaaattggtgtctatttttgggaattaacaaaaacagtggcaagcagtcagtgttttcagtttattaggactgtccccagacctacagaaaagagaagctgctgattactagttaggaccagacttggcatcggcaacgatgttgcaggccctggcgtgggccctctggggcctgagccctcctcgcagccctgcgggacccctctgtcccccttgaacaccacgttcacccagcgtgggttcctctcctccctgcccttctgcccccgtcagaccacaggacagtctcrgccacgtcagagccagcatgggctccccaccacgcaggcctccctgcttctccgggcttctgcttctgttactatgacgagctccacactgccctcccccaggaggtcccatcctgcagcctggtctgcccggctggctccggggcgagcgtgagggccaggcagctcagccctctaacacgtctcttctcttttgacctcctcagccaaaacagagtggagtacgagaaaagggtccgagcacaagccaagaagtttgcgccctcataagcagcgaccttgtggcatcgtcagaaggaa

SEQ ID NO: 27229 - DNA, 601 bp, Human
tgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagyggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaa

SEQ ID NO: 27230 - DNA, 601 bp, Human
gatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccytcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgt

SEQ ID NO: 27231 - DNA, 601 bp, Human
gcgtggcagcctgagggaggggcgtgcgccgagagggagctcagatcgagcggggcgcgggtggagaagctgcggcagcgcggcccgtaggaaggtgctgtccgaacgatcgggataggagcggtccctgcgcttgctgctgggaagtgggtaagcgccgctcccaggctggccccgccgcccgggcgggatgctcccaggtctgggcgggatgtggagggagcggggctggggtgtgcgcgctgctcccggtcgctcgctgcgctgggtcccgggcttcccgtctcacgaccttcgtctytttggggcttagggcgggaaccgcattttggaactgctgtcctggggatgtggtcgtctgggcttcttattcaagactcgtgagtcttccagccccttctctttctgcctttacccactttcctgacttggatgagatttccctgccgcctccaaagccgaacgcccaccacaggaagcggttctctcgttggggacctcattttggccgcagagtcgtagtcttttgtttgtgtttaagagtctgctcacctgaggggctcctgcttttctcatgccgcccctcttaagaaaccaaaga

SEQ ID NO: 27232 - DNA, 601 bp, Human
ccttgttacaacagatttaattttgaaccatatgaacattattcagaatcaataatttttttttttttttttgagatggagtttcgtgcttgttgcccaggctggagtgcaacatggcacgatctcagctcactgcaacctccgcctcccgggttcaagcgattctcctgcctcagcctcccaagtagctgggattacagacatgtgccaccatgccccgctaattttgtatttttagtagagatggggttttgtcatgttgatcaggctggtcttgaactcctgacctcaggtgattcascctcctcggcctcccgaagtgctgggattacaggcatgagccaccgtgcctggccagaataaataatttttaaaaatttatttcatatggctaagaatactatttgaatacagattcaaatagaatactgttctatttaattgaatcatataattcaaaattctgtccatttttactattttaccaaagttctatttcttttaattgttttttaaaagtcatgaggggcctggcacagtggctcgtgcctgtaatgctagcactttgtgaggctgaggcaggcagattgcatgagctcag

SEQ ID NO: 27233 - DNA, 601 bp, Human
taaatgagcatacttatgtataaatcagttccttgtcattttgattagtgtgaatcagttcacctaatgcttttgaaaatctatcaaaatctgtgtaacccacttttctgctggcattgggaaggaaaaaaatctgtgtaacagctttggtaattacagaaattacattttctttaaccaccttatggtttctgattaaagttgaaatggagtttaagattattgcctagtacctaaaagtaaactttgaaagccaaagtagtgtgtagggcatataatctcatcagaggccaattctggrctgtggaactaatcttattctatatcatcgtaatctaaacctgttataaactcatctttgtacactagcatttatttaagcaagaatcgtacaagtatgttcatcctggagctttctctcagcaatcaaagttgtcctagtgtattatagacctaaggaaggttttactttgattctttactttctaaatattaggtcattataatctttgtggctccccttcagtaatatcagttactgtaattatttccatatgtttcatgctagtgcagctgagaacaggctaggtcatccaattgg

SEQ ID NO: 27234 - DNA, 601 bp, Human
tggggtttcaccatgttggccaggctggtcttgagctcctgaactcaggtgatctgcccgccccggcctcccaaagtgctgggattacaggcgtgagccactgcacctggccttcttccctgtttcctaattttgtctgttagtatcattaccatattataataaaattaaaaagtggtatcctgtaaaaataaaataaatacaacttttaataatattaatataaatttaatatatttttggattattttactaacatcacataaacattagatggacaaatggcatctttcatatttaragtttggtgccacaaatatttttaactggaatttcaaaattttgtgaatttagagaatttagaaaaatatgcttctaactattttactgagctatctggtttcctttttttttattatttcactgtaaaatgagttcatcatattatgcttttgaaactcaacagaaaagcatttgcaaatttgatggtagcattttctagctaacattaatatgtttatatttttccccaagaaaagcttggttattttttatttgttttttgagacggagtttcactcttgttgcccaagctggagtg

SEQ ID NO: 27235 - DNA, 601 bp, Human
agtagagacgaggtttcgccatgttggccagggtggtcttgaactcctgacctcaggggatcacccctcctcagcctcccaaagtgctgggattacaggtgtgagccaccatgcccggctgaagcttatttctttatgactattatcaaccatagactttagttgccttagacttttagaaggaaagtctcaatccagttttatctctaagataggtctgcctgctatctataggaatataagatatggaaatctatgaaaaagcatctatagactaatagtcactcaaaaacacagattkacttattatatctgaatcagatttaggattgaaatattggcggcacggtggctcacacctgtaatcctagcactttggaagaccaaggcaggcggattacctgaggtcgggagtttaagaccagcctggccaacatggtgaaagcccgtctctactaaaaatacaaaaaattagccgggtgcagtggtgcgcacctataatcccagctactcgggaggctgaggcaggagaatcgcttgtacccaggaggcagaggttgcagtgagccgagatcacgccattgtactccagcctgggcta

SEQ ID NO: 27236 - DNA, 601 bp, Human
aatcagatttaggattgaaatattggcggcacggtggctcacacctgtaatcctagcactttggaagaccaaggcaggcggattacctgaggtcgggagtttaagaccagcctggccaacatggtgaaagcccgtctctactaaaaatacaaaaaattagccgggtgcagtggtgcgcacctataatcccagctactcgggaggctgaggcaggagaatcgcttgtacccaggaggcagaggttgcagtgagccgagatcacgccattgtactccagcctgggctacagagcaagacttcrtctcaaaaaatatatatatatattactactatatttggtttagggtaatttttaaaaatgttttagaaagataacttgatggtgagttctataatgctgatattgataaaagggttgcaagtcatttgaaaccccataaaccatacttatatccaaacattcagtaatgaattctgccagcagtgtattctagtcttcacaaataagccaggcatggtggcatggccttgtagttctggctactcaggaggctgagacagaaggatcatttgagccaagggtttcaagtccagcctgggc

SEQ ID NO: 27237 - DNA, 601 bp, Human
aataaattagaataatgacacccatcagaatggttaaaatgatattactgacaataccaagtgtttagcaattagaattttatgcactgcttggtaagaatatcaattggtacagtcacttggcagacgtgtttgatagtatctactaaagctgaaaatataggccaggcacagtggctcatgcttgtaatcccaacagtttgggaggccgggcgagaggattgcttgagcccaggagttcaagcccagcctgggcaacattgcaagacccctgttccttttcttttttttttttttttttaaaggccaaccgcggtggctcacacctgtaatcccagcacttttggaggccgactccatcctggtcaatatagtgaaactttgtctctaaaaaatatttaaaaattaactgggcattgtggcatgtgcttgtggtcccagctacttgaggagttgaggcaagagaatcacttgagcccaggaggctgaggctgcagtgagccctgttggcgccactgcactccagcctgggcaacaaagtgagaccctgtctcttgaaaaaataaaaaaaaactattagtctgtgatccagcaattccaa

SEQ ID NO: 27238 - DNA, 601 bp, Human
agttcaagcccagcctgggcaacattgcaagacccctgttccttttcttttttttttttttttttaaaggccaaccgcggtggctcacacctgtaatcccagcacttttggaggccgactccatcctggtcaatatagtgaaactttgtctctaaaaaatatttaaaaattaactgggcattgtggcatgtgcttgtggtcccagctacttgaggagttgaggcaagagaatcacttgagcccaggaggctgaggctgcagtgagccctgttggcgccactgcactccagcctgggcaacraagtgagaccctgtctcttgaaaaaataaaaaaaaactattagtctgtgatccagcaattccaagtgtatatccaacagagatgcatacatatgtgcactaaaagacagaaggaacaacctaaatattaatcagcaatagaatggatgcatgaggctgggtgcggtggttcacgcctgtaatcccagcactttgggaggctgaggtgggcggatcacctgaggtcaggggttctaaaccagccttgacaacgtggtgaaatcccatctctactaaaataatacaaaaattagccaggtgt

SEQ ID NO: 27239 - DNA, 601 bp, Human
tcaagcccagcctgggcaacattgcaagacccctgttccttttcttttttttttttttttttaaaggccaaccgcggtggctcacacctgtaatcccagcacttttggaggccgactccatcctggtcaatatagtgaaactttgtctctaaaaaatatttaaaaattaactgggcattgtggcatgtgcttgtggtcccagctacttgaggagttgaggcaagagaatcacttgagcccaggaggctgaggctgcagtgagccctgttggcgccactgcactccagcctgggcaacaaartgagaccctgtctcttgaaaaaataaaaaaaaactattagtctgtgatccagcaattccaagtgtatatccaacagagatgcatacatatgtgcactaaaagacagaaggaacaacctaaatattaatcagcaatagaatggatgcatgaggctgggtgcggtggttcacgcctgtaatcccagcactttgggaggctgaggtgggcggatcacctgaggtcaggggttctaaaccagccttgacaacgtggtgaaatcccatctctactaaaataatacaaaaattagccaggtgtagt

SEQ ID NO: 27240 - DNA, 601 bp, Human
gaccctgtctcttgaaaaaataaaaaaaaactattagtctgtgatccagcaattccaagtgtatatccaacagagatgcatacatatgtgcactaaaagacagaaggaacaacctaaatattaatcagcaatagaatggatgcatgaggctgggtgcggtggttcacgcctgtaatcccagcactttgggaggctgaggtgggcggatcacctgaggtcaggggttctaaaccagccttgacaacgtggtgaaatcccatctctactaaaataatacaaaaattagccaggtgtagtagcrcatgcctatagccccagctactcgggaggctgaggcaggagaatcacttgaacctgggtgggggaggttgcagtgagccgagtttgcaccactgcactccagcgttggtaacagagtgagactccgtcttaaaaaacaaacaaacaaacaaaaagaatggctacatgaattattttataatactgcaacaaaatactgtactgtgttgaaaatcaatgaaactactcctgcacttaagaatatggttaaaatcttacaaaagtagtgttgccagacacaaaggagtacataccgtataat

SEQ ID NO: 27241 - DNA, 601 bp, Human
atatgtgcactaaaagacagaaggaacaacctaaatattaatcagcaatagaatggatgcatgaggctgggtgcggtggttcacgcctgtaatcccagcactttgggaggctgaggtgggcggatcacctgaggtcaggggttctaaaccagccttgacaacgtggtgaaatcccatctctactaaaataatacaaaaattagccaggtgtagtagcacatgcctatagccccagctactcgggaggctgaggcaggagaatcacttgaacctgggtgggggaggttgcagtgagccgagwttgcaccactgcactccagcgttggtaacagagtgagactccgtcttaaaaaacaaacaaacaaacaaaaagaatggctacatgaattattttataatactgcaacaaaatactgtactgtgttgaaaatcaatgaaactactcctgcacttaagaatatggttaaaatcttacaaaagtagtgttgccagacacaaaggagtacataccgtataattccatttgcgtaagtttcaaaaataggcaaactaatctatgattatagaattcagcatgatggtaatttgggaatagtagtga

SEQ ID NO: 27242 - DNA, 601 bp, Human
taccaaaaatacaaaaattagccaggtatggtggtgtgcgcctgtaatcccagctgcttgggagtttgcggcacgagaatcacttgaacctggtaggtggatgttgcagtgagacgagatggtgccactgcactccagccagggtgacagagcaagactgtctcaaaaaaaagaaatttttcagtctagattttgctggttcagttccttggagtttttcaacttattctttatttaatgtaaattggtagttagatctaaaggtacaggtccaatcagatttaggcttgattttttttttataagaatatttgttaagtggttttatacccctccatattcttaacataaatatatctcctgttaaactgggattttttttttaaataaaagggttccttgcaataggacttagaaaaatttatatttatttaagcatatagaaaaatttatatttatttaagcatatatggagtaaattgactttcacagccagttctatggcctgaattattgggagtaaaaatgtgcattcataatgacaatgcaaaatcatatatttgcttgaaatcacagaagaccttgaattttctgaaaattg

SEQ ID NO: 27243 - DNA, 601 bp, Human
tgcaaaatcatatatttgcttgaaatcacagaagaccttgaattttctgaaaattgtgttgatactcatagttaatggttaactcttatgagttagtcacatggtaaacaatgacaaagcattaaatgagctgctcttctgattgtagcaagtttaatggcaatttccattttactttatttacttaagtgtacttatgaggcagggcgtggtaacttactcctataatcccagcactttaggaggaggagcagggaggattgcctgagcctgggaggtcaaggttgtagtgagctgttaygcaactgcactccagcctggggaacagagcgaaaccctgtatgaaaaaataaaataggccaggtgtggtggcttgtgcgtgtaatcccagaactttgggaggccaaggcaggtggattacctgaggtcaggagttcaagaccatcctagccaacatggtgaaaccccatctctactaaaaatacaaaattagcccagtgtggtggtgcatgcctgtaatcccagctacttgggaggctgaggcaggagaactgcttgaacccaggagacggaagtcgcagtgagccgagatcataccact

SEQ ID NO: 27244 - DNA, 601 bp, Human
ggtcaaggttgtagtgagctgttacgcaactgcactccagcctggggaacagagcgaaaccctgtatgaaaaaataaaataggccaggtgtggtggcttgtgcgtgtaatcccagaactttgggaggccaaggcaggtggattacctgaggtcaggagttcaagaccatcctagccaacatggtgaaaccccatctctactaaaaatacaaaattagcccagtgtggtggtgcatgcctgtaatcccagctacttgggaggctgaggcaggagaactgcttgaacccaggagacggaagtygcagtgagccgagatcataccactgcactccagcctgggtgacagaaagaggctctgtctcaaaaaaaaataaaataaaataaaataaatgggctgggcatggtggctcactcctataatcccagcactttgggaagctgagatgggaggattgtttgagcccaggaatgtgagaccagcctggacaacccagtgaaaccccaaaaccccatctctgccgaaaaaagatacaaaaattagccaggcctcatggctcctgtggtcctagctacttgggaggctgagatgggaggatcattt

SEQ ID NO: 27245 - DNA, 601 bp, Human
gtagtgagctgttacgcaactgcactccagcctggggaacagagcgaaaccctgtatgaaaaaataaaataggccaggtgtggtggcttgtgcgtgtaatcccagaactttgggaggccaaggcaggtggattacctgaggtcaggagttcaagaccatcctagccaacatggtgaaaccccatctctactaaaaatacaaaattagcccagtgtggtggtgcatgcctgtaatcccagctacttgggaggctgaggcaggagaactgcttgaacccaggagacggaagtcgcagtgagcygagatcataccactgcactccagcctgggtgacagaaagaggctctgtctcaaaaaaaaataaaataaaataaaataaatgggctgggcatggtggctcactcctataatcccagcactttgggaagctgagatgggaggattgtttgagcccaggaatgtgagaccagcctggacaacccagtgaaaccccaaaaccccatctctgccgaaaaaagatacaaaaattagccaggcctcatggctcctgtggtcctagctacttgggaggctgagatgggaggatcatttgagcccagga

SEQ ID NO: 27246 - DNA, 601 bp, Human
cagcattgtgggaggccaaggtgggcagatcacaaggtcaagagattgagaccatcctggccaacatggtgaaaccccgtctctactaagaatacaaaaattagctgggcgtggtggtgtgcacccgcagtcccagctactcaagaggctgaggcaggagaatcgcttgaaccaaggaggcagaggttgcagtgagccgagatcgcgccactgcactccagcctggtgatagagtgagactctgtctcaaaaaaaaaaaaaaaaaaaaaaagaactaggaaatgctggtaacatgagagcmcatgtgatgatagtatatttcatatttatttcattatttcttgtttccagtggttggcagaggtgagatgaagaaaatcagtttgcaaacttacaggcatctcctctctaaatgaattttacattaattgtttgtaacttggcatatgttggttagattatcaggctaaccaacagacacctttacctcataatgtggctgaactgtcctacctttataatgaaaaaaacagaaccaacacttgagattaaactctagtaaaccactatttgaaccaaagcaacttacatcttgctgtcc

SEQ ID NO: 27247 - DNA, 601 bp, Human
aggaggccaggtgcggtggctcacgcctgtaatcccagcactttgggatgctgaggtggacagatcacctgaggtcaggagttcgagaccagcctggacaacatgatgaaaccctgtctctactaaaaatataaaaaaagtggtggggtgtggtggcgcatgcctgtagtcccagttacttgggaggctgaggcaggagaatcgcttgaacctgggaggcagaggttgcagtgagccgagattacactactgcactctagcctgggcaaagaacaagactccatctcaaaaaaaaaaaaaagactttaaaacttatttttaaggactataataatatattatgtacaataaagaaagggaataagaaaaggcttacatttcatttcagattgtgaagtcctttaggataaccgtctcattcatttatgtatcttcagggcttagctggaatctgcctgccctagttatccggcatatagatagtagcttcctaacaaaaatttattgaatgagttctctagatgcttcaagctatttcttctgattattatatttataaaatgtattatttctatggaactaacagaggattaaatcaggg

SEQ ID NO: 27248 - DNA, 601 bp, Human
gaaataattttcacaagggagatcatatatgagggtataaaagattctgaaaaattctgaaatcttaaaatagtaatttggtttttatcactctttccctctttaccctttttcttaatcatctgtcctctctaatttaaaacattttccctttctaacccatccattgtctcctcaaattgagctcatcagtatcttatatatctccctcagtaatttgcgtcaacgcaatgaaatataaactagatgtataaaattgctgttttagcttatcttactcttctctatgttttttttttttaaggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttggtaaattcaaatttttctctagtagaaagagctagtgtttatttactgaaggcatattatttgctggtaccagcgctttatatatctcattgaatccttataacctgttaggtagatgctgttattttcttttttagagatgattcaga

SEQ ID NO: 27249 - DNA, 601 bp, Human
cctcaaattgagctcatcagtatcttatatatctccctcagtaatttgcgtcaacgcaatgaaatataaactagatgtataaaattgctgttttagcttatcttactcttctctatgttttttttttttaaggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttggtaaattcaaatttttctctrgtagaaagagctagtgtttatttactgaaggcatattatttgctggtaccagcgctttatatatctcattgaatccttataacctgttaggtagatgctgttattttcttttttagagatgattcagactcagggaaatttgtgcaacttgctcaaagtcatgcagctgagtgactagatgtttctaacgccaaagccatattattccttactgcatactgcattgcactagagcaagggtgggcaaactatggcctttgggtcaaatccagcccacaacttgtttttgtaaataaattt

SEQ ID NO: 27250 - DNA, 601 bp, Human
gagtttgagaccagcctgggcagcatggtgaagccccagctctgcaaaaaaaaaagacaaaaaattagtcaggcatgatggtgcacacctgtagctccagctacctgggaggctaaggtaggaggatcacctgagcccaggaggtcaaggctgcagtgagccatgttcatacccctacacttcagcctgggcgacagagggagactctgtctcaaaaagagaaaaagtttgctgaccctgtgctaaagaatgtggggcagtcatactagatgaatgagaaaaaaaaggagataaaaggaamcaatataaaaagttaaacgtagccataatgaaattttagttagaaaattatttggaagttacttgtggagttgtttagttgcctgcaaattttacataatttataagcccattatttatccatctgaattttattattaaaaaatcttagtataagctttctgatttagtataaagaaatttgtcacatgattgagttttctcgttcttacatgaaaatattgttcatttttttctttctgcagggtttggtgggagctgtttccaaaaggatgttctgaatttggtttatctctgtgag

SEQ ID NO: 27251 - DNA, 601 bp, Human
catactagatgaatgagaaaaaaaaggagataaaaggaaacaatataaaaagttaaacgtagccataatgaaattttagttagaaaattatttggaagttacttgtggagttgtttagttgcctgcaaattttacataatttataagcccattatttatccatctgaattttattattaaaaaatcttagtataagctttctgatttagtataaagaaatttgtcacatgattgagttttctcgttcttacatgaaaatattgttcatttttttctttctgcagggtttggtgggagctgyttccaaaaggatgttctgaatttggtttatctctgtgaggctctgaatttgccagaagtagctcgttattggcagcaggtattaatctctataggtaataatttctgtttagccaggcatagtggttcacacctgtaatcgcagcactttaggaagccaaggcaagagcatcacttgaggccaggaatttgggactggcctgggcaacatagtgagaccccatctctacaaaaattttaaaaattagccaggcatggtgttgcacacctgtagtcctagctacttgggaggctgaggtgg

SEQ ID NO: 27252 - DNA, 601 bp, Human
atttggaagttacttgtggagttgtttagttgcctgcaaattttacataatttataagcccattatttatccatctgaattttattattaaaaaatcttagtataagctttctgatttagtataaagaaatttgtcacatgattgagttttctcgttcttacatgaaaatattgttcatttttttctttctgcagggtttggtgggagctgtttccaaaaggatgttctgaatttggtttatctctgtgaggctctgaatttgccagaagtagctcgttattggcagcaggtattaatctytataggtaataatttctgtttagccaggcatagtggttcacacctgtaatcgcagcactttaggaagccaaggcaagagcatcacttgaggccaggaatttgggactggcctgggcaacatagtgagaccccatctctacaaaaattttaaaaattagccaggcatggtgttgcacacctgtagtcctagctacttgggaggctgaggtgggaggatcacttgagcctaggagttggaggctccagtgactgacttatgatcgctccactgcactgtagcctggacaacagagtgagacc

SEQ ID NO: 27253 - DNA, 601 bp, Human
ataagcccattatttatccatctgaattttattattaaaaaatcttagtataagctttctgatttagtataaagaaatttgtcacatgattgagttttctcgttcttacatgaaaatattgttcatttttttctttctgcagggtttggtgggagctgtttccaaaaggatgttctgaatttggtttatctctgtgaggctctgaatttgccagaagtagctcgttattggcagcaggtattaatctctataggtaataatttctgtttagccaggcatagtggttcacacctgtaatcgmagcactttaggaagccaaggcaagagcatcacttgaggccaggaatttgggactggcctgggcaacatagtgagaccccatctctacaaaaattttaaaaattagccaggcatggtgttgcacacctgtagtcctagctacttgggaggctgaggtgggaggatcacttgagcctaggagttggaggctccagtgactgacttatgatcgctccactgcactgtagcctggacaacagagtgagaccctgtctctgacataataatagtaacagcaataataatagcagtttctgtttag

SEQ ID NO: 27254 - DNA, 601 bp, Human
caggcatagtggttcacacctgtaatcgcagcactttaggaagccaaggcaagagcatcacttgaggccaggaatttgggactggcctgggcaacatagtgagaccccatctctacaaaaattttaaaaattagccaggcatggtgttgcacacctgtagtcctagctacttgggaggctgaggtgggaggatcacttgagcctaggagttggaggctccagtgactgacttatgatcgctccactgcactgtagcctggacaacagagtgagaccctgtctctgacataataatagtaayagcaataataatagcagtttctgtttagcttctcattaagcatgtcactttttgtccatgaaatgtttttgatggaatttatttattccaggaagtcaaaaattagtatattcaatttgcttattttatgtttatttattgggtatctgtgtttttaatttatctttcctgctaatcaatgttgatggaagtttgtgataagccagtattctaatttgctcccagagtaaaacaaaaacaattatccttaattataactcttctctcttttttttttttttttttttgagacaagatctc

SEQ ID NO: 27255 - DNA, 601 bp, Human
gcactgtagcctggacaacagagtgagaccctgtctctgacataataatagtaacagcaataataatagcagtttctgtttagcttctcattaagcatgtcactttttgtccatgaaatgtttttgatggaatttatttattccaggaagtcaaaaattagtatattcaatttgcttattttatgtttatttattgggtatctgtgtttttaatttatctttcctgctaatcaatgttgatggaagtttgtgataagccagtattctaatttgctcccagagtaaaacaaaaacaattatycttaattataactcttctctcttttttttttttttttttttgagacaagatctcactttgtcacccaggctagaatgcagtggtgccatcgctgctcactgcagtgacctcctgtgctcaagcaatcctcccacttcaacctcaacttcaggaacgcaccaccacattggctaatttttttatttaaaaaattttttttgtagagacaaggtctcactatattgcccaggctggtctgaaactcctgggctcagcagtcctcccatctttgcctcccaaagtgctgggaatataagtgtt

SEQ ID NO: 27256 - DNA, 601 bp, Human
tttgcttattttatgtttatttattgggtatctgtgtttttaatttatctttcctgctaatcaatgttgatggaagtttgtgataagccagtattctaatttgctcccagagtaaaacaaaaacaattatccttaattataactcttctctcttttttttttttttttttttgagacaagatctcactttgtcacccaggctagaatgcagtggtgccatcgctgctcactgcagtgacctcctgtgctcaagcaatcctcccacttcaacctcaacttcaggaacgcaccaccacattgsctaatttttttatttaaaaaattttttttgtagagacaaggtctcactatattgcccaggctggtctgaaactcctgggctcagcagtcctcccatctttgcctcccaaagtgctgggaatataagtgttagccagtgaacctagcctaattcttctctatcttgaaaggcataaaatcaaaataaaataagaacctatattataacgttggtcgggcatggtggttcacacctgtaatccctgtacttcgggagcctgaggtggacagatcacttgagggttgggagttcgagactggc

SEQ ID NO: 27257 - DNA, 601 bp, Human
atgtttattgaatgcttaccctgtactgggtactcttttgggcactttgcatacagtatctcatttaatcctcatcactaacattatcctctttatttgatgagggaactgacatggagatattaagtaatttgccccaattactagtcggtatatgtgcctttcccaaatattttccccgagtttataatttttcaggtttcagcagtagatatgggagggaatctaaagaaatgcacgtttctttttttaaaatgttttactttttagagacagggtctcactgtgttgtccagcctasattccaactcttgggctcaagtgatccttccacctgagcctcctgagtagctgggactacaggtgcaccaccctgcctagccggaaatgcacattttaaagtgaaaacagatacaattagtgtcattccagtcaatccatcatgatggctttatctcactgttcattgtgtgaaaaatgcagataaactcttgattttccaacactttgggctaattgcttaagctctcagggtttgattgagatggtccctgaaagcttaaagccttaaaaaagtttcttttgctttgcccacctggtt

SEQ ID NO: 27258 - DNA, 601 bp, Human
attatcctctttatttgatgagggaactgacatggagatattaagtaatttgccccaattactagtcggtatatgtgcctttcccaaatattttccccgagtttataatttttcaggtttcagcagtagatatgggagggaatctaaagaaatgcacgtttctttttttaaaatgttttactttttagagacagggtctcactgtgttgtccagcctagattccaactcttgggctcaagtgatccttccacctgagcctcctgagtagctgggactacaggtgcaccaccctgcctagcyggaaatgcacattttaaagtgaaaacagatacaattagtgtcattccagtcaatccatcatgatggctttatctcactgttcattgtgtgaaaaatgcagataaactcttgattttccaacactttgggctaattgcttaagctctcagggtttgattgagatggtccctgaaagcttaaagccttaaaaaagtttcttttgctttgcccacctggttaccaacctaaatttaacagattaagtgatcagagactcttataacatttagttagttaaaaaaccttgtcaaatagttgtgg

SEQ ID NO: 27259 - DNA, 601 bp, Human
gccaaatgaaattagaaatttttagaatggctttttttttttttttaaatttacggcagggtctggctctgtcgcccaggctggagtgcagtggcatgatctcggctcactgccacctctgcctcctgtgctcaagccatcccacctcagcctcccaagtagctgggactacaggcacatgccaccttgcctggctaatttttgtattttttgtagagacagggtctcgccgtggtgcccaggctggtcttgaactcctgagctcaagcaatcgcccacctcggcctcccaaagtgctggrattacaggtatgagctaccactgctggcctaggatggctttaaggaaggggatgagtgatttttttttttttttaatccataggcactagagtttggttaatttttgcctcttgttaatatgtaagcattgtatttgtacaatagcactcaccataaaattctgagtaatgtgtgtcataggctgtgcctcttttaactaatcattgcacaattgtacatgtaatttcaggtcatagacatgaatgactaccagaggaggaggtttgcttcccggatcatagatagtctgtttaatacag

SEQ ID NO: 27260 - DNA, 601 bp, Human
cccaggctggagtgcagtggcatgatctcggctcactgccacctctgcctcctgtgctcaagccatcccacctcagcctcccaagtagctgggactacaggcacatgccaccttgcctggctaatttttgtattttttgtagagacagggtctcgccgtggtgcccaggctggtcttgaactcctgagctcaagcaatcgcccacctcggcctcccaaagtgctgggattacaggtatgagctaccactgctggcctaggatggctttaaggaaggggatgagtgatttttttttttttttaatccataggcactagagtttggttaatttttgcctcttgttaatatgtaagcattgtatttgtacaatagcactcaccataaaattctgagtaatgtgtgtcataggctgtgcctcttttaactaatcattgcacaattgtacatgtaatttcaggtcatagacatgaatgactaccagaggaggaggtttgcttcccggatcatagatagtctgtttaatacagtaactgataagaagatagctattttgggatttgcattcaaaaaggacactggtgatacaaggtatcagttttta

SEQ ID NO: 27261 - DNA, 601 bp, Human
cacctcagcctcccaagtagctgggactacaggcacatgccaccttgcctggctaatttttgtattttttgtagagacagggtctcgccgtggtgcccaggctggtcttgaactcctgagctcaagcaatcgcccacctcggcctcccaaagtgctgggattacaggtatgagctaccactgctggcctaggatggctttaaggaaggggatgagtgatttttttttttttttaatccataggcactagagtttggttaatttttgcctcttgttaatatgtaagcattgtatttgtacartagcactcaccataaaattctgagtaatgtgtgtcataggctgtgcctcttttaactaatcattgcacaattgtacatgtaatttcaggtcatagacatgaatgactaccagaggaggaggtttgcttcccggatcatagatagtctgtttaatacagtaactgataagaagatagctattttgggatttgcattcaaaaaggacactggtgatacaaggtatcagtttttaaaaatatttcaacccttttgagattgtgttaactcctcatcttaattttttgattggggtaggtgtac

SEQ ID NO: 27262 - DNA, 601 bp, Human
tacatgtaatttcaggtcatagacatgaatgactaccagaggaggaggtttgcttcccggatcatagatagtctgtttaatacagtaactgataagaagatagctattttgggatttgcattcaaaaaggacactggtgatacaaggtatcagtttttaaaaatatttcaacccttttgagattgtgttaactcctcatcttaattttttgattggggtaggtgtacataaaatacatgtatatatataaaatataaagaataaaaataaatatccatatcttcaccactctaccagcttmagaaatataattttacctgtatcttaaactccctggtattagaatataatgccacataaagcttaccaatactgattttttttttcctatagagaatcttctagtatatatattagcaaatatttgatggatgaaggtgcacatctacatatatatgatccaaaagtacctagggaacaaatagttgtggatctttctcatccaggtgtttcagaggatgaccaaggtaaggctttgagtctcatgaatcattttgagtccagacctgaaaactttttatcttttggaaaccttaggttg

SEQ ID NO: 27263 - DNA, 601 bp, Human
taactgataagaagatagctattttgggatttgcattcaaaaaggacactggtgatacaaggtatcagtttttaaaaatatttcaacccttttgagattgtgttaactcctcatcttaattttttgattggggtaggtgtacataaaatacatgtatatatataaaatataaagaataaaaataaatatccatatcttcaccactctaccagcttcagaaatataattttacctgtatcttaaactccctggtattagaatataatgccacataaagcttaccaatactgattttttttttcctatagagaatcttctagtatatatattagcaaatatttgatggatgaaggtgcacatctacatatatatgatccaaaagtacctagggaacaaatagttgtggatctttctcatccaggtgtttcagaggatgaccaaggtaaggctttgagtctcatgaatcattttgagtccagacctgaaaactttttatcttttggaaaccttaggttgttcagttttatcatgtatatcattggtaggccctcttttcaacctcatttctctgaaattaaagtcttaggcataatgtcatcaa

SEQ ID NO: 27264 - DNA, 601 bp, Human
tcctataccttctgagtactcagcactgtgccagtgctgtgaggggtctgaatgaaacatatgggagtttcaatggtactggccctcttctgattcaaagtttgtcaactggccaggcatagtggttcacacctgtaatcccagcactttgggaggctgtggaggtagaccacttaaggccaggagttcgagaccagcctagccaacatggtgaaaccccgtgtctattaacaaatacaaaaattgctgggcgcggtggctcacgcctataatcccagcactttgggaggctgaggcgggyggatcacaaggtcaggagttcgagaccagcctggacaatactgtaaaaccccatctctactaaaaatacaaaaattagctgggtgtggtggcacacacctgtaatcccagctactttggaggctgaggcaggagaatcgcttaaacctgggaggcggaggttgcagtgagccaagatcacaccactgcactccagcctgggtgacagagcaagactccgttttgggaaaaaaaaataataaaaattagtcaggcttggtggcctgtgcctgtaatcccagccacatgggaggctgacgtg

SEQ ID NO: 27265 - DNA, 601 bp, Human
ggtgaaaccccgtgtctattaacaaatacaaaaattgctgggcgcggtggctcacgcctataatcccagcactttgggaggctgaggcgggcggatcacaaggtcaggagttcgagaccagcctggacaatactgtaaaaccccatctctactaaaaatacaaaaattagctgggtgtggtggcacacacctgtaatcccagctactttggaggctgaggcaggagaatcgcttaaacctgggaggcggaggttgcagtgagccaagatcacaccactgcactccagcctgggtgacagarcaagactccgttttgggaaaaaaaaataataaaaattagtcaggcttggtggcctgtgcctgtaatcccagccacatgggaggctgacgtgggaggattgcttgagcccagcaggcagaggttgtaatgagctgagatcatgccattgcatgccagcctgggtgacagagcaagaccctgcctcaaaaaacaaaaaacagtttgtcaattatggaacatttggaaagctgacagaagcctccacccagaacagtgtttttgtatgttacatctatttcagttctccaaggagtcccaaag

SEQ ID NO: 27266 - DNA, 601 bp, Human
aattcatgactgttgaagtagtagtgtttttaatgataagatgatgattttgaatatatggaataaatgaaaaatgtaataggcaaaaccaaaattgattatcatttagtgaaggctggcttgctgtatgctaagcactttacctaatttaatacttaccacgaccctttgagttaagtggtggtaacacaatttacaagtgaggaagaaagacctagagagtttaggtaatgcagcaagtgccagtcaggattccagctggggcctttcagactctgaagtctgaattcttaagaattaygctggccgggtgcggtggctcacgcctgtaatcccagcactttgggaggccgaggcgggcggatcatgaggtcaggagatcgagaccatcctggctaacacggtgaaaccccatctctactaaaaatacaaaaaaattgccgggcgtggtggcaggcacctgtggtcccagctgctcgggaggctgaggcaggagaatggtgtgaaccgggaggcagagcttgcagtgagccgagatcacgccactgcactccagcctgggcaacagagcgagactccatctcaaaaaaaaaaaaaaatt

SEQ ID NO: 27267 - DNA, 601 bp, Human
gtgccagtcaggattccagctggggcctttcagactctgaagtctgaattcttaagaattatgctggccgggtgcggtggctcacgcctgtaatcccagcactttgggaggccgaggcgggcggatcatgaggtcaggagatcgagaccatcctggctaacacggtgaaaccccatctctactaaaaatacaaaaaaattgccgggcgtggtggcaggcacctgtggtcccagctgctcgggaggctgaggcaggagaatggtgtgaaccgggaggcagagcttgcagtgagccgagatcrcgccactgcactccagcctgggcaacagagcgagactccatctcaaaaaaaaaaaaaaatttatgctgttggcagggcacagtggctcacgcctgtaataccagcactttgggaggccaaggcggatggatcacgaagtcaggagttcgagaccagcttggccaacatagtgaaaccccgtctctactaaaaatacaaaaacattagcctggtgtggtggcgggcgcttgtaatcctagctacttgggaggctgaggcgaggagaatcgcttgaacctgcgaggcagaggttgcagtgag

SEQ ID NO: 27268 - DNA, 601 bp, Human
gagccaccacgcctggcccatgaaccaagtgtttttaaggaaacaaaactatttttttaatcatcagatttatactagctatatggatattagcatatctggtaattatgaatctagaatttttttacatatttttataatactgttagctcagttattggatgagtgaaagataatcatgttggttttaatagtgtcaatttttgtaaaataaaaattaaacttcaaactctttactttataaattgtccataggccacactttaatatcacattataaagggaaggacagtcttcattyctcctggttattggtttgtttgtcattaaagatatattttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagattttttttttaatcatgaagagaaaattagtagcatttctttctctccccattatttattggttttcctcactaatcttttttttttagtccaaaagccaaaaatattt

SEQ ID NO: 27269 - DNA, 601 bp, Human
ccataggccacactttaatatcacattataaagggaaggacagtcttcattcctcctggttattggtttgtttgtcattaaagatatattttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagattttttttttaatcatgaagagaaaattagtagcatttctttctctccccattatttmttggttttcctcactaatcttttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgttttctgtctgcttttttcttatgtctcttgttgagttttatattttcagtggttatttttgcttgtgttagatcattattaaaatatatccaatgtccctttgatact

SEQ ID NO: 27270 - DNA, 601 bp, Human
aaagggaaggacagtcttcattcctcctggttattggtttgtttgtcattaaagatatattttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagattttttttttaatcatgaagagaaaattagtagcatttctttctctccccattatttattggttttcctcactaatcttttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgttttctgtctgcttttttcttatgtctcttgttgagttttatattttcagtggttatttttgcttgtgttagatcattattaaaatatatccaatgtccctttgatacttgtgctctgctgagaatgtacagtttgca

SEQ ID NO: 27271 - DNA, 601 bp, Human
accccaaatatggttaaaagattttttttttaatcatgaagagaaaattagtagcatttctttctctccccattatttattggttttcctcactaatcttttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgttttctgtctgcttttttcttatgtctcttsttgagttttatattttcagtggttatttttgcttgtgttagatcattattaaaatatatccaatgtccctttgatacttgtgctctgctgagaatgtacagtttgcattaaacatcccaggtctcatccttcaggaattttgcagttcaatgagaagagggagacaaatataaagatgaggacagaagcatctctacagatgaaaattacataaataaaacattctccatcaacaactatatgggtgtaatttttgtcaattcacaagtaactgagtcatgacagcctgacattagatgg

SEQ ID NO: 27272 - DNA, 601 bp, Human
ttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgttttctgtctgcttttttcttatgtctcttgttgagttttatattttcagtggttatttttgcttgtgttagatcattattaaaatatatccaatgtccctttgatacttgtgctctgctgagaatgtacrgtttgcattaaacatcccaggtctcatccttcaggaattttgcagttcaatgagaagagggagacaaatataaagatgaggacagaagcatctctacagatgaaaattacataaataaaacattctccatcaacaactatatgggtgtaatttttgtcaattcacaagtaactgagtcatgacagcctgacattagatgggaaaaaaatgacacctcactttttagagaaaatggtatatcattctctcaaatgatgcaacaaagggagggaatttagcaaataaacattggcaaactgt

SEQ ID NO: 27273 - DNA, 601 bp, Human
atgctacacgcagaaggagtccccactcctgttaattgcagagaatgcagtaaaccccaagcacagcaatgaggggacgggatggaggaacagagaaagctaagggtagcctctgccctcctactccccaggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggtgaggagtagaagtcagrttggcaggtgggggaggcaacgggcccagcagggagggaagcccccccagccagttctgacttcaccctgccttgccactaaccccccactctccctgcaggccagttctacgtcatgatgacgccccaggatgtgcttcagacaggaacacagaggacgatcgccccccggacacacccttactctccgtatgtgcaggggacacctggagggcctggtgttgaaatggaaggaagaggggtttctggagtagaagctgggcagttagcatgaagtgggcacatggtgtaatgtttttt

SEQ ID NO: 27274 - DNA, 601 bp, Human
ttggaactggccatttgttgacccggctggtgatcttgaattcatggcccacatctaagatggtggacttcacactcccatacggattgcctgccccacttgaaaaatggggctgaccgggctcacgtgggctgacctttccacgtggcagctgtcatgctcacatcccgcactcccatgcctgcctggcctccagaagtaggtctgttcccccagggagcacatctgagggagaaactgcatgaagttctgcctctggctacctaaggccggagcatcctgccctttccagaaacaccargtctcacctcaggtcatttggccttcagcactgtcccgccccgcctgtcagtagccactgcagtgggcacagcactgtgcaagtgccaggagagtgcttacacccaaacaaccatcattcaacaaatatttactgcccgtgggttctgggctgagcggcacaggccctgtgccaggtctggagtctggcctggagcgtcagggaggctcaaaggcctgagggcttatgtctcatgggtctcatgggacattgatggggggtgggctggggtgacgcttccctagggagaggggagtgtgg

SEQ ID NO: 27275 - DNA, 601 bp, Human
tgcagagcatctgccccaatctgctcatcctcccagtaccctcagccatctggctcatggctctaccaaaacagctccacttccggtcacccgtggtgaccccattgccacatccactggcctcctttgctgtctgggctccaagcatctgatgctgcctgtttccctctgttcctttctggaatcttcctttctcctccatcctctctgattctcctgtgatctttgcctttcctaccccactgttaacagtgaaatttccagggctgtcccagttccaagtgagtagatgggggtgccrgggaatctgtgttttccatcagctcttcaggtgatttgtcatagtggacaagcttgagaaactgctttggctgcgagtgtttctttttttttgagaagggggtctcactctgtcacccaggctggagtacagtggcacaatcacagctcactgcagccttgacctcccaggctcaagcgatcctcacacctcaggcttctgagtggctgggaccacaggcaggcgtcatcacatggggtaatttttttttatctgtagagtggaggtcttgctatgctgcccaggctcgtcttgaacttc

SEQ ID NO: 27276 - DNA, 601 bp, Human
ctttctggaatcttcctttctcctccatcctctctgattctcctgtgatctttgcctttcctaccccactgttaacagtgaaatttccagggctgtcccagttccaagtgagtagatgggggtgccggggaatctgtgttttccatcagctcttcaggtgatttgtcatagtggacaagcttgagaaactgctttggctgcgagtgtttctttttttttgagaagggggtctcactctgtcacccaggctggagtacagtggcacaatcacagctcactgcagccttgacctcccaggctyaagcgatcctcacacctcaggcttctgagtggctgggaccacaggcaggcgtcatcacatggggtaatttttttttatctgtagagtggaggtcttgctatgctgcccaggctcgtcttgaacttctggcctcaggcagtcctccggcctcggctacaggcctgagctgccacacccagtcttgctggtgtttcataaggtccggcccctcccgtcggcctcaggtgtatgacttgtgaggcccagcgatgggctcggaagctcttggtcagtatcccccaaactctgttcccccttgta

SEQ ID NO: 27277 - DNA, 601 bp, Human
ccatcagctcttcaggtgatttgtcatagtggacaagcttgagaaactgctttggctgcgagtgtttctttttttttgagaagggggtctcactctgtcacccaggctggagtacagtggcacaatcacagctcactgcagccttgacctcccaggctcaagcgatcctcacacctcaggcttctgagtggctgggaccacaggcaggcgtcatcacatggggtaatttttttttatctgtagagtggaggtcttgctatgctgcccaggctcgtcttgaacttctggcctcaggcagtcstccggcctcggctacaggcctgagctgccacacccagtcttgctggtgtttcataaggtccggcccctcccgtcggcctcaggtgtatgacttgtgaggcccagcgatgggctcggaagctcttggtcagtatcccccaaactctgttcccccttgtaggtgttcctcttttttctttgctgcagaagagtgtgtgactcacaaaaagttgaggactgttccttgatgtcctcccaggcttcgcccaccacctggctcctggtaatgcaaggaactgtgtttccatccattcccttcctt

SEQ ID NO: 27278 - DNA, 601 bp, Human
cagctcttcaggtgatttgtcatagtggacaagcttgagaaactgctttggctgcgagtgtttctttttttttgagaagggggtctcactctgtcacccaggctggagtacagtggcacaatcacagctcactgcagccttgacctcccaggctcaagcgatcctcacacctcaggcttctgagtggctgggaccacaggcaggcgtcatcacatggggtaatttttttttatctgtagagtggaggtcttgctatgctgcccaggctcgtcttgaacttctggcctcaggcagtcctccrgcctcggctacaggcctgagctgccacacccagtcttgctggtgtttcataaggtccggcccctcccgtcggcctcaggtgtatgacttgtgaggcccagcgatgggctcggaagctcttggtcagtatcccccaaactctgttcccccttgtaggtgttcctcttttttctttgctgcagaagagtgtgtgactcacaaaaagttgaggactgttccttgatgtcctcccaggcttcgcccaccacctggctcctggtaatgcaaggaactgtgtttccatccattcccttcctttcac

SEQ ID NO: 27279 - DNA, 601 bp, Human
cccaggctcgtcttgaacttctggcctcaggcagtcctccggcctcggctacaggcctgagctgccacacccagtcttgctggtgtttcataaggtccggcccctcccgtcggcctcaggtgtatgacttgtgaggcccagcgatgggctcggaagctcttggtcagtatcccccaaactctgttcccccttgtaggtgttcctcttttttctttgctgcagaagagtgtgtgactcacaaaaagttgaggactgttccttgatgtcctcccaggcttcgcccaccacctggctcctggtmatgcaaggaactgtgtttccatccattcccttcctttcactgcaactccagccccacgttttgaactacctattcgagatttctgtctctggacatccctgtaatgcctcaaactcaactcgcccaaaagagaatgtgccatctcccgtctccaaaggctttcatgcaaccttcttctttgcagagcagcaaaagctacccctgtcacagctgcccaagccagaaactaagaccagagccgctttcaactctgccctcttcttcccttatggccacaaaccccaagtttctcttctgtgg

SEQ ID NO: 27280 - DNA, 601 bp, Human
ttgctggtgtttcataaggtccggcccctcccgtcggcctcaggtgtatgacttgtgaggcccagcgatgggctcggaagctcttggtcagtatcccccaaactctgttcccccttgtaggtgttcctcttttttctttgctgcagaagagtgtgtgactcacaaaaagttgaggactgttccttgatgtcctcccaggcttcgcccaccacctggctcctggtaatgcaaggaactgtgtttccatccattcccttcctttcactgcaactccagccccacgttttgaactacctattcragatttctgtctctggacatccctgtaatgcctcaaactcaactcgcccaaaagagaatgtgccatctcccgtctccaaaggctttcatgcaaccttcttctttgcagagcagcaaaagctacccctgtcacagctgcccaagccagaaactaagaccagagccgctttcaactctgccctcttcttcccttatggccacaaaccccaagtttctcttctgtggtgatttcagatccgcttctctcacttctttttccctccttcccaccacttcttggtactgcaggagcttatcccag

SEQ ID NO: 27281 - DNA, 601 bp, Human
ttagccaggcctggtggtacatgcctgtaacagtcccagctacttgggaacctgtggtgggaagatggcttgagtccgggagacagaggttgcagtgagctgagattaccctccagcctgagcaacagacccagaccttgtgtcagaaaaagataggaaaggttgtggggggcccccagtgatctggggcatgtgtgcgctgcctgaagggtggcccttgcccagtgccttccccttgctgccctgtcagaatctagggccactgttgccagaaactctgagaagctagaaatcgagacttatgtgaaatctgatttttaggtgccagattagattgctttttccgtttcattgatttctactcttaatgttactaattcatgcttctactcacttggttttttgtttgtttgttgttttgttttgagatggaatctcgctctgtcacagtggcgcaatctcagcttactacaacctctgcctccccggttcaagtgattctcctgcctcagtctcccaagtagctgggactacaggtgcccgctgccacacctagctagtttttgtatttttggtagagacggggtttcaccatgttggc

SEQ ID NO: 27282 - DNA, 601 bp, Human
cttccctggcacaccccaaccccagctttttaaggtaattctttttttttttttttttccaattttctactaaaatctttattttacaggattaatgtttcacagcagggattgagatgattcttaacctttctctttgcttaacaacatttagagttgccagttcactccagcatcactttagctacatcccactgggatatgttgtttttgttatcattcagtttaaagtgttttccaattttccttgtgatttcttctttgacctttctgttatttggaggcaggttgcttaatttcyaaatatttgtgggtttttcagatatctttttgttattgatttttaatttagttctgttatggtcagagaacatactctgtatgatttcagttccttgaaattcgatgagacttacccgacgggcccgaatgtgtcctagcttggcggaagcttctggggcattgacgaggacaggtgtctgctgctgtcaggcagaatgtccccccaggtcagtgaggtcaggctggttgagtgttcaggctttctattctgatttttgttgttgttgtttacttgttccaccaatcaatgagaaagatg

SEQ ID NO: 27283 - DNA, 601 bp, Human
accccctggccttcctgccacatgtgccctagctatagggcttcgttcccctccacaaatggtgcagacagcatgagccaccctggcagggggctgggggtccgtggggtaggagttgggggtagctgagcgttctttcctgtccccacggtgcctggtgctggggcttggcagccagggttgggacagcctggctttagcaggtcctgagtcaggggtctcaggctccgcagcacacagtccccaggcaggtgtcaggatgggatgtggccagagaaaggcatgtgctctgtctggggayagctgccacccagctgacacagttggcatgagattgtggagttttatggagtaaaatcacaaatctgggttttttaagtaaaaccttctatgagttgccatctctggccttcaacataggatttgggtctttcctgggtgagctggtgctttgtgggccaggccctgggagctgcaagtaccagttgggatctgccattgccctgtggaaggattttaagcaggggtgaaacatggtcagacttggatttagagatgaggaaaaaaaacaaaatcacggtgccagagtctctggggagac

SEQ ID NO: 27284 - DNA, 601 bp, Human
gtagctgagcgttctttcctgtccccacggtgcctggtgctggggcttggcagccagggttgggacagcctggctttagcaggtcctgagtcaggggtctcaggctccgcagcacacagtccccaggcaggtgtcaggatgggatgtggccagagaaaggcatgtgctctgtctggggatagctgccacccagctgacacagttggcatgagattgtggagttttatggagtaaaatcacaaatctgggttttttaagtaaaaccttctatgagttgccatctctggccttcaacataggrtttgggtctttcctgggtgagctggtgctttgtgggccaggccctgggagctgcaagtaccagttgggatctgccattgccctgtggaaggattttaagcaggggtgaaacatggtcagacttggatttagagatgaggaaaaaaaacaaaatcacggtgccagagtctctggggagactggagaatgcagtgcaggggccgcaggagccaaaaaggggcactggtcctgcgaagagtggctctgtccatccctgccttccagtatgtgcccactgtgaccagagctccatttctcaaaa

SEQ ID NO: 27285 - DNA, 601 bp, Human
gcccactgtgaccagagctccatttctcaaaagaagccagtgatgccaattaccatgagaaatttccttatttttaactgtcgattaaaatttgtacaagtatggtggggcaggcctgcaaaatgatctccaagtgcctggcctttgatgcccgtcctaaaagcatgtgtggcactggagggcccacgtttctttgttcctcttgagaagctggggtgggggccggctgggctcagggtgcggcccctcacttcccagggctgtggtctcggtggggcctgcactgttcctgggtgtcctygggctgagcctctgccctgtgaggacggccgctcaggcatgatccgtcagcgaagccgtggctgtgactctgttttccgcagtggagcggaggcggagggacaagatcaacaactggatcgtccagctttcgaaaatcattccagactgtaacgcagacaacagcaagacgggagcggtgagcaccccggaccctcagtgtctgcggtggtcccggcccccgacccttgcatgcagaaagtccaacagccatggggctcgggagtcatccctggggtggaggccggtgggcggtgcctgc

SEQ ID NO: 27286 - DNA, 601 bp, Human
tgccaattaccatgagaaatttccttatttttaactgtcgattaaaatttgtacaagtatggtggggcaggcctgcaaaatgatctccaagtgcctggcctttgatgcccgtcctaaaagcatgtgtggcactggagggcccacgtttctttgttcctcttgagaagctggggtgggggccggctgggctcagggtgcggcccctcacttcccagggctgtggtctcggtggggcctgcactgttcctgggtgtccttgggctgagcctctgccctgtgaggacggccgctcaggcatgakccgtcagcgaagccgtggctgtgactctgttttccgcagtggagcggaggcggagggacaagatcaacaactggatcgtccagctttcgaaaatcattccagactgtaacgcagacaacagcaagacgggagcggtgagcaccccggaccctcagtgtctgcggtggtcccggcccccgacccttgcatgcagaaagtccaacagccatggggctcgggagtcatccctggggtggaggccggtgggcggtgcctgccctaaggctcctggtcccctcgccccccagagtaaaggaggga

SEQ ID NO: 27287 - DNA, 601 bp, Human
accacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtccygctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgccttgtctgcttgtgtgtttgtccatctcaggagtggggagggggcctggggtc

SEQ ID NO: 27288 - DNA, 601 bp, Human
aaagaaggtaaattaaattagctcaactcaagtacacgatgacatcagaatgaacaagagatgtttatgttttaatctactgaccataagaatgaaaaagagatgcttattttttaacctaatgacatcagaataaaaaaagaggtttatttttaacctaattttgcttttgttttacatttatgtggttcaaatatcaaagtgctgcaaaaagatatacctgataagtcttcctcctaacctggttcccatccactctaccgctcctcaccctctaagagtaatcatttctattggttaycaaaatagaaaaaaattttaccctgaaaatagaaattggtagctaggattttggctctttttcagttttgtagcattacgcatctttcattgctccactgtaagcagtgaattaatcagaccttttgtctgactgtgactgctgggttcccattctgtttaatgcatacagtgtctttcacctcttctcgcccctaccaataaataattaactttgtcttaccatacttgtttcatgcctccccattggtgcagtattcttctggaaagtgatgattcctctagaaaagtgggggaagaa

SEQ ID NO: 27289 - DNA, 601 bp, Human
aaaataaattgatgtttcccttctgatctaagttatctttggctagtacatctgatcatgcactcataggtagcatagatttttagagccaggaaggtattcttagagatgaggaattgagacccagagaaggtaacttgcatgaagtctcaggactagacaactttctcttgtttaaatgtagtttgtaagattttgttctactgcccaatctatactttccagaaacatcttaaaccagaaacatctggtttaaaacattgacttgcaggtggaaatgaggttagaaaggggatggagygggaagacaggtgttggtggagggagaagggagagtatggtgggcagtcatggagagaggttcttattccccatatttaaaattttcaagagcctaggattgcaggactttacttttttaaccgaagttcctcttgattgtccatagaaggaggtcattattattcacaggtgttctgaggcctaaatctatgtttaatttaaggagtgtttcagttcctaggaaagcacgtacaaatggtttagcttgtcgttccatcttttggtatgcagggaagagtgccaaggcactgtatttttt

SEQ ID NO: 27290 - DNA, 601 bp, Human
ttttacagagaagaatactcaaatgaaggtgcagtttttctctcttctatttcatatctgaattatactgacctgaaatatacagacctacatgacaaggtttagcaaaatggtttgtggtacaaagcatggctgaccacaagggttacgattattttcaccctttataaatatatccccaaattgacttctgtcctagttgtccagtgaatttgtttatgtcatattcattgtttgtatacttacatgcttatgacagaattctgtcaattctataataaatattgcctttcaaaagaartatatatgaaagtcttaggagaaaaaaattcccttagacatgtttgtttttactagatatgactaacataaaatggttacttataacctactgttttccagaaagaatttaagatggctctttcagttattgttttaaatctctgaaattgtctaaaattaatgctgttaaaaattttggtaacttattgaaagtcgcagttattaaatgcagcttcattcaaaattggctattggttccttttaggggaaaatgaacatctcttaattttaacttcttgacggtgtcacacctcccact

SEQ ID NO: 27291 - DNA, 601 bp, Human
aattaggtttgtaggagtcagttcctgtttcttaatttgtagtattatttaaatgacatttaaatttgagattcaatgaggtaaggagggggaaagtagctaaaacagaacctaacatgcagggaatgcatattaaattcaatgcatgtcagttgaatttagtttcctaactagtagcctttaatgttagagtagacataaaaatttctgaccttcgtttccctttgaatttagatttttgaaatgtaataaatacctattgcttttctcactgaaaataaaagtgtgttaggaaaatggtttaacaggttttaagtgaaatatttttacattgacataattattctccaggatgtccacacacttcctaagtaagagtttgtgattaaaagaaaacctatgcctagataacttgtgttagatcctgaaggctacccagttctctgaggttaggagttgcctggcctcaagtcttttaaaaagttattgattcaggccttgctaatttggaattaagctaaagttgacctttgcattaattttgaaggcaacgttttctgcacaaattaatttaagacatgataggagagatttgctgata

SEQ ID NO: 27292 - DNA, 601 bp, Human
atgcatgtcagttgaatttagtttcctaactagtagcctttaatgttagagtagacataaaaatttctgaccttcgtttccctttgaatttagatttttgaaatgtaataaatacctattgcttttctcactgaaaataaaagtgtgttaggaaaatggtttaacaggttttaagtgaaatatttttacattgacataattattctccaggatgtccacacacttcctaagtaagagtttgtgattaaaagaaaacctatgcctagataacttgtgttagatcctgaaggctacccagttmtctgaggttaggagttgcctggcctcaagtcttttaaaaagttattgattcaggccttgctaatttggaattaagctaaagttgacctttgcattaattttgaaggcaacgttttctgcacaaattaatttaagacatgataggagagatttgctgatattcaaaccatttgagaatcaaagcacttaaaaataccacatatcttcttctaattacaagtggattttgaaatagatcctcttatgattctgccttttattgacagctaccatggttacatataacttgataataaaaata

SEQ ID NO: 27293 - DNA, 601 bp, Human
acctctaatcacggaggagtaagtcatactgagctgggcattctttgcaaaatttttggttctccccttccctgaatccaaaaggtaattattttgaatgaaagttcttctcttccagttcccattgagcagacttccatttatgtcaacagagttcttaattaagcagattaaatcatgatgccaatgagaattggaaagttgactgtataaagataagacccaaataggttattgaactaggctttattgattttctaatctaatatttattctgttttagattaatatttgaatgaatgtgaaaaacctaaagtaggttggaggtgctaaatactattaaattgttagagtctgttttcatcatccatattcttaccacaagctacttagtatctccaaatagatacagttccaagtatctttttttgcgtgtctgttgttgaaacctcaccctatggtttaagggcactgcttggctgttagctatcagatatgttgccttctattcactcgtcttgtttaaaatcatccattccttggtgaatgaaatgacttgtaaagtatcctctctaaataatgaatgtgtcaacaatgtaga

SEQ ID NO: 27294 - DNA, 601 bp, Human
agcctgctgtgagccatgatctcaccactgcattccagccagggtgatggagcaaaacccctctcaaaacaaaaaacaaacaacaacaaaaaattgcttgtaacagtacctggcagaattaggactcaaaagatagtattactactagtttgactataactgtttcagctgctcctacaacaaacatggctgcctgggcccacccagttccagaggaaactggtgttttcagaggtggcaggcagagggtgccgctaacctagtgatgattgattgagctccgctaaccaaatgattgatytgagctttactgatgcaaactcatatttaatgtcttaactaggacaaaataatctgaatgtaaattattaatttcttatgtaagggccaaataaataaaccactcctttcaaaccaaattaatagtaatcaggagcaatttgtcatcctattagcatttgtcattagcagctaagtgatctcaatgtaaatagtgtttatgtgtgacaggatggctgtctttttctctgtagggggaaaggagattctccagaggctcgagccttggccaaacaggtggccacggccctgcagaacctgc

SEQ ID NO: 27295 - DNA, 601 bp, Human
actgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatcttagttttgaaagtagaaaaaattagtaaagcaatccccttgccacatacacacataactaggaaaatatttggataatcttttttttttttttttttgagggacagagtttcgctcttgtcamccaggctggagtccaatggtgtaatctcagctcactgcagcctccacttcctgggttcaagtggttctcctgactctgcctcctgagtagctgggattacaggcacccgccaccatgcccggctaatttttctattttttagtagagacagggtttctccatgttggccaggctggtcttgaactcctgacctcatgatccgcccacctcggcctcccaaagtgctgagattacaggcatgagctactgcggccggcttggataatcttaagaggctactttgttttgattttggagttt

SEQ ID NO: 27296 - DNA, 601 bp, Human
tagagacggggtttcaccttgttagccaggatggtctcgatcttagttttgaaagtagaaaaaattagtaaagcaatccccttgccacatacacacataactaggaaaatatttggataatcttttttttttttttttttgagggacagagtttcgctcttgtcacccaggctggagtccaatggtgtaatctcagctcactgcagcctccacttcctgggttcaagtggttctcctgactctgcctcctgagtagctgggattacaggcacccgccaccatgcccggctaatttttctattttttagtagagacagggtttctccatgttggccaggctggtcttgaactcctgacctcatgatccgcccacctcggcctcccaaagtgctgagattacaggcatgagctactgcggccggcttggataatcttaagaggctactttgttttgattttggagtttatatcttttctccacatctttgtgagagttttttttttttttttaaattgatctgtttctataactttcttttttctacttattgtgtaacaaggcatggctagtaagtttgggagcaaaggaagattgggaaaa

SEQ ID NO: 27297 - DNA, 601 bp, Human
gtaaagcaatccccttgccacatacacacataactaggaaaatatttggataatcttttttttttttttttttgagggacagagtttcgctcttgtcacccaggctggagtccaatggtgtaatctcagctcactgcagcctccacttcctgggttcaagtggttctcctgactctgcctcctgagtagctgggattacaggcacccgccaccatgcccggctaatttttctattttttagtagagacagggtttctccatgttggccaggctggtcttgaactcctgacctcatgatccrcccacctcggcctcccaaagtgctgagattacaggcatgagctactgcggccggcttggataatcttaagaggctactttgttttgattttggagtttatatcttttctccacatctttgtgagagttttttttttttttttaaattgatctgtttctataactttcttttttctacttattgtgtaacaaggcatggctagtaagtttgggagcaaaggaagattgggaaaaaaaaccaaactgtacagttattaaaagtttactatgtgataggttttcttaaaaatattagctcaac

SEQ ID NO: 27298 - DNA, 601 bp, Human
agctcactgcagcctccacttcctgggttcaagtggttctcctgactctgcctcctgagtagctgggattacaggcacccgccaccatgcccggctaatttttctattttttagtagagacagggtttctccatgttggccaggctggtcttgaactcctgacctcatgatccgcccacctcggcctcccaaagtgctgagattacaggcatgagctactgcggccggcttggataatcttaagaggctactttgttttgattttggagtttatatcttttctccacatctttgtgagagttttttttttttttttaaattgatctgtttctataactttcttttttctacttattgtgtaacaaggcatggctagtaagtttgggagcaaaggaagattgggaaaaaaaaccaaactgtacagttattaaaagtttactatgtgataggttttcttaaaaatattagctcaacattatttagtgtgatgtttgtgcaatttttcttctattcaaattatagaaaattcattattttttcatttatttattcagacatttactgagtgcctatgatacattcgaaactatgctaggcttta

SEQ ID NO: 27299 - DNA, 601 bp, Human
tgaaaagagacttgccactttctggctttacagtgccatctgtaggtaaagaggagaaagcttggctgaaggtttgtatctggagagcaagggtgctctggtgtttaaaggtgttttgtcattgtcaggtggtctcggctgctcgtatcttacttaggaaccctggaaatcaagctgcttatgaacattttgagaccatgaagaaccagtggatcgataatgttgaaaaaatgacaggtagagttttctatacaaatcttgttgtctaatccatgaagaatgagttctgagaaattggagygggactggttctgttactcagctgtaattggataaagggccggtcacgtgctgagcagtgtacttggctctgcttaaggctgctgagcagtggcggcttctcattcaagccttgcaactttgtcagaagagagactctttgagtctcttttattttaatgctgccctcctggcgtgatgtttattgtcaccactcctatcttctctttgaatagtgtctttgcccagtccgagcccgagtttggtttcagaggctgggaggcggtgtttgtggatacagtaagtgtccctgtcattttca

SEQ ID NO: 27300 - DNA, 601 bp, Human
ccacaatagctaccatttaatacaacttgtctcaaagtttcctccaacttatcaactacgtagtttttttaaaaaggagaaaccaaccaccagcaaacctgtgtctgtgcaattgaagtggcacctctgaatcgtcttcattctctgtaaagggagagataggaaagaaggaatgaggaatgtaggctttttgctgtccctgcagaacctgctgtgactggggtccatggcagcccgagatgaaagtggaactcctgaggtgtctgaagagaggtaacaggaataagaaataggctgttasggttattggaatcctccgcatggctcatcttgagcactacaagctgccaacaagcaacagatggctggggagtgagagggacagggagaaaatattattcacagataacgtggtggtgatgcagtgatggtttcagacatattccttgtttcctcccgatgttgcatttctggttgtctggggtggatacaagaaggctggcaaccacggttggtataaatgctgcaaatccagatgggcttttgggctatgtcctcactgttttttttaactgtggtgtttacctggaagcttttgatt

SEQ ID NO: 27301 - DNA, 601 bp, Human
atctcccatgttctgagttgggcaggcttatctcttgactgcctcatcataagagaggtgatggatgccacctgagcccaaagtgttcatgcccagggatctcctgggtactttttagttgtacagccaagaaggcaccctgaacactaaaagaacagctggtttgtgatgcttccaatgctctgcaggcctcagggcatctgccttgtcctgcctccccccttcttcaatcactgcccgtgatatttactggcagcttcacatccagcttttgttcatggaaccagttctgctgctgcamagacagtgctttggggcactgacccacccagctgaaagtgaggatgtcttgtgtttaggactgcaaaagagcttcctggactcaggatatcggatcctgggagctgtggccaaggtcagagaagccttccaacctcaggagcctgacttcccgccgcctccaccagaccttgaacaactccgagtaagtaaattcagatatgcagagaattgagcaggaaggtgttgagacttcagcaagagagaggtagattgtgttttagagcctccatcactaggtggcttcgtttagctttcattt

SEQ ID NO: 27302 - DNA, 601 bp, Human
tgtgtgtgtagtactggtgtgtgtggtagtggcttgctgtgatggggagcggctggagcagaggagctggctttggtaagtgtggatgtgatgagtgatgaggtagtgcattgtggtaaaataatctgcacagcttggagtaaggagatttggtgtgttcttagttgataatggtagaaccgaggtggttgaaatcttgtgttggttctttcctttatttgacttttttttaagtaacaagatacatgcttttaaaaaatttttccctaactataatttaagatctttagataccttcccyactaccccccgcaagtactgtgaatatatttttacatggtgtaggaagaagctagctaggcagtatgttgcagacacaaattccagaaacagaaatagtgattatttctagacacttattccaactaacagtattagaaataccttgactttgtaaataacttatcaaggcaataatctgatttactttcccatatttaatgtcagtaaaagatgttaagtttttaagttggttgagtacaaaattgtgtcatcgcacacacagctaaggaacagtgtttcccagccttcaacgcatctt

SEQ ID NO: 27303 - DNA, 601 bp, Human
tgtgtggtagtggcttgctgtgatggggagcggctggagcagaggagctggctttggtaagtgtggatgtgatgagtgatgaggtagtgcattgtggtaaaataatctgcacagcttggagtaaggagatttggtgtgttcttagttgataatggtagaaccgaggtggttgaaatcttgtgttggttctttcctttatttgacttttttttaagtaacaagatacatgcttttaaaaaatttttccctaactataatttaagatctttagataccttccccactaccccccgcaagtacygtgaatatatttttacatggtgtaggaagaagctagctaggcagtatgttgcagacacaaattccagaaacagaaatagtgattatttctagacacttattccaactaacagtattagaaataccttgactttgtaaataacttatcaaggcaataatctgatttactttcccatatttaatgtcagtaaaagatgttaagtttttaagttggttgagtacaaaattgtgtcatcgcacacacagctaaggaacagtgtttcccagccttcaacgcatcttagattcttcccagctgggt

SEQ ID NO: 27304 - DNA, 601 bp, Human
atgtcagtaaaagatgttaagtttttaagttggttgagtacaaaattgtgtcatcgcacacacagctaaggaacagtgtttcccagccttcaacgcatcttagattcttcccagctgggtgcttggtgggtgtttagagctgggagagagggctattcctgggaatggcttcttatgtgagcaacagagttatgtcatttagaatctggatcttagaggtcatttggtctagctacccctcagtgacagatgaggaacctcaggccaaggggagaagttacttgcctatgtagctgctttytggtagaaccaggaccacaacttacatcttctgtagggactttttgagaatccttcatctggtagcactgtgtatacttccctgggatgcaaccaaaacagtagctgcaagccttttttttttttctttttttcttgttttgagatggagtcttgctctgtcgcccaggctggagcgcagtggcatgatctcagctcacggcaacctctgcctcccgggttcaagcaattctcctgcctcagcttcttgagtagttgggattataggcacatgccaccatgcccggctaatttttgtgtt

SEQ ID NO: 27305 - DNA, 601 bp, Human
cctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaaggtaagtagtgaagcttttcttgttgagaaaggatgtcttctcggaaaggatgaaggaccatgaaagacccagaaagaagagtctatttggagtcaccctctctctctcctttggttcctgtgttgccaatagcatattcctcttcttaccygtgctttagtgagatgtttctgacacctgatggtttctccttcaagcttgcaaaagccagagtcagggtgcctgtgatttgagaagaggattcctgtcctttgtccattagagtgccaggtgccttgaccttagcatttggggtcttttagaaattgcttatctttcttggaactgcaaatgtttttagatgctacattgctaatgatcagagctccaaatatgaattgtgtgggctgtgctaaagctagatgaaatgtttgcattttctttttttttccacagaagcaagtagattggt

SEQ ID NO: 27306 - DNA, 601 bp, Human
tatgaccctagatcttttttttaatgtttttatgaccctagatctttattcccaccacctatttgcctttattctttacacatcctcaaagctttcaagctcttgtgtcgattgtatttcctcagggacctcctgcacctgcagctgatcttggatttttttcaggctgggaaattcacattggtttttaactctgtattttgctgaactgttagctgtgagcccaggttctaagaaggaagggagactttgctggtgttggacctgacctgtagaattatttataatggtatctctccarctgcatgtggcagagccccactgtgcatggggagtgggggagggtgacagtgaagattttaaaggaaatttaaatttcattacaatgaaccaaaatacactatgcagaacaaaaaatatacatgaattatttaaaaaaacaaacaaacttaaaagcagacagcattggcccacattacttgccccactctgccatttgtggccagaagtcctgaggtctatctcctgaagtgtgcaagatcaggagtttgctgactttgagttgtgtgaagtcagaagctacttgaaccatgtgtgtact

SEQ ID NO: 27307 - DNA, 601 bp, Human
agtgggaaatggagtactcaaggccacaagacaggccgccatagaactttggccttggggaatgaaccaaagctagtttggagagtagggtgattggggtgatcacttttccctttaaaggtggcatgctgcaagaagaaaggctttgaagagtgatgggtagtcactaaccatggcactatgctatcttctaaccaacgtgatggggtcctggaatgatcctaggtctgcactagaagaggtagacccagaggaccttgtctaacataccccttgcttcttgacttcttcccatacctgygttctctccggcctcaattactgcctgagatgttacacccttccagcataaatgatgaaccgcttcatggtgcctgtagaggcctcttgcagagcaccctgcagtggtatggtttgtgtatgcctcactgcactgtagagaaatgaagagcatgaggggaaaaatgagtagggcctggacttttagctagttttgaacactgcagttgctatgacttggggttgttagcagccaaaagaggagctttcatgagagggcacagaatacataacttgtctgtttctttactatgacccatga

SEQ ID NO: 27308 - DNA, 601 bp, Human
ttgtgtatgcctcactgcactgtagagaaatgaagagcatgaggggaaaaatgagtagggcctggacttttagctagttttgaacactgcagttgctatgacttggggttgttagcagccaaaagaggagctttcatgagagggcacagaatacataacttgtctgtttctttactatgacccatgagggttttagtaaaccaaaatgccaagtctaagataaactgccattccttggagtgagggttccatttacagcctgaatcacgacttttattttcctaatgccttctcttgcatyctcttagctgaaggttcctttaactggagtcttcacttagctgaggggactgaagaattgattctttacccttttacgtgggaaaaattaaagcaacatgttcgttcaggctgacaggacaaataagaggcagtagagggatagccagagcaggctagatcagaaaatatcttttttttttttttccctcacccagctgagaatagttacttgggtttgaaattctagttaagtagcaagaacgcttggctgctatttgcaacaagggtaagcatgaagagggtgatttcagcatctgga

SEQ ID NO: 27309 - DNA, 601 bp, Human
ttttttttttttccctcacccagctgagaatagttacttgggtttgaaattctagttaagtagcaagaacgcttggctgctatttgcaacaagggtaagcatgaagagggtgatttcagcatctggaaaggctcctctgtatttttcccctcaggccagctctactgctttctccctatagaaatgaaagtgcctgtttaaccagctccttggccctgtccccagtttattgatatgattaacctggagatgccaaagtgcttgttcagtgctgtgcctggggtgcacatcttgccctttyagactaatatctgggtcttccttttttttagtcaggaaatgtctctctccctctcctttccccctcctctctcctctctctttgtttctcacactgagtgcttgggcgagtgccctgtctcattctttttttttcttccagtgctatccgtatcactcaagaacggcccttttctcctcttctcacccttccggagggatgctaaggtggcaagctccctcctcttctctgtgcttctccttccttccttaacatggccagagcgtgggcagagctcacactgtatctttgcttccctct

SEQ ID NO: 27310 - DNA, 601 bp, Human
caaagtgcttgttcagtgctgtgcctggggtgcacatcttgccctttcagactaatatctgggtcttccttttttttagtcaggaaatgtctctctccctctcctttccccctcctctctcctctctctttgtttctcacactgagtgcttgggcgagtgccctgtctcattctttttttttcttccagtgctatccgtatcactcaagaacggcccttttctcctcttctcacccttccggagggatgctaaggtggcaagctccctcctcttctctgtgcttctccttccttccttaayatggccagagcgtgggcagagctcacactgtatctttgcttccctctagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtactcggggaaagaggctgcgtgtgtgtgtgtgtgtgtgtgtgtgt

SEQ ID NO: 27311 - DNA, 601 bp, Human
catggccagagcgtgggcagagctcacactgtatctttgcttccctctagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtactcggggaaagaggctgcgtgtgtgtgtgtgtgtgtgtgtgtgygtgcgtgtgtgtgtgtgttggaggggagggtatgagagggagaaaagcaggagagaaaaactaggtaagggagaaagaggcacttcaccggggacagaaatagcagaaagggaaaaaaacaaatgtactgggaaagacagattcaggaaaggttacttcctaatcaaatgaatgcttccatttctggagaaatggattgtactgaccctaggggaaaaaacaagtggaattctgctgcttatttatcgagtgccttttctgtgccagccactgggaatacagaggtaggtaagtcttgcc

SEQ ID NO: 27312 - DNA, 601 bp, Human
gaaggtcaaggcagtaagctgtgattgcaccactgcactgcagcctgggtgacagagtgagactcttgtcttgaaaaaacaaaacaaaacaccaggaattgggagccaggtgtggtggtgtgcacctgtagtcccagctactcaggaggctgaggcagtaggatcatttgaaaccaggagttgaagactagcttgggcaaaatagcaagaccccatctcaaaataaatagataaataaataaataaataaataaataaataagtaaataaaaggaatctggaattgctcttgggcaacttktgtcattttacagataggaaactgaggtctagagaggttaagtgtctgaaataacactatggatcagtggcagttaggactctactcagttccttacccttggaataagtttggctcttttgaggcctccagtgcctgttcatttcaactcactgtatgtttctggctggagagaaggtccgctttccagctctctgtgtgttagtgcctcagggaggatgaatagtgcaggcttttccggggcatgaggtagttaggcctgtgctgaaactgaaatgacagctcaaaggaggtgcttct

SEQ ID NO: 27313 - DNA, 601 bp, Human
ctgctctaagcaagattcccacatggactgcccacacagggctcctcacacatggggtacatagttttgttggactagccacacgaggctcatcacacatgggctaaggtgaagcactgtattaggtgttaagggagtttaaaaaattaagagacacaattccccccacccaacgtggggaactcaaaaatagtctgaaagaacaactgtttctgatctctaggccaggagatagggcactggggcactttagaggaaataaggcggccattcttcttggtgccattattgttgcttctgytaccatattctaatccaacaactctcaccctaatcctctcttctcccaaaccatgggaactgtatcttcacacctaacttccacatattctatgaagggtttgcacacttcgctgtttctatgtcatgtgatctcttctgtccaaagaaaggtggaaaaaaatggggaaggaagggtaagactgagattcaggcctaatcagagacttaatcaattaaccactaaaaatatgccttgagaatatctattatgttccattaaatattccagttttaaaaagggtagaaattgacagtatgg

SEQ ID NO: 27314 - DNA, 601 bp, Human
ttctgtccaaagaaaggtggaaaaaaatggggaaggaagggtaagactgagattcaggcctaatcagagacttaatcaattaaccactaaaaatatgccttgagaatatctattatgttccattaaatattccagttttaaaaagggtagaaattgacagtatggtagaatggaaaaaacacaggactgtttgggaggctgaggcaggagaatcgcttgaacctgggaggcggaaattgcagtgagccgagatcgtgccattgcactccagcctagttaacaagagtgaaactccgtctcaaaaaaaaaaaataataataaaataaaataaaataaacaacaacaaaaaacaaaacccataggactataagtcagaaatcctgagtcctaattctcactctatgaatgtctctgggcctgagtccctttgctgaccaagtgaaaagaacaactgatgaggaattccagcccacagttacacttatcagagcctgtgaaactgagtgtacaaattttatgcaggtgtgcattttttctgggggagaattcaccgccttcattaaatcctcaaatgatgtatgacttaaaaatagccaagaat

SEQ ID NO: 27315 - DNA, 601 bp, Human
aacgtatttagattttcatgggtttaaagtggttggttgcttggtttgttcatttggttgtttttaaaattcattaattaaatatttatgaaatacctcctgtgtgccaggcaccatcctaaatactgggggtatgacagtgcacaaaattgacaaaaatctactctgtataacttaaatgttagtatgaagacagaaaaaaccctcaaaactcccaaacaacctaggtaaaatacgtagtgtatcagttcgtgatgataggttcaatggaaaaaataaggccaagcgcggtggctcacgsctactgtatgtagtcttagcactttgggaggctgaggtgggcagatcacttgagcccaggagtacgagtccaacctgggcaacatggcggaacgccatctgtacaaaaaattaaaaaattacccagatgtggcagcatgtacctattgtcccagctgctcaaaggctgaggcaggaggatccttgagcccagggggcagaggctgcagtggccgagatcacaccactgcactccagcctggatgaaagagaaagaccccatctcaaaaaaagaatgagcagggaaatcctcaccaaggtg

SEQ ID NO: 27316 - DNA, 601 bp, Human
acctcctgtgtgccaggcaccatcctaaatactgggggtatgacagtgcacaaaattgacaaaaatctactctgtataacttaaatgttagtatgaagacagaaaaaaccctcaaaactcccaaacaacctaggtaaaatacgtagtgtatcagttcgtgatgataggttcaatggaaaaaataaggccaagcgcggtggctcacgcctactgtatgtagtcttagcactttgggaggctgaggtgggcagatcacttgagcccaggagtacgagtccaacctgggcaacatggcggaacsccatctgtacaaaaaattaaaaaattacccagatgtggcagcatgtacctattgtcccagctgctcaaaggctgaggcaggaggatccttgagcccagggggcagaggctgcagtggccgagatcacaccactgcactccagcctggatgaaagagaaagaccccatctcaaaaaaagaatgagcagggaaatcctcaccaaggtgacaagtgagcaaagatctgaaggtgaggggatccctgggatccctggggaaagagcagtccaggtacaggaaacagcaagtcctgagggagaag

SEQ ID NO: 27317 - DNA, 601 bp, Human
gcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttawaatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaatccctgaatgatgattagagac

SEQ ID NO: 27318 - DNA, 601 bp, Human
gttagttcccaacatcgaatgtgtacaacttaagttggtcctttacactcaggctttcactatttcctttataatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatctcagtgctcgagacacagtgaagcaaattaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaaatgctttaaatgatggatatgttactttagcaagaacttttaggtcaggtttctcctttgttttgatgaatagtcaatgaaactaatcctcaagatctggaaactaaagatttttatttaatc

SEQ ID NO: 27319 - DNA, 601 bp, Human
taagttggtcctttacactcaggctttcactatttcctttataatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaaatgctttaaatgatggatatgttactttagcaagaacttttaggtcaggtttctcctttgttttgatgaatagtcaatgaaactaatcctcaagatctggaaactaaagatttttatttaatccaaatgttgcactggaagaagaaatcaaca

SEQ ID NO: 27320 - DNA, 601 bp, Human
cagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaagtaaggctgcgcccatgcaagtagctgggcctcgggagggggctggagggagaggggaacgcccccccggcccccgcgagagctgccacgcccttggggatgtggccggggggaggcctgccagggagacagcggagagcggggctgtggctgtggtggcgcagccccgcccagaacccagaccttgcagttcgcatttcctcctctgtccccacacattgcccaaggacgctccgtttcaagttacagatttcttaaaactaccactttgtgtgcagttgaaggcccttgggcacaatgagagccagtcctccaaactttcagaaagtttcctgccccttctggcaggctgccaatcaccgggcgggagaaggaaggaggggaaggcggtggagggagcgagacaaagggat

SEQ ID NO: 27321 - DNA, 601 bp, Human
taaagaaaaatcttttaactttttactttgtttcccaaatgttgcacagttttgcaacacattgaccttctggtttcgaacggttacaattttagattgtggtttgccaaagtcaagttgcttaatttttacaaggccacaaaaagcgcaattatgccctgcagtttaaaatggaaaacgtgttggaagataagaaaacttagtttccaactggaatggagccagcaagtttcttttcttctttgcaaattctattgtgtcattaaagttcgatggaagtatcactatgcacaactattttgtgatctaataagggtgaaaaggagccatctgtccccttggctaaggggtattaatggtttctatgggcttcactatggaatgtagatacagacattctggcaaatgtggtggctctggacagaaataataggagtctttgtattcccagggaagctttgcaacaggctacattcttactgaatatgtaatgatgtaagcacggttctaattggacacaagtatttgctaacatccgttatctaatatctggcccagacttgagaagtaggtaatgtaaaaagtttttaaagctacaagc

SEQ ID NO: 27322 - DNA, 601 bp, Human
tcccagggaagctttgcaacaggctacattcttactgaatatgtaatgatgtaagcacggttctaattggacacaagtatttgctaacatccgttatctaatatctggcccagacttgagaagtaggtaatgtaaaaagtttttaaagctacaagcatacctcacattttaaaagtcctttcttgattgggttcttgtgttctttagcactcttgccataaaaaataataacagtaataaacccaaggctgaaaaactgaattttaactaaagggtttttgtgcgtgttttttttttttttcaccaaaattagatggacttacagaatttttaacttaaaattggaatccaaaagccagaagatccccattatagtttatagttgtattccctggaatatttactgggattaactgcaaagcactctcagatgaatagtgtagtataacattttgaaactgaaatacatttaccaaattaatttaaccacagcaatgtgtgtggttcattttagtccttgagcatttttgattatcatacctgtcatgttttctgcagtgtagtgagttaacataaaacaacatcaatacaaaagatcctc

SEQ ID NO: 27323 - DNA, 601 bp, Human
tagtccttgagcatttttgattatcatacctgtcatgttttctgcagtgtagtgagttaacataaaacaacatcaatacaaaagatcctctgtttcgagattaagcaaaattcctcattctcttcaatgtgatagaataccacattgatctttctttggaggttagtaaaatatcttttatgtatttttcagggcttaacaagtaaaaatcaatgttttcatcaagtctgatctttttgtcacccactcttcattcatttttccactaaggtgatagaaaagtctcaacagtttaagaccrtaaggctatgaactccaaatataattgctgacaagataagcaatcctcacgcatccttttgagaggaaataaaatcttagttgcaagattacatattctgatttggaatgctgagctttttaaatggaaatatagaaggacggctgaatcagcaaaaatcctttatgtagtttcattctttgcaagcttgaccagtcattctgaaacaggctaactgaactgatacagtggcaagtgaaaaagacatgcctttacaggatgagtcaaaggagttttagaagaaaaatccaccagagaaag

SEQ ID NO: 27324 - DNA, 601 bp, Human
cctccctgaacctgaggggtaagcattttatttccctttaggaaaaacgtcagctgcttgtaaccactgtgtttatgtcaaagcattcattttttttaggatatctgaaaaaatgccatataagagaaaactctataaaacatctataattttcgaacccaagtacactcttgcattctatgctttaagttaaatgcaaactcctttttccttcttcctgctgcaagtactatctcatcctgatgctcaagagtgtcagggcctgggtttccaaacagagactaccctaaaattatttggsgagtagtactttacacaattgcctctcccccacaaatcataattgtttcagtaaaatggttacttggtttttccaagaaaaaactcgtttttactcatttttggcctgtttgtttatttagaaactaatctggattcactccctctggttgatacccactcaaaaaggacacttctgattaagacggttgaaactagagatggacaggttggtatcttttaaggaaaaaatagggtaatctcagacaggagttgatatattttaaaatcagtgaatctgaatctcagatacagctggcta

SEQ ID NO: 27325 - DNA, 601 bp, Human
ttttttaaacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaatacyattaaaactgcttttttttttccagcaagtatccaaccaacttggttctgcttcaataaatctttggaaaaactcttttgttgtgttatttattggataatatctaaacaattctctacttggtcctattagttaatttgtcattacaatcatgtaagttgataaattcaggttatttatgcttgagatgtagttcttaattttgtcatttttgatagacctcacttctttttattattacttaaaaacatttacaaataggtggtgtcgaataaaataacttgtaccaaaatgaagata

SEQ ID NO: 27326 - DNA, 601 bp, Human
ctgcctctggaacttttctcacaaaataatgaatttttctctcttgaaaagaatttgatagtgctttgcttttgcaacagcaaaaaacaagtttctcaagtcacctggtaaggatagaaatacttcaatttctctcatatggatagattttctgaattcttttgtttgtaagatgctttaccctgcttgctcttttactgaatactgatttttacaaataattcattcaagtaaagtttacttgtatgtagatttttgactgaaaatttcagtgggaacatttgcttttgaaattttcaayttatttttaaagtgctttttttttcctatttcgtatgttggttaagtgaatctaagatgcatttattttttccttaagtttaaattccataatttttataggcagcaagagaaacagaccttactcctaggcttttaatctagaaactagaaatgaaatgtgtaagttgattaaatgcaagaaatgcaagctttgcttttaatatatattttcctcttatggaaaaatttatttcaatgacaacatatgattcagtaatattttgagtattaatattcactactgagttaagaagttcaa

SEQ ID NO: 27327 - DNA, 601 bp, Human
tctatgtgtcatggcttcattcatcctgatttactgcagatcttacagctgtacataattttcatactgaaaggttgtaacaagccaggatgaacacaccattcacttccattctgttgcacataattccaacatcacagattgtaccaattctgataaaagtacagcatttagcattccaatgatggaagagttgccaaggagttttgtctctatataaagaaaagatacctgatagagctgttcattcatagagctgtttgtctagagcatcatttcaagtacagaccaagtagctctrtagtacttggtacagacaaagtataaaaggtgcttcatttgaaagagaaaaggtgggatgataggccttaatgccttctctatcttaagagattttgtttccaaatattttggaaaaagaaaaaaaaaggtgtactggggtttatgaactttccaaaatcagaatattttcccattgtgaatgtctttattcagtggggcagacacaaagcaccatgtacaaatagcagctaatttaaatagatcatatttttacaccaatatttcttagaaagaaatagttataaagattcaaccatgg

SEQ ID NO: 27328 - DNA, 601 bp, Human
ttctttgaagaggaaatcatgtgggtcatccattagtgaaaattacaagtgaatcattaataatggttagttagacgtcttttcacattccagttcctctctgataatcagtcctctagaagctgctctcttggtatgtcccaggacatgatcccctgccacaggctgttaacaagggacaaagagaaataagtgtttatcagataagtaaatcagtgaatgaaactaagatgctagaaataaaatatattttatgcctaaagcaacaattttttctttttcagaattcttgaaggaaaaygatacgcaacataattaaattttgagttctacataagtaattcaagaaaacaacttcaatatccaaaccaaataaaaatattgtgttgtgaatgttgtgatgtattctagctaatgtaataactgtgaagtttacattgtaaatagtatttgagagttctaaattttgtctttaactcataaaaagcctgcaatttcatatgctgtatatcctttctaacaaaaaaatatatttaatgataagtaaatgctaggttaattccaattatatgagacgtttttggaagagtagtaatagagc

SEQ ID NO: 27329 - DNA, 601 bp, Human
ctggcctgaggtggtgggcaggtggctgggtttcaggcctgtctcctaagctaggatatccccaaagtacagtgttcttcttgtcccaaagacccagggtagagcctcaaatgccaggatgaagggtttaggctgcatcctcaggcactagggagccggcgaggtctctgcagcagggcagggacaaacttcttgctttggaggtgcaccctggatggcctgcaagaggaaactctgaaggtcaggaggctgggctggatggggtcatgggcctgtatttcatggtgagggcctgagaagwggtgctgggacttccttccagagtagtgttgtctgaagatggagggggctgccatggcagagagtaagctccctgtcacagaggtatacaaatggagtacaaggtgatcctgggatgctgctgacttgatcttccttattggtcctgcaaggttctctggcccctagttgattgtatgcactgtttcccttagaggtatacaggtttttcaggtagacgactttgctttcaattcagcaaatatttatttcctggtcatcttggatttaaaaccaggaagccaaccccacgagagtagtg

SEQ ID NO: 27330 - DNA, 601 bp, Human
aacttctgcccagcgccctgttcttgctgaaagagtattgggcatccctacaggggcgggcactgtcacctggcctgtcttatctaatccttggagaggaaggactaacagcccattgttgcaaatgagaaaacagaggctcagagcaggaagcgcttgcccaaggctgcacagtggctaaacagtggtatcgtcggctctcctgaccccctggccagagctgaggcacgccaacaagctttggagtcagaccaggttcagatcccagctctccatgggggtgagtcatttcatctctcaygggcctcagttttctcatctgcaaaatggaaaggacatatcccaccttccagcaatcccgagaggacagacagggatgctgcctgtgaaggcgcagcccagacgctgacagcatcactgtcctgttctctgaagcctctctctgtccccactctgctccttgctcctctgagcctgagccagcccctggcccagaactgacctggaggacggtccctgctcgggggtcaataacccgaatcttgcggtctttgcaggtggtggccaacaggctgccgttggtgttgaaggacatggagag

SEQ ID NO: 27331 - DNA, 601 bp, Human
tatgtgaccatgctacccactggggactgaaggtcaagggcatggcttctgaggtcatgagagaagaaaaatccaggcccaacccctctcaattgcttggggccactgggcacgccatgttcctgtcacatttgcctgggcctcttctctgccttcctcacctcgattcatcccgctgagccactcctgggccgtcagggagggctgggcccctgctgttggagggtatatgtcctcttggtaggattctgactgcaggagaaatccagacagtgaggagggtggtagggtaggctgctcrgatgggaaaggcccttagacctgggagtccaggctctcaccaacccctgctgaattgaggaaactgaggcccagagaacaaagggacttgcccgaggtcacgcagcagctcaagaacagaggtggaccgagacccaggactcctgacgcccactgatgtcacactggctgtgagaaaggccgctctgtggctgccccatgaacgtgggctccaggctctggtgcccgacagccctgggtctgtcttctccaggacaggttccccacctgcctcccatgcggtcccgactgcccttacccg

SEQ ID NO: 27332 - DNA, 601 bp, Human
cagaaagcaggggaggctggcatcatggctacagatgaggaaactgaggcccagggagcaaaacctacttaaggttatccaaaactaggactcggccctggtccgctgccccccaaggcagaggctcttccagtacaccaggaggcccgctcagccactggggtgggggtgaaggaagtttgtgggggtggaagggagagggagcagctggggtgactgcttctgctgggctggcccccgtgttggcaggagcgggagagtggctcaggacaggcagagtgggcagagggacctgggtggrggttgctgcctggagggcttcttgggtcaagaagaattgcaaaaggccaggcccagtggctcgcacctgtaatcccagcacttcgggaggccgaggcaggtggatcacttgaggtcaagagtttgagaccagcctggccaacatggcaaaacccccatctctactaaaaatacgaaaaattagctgggcatggtggcacgtgcctgtagtcccagctactcaggaggctgaggcatgagaatcacttgaacctgggggtggggtggaggttgcagtgagctgagattgtaccactgcact

SEQ ID NO: 27333 - DNA, 601 bp, Human
aagaccctaaattagtactcagcagagccaggatcagaatccatctgtgagatgccagcctctgtgttcttagccactacagactgacttccagggctgttgagagaattcaatcacgtgctgtatcaaagtgcctaccccaggatctgccacacagtaggcactaaacaaatgtggactttgaaagcacagaaagtcctataatgtcagaactggaaagactttgatacccactaggtcaaaccctctccattttacagatggtttcccaccattttttttttttttttttttttttttgagacagagtctcactctgttgcccaggctggagcgcagtggtgtgatcctggctcactgcagcctctgcctcctgggttcaagcaattctcctgcctcagcctccagagtagctgggactacaggcacgcaccaccatacccagctaatttttgtatttttagtagagacggggtttcgccatgttggccaggctggtctcaaacttctggcctcaagagatccacccgccttggcctaccaaagtgctgggattacaggtgtgagccactgcacctggtcacctggtccccaccatctt

SEQ ID NO: 27334 - DNA, 601 bp, Human
tgacctcgtgatccaccagcctcggcctcccaacatgctggaattacaggcgtgagccactgcgcctggtgagactggtttcaaactcccgacctcaagcaatccgcccacctcagcctcccagagtgctgggattacaggcatgagccactgcgtctggcccagtcttcccctattctctggaccacagtttgaaaatcacagacaggtcaacctagatccttccagctctagttttctactgtgttctttcctcttgagaagttacagctcatcatgggcccttaataacagaattcawcagaaggcatcatctgaaaacaaagtcaattcagaaactgttgttgcaagaaggcaaacagaaaaacggcaccatgtcccactggaatctctttcagcgatggagagttttgttttctggtaaaaaatatagaaatagtggttgtccttgaggggacttgtggtttggttctaaacctccccatggagccgagtggtgtccctgagggtgaggagggcagaggtctctgctcagagctgctctgagcccatccgcaagtttttgatctccagttccaactgtttggcctggacctctcgc

SEQ ID NO: 27335 - DNA, 601 bp, Human
aggaaagagactccatgcagtgattatgtggaggggatttgctatgtctcttccccccgcttctttctttgtcctctttctcctggtccccttcttctgcatttgtctgggaggatcctggagtgttcttttgatcgactcaatctttctctggcacttgagttctgattggctgaaggacttagaggggaaaaaaaactttaattaagtagataatctcttctttggacgtttggcagctccatttcacctccccttaactctgtttgggatcgcttacacaccaaggaagttgggcttygagaattccatcccactggcactgaggagaatatttctccgtcttgcttacccatctcccagttttttggaattttctctagctgttactccagaggattatgtttctttcaaagccttctgtgtacatctgtcttttcacctgtgtcctccaactcagccacagctggtaagtaacctggactcttacctggagctgggaataggtaagtgtatgtaatgtgttgggtaaagctcatttcatttccagaaatgtaggaagccttgatagctctcctaggaaaaactgttctatggggta

SEQ ID NO: 27336 - DNA, 601 bp, Human
gatcgactcaatctttctctggcacttgagttctgattggctgaaggacttagaggggaaaaaaaactttaattaagtagataatctcttctttggacgtttggcagctccatttcacctccccttaactctgtttgggatcgcttacacaccaaggaagttgggctttgagaattccatcccactggcactgaggagaatatttctccgtcttgcttacccatctcccagttttttggaattttctctagctgttactccagaggattatgtttctttcaaagccttctgtgtacatctstcttttcacctgtgtcctccaactcagccacagctggtaagtaacctggactcttacctggagctgggaataggtaagtgtatgtaatgtgttgggtaaagctcatttcatttccagaaatgtaggaagccttgatagctctcctaggaaaaactgttctatggggtagggctcttcctaaatttatggctgattttagtgaatctttaggacccctaccaataaaggactaaatgatgggagcgggggttcctatttttataaattgctattccacaaatattcccccaaagtgatttg

SEQ ID NO: 27337 - DNA, 601 bp, Human
ccctgcagctgtccagccatggtgggcttcgcagtggtaagaaaaacctcagccacagctccctggaccctctggtcacaggttagagccccagggatagccccttgcctcctcgacacccttattcctcacctgctctcttctcttaggtcatctccctctccaggatcttctcttttccttttctacttcctttttcccacctgtagagttttttctttctttctcaacactctcattgctcaacaaatggatcttgccttactcccaatcccataccatccttggcctcccagctggmtaaaggtctcctcacaatgtaagtaatatcaggaggtaggcaggggtcataattcctcagacctcttagccccttcctcagcagagagatactgggcaagtggagagtgacttggagaccagattcccatggagaagataaagagtggccatgccagtaaatgaaagagctaccaatcagaggttcttttcaagactaactgcacatgactcttagaccctaagtgttccaggaggaagtggggatgggttctttacaacctagccttcagattcatctccctccccatttcttcctcag

SEQ ID NO: 27338 - DNA, 601 bp, Human
agctttaaaacgaaaagcatgtttccgtttgtgctgttttgctttctactccacgatatatccatgtttgttttaatataaaagtaatgtggtttgcccacccacctgcctgccccaggggtcccataaagttgatattgctagcagatgtactgcgtttttcccatggcttacagtgctgctggcatgcctaccccttagccctactctgattgtagaaagaatcactctggtctccagctaggaagctgactacccaagccccttctgctgggccttttcctcgtctgcacaccctaggcctccctctcttgcccttccgttggctcttctttggttttggttttgttttgttttgtttttgagacagagtcttgctctgtcgcccagactggagtgcagtggcacaatcttggctcactgcaacctctgcttcctgggttcaagcaattcttctgccttagcctcctgagtagcggggattacaggcacccgccaccatgcctggctaatttttttatttttagtagagacggggtttcaccatgttgcccaggctggtctcgaactcctgacctcaggtgatccacctggctcggtc

SEQ ID NO: 27339 - DNA, 601 bp, Human
cacgcacgcctctcgtcatgttggccgatgtactcgttctaggaaatcaacaacaccatcattagcctttttcgtggtatcagatcccacatgaaaggcccccaaccacatcccagttatttctgtctgtcggctccaaccccttgtcagctacaagcccaagcacaccaagtgcctcttccaggaagccctctgtaactctcccagccttcaatatcttcccttcctttgagcaaccgtatcttttgcagttcaactcccccgcccccacactgttcacactggactcagtgtaacactrgactgttctgcaaaggagacttgttgccctgccctgcaaattctatgcagtctagggtcctgtcttttggctcgtttgggttttcccctccagctaatccttctccctcctgagtcaagcacagtagactgggaacatcataacttctgcaaagggctttacacattatcatattttgatcctcataatccttggagatagatctcattacagacccatttctctttgcagaagaggaaactgaggctcagggaagttcagatacttacccaacgttcttagcccttcccagcatgtggg

SEQ ID NO: 27340 - DNA, 601 bp, Human
attcactgagtcttctaggttgggtctctgcactcatgaattttaaaatatttgtactgattcttttaaatgtattttaattacacaatccatgaatacatcctcattgcaaaacattctgcaactacaatttcaaatgctctatctttatagtcccaccgcccctccttctaccaaggtccatttctttatatcctagggaagctgagtcaccctcgttagcatggacaaattcagggactgaaggaagagcataccaatggacaagaggaaggggtcaaaacccacacgccctccagcrggaatctcggtgaggagccaggtgacaataggagtggtgccaactgaaagaaagataggaagcaatgcagaggtcaccttcagggccagccccaggctctccagccaggggttctgtctgatggtcctaccatgtgtgtcttccttgagatcagccttgaaagtcagtgatggcctcaaatttcctaagctccccatagaggcccagcatggtcttacatgcacgctctcacctataccttcctgaacctagtccaggtcccaagacttggggaacaaatccatgcggcccttctacctt

SEQ ID NO: 27341 - DNA, 601 bp, Human
tggcccacgctcttaatctgtacagacaccgtactgtcttgataacattctcagtctccaaatctgtccttaaactctgtgtcacagcaccgtcctttctcagatgcttatatctgggttctatgactttagttttcatcttctatccctgccccctgcaagatattcaaagagtctacccctaggcaggactaggagtttgctggccgaaggccataaacattaagggtcctagttgggttcagatatgagcataaataacttaatgtcgtgaaaaatatttcatgtgaacaggtaaaamtattcaacaatgaccaaagctttgggtacaatacatttttgtaggtttattttactacatattttacacataatttatgttatgtgtattttacacataacataaaacatatcattttaatctttttaaagtgcacaattcagtggctttcagcatactcacaatgttgtgcaaccatcgccacgatctaattctagaacattttcttcatccccaaaggaaaccctgtactcactaaggagtcactccctatcccccctcccctgagccccaggaaatccctaatctattttctgtctc

SEQ ID NO: 27342 - DNA, 601 bp, Human
tcaagagagcagtcctagttgaaggacaaaggggtagggctggggccgtgttcaactttctctgcagtaaccccagtatttactaagccacgggtactgggctaagcactccatgtgcattgttctaattcttacccatcccattttacagataaggaaactgaggcttcagagaggtaaagtgacttgtctagggtttcatggatgcaagaggtagagctgggatttgaactctggtctgtctgactgcatggcccacgctcttaatctgtacagacaccgtactgtcttgataacattstcagtctccaaatctgtccttaaactctgtgtcacagcaccgtcctttctcagatgcttatatctgggttctatgactttagttttcatcttctatccctgccccctgcaagatattcaaagagtctacccctaggcaggactaggagtttgctggccgaaggccataaacattaagggtcctagttgggttcagatatgagcataaataacttaatgtcgtgaaaaatatttcatgtgaacaggtaaaactattcaacaatgaccaaagctttgggtacaatacatttttgtaggttta

SEQ ID NO: 27343 - DNA, 601 bp, Human
gccaagtgctccctagaagcaaaggagccccaaaaaagtgtaagtgacagaccttgcctttggcactcggttcctggaaggtcagccttagggtaacagttttgcatcctcttaaaaagcagcgaaaccctttcctcaaacaaactcttacttgtgtactcattaatgacatgggccctggacccagatggggctcaaatcctggctttgccattactggatgggtgaccttgggcaaattacctaacccctctgtgttccattttgcacatttgtaaaatggggatggagtataataagyatctgcctcaatagggctgctatgaggatggaatgaattaatatttgtaaagcacacagaatggtatcttgagatgtagtaactcttgtatctttctgattaataaataatcatgcagactgagatcaagagagcagtcctagttgaaggacaaaggggtagggctggggccgtgttcaactttctctgcagtaaccccagtatttactaagccacgggtactgggctaagcactccatgtgcattgttctaattcttacccatcccattttacagataaggaaactgaggcttcagaga

SEQ ID NO: 27344 - DNA, 601 bp, Human
tcactgcaatctccacctcgcaggttcaagcaagtctcctgcctcagcctcccaggtagctgggtttgcagatgcctgccaccatgcccagctaatttttgtatttttagtagagacggcgtttcaacatgttggtcaggctggtcttgaactcctgacttcaggtgatccgcccaccttggcctcccaaagtgctgggattacaggcgtgagtcaccgcacccggccagaggcaagcatttctgacacttttgccccactgtttcctttggcctccaaagattaccaacagcatgcttgyatcatctacctctgcatgttactcaatctttttgccggggggggggggtgggggagtgggcgtctttgagatgctgttgagagttatggatcttttccccccagaaaaatgcagatacttagcagtcagcacacagttccagtgggtccctggaatatctgaagcccagccatagggatcagacaagaagtcctgagccatgtcggaaagagtagagtcccactgggtgctaaagctgggagtgtgagtgccctggggtagtggctaagttgttgggaggcatttcctggtcctcctccc

SEQ ID NO: 27345 - DNA, 601 bp, Human
ccaggctggagtgcagtggcaagatctcactgcaatctccacctcgcaggttcaagcaagtctcctgcctcagcctcccaggtagctgggtttgcagatgcctgccaccatgcccagctaatttttgtatttttagtagagacggcgtttcaacatgttggtcaggctggtcttgaactcctgacttcaggtgatccgcccaccttggcctcccaaagtgctgggattacaggcgtgagtcaccgcacccggccagaggcaagcatttctgacacttttgccccactgtttcctttggccyccaaagattaccaacagcatgcttgtatcatctacctctgcatgttactcaatctttttgccggggggggggggtgggggagtgggcgtctttgagatgctgttgagagttatggatcttttccccccagaaaaatgcagatacttagcagtcagcacacagttccagtgggtccctggaatatctgaagcccagccatagggatcagacaagaagtcctgagccatgtcggaaagagtagagtcccactgggtgctaaagctgggagtgtgagtgccctggggtagtggctaagttgtt

SEQ ID NO: 27346 - DNA, 601 bp, Human
tcctcaagccctgacctgtcatttatagaggaagatcagaggacacactgtagacacacattatttcctctccacctccattttacggataggagtgaagaaacccagctctctgtatctgaaaactcccccagtcctgggagagcatcctgtacctcaaacctacaatccggccctgacctgggccaagcatgccttcgggaatcctcctccctacctggtattctcaagtggtccaggggctgacctggtctgagccacagcaccccccagggagattcagaccgtacctgaagcagamactaggggacgctattgggttgtggcccttcgagttgtcctgctttcagcggggcgggaaatatcatccaacgccccctgctcaactccccgaccacccaagaacctgtcactccttgttctccagagccctcccccacccagcacgcatatgaggaggatcttcctttctgctaagtaaggggacaaattccccctccctgcccccactgccacactaaaagacagtcagccaaaaaggacggccgtggctcttcaccctcggaacttgtccacgatctctgcccccgagaactcatcc

SEQ ID NO: 27347 - DNA, 601 bp, Human
gcttttcatcaggcaggcctgcaggggtttgttttctatagggccaaacacctggctagcctgtatcttgggcccaccttggctggttcaggctgagtgaacagacctctctccatgtgaactcgtgagctttaagcattagctaacataagcaacacatgggaagccagggaaaagcatccaatggcatcggtgtcttccttccaggtcccccagcctccagctctcaggccttttcattacaaggcaactccctactccacactgagctcctctcccagcccccacagggctaggggcytcggaccttcaacgtggactcaggtcccagaacatccccctcccctcaccctgttcctctacacacacaacaggatgccccaacagggccctagaaaattctttttcctcaagtacctgtagtgggccagggcagcattcagaccactagcagagatggtttcaaaactgggtccggaggagaactgttcttctctggaaagtacaaggcaaggcatggtcaatgaatgggcccctggactaggctgggcccgggatatctaatcaaatccaatgaaggtcatggctgcctctacctctc

SEQ ID NO: 27348 - DNA, 601 bp, Human
atttataggacacttttgctgctccctgggaagaatggtagaagaggcctcattatccccagttcacagatgaggccattgaggccatgcggctgtttccctctctgaacctcagtgaagccaggcctagagcaagcactgcctctccacacagtcctctccatggcaaacacggatctgacccagtgacttgctgagttccagttaggtgaagcctcagtcccaaggtctgactcccaactcccagctgcagcagttgccacagatggcccctgtgatcatgccttggtgagggagaggrgagaaatggtcccagggccctggggcttctccttgggtcatggggtgtggtgaccttcttcttcagaaggaaagaagaggaagtgaggtgactatttccccggcctcaccctactctgagcacaccccattccagcaacgcccccacaaattcacttcccctttgctcattggccatctcaagtacacacagcatcgaactcctgaccagcaaaggctgctaagctgagcgcctgctactctggatcccctagagctgtgctaagaacaagcaaagagcctctgtcgttagcacattcgc

SEQ ID NO: 27349 - DNA, 601 bp, Human
agtcggcctgctgcatgcagcatgacggcagctcgctgctccacccccagggccctctggtgcacagagacaatgccctcgcctctgccccagctggccagccctcgctgtttcctgaacacctctggctcctttccaccgcggaggcttcacttgtgccgttttcctccacttgggatgcctttctttctcctttctgctgagtacagggccaggcacacaggcaacaacaaaaaaatatttgtgcactgatttaccagaataggatgaggctcagcttgggctgaggccttgtcagtgrcctgaaatatccccggggaagcagcagggagcactgggttttccggcaccagtggtgtcaccttgggcaaactacttaacctctctgagcttcagttttagcctctgaaatggaagggatcttgactgcttgggtgcccccttgggggaaggtggtgaggggaaatctgggcccatgcttaccttctggaaggcagagggggtgccccagtggactgttctggtgatgtctgtggtcccgtccctatggagaaggaaaaccaacatgccaaatgcctggggctagggactggggccatgt

SEQ ID NO: 27350 - DNA, 601 bp, Human
gtggcattaagctgggagagggcccaagcccaggcttcctgtacctactgatgagtggctggagggactggctgtctggctgtcccctggctgttgactctggcagccccacaactggttagatgtttgttggctaagcagaggcaactcatccctgtcaggcctcagatcccccacaggggcatctctgactcactctctcttccctgtagcccagcagggaagccctaaaaacccacttgggtcctgaaggtactcccatctccctggatgccactgtcctgttactccagcatttggyaactccagagtctgaatatacagctgggtctacggccataccaccctgaacgcacctgatctcgtctgaatatacagctgggaaacaactcccaagagcaaaaagagggtctgggctgaggggagctggaattagggtgggacaagccatttggggctgggcgtagcggtgggaatggggaggtgagtcccgagctgtactagtgcctgctgtgctcctctgaagtctggtacactctagactgcagtcctgggctagtcctgctctgggatggggtggtgaggtagaggggcctgaggg

SEQ ID NO: 27351 - DNA, 601 bp, Human
ttcctagctatcttcgcatgtttatttttacaaataaactttactatcattttgtgaagttacaaaagtatccagttagcactggaattgaggttatcttgaatttatagattaatttagagagtaatgatatcttcataatattgaggcttctctccagagagcaccatttacttaaatcttttttatgtcccttagtagagagtttctccatgtaagcctttttaagtttacatctaggtattttatcttgttggctgctattatacagaatctttatttctaacaagctcccctggcrattattatgtgcattgagaaccaatgatatagggcagggatactgattcacttggtctggaatggggcctgggcatgggcatttaaagcaccagaaagctctctgggtgattcaaatgtgcaagcgagtttgaaaagtctgacttatggaattcctaaggaagactccagataaattcatgcctgcacactaaatgcccttctcctttgatcttcctccccactttcctcccatgcagcccaaagtcactgacatgctgcccacacctccagcccatcctggtggcagtttaccttggtc

SEQ ID NO: 27352 - DNA, 601 bp, Human
tcccacttcagcctcccgagtagctgggactgcaggtgcatgacaccatgtgcagctaatttttttttgtattttttgttgagatggggtcttgccatgttgcccaggctgctctcaaactcctgagctcaagcgatcctcctgccttggcctcccagagtgctgggattacaggcatgaggcactgcacctggccctgctcttctttttcagaattttcctagctatcttcgcatgtttatttttacaaataaactttactatcattttgtgaagttacaaaagtatccagttagcactsgaattgaggttatcttgaatttatagattaatttagagagtaatgatatcttcataatattgaggcttctctccagagagcaccatttacttaaatcttttttatgtcccttagtagagagtttctccatgtaagcctttttaagtttacatctaggtattttatcttgttggctgctattatacagaatctttatttctaacaagctcccctggcgattattatgtgcattgagaaccaatgatatagggcagggatactgattcacttggtctggaatggggcctgggcatgggcatt

SEQ ID NO: 27353 - DNA, 601 bp, Human
gttgtttatgggaataagagggtttacttctggactgattgttctgtttcattgttacagctatctatttcatctccagtgtcatactgttttagttatggtagtttgtgttcaaatttgagaggactggcttttcttattgctttttttttagattgggttttgctctgttaccgaggctagagtgcagtggcgtggtcacagctcactgcagcctcaacctccctaggcttagaccatcctcccacttcagcctcccgagtagctgggactgcaggtgcatgacaccatgtgcagctawtttttttttgtattttttgttgagatggggtcttgccatgttgcccaggctgctctcaaactcctgagctcaagcgatcctcctgccttggcctcccagagtgctgggattacaggcatgaggcactgcacctggccctgctcttctttttcagaattttcctagctatcttcgcatgtttatttttacaaataaactttactatcattttgtgaagttacaaaagtatccagttagcactggaattgaggttatcttgaatttatagattaatttagagagtaatgatatcttcataat

SEQ ID NO: 27354 - DNA, 601 bp, Human
aacctttctggagggcagtttgacaatatctatcaaattacctattaaaaatgcttgtactttttgtcttggaaatccctacgccagatatgtaccttctggatatagtcccaaaagctcaccaagatgtttatacagtgatttgtagcattgatggcaaatatagtaaaaatttggaaacagcctcaatatccacggttggttaaataaatcatgggacatccacatactataggctcttcgacaacccttcaaaagaatgaggtagatctccctgcgctattgcagaccactctcctargtttactattaagtaaggggcagcggggcagggaaggaaggtgcagaaaagtatgtacagtagaatccattttgtttgtattttcaaaatatatacatagatagatacatacgctgtgtgtgcctgaaatgttctcaggaaggaaactgagcaagaaagagacttttttttcccttctcttttctttcttttccttcttctttttttagagacagattctcgctctgtcgcccaggctggagtgcagtggtgtgatcttggctcaccgcaacctccacctcccgggttcaagcgattctc

SEQ ID NO: 27355 - DNA, 601 bp, Human
gcaattcactaaaatttaacaccaaatggttcacatacatgtggaaagatgctcaagttcatccttaaagaaattcaaggctgggtgtggtggctcacgcctgtaatccagaactttgggaggccaaggcaggtgcatcacctgaggtcaggagttcaagaccagcctggccaacacggtgaaaccctgtttctactaaaaatacaaaaattagccagtcgtggtggtgtgtgcctgtaattccagctactcaagagactaaggcaagagaatcacttgaacctgggaggcggaggttgcrgtgagccaagatctcgccactgcactccagcctgggagaaagagggagactccatcaaaaaaaaaaaaaaaaaaaaaagaaagaaagaaagaaaaaaagaaatacaagtcaaaacaacaatagaataccatgtttcacctatcagattggaaaaattagtgacttcgatgattctcagtgctagtgagtatgtgaggaaatgggcactctcacacactgttggagaaagtacaattggtgcaacctttctggagggcagtttgacaatatctatcaaattacctattaaaaatgcttgta

SEQ ID NO: 27356 - DNA, 601 bp, Human
tgagcttttacaaatccataagacaaaaataggcaaaacaggaaaaaataaggcaaaggacatgaaaaagcaattcactaaaatttaacaccaaatggttcacatacatgtggaaagatgctcaagttcatccttaaagaaattcaaggctgggtgtggtggctcacgcctgtaatccagaactttgggaggccaaggcaggtgcatcacctgaggtcaggagttcaagaccagcctggccaacacggtgaaaccctgtttctactaaaaatacaaaaattagccagtcgtggtggtgtgygcctgtaattccagctactcaagagactaaggcaagagaatcacttgaacctgggaggcggaggttgcagtgagccaagatctcgccactgcactccagcctgggagaaagagggagactccatcaaaaaaaaaaaaaaaaaaaaaagaaagaaagaaagaaaaaaagaaatacaagtcaaaacaacaatagaataccatgtttcacctatcagattggaaaaattagtgacttcgatgattctcagtgctagtgagtatgtgaggaaatgggcactctcacacactgttggagaaagta

SEQ ID NO: 27357 - DNA, 601 bp, Human
ctttggaaagttcaaagggctcctcgaatgccagggaagtctagaatagtgacgggttccggctgcccaagtttgttctccaacctctggtagggtcatattccagagtgcctcaccgcattccctcttactccacagccaaattcctatggcttaactccctctgctgttacttggcatggagcctacccagggtttaggaatgatgggttcacatgtggggggttgatgtttcatgccctggctgggtgggaacagctctggctatgcccaacaggtggtgataggtttgggctctccygggaccatggcacccttgggtggtaggggcattgctctcttggggttttgtttggcgggaggggagcagctgtagcagtctgtgctaggttataggttaggcctactgagatcacagaagagaagagactagctggctttcctatctcggggcctgggattaggggcccagggtgtggtatacaaccccggggtgcagggaggtgccatctggggccaagaagccctgtgttcctggggcctgggaccttctccataggtcttggagaaggaggatgaatgcaaaggtttctaggcaatg

SEQ ID NO: 27358 - DNA, 601 bp, Human
tgggaggatttaacagcattgtagctgtggctgcactttggaaagttcaaagggctcctcgaatgccagggaagtctagaatagtgacgggttccggctgcccaagtttgttctccaacctctggtagggtcatattccagagtgcctcaccgcattccctcttactccacagccaaattcctatggcttaactccctctgctgttacttggcatggagcctacccagggtttaggaatgatgggttcacatgtggggggttgatgtttcatgccctggctgggtgggaacagctctggcyatgcccaacaggtggtgataggtttgggctctcccgggaccatggcacccttgggtggtaggggcattgctctcttggggttttgtttggcgggaggggagcagctgtagcagtctgtgctaggttataggttaggcctactgagatcacagaagagaagagactagctggctttcctatctcggggcctgggattaggggcccagggtgtggtatacaaccccggggtgcagggaggtgccatctggggccaagaagccctgtgttcctggggcctgggaccttctccataggtcttgg

SEQ ID NO: 27359 - DNA, 601 bp, Human
gggttgaggattggctaaatgctttgccacattcttcacatttgtagggtttctctccagtatgaattatcttatgttcagtaagagttgaagatttcctaaaagctttgccacattcttcacatttgtagggtttctctccagtatgaattatcttatgtgtagtaagggttgaggattggctaaaagctttgccacattcttcacatttgtagggtttctctccagtgtgcatcctcttatgtgtagtaaggtgtgaaggctggctaaatgctttgccacattcttcacatttgtaggktttctctctggtatgaattctcttatgttcagtaagggttgaggaccagataaatgctttgtcacattcttcactcttggaaggtttctctttagtatgaattatcttatgtgtcgtaagatttgaagattgattaaaagctttgccacattcctcacatttgtagagtttctctccagcatgtattattttatgtttagcaagggctgaggagtgcttaaaagctttgccacattctttacatttgtagggtttctctccagtatgaattgtcttatgcttagtaagggttgaggaacg

SEQ ID NO: 27360 - DNA, 601 bp, Human
atttgtagggtttctctccagtatgaattatcttatgttcagtaagagttgaagatttcctaaaagctttgccacattcttcacatttgtagggtttctctccagtatgaattatcttatgtgtagtaagggttgaggattggctaaaagctttgccacattcttcacatttgtagggtttctctccagtgtgcatcctcttatgtgtagtaaggtgtgaaggctggctaaatgctttgccacattcttcacatttgtaggttttctctctggtatgaattctcttatgttcagtaagggytgaggaccagataaatgctttgtcacattcttcactcttggaaggtttctctttagtatgaattatcttatgtgtcgtaagatttgaagattgattaaaagctttgccacattcctcacatttgtagagtttctctccagcatgtattattttatgtttagcaagggctgaggagtgcttaaaagctttgccacattctttacatttgtagggtttctctccagtatgaattgtcttatgcttagtaagggttgaggaacggctaaaagctttgccacattcttcacatttgtagggctt

SEQ ID NO: 27361 - DNA, 601 bp, Human
aagctttgccacattcctcacatttgtagagtttctctccagcatgtattattttatgtttagcaagggctgaggagtgcttaaaagctttgccacattctttacatttgtagggtttctctccagtatgaattgtcttatgcttagtaagggttgaggaacggctaaaagctttgccacattcttcacatttgtagggcttctctccagtgtgtatcctcttatgtctagttagggttgaagaccatataaatgctttgccacattctttacatttgaagggtttctctctagtatgaawtcttttatgtttagtaaggcttgaggaccagttaaatgctttgccacattcttcacacttgtaaggtttctctccagtatgaataaacttatgtatagtaagatttgaagatcgattaaaagctttgccacattcttcacatttgtagagtttctctccagcatgtattattttatgtttagtaagggttgagagtcgcttaaaagttttgtcacattctttacatttgtagggtttctcttcagtatgagttatcttatgattagcaagggttgaggaattgctaaaagctttgccaca

SEQ ID NO: 27362 - DNA, 601 bp, Human
atttacaggacttctctgtaatataaacgcatttatgttgggttttgtgtaaacggatgcaaaatgacttgacacattttttacatttgaagcatttctttccagtatgtcttatcgtatgtctgtttgaatttaaaaatttatagaagactttcaaatatttcccacattgaaatactttgctctgggcagttgtgagacactggttaagtttattataaccttctttgtgcaccttacactcatccacacttttacaaccttttcttaactgtaaattctcatgtccacatttttcatrttttctcagtaatactttttgaaaagaatcttccatgctctgctctggccaaaagtcttgaggaaaatgaggacatatacctgaaaaaaaaaaactaaaaataataaattactccactcacctagactcacatgaatatagtttaaaaatcttacctacaaaattatacaaactacataaacaatatggcactgcaaaataccacaggccctaattctatttttgtttttttgtttgtttgtttttgagacggagtctcgctctgtcacccaggctggagtgcagtggtgcaatcttggc

SEQ ID NO: 27363 - DNA, 601 bp, Human
acttcaaaatttctgcatacttaagtaaacatttaatagagaaataatgcctcctataaaatggatgaaaatatttacaaattacatgtgataagtgtgaatatccaaaaaatataaacaacttttaaaacggaacaataaagttaaataactttatttagaaataaataattaaaataaattttcataaaaaaacacaaataaaaaaacatttgaaaggacacacaaaattactaatttgtagagaaatgcattaaaatcacaatgagaaacaaaatcccctcacacccacttaaatggwcactatccattttttaaaagcaccaaatctcttgataatgcaatcaaaatgaaacccttggctgggcacagtggttcacacctttaatcccagcactttgggaggccgtggcaggcagatcacaaggtcaggagttcaagaccagcctgctaaacgtggtgaaaccctgtctctactaaaaatacaaaaattacccaggtgtggtgacgtgtgcctgtaatcccagctagtcaggaggctgaggcaggagaatcgcttgaacccaggaggcagaggttggagtgtgataggatcgtgcca

SEQ ID NO: 27364 - DNA, 601 bp, Human
gcccctctgcccggccaccaccccgtctgggaggtgtaaccaacagctcattgagaaggggccatgatgacgatggcagttttgtcgaatagaaaagggggaaatgtggggaaaagatagagaaatcagattgttgctgtgtctgtgtagaaagaagtacacacaggagactccattttgttctgtactaagaaaaattcttctgccttgggatgctgttgatctatgaccttacccccaaccctgtgctctctgaaacatgtgctgtgtccactcagggttaaatggattaagggcggtrcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctccgagaaacacccaagaatgatcaattaaaaaaaaaaaaaagcaaaaaacaaacaaacaaacaaaaaaaacttatattgattgttggtggaaagc

SEQ ID NO: 27365 - DNA, 601 bp, Human
tgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctccgagaaacacccaagaatgatcaattaaaaaaaaaaaaaagcaaaaaacaaacaaacaaacaaaaaaaacttatattgattgttggtggaaagcaggatgcacccattattttataatgttataaatttactttaaataaaattattatcaaatacagcaattccatttatgaatctatatctaaaatatgcatcataagaccctgaagacatatttgatacaacggagtattattcaaccttaaaaaaaaacacaaaaaacttgtcacatttaaagatacactttgagattatgtcaactgaaataaactagtaacgaaacgataaatgttatgatttc

SEQ ID NO: 27366 - DNA, 601 bp, Human
cagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctccgagaaacacccaagaatgatcaattaaaaaaaaaaaaaagcaaaaaacaaacaaacaaacaaaaaaaacttatattgattgttggtggaaagcaggatgcacccattattttataatgttataaatktactttaaataaaattattatcaaatacagcaattccatttatgaatctatatctaaaatatgcatcataagaccctgaagacatatttgatacaacggagtattattcaaccttaaaaaaaaacacaaaaaacttgtcacatttaaagatacactttgagattatgtcaactgaaataaactagtaacgaaacgataaatgttatgatttcactaagatatataaaatagtcacactcataaaaacagaaagtggaagggtgtttgtcaagggctagagagagcataaaatggtcaaat

SEQ ID NO: 27367 - DNA, 601 bp, Human
ccatgaacagtactctggctgtcactgtaaacttgaagaaagatcattgaagggaaagtagaattcttagagattttataagcattaacagaagtgatagcataatttaaaaaaaacattcaggcttcccagaaactatttcctttggaacacagcttctcagatcactttaaagacctgctttcttcttgactttgggcctctcatccttgtcgtctgttgtattcactctcacctacctgtgggttcatccaccatctcatgttgcttcatattccagggctcttttccttgctccagrtaagtaatcaggtctggcttagagagagcaatacctgttttattaaaaataactaacatgagtcttgctcatattctccacctgccaacttagtaatgtgctcagtaaagagcatataatagaatattctaataaattgtcccaatatactaatttgtaacagaaatgtttaaatatttagaagatattttaattttataggttcttaattttactgcttggtactactgtatcaaaaactggtgatggcaattagattttaaggtgtgagtaacagtattttatgccacaaaacttctg

SEQ ID NO: 27368 - DNA, 601 bp, Human
tttccccattatgccactgcgcccccagttgtggggttaaagagcaggccctgcttcactcatggggagagcatttctacctgacaccctcccatttctgttttccttacccagatctaccttctgagatatcatccttcttcagggagataaggaaaaaaagccacagggtcccggagagccaggggaatggtgagtgtttcctgtctccattactggctgtaacaggatggacacattcccttctcttaccctgactgccttattggtgcctagtagagttcagctccaattcctcttacttgctcccctgcctcagcatcactttctgcaaaacccatgacacagttattcacctagtaaactgaacaacacacaattctacagtatgagatagagtctgcatttctttgttcagcttcaaaagttctgctgcctgagagtaacgtcacagtaatggaacgggaagattctggaatctgtgtccccacctagacaacgattatactggcaggatctatcaggtgtacctattttggaactctggagtctagttgaaggcctccagttcccagggggaaggaagcatagagggtaagtc

SEQ ID NO: 27369 - DNA, 601 bp, Human
cagatagtgtacttactaaacaaagactttaaaacagccatcttaaagagctaaaggaagatgtggagaaagtcaagaaaataatgtaagaacaacatggaaatatcaataaacagacagaaaacataaaaataaaccaaaaataaattttggatttaaaaagtacaactgaaaagaaaagttcattagagggattcagaagtagatttgagcagacggaagaatcagcaaaccaggagataggacaattatcaagtctgagggacacagacaaaaagattaaagaaaagtgaacagagcctaagggaactatgggatactatcaagtggatcaactatgccttatgggattcccaggagaagacaaaaaagggacagagagattgtttgaagaaataatggctgacaacttcccaagtttgatgaaagacttgaatataaacatccaagcagctcaatgaactataagtaggaaaacctcagaaggactcacactgagaaacaatgtaatcaaagcatcaaaagccaaaggtaacagagggatttttgaaagcagcaagagaaaagcaacactacgtacaagggatcctcaataagatta

SEQ ID NO: 27370 - DNA, 601 bp, Human
tatggaatctcaagggacactgaatacctaaaacaatcatgaaagagaaccaagttggaggacttacagttccttatttcagaatttactacaaagcaacagtaacccaaactgtggtactagcataaaaacagacttacagactaatagaacagaatagagatcccagaaataaacccttgcatatatggtcaaatgatttttgacaagagtggcaagaccattcaatatgaaaaagactatactcaacaaacgctattgggcaaactgtatatttatatgctgaagaatgaagttgaayccttacctaacaccatatacgcaaattaactgaaaatggatcgaagacctaaacataaatgtgaaaactataaaaattgtagatgaaaacctaggcaaacatctttataactttggatttggtgatgatttcttggaaatgacaccaaaacataggcaataaaagaaaagaatagtgaacttggacttcatcaaaatttaaaactttcattcatcaaaggaagggaatatatttgcaagtcacatatctgataagggattaatatttagaatatataaagaactcctacagcttaacaac

SEQ ID NO: 27371 - DNA, 601 bp, Human
tctaaggctggaagtttaatgaactgttttctacatttcacaggtaagaaaactgggatactagttggtggcagaggtgggtctgaaactcaggcaccatgattccagggcttcactactctctgcttgtgaccatcaggcccgagaaagccaagccgtaggattttgaggaattactgagttatagtggactatttgatcttttaaattcttaaaactcggaaaatctgttatcctttattgttgcttacattttatatgttgcttgctcttctgtctgcctagatttaaagttcccaaratgtagggactccattttgtgcacatataccctgtgtggccccccaggatcttgactgtatgggttcacaaatgccactggctggattgagacagggatttaaaagtcttggaacacatggcaccagggtcactgggatcttgatatctcacctgcctcccccagggcagccttatccctgcccctcaccctgccatgggcaaggctggcttctgagtgagcagggctcagttttgtgttacaggcacacatggcattcagggatgtggctgtggatttcacccaggatgagtggaggct

SEQ ID NO: 27372 - DNA, 601 bp, Human
ctcgatgtagaattctacattggttattttttcagcacgttaaagataacattccattgttctgcctgccattgtttctgatggagaagtcaccatgaacataatttagctttatttcctttggctacttttctccatacttttggtattcagcagtttcactgtgatgtgactgccttaagtacattcttcctttacatgtttttatctgcctgaatctctctgtccccttttgggactataggcacatgtatattagtcctttttatataatcccacaggttatagatcctttccatayttttaaatcttttttttctctctgttctttagactggatgatttctgttggtctgtcttcaagtttactgtctcatttgtcatttccaatgtgctaagctctggccagtgaatccttcatttcacttatttttcagttctgcaatttccattcacttttactacacttttctttgtggtgagatttcctatctgttcactaattataattaaattttactttatcttctttaaatcagacactaagtggataacttattaagtgaaaaagttataggattttgtatactatgcagttgag

SEQ ID NO: 27373 - DNA, 601 bp, Human
cgaaacctatcttttttgtctcgtttttaatccttgttttaatttaaagaaaaacagcagctcttacaatgatgttgagcacattaaaaagaatgctgtacaatccaaggagcaagtcattgtggttgcccaggaagctgtcttggaaacccaaaatatatgtgtaacgggaggaagactgttctaggtataaaatacatcttaacggtttcattattctatatttgggacttggatttaagacaggcaatatcagaatcctcaaaataggctagttacaagaaaagtatttaattttctyggctgtttcattaatcagaatgctaattcaataaatgtaacagaatcatttgcaacaacatggatgaacctggaggatgttatgttaagtgaaataagccagtcacagaaagacaaataccacacaatcttacttatatgtgcagtctaaaaaggttggactcatagaggcagagaatacaatggtggttactaggggatgggggtggttggggaagatgttggtcaaaggattttcacatagaaagaataagttcaagagatctattgtataacatgatgactacagttaataacaata

SEQ ID NO: 27374 - DNA, 601 bp, Human
agatcttagaaattgaaaaacaacttaatcagtcttaagttaaaaactgcctgaaaaatatgccatttctggtatttactttgagtaaagtaattgtagattcacgtaatttctggcactgtctgtaaattataagatactagttggacacatatatctacatgtgcctaatcttacatatttatgaaggcaatattagcctatctgatttttaaaatcagtataggttgactctcccttatccaaaatgcttaggaccataagtgtttcagattttgggtttgtttggttggttggttgrttggtttgcattttggaatattaccataaacataatgagatatcttgggtataggaccctagtctaaacaggaatttcatttatgttttgtgtacaccttgtacacttggcctgaaggtaattatatttttcctttgaggatgctgaataaactgaattttatgtgcctgtgttttgactatgacctgtcacatgagatcagctgtggaattttctacttgtggctgcatgttggtgcttaaagattttcagattttggaactttgcagattagggatgctgaacctatatattagtctt

SEQ ID NO: 27375 - DNA, 601 bp, Human
aattcctgacctcaagtgatccactcgactcagcctcccaaagtgctgggattacaggcgtgagccgctacacctggcctgattttttttttaatttagttattctcgagtttttaaattttaaatttgtgtcagtgcccattagtctctataaacctatcagtgcaggagcaccttagatttaaaatattttataaataaattcattaacctggtaatattttgtgttaaaatttcttctaagactaaatattcctagtgtatacacagaatgccaaatttggtgaccaactgaaaaaaytgactaatggagaattaaagttttgtttttcttctgtcactccatacaaatgttaaaaccatgttgaattaagatttctctgaaggcgcttctataattctgaaatacatttagtgtaaataaaagcctgccactttacacataggcacagcagctagggctgtaataagcctacatatcagaagccttggttcttataagggtgggtgggaggtattacctgtgtcaaaattatagtcactgtgcttaactcaggacagacacaggagttccttttactgctgaaagacctacttaccc

SEQ ID NO: 27376 - DNA, 601 bp, Human
aattctgaaatacatttagtgtaaataaaagcctgccactttacacataggcacagcagctagggctgtaataagcctacatatcagaagccttggttcttataagggtgggtgggaggtattacctgtgtcaaaattatagtcactgtgcttaactcaggacagacacaggagttccttttactgctgaaagacctacttacccatgactatgccctaatatgtatgaaggtaagccaaggagatatgagctgttgcttcccttctcctgtcgtattcaagagaaacaaaatagccaatraatcaaatctgacaactccacccaactcaagtttccataatgtcaaggaagttgctggccagaaatagaacacaaaatcagttatgagttgtggaacctcagacaacctagattaaaccaaataaacttagtgagaactcagtgaaagcagctaggatttactgctgaaaaagggtcttgagggaccacccggcacctgtcctgaatacaagggctggaagagcaggctttctctgcaggagctcctcagcactggcgtggggagaggcaggcatcaggttagattgttggttcctctgt

SEQ ID NO: 27377 - DNA, 601 bp, Human
aactgctttctcaatccatccccttgtcctcatagggaaataaggaaggacatttccacatgagtcctagggttagacatctttccatcaaagaagaaagtacttgtggacatgatttatctcagtgtgcatggttgtgagttagaaggtaattaattgtattgaaggtgagggggaactgttccatactggccctatttacacacccaaaaatgccagggatgcttgtgtagtcttatatgtagagcaggtcttaacaagtgggttttctagattgtaatgctagacgtaataagtagcrgtaggctggagagtaggccatgtaaaggaagtcccggttggatggcacttaaggcctaagtgttttgaagcctaggggatctgactaagctgattgctcaggctgcccactgaggactcagttgtgactcacacttttctctctgcagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggc

SEQ ID NO: 27378 - DNA, 601 bp, Human; identical to SEQ ID NO: 22326

SEQ ID NO: 27379 - DNA, 601 bp, Human
gaacttcttatgaattgagtacagctccccagccctgtctgtctcacccattctcctctccacatatgtgggatgtttcaggactcggtggcttttgaggatgtagatgtgaacttcacccaggaggagtgggctttgctagatccttcccagaagaatctctacagagatgtgatgtgggaaaccatgaggaatctggcctctataggtaaggattgtatacttccatcacttagcaattaaagaagaagtgcttcttgtgcagtgatgctgttccatggtttgcatcatggagggagartacttggggggctaaaacaggcatagtcacagggtatcatgaacctagaatctaataatttttctataattttgcactaattcagaatttttctgggtctctgttttagggaaaaaatggaaggaccagaacattaaagatcactacaaacaccgagggagaaatctaaggtaatttgtactcagagaaagcaaattcacttgaaagtaccttagcatgtcatgaaattttaaaaacaggcaaacataactgataagccaagcttcaaattgatttattttttgaatattttccccaaat

SEQ ID NO: 27380 - DNA, 601 bp, Human
ctgataagccaagcttcaaattgatttattttttgaatattttccccaaatacatattcttcagtgtaaacagatgttcagtttttataaaaatgttcatttgtcaacagaattaagaaactatttaagaatatcactgtttgagtgatagttgcggtcaagcccattgcagagcattgaattcattcatgctcaaacaaatcagacttggcatcgagtctacgctttacctgataatattgaaaatgcaagtttaatagctattaatataaaatgattaacaaatccttagtaatgtccktctcattttttacagaagtcatatgttagaaagactctatcaaactaaggatggtagtcagcgtggaggaatttttagccagtttgcaaatcagaatctgagcaagaaaatccctggagtgaaactctgtgaaagcattgtatatggagaagtcagcatgggtcagtcatcccttaatagacacatcaaagatcacagtggacatgaaccaaaggaatatcaggaatatggagagaagccagatacacgtaaccagtgttggaaacccttcagttctcaccactcctttcgaacacatga

SEQ ID NO: 27381 - DNA, 601 bp, Human
gtcatcacacaaccctgtcacacatgaatgtgtagtggagagaaccttggtaaatgtaaagagtgtgggagagcctttagtcattttagttccacttgaagccatgaaagaacacacaaaagagaaagctcttgaatataagcaatgtccacacgtttttagccagcccacatgctttcaacaacatgtaagaatgtaccctggatcaaaacactataaatgtgaaaactacaaggaaggttttccattatacttttaaagtcatttgagggctctggctctgtggctttgtgggttaaastacttgtctggcaaacaggagatgctggatttcaatcccagcagggcctcactagttgaggtattgaatttgaacagatgttttggctctggctgggtgtggtggctcacacctgtaatcccagcactttgggaggctgaggcaggaggatcacttgaggtcaggagtttgagaccagtgtgcaaaacatagcaagacctcatctcagaaaaaaaaaaaaagtcatttgaaaacttctaatacagcaaaatcctataaatgtaagtacttcaaaaagcctcatgcatagcgggtcatgta

SEQ ID NO: 27382 - DNA, 601 bp, Human
ccttgcatgtcatcatagacttcatactgtctaaggtttctaatcaacaatcaaaccttgcacaacatcagagagtttatactggagagaaaccttacaagtgtaatgagtggggcaaagccttaagtgggaagtcgtcacttttttatcatcaagcaatccatggtgtagggaaactttgcaaatgtaatgattgtcacaaagtcttcagtaatgctacaaccattgcaaatcactggagaatccataatgaagacagatcttacaagtgtaataaatgtggtaaaattttcagacatcratcatatcttgcagtttatcagcgaactcatactggagagaaaccttacaaatatcatgactgtggcaaggtcttcagtcaagcttcatcctatgcaaaacataggagaattcatacaggagagaaacctcacaagtgtgatgattgtggcaaagtcttgacttcacgttcacacctcattagacatcagagaatccatactggacataaatcttacaaatgtcttaagtgtggcaaggtcttcagtctgtgggcactccatgcagaacatcagaaaattcatttttgagataactgttc

SEQ ID NO: 27383 - DNA, 601 bp, Human
gatcataaagctttaattgacattagagccaaataggcattgacttgagattgagttgacttaaccttgagtttaagaattaatttacattaaagtgtttatgttaagaagattgggccaggtggggtggctcatgcctgtaatcccagcactttgggagcccaaggctgatagatcacagccacacctggctatgagagtgtgtaggtggccgttggggtgggacctgattagaaggggcagggccttgaacagaatctgggcggggcaagaatgaggaggctgcctggaggccgggccmgagggtgatcgtcatcttgagggcaaggtctggaagtggtgttttgaagggcagggtctcgagggggcgggtcctggctttctcctcagctggaccccaggtgtcgtctgctgtcatcctcttgccctgcaggactagattctccgggtactaattggtggatagtttctgatgtgccgtgatattacccctaatatcacagggatgcctcctgtccattttagagacttgctctgtcgcccaggctggagggcagtggcgcgatctcggctcattgcaagctccgcctcccgggttcat

SEQ ID NO: 27384 - DNA, 601 bp, Human
gtctcgagggggcgggtcctggctttctcctcagctggaccccaggtgtcgtctgctgtcatcctcttgccctgcaggactagattctccgggtactaattggtggatagtttctgatgtgccgtgatattacccctaatatcacagggatgcctcctgtccattttagagacttgctctgtcgcccaggctggagggcagtggcgcgatctcggctcattgcaagctccgcctcccgggttcatgccattctcctgcctcagcctcccgagtagctgggactacaggcgcccgccaccaygcctggctaattttttgtattttcagtagagacggggtttcactgtgttagccaggatggtctcgatctcctgacctcgtgatccgcccgcctcggcctcccaaagtgctgggattacaggcgcgagccaccgcgcccggcccctaagttaatatttcaaacaatcgaaggtaaaacaacatattgtgttgggccacctgtactgaacgctgaatcgtttttcctcttaagttgaaaatggttttaatgcaaagcgccttttttgagcaggtagagtcacgcatccggcaggcggggcga

SEQ ID NO: 27385 - DNA, 601 bp, Human
tcatctctactaaaaataaaaaaaaacagccaggtgtgttagtccacacctgtggtcccagctgcttggggtgctgaggtgggaggatcacttgagccagaaagttggaggctgcagtgagctctgatcttgccaccacactccagcctgggtgaaaaagctagaccctgtctcaaacaagcaaataaatgagaggtataagtcctcctttaaaagtaaaggaagagatttttctttccttttgtctcttagaacattcaattagaaaatttgtaaattcattttctctgtcttctgaggtttttttttttagacagagtttttctcttgttacccaggcttgagtgcaagccacgatctcgcctcaccacaacctccgtctcccgagttcaagcgattctcctgcctcagcttcccgagtagctgggattacaggtatgaaccactatgcccggctaactttgttttttttttttagaaattaaaccttttttcagcttaatgacccaggggtgtatttttgaaggacttgggagctctctttgaaaggcaaacaacaagggaaacagtacctttatctcagtaggaaattaaataattc

SEQ ID NO: 27386 - DNA, 601 bp, Human
ctgcttggggtgctgaggtgggaggatcacttgagccagaaagttggaggctgcagtgagctctgatcttgccaccacactccagcctgggtgaaaaagctagaccctgtctcaaacaagcaaataaatgagaggtataagtcctcctttaaaagtaaaggaagagatttttctttccttttgtctcttagaacattcaattagaaaatttgtaaattcattttctctgtcttctgaggtttttttttttagacagagtttttctcttgttacccaggcttgagtgcaagccacgatctcrcctcaccacaacctccgtctcccgagttcaagcgattctcctgcctcagcttcccgagtagctgggattacaggtatgaaccactatgcccggctaactttgttttttttttttagaaattaaaccttttttcagcttaatgacccaggggtgtatttttgaaggacttgggagctctctttgaaaggcaaacaacaagggaaacagtacctttatctcagtaggaaattaaataattcaaacatcaaataacttcaatttaaggctatggactttgagataattctgagccttgagagg

SEQ ID NO: 27387 - DNA, 601 bp, Human
accctgtctcaaacaagcaaataaatgagaggtataagtcctcctttaaaagtaaaggaagagatttttctttccttttgtctcttagaacattcaattagaaaatttgtaaattcattttctctgtcttctgaggtttttttttttagacagagtttttctcttgttacccaggcttgagtgcaagccacgatctcgcctcaccacaacctccgtctcccgagttcaagcgattctcctgcctcagcttcccgagtagctgggattacaggtatgaaccactatgcccggctaactttgttttttttttttagaaattaaaccttttttcagcttaatgacccaggggtgtatttttgaaggacttgggagctctctttgaaaggcaaacaacaagggaaacagtacctttatctcagtaggaaattaaataattcaaacatcaaataacttcaatttaaggctatggactttgagataattctgagccttgagaggaatgtggtcaggcaacctgagtccagtggaatgcaggtgcaacttctaagagttttcctgtaagtaattaagaagactaagtagccccagagataagacctcc

SEQ ID NO: 27388 - DNA, 601 bp, Human
tcagtaggaaattaaataattcaaacatcaaataacttcaatttaaggctatggactttgagataattctgagccttgagaggaatgtggtcaggcaacctgagtccagtggaatgcaggtgcaacttctaagagttttcctgtaagtaattaagaagactaagtagccccagagataagacctcctcggatcattgtcccttcttatgtagtgataaagtaaccttccttgaagtgtatctatccgtaatcaatcaagttgctgcagcctatgcactggcccagaataaaaaacgtggtrattctgctaaagcttctctgtctttccctgtgtgtgaaatcttaacgtctctacttgggaacgctgatcccattcatttagagttgatgtttccacgtggctatttccaagctttgccttcaaataaattctgtacttaatcatatattctaaattttattatttactgctgacatcagtttctgtcggattgtaggagcctcaccagagagggcccctgtcgccatgttgtaaaactcacacttgccaaaagttgtgggttagggtttctccccctccctcaggatgacgctagttagc

SEQ ID NO: 27389 - DNA, 601 bp, Human
caaggtgaaatcaatattgttgagaagattcttccatctggtaatgttgagaagacttcatttggtaggagtcccttactttacgtgtgtaaattcctaccaggaaagaatacatatccaatagattggagaaagccagagattagccctcattccgcatctgtcaaccaggacagaaagcatggacaagggatgagctttacaaagatgatgcactttggagatcagaaaattcatatttaagcaaagtgatacaaacacagtgatttgggaatgccttcatttacaatgcaatacttamattttaatactcttgtaggagaaaaagcaactgtataaatgaatgtagagtgactttctgcaatatttcaaacctatatcagagaattacactgtgggaaaactaccattgtaataagtgtagcaaaatctccttagatatctgaaaagtcatactggatggaatctgtaggaaacggttctattttgagggaagggggattcctttttgttttttaagtgaattcagaaaatgttataaataaatcttttggtttattataaaccttctgcttgctgattttttcccacagcatgtgat

SEQ ID NO: 27390 - DNA, 601 bp, Human
tatgtgaaagtgatgactgtgaagtaatatggcccacactttattcaccaccctggagaaaaaaaaacccaggaatatgtggaaaagccattaataaccactcttttatttttttgcaataacaaggtgaaatcaatattgttgagaagattcttccatctggtaatgttgagaagacttcatttggtaggagtcccttactttacgtgtgtaaattcctaccaggaaagaatacatatccaatagattggagaaagccagagattagccctcattccgcatctgtcaaccaggacagaawgcatggacaagggatgagctttacaaagatgatgcactttggagatcagaaaattcatatttaagcaaagtgatacaaacacagtgatttgggaatgccttcatttacaatgcaatacttacattttaatactcttgtaggagaaaaagcaactgtataaatgaatgtagagtgactttctgcaatatttcaaacctatatcagagaattacactgtgggaaaactaccattgtaataagtgtagcaaaatctccttagatatctgaaaagtcatactggatggaatctgtaggaaacgg

SEQ ID NO: 27391 - DNA, 601 bp, Human
attcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacactcttgacaacccctatgaatatgaaaattcatttaattaccactcattccttactgaacaccagtgaatttacactgcaaagaaaaactatgaatgtatggaattttttwaaaagaagtataatgccttacttcagagaactcttggaaagaagccttatgtgaaagtgatgactgtgaagtaatatggcccacactttattcaccaccctggagaaaaaaaaacccaggaatatgtggaaaagccattaataaccactcttttatttttttgcaataacaaggtgaaatcaatattgttgagaagattcttccatctggtaatgttgagaagacttcatttggtaggagtcccttactttacgtgtgtaaattcctaccaggaaagaatacatatccaatagattggag

SEQ ID NO: 27392 - DNA, 601 bp, Human
cacttggcatgcatcccttattcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacactcttgacaacccctatgaatatgaaaattcatttaattaccactcattccttactgaacaccagtgaatttacactgcaaagaaaaactaygaatgtatggaattttttaaaaagaagtataatgccttacttcagagaactcttggaaagaagccttatgtgaaagtgatgactgtgaagtaatatggcccacactttattcaccaccctggagaaaaaaaaacccaggaatatgtggaaaagccattaataaccactcttttatttttttgcaataacaaggtgaaatcaatattgttgagaagattcttccatctggtaatgttgagaagacttcatttggtaggagtcccttactttacgtgtgtaaattcctaccaggaaagaata

SEQ ID NO: 27393 - DNA, 601 bp, Human
ctgagttttgctggggaatccaatttccacctctgctgcagatcttgctgtgtaggaaacagctgctttattagtcaacagtctttaatcacttttttattaaacttcaaaactgtaaattataactgccatccatctgggactgctactagtttgagacattttaaattcccattcatgccttatagatcaatgtggatcactcaagtggtgcaaaaccaggctgcaaagcaagggcttatatattattccccctaactctgagggaaagtgctttaggttctgtcctgggaggtattayattctcttcttgcggaatcaagattctttattgcttatcctccttgttctgtgacattgctaaaattaccactaagtttcacaggtatttctttaggattagggataactgtgacaaacttgagactgtatgccccatttgaagggtggtgctgttatctgctgtagccaattattaccctgaagaaattctggctgaattatattaaaataggctggtattaaggaaaatatacattgtttattaacataaaggaatactgtaaaatcttaagaatttttacaaccaatgccaaaaatc

SEQ ID NO: 27394 - DNA, 601 bp, Human
gaacacatttttattttgatttggcctaagggcttggctggtaattgtgcttcacagcagtggggataacagggtcaactattcaaaatgagtccctcatttcagttccacttctttatcctactttttgtcatacttctctccaaattcagaggttctctgagttttgctggggaatccaatttccacctctgctgcagatcttgctgtgtaggaaacagctgctttattagtcaacagtctttaatcacttttttattaaacttcaaaactgtaaattataactgccatccatctgggrctgctactagtttgagacattttaaattcccattcatgccttatagatcaatgtggatcactcaagtggtgcaaaaccaggctgcaaagcaagggcttatatattattccccctaactctgagggaaagtgctttaggttctgtcctgggaggtattacattctcttcttgcggaatcaagattctttattgcttatcctccttgttctgtgacattgctaaaattaccactaagtttcacaggtatttctttaggattagggataactgtgacaaacttgagactgtatgccccatttg

SEQ ID NO: 27395 - DNA, 601 bp, Human
tttcacatgtatcattctttgttcccaagtgtctttatttttcttcaaggtagaagatgttgttagcccaaataaatcgagattctcagggaatgacagagtttcctggaggagggatggaggcgcaacatgttacgctgtgcttgacagaggcagtcaccgtggcaggtgagcagttgtgtttgaagggatgcgtttgaaaatatcatttatcttaaaagaaaaaaaatttacaacttcctagttcctgatttagcagaaaacaatataaacctaggtctttttatgaggtgttttggtktttttttttttgaaacgggacggagttttactcttgtcgcccaggctggagtgcgatggtctgctctcggctcactgcaacctctgcctcccaagtccaagtgattctcctgcctcagcctcccgagtagctgggattacaggcatgtgccaccacgtccggctaattttgtatttttagtagagacggggtttcaccacgttggccaggctggtctcaaactcctgacctcaggtaatcaacctgcttcggcctcccaaagtgctgggattacaggcatgagccattgcgcccagcctc

SEQ ID NO: 27396 - DNA, 601 bp, Human
accatgttgcccaggctggtctcaaactcctgggctcaagccatccacccacctcagcctccaaaagtgctgggattacaggcatgagccattgttcccagcctgtttttggtaagtgctaaatctcactttttttcttttttttgagacggagtctggctctgtcgcccaggctggagggcagtggcacaatctcggctcactgcaacctctgcctcctgggttcaagcgattcttctgcctcagcctcccaagtagctgggactacaaggtgcatgccaccgcgcccgactaatttttrtatttttagtagagacggggtttcacctcattggccaggctggtgtcgaacttctgacctcatgatccacttgccttggcctcccaaagtgccgtgattacaggcgtgagccactgcacccggccgctaaatctcattttgagtctgagttaagcagtttaccttttttctgatctttatttgaaaaaaaaattaatcagcatgtccatatgctagctgtctaaagaaaatattgatttttttgtaatagatggtgacaacttagaaaatatggaaggcgtaagcttgcaagcagtaaca

SEQ ID NO: 27397 - DNA, 601 bp, Human
tccatatgctagctgtctaaagaaaatattgatttttttgtaatagatggtgacaacttagaaaatatggaaggcgtaagcttgcaagcagtaacacttgcagatggttctactgcttacatacaacacaattctaaaggtatgtgcctcacatatggctgattggttaataccagtgatttataacctgtgagttggagcacctagaagctataccacctttcctatgtctcctaaagatgctgtattgcatatgatgattttaagtcatttcagtttaattctttttttttttttttttataatttggaatagtcctttgagatatttggaagataccctgggatatcaaaattagtgggagagaggagagcagggagtatgtcttactattttctagtaagacctttcttgcttctttaccttgggtcattatttcgtatttttaccaaatacctgtaagagtaaagacatttggggccgggcatggtggttcacgcctgtaatcccaacgctttggaaggccgaggcgggcagatcacctgaggtcgggagttcgagaccagcctgaccaacatggagaaaccgttttctgtaataa

SEQ ID NO: 27398 - DNA, 601 bp, Human
gggccgggcatggtggttcacgcctgtaatcccaacgctttggaaggccgaggcgggcagatcacctgaggtcgggagttcgagaccagcctgaccaacatggagaaaccgttttctgtaataaaaatacaaaattagctgggcatggtggcgcatgcctgtaatcccagctactcaggaggctgaggcaggagagtcgcttgaacccgggaggcagaggttgcagtgagccgagatcacgccattgcactccggcctgggcaactagagcaaaactctgtctcaaaaaaaaaaaaaaaaagacatttggttttgcttatctgacattgtctctgaattagtgtttgctttgctccaggaaacagccaagtcctcaaaaactctttgtttctatggaaacctactgagcacatgcatacataaacaggggtcttatagccctcagggatgagaatgacagatgatctcacatacactgacataatctgtctgtcttcccagcttcaactccccactggtcatggtcactgattctaagtgactctgaaaggtataaagcagtccaactcatgtagcctgctgtgatgagccactcttcctc

SEQ ID NO: 27399 - DNA, 601 bp, Human
tggtcttgttctcaagtcctccttctgtaaagggagattatagatgccacagagtggatcttaaccaagactttctcgtaaagataatggaaaagaagttactggactgcactgtggagataaatgagtaacagtcctgagtgaatgtttctgttttttgagctgaatcttacatgtctctcattttcttcatttttccccttctttcaactctctttaatactggtgtatatttctaaaaccaatattctaatgtctttttacctttaaacactgacgcagggaagctttactgaacttwcttaaatgttcaaagactcatgaagcaagtatagattgttataatgtgttaatggtttattgactcttgttgctaagtgagttaattggaatgtgctagaaaacatgagatctaaatgtaagcattgttcttgagcaggggacagtttgcgtctagaggatggtcaagcagtacagttagaagatggtaccacagcatttattcaccacacctccaaaggtaaaataactttgaaagtatgaataaaataagggagaagtgggagtggtgggggaaagaagacctgtgtttagcttctga

SEQ ID NO: 27400 - DNA, 601 bp, Human
tgggcatgttggctcatgcctgtaatcctagcactttgggaggccgatgcaggcggatcacctgaggtcaggggtttgagaccagcctggccatgcaaaaccctgtctctactaaaaatacaaaaaaatacaaaaattagccagttgtggtagtgcatgccttcaatcctggctactagggaggctgaggcaggagaatcgcttgaacccaggaggtagaggttgcagtgtagttgagatcgtgccactgcactccagcctgggcaacagagtgagaccctgtctcaaaaaaaaatatatrtgtgtgtgtgtgtgtgtgtgtgtgtgtgtgtgtgtgtgtgtgtgtgtataaaatttttaaagcaaggtcctttgcctactatgtttaattgaaactaagtatacaatgtcaaaaatatttgaagcaaatacagcaaaatgttaatgcttattacatttgtttaagggaagttcaggggtttgaggtggaatgtctaggaatgatgagtacagctctgcaaccagactatgtatattcaaagctactttttttttgctgtgtgacattaagcagattacttttctgtgctttagtttcatc

SEQ ID NO: 27401 - DNA, 601 bp, Human
gagggactgtggagtcatactgacatgagttcaaatcctgatttctctacatattgattttgactgttaattgttagtgttttttctttgtttgtttttgtttttggtttgttttttgagagggactctggctctgtcgcccaggctggagtgcagtggcacgatcttggctcactgcaacctctgcctcccaggttcaagtgagtctcctgcctcagcctccccagtagctgggaatacaggcgcgtgccaccgtgccctgctaagttttttgtatttttagtagagagggtgtttcacygtgttagccaggatggtctcaatctcctgacctcgtgatccgcccgcctcggcctcccagagtcctgggattataggcttgagccactgcacccggcctgttaatgttttttaaattttctgattgctaaggaaagtgatgttacttctccaaacctgagttcccatttatacaatgaaggcagtaaatgtacctgccttgcagaattattgtgaggattaaatgaaataacacatatcaagtgcgtggtccagtactcagagtaactactcaataaaagctcatttctctcttccttta

SEQ ID NO: 27402 - DNA, 601 bp, Human
tttaatttaatggcattctcttccactctctcagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctacaattgaccctgacaccatcagtgctttggaacagtatgcagcaaaggtatagcatttcacaatgtcaagaatgttgcagatatagcttctttatttttcatgaaaagaaaagaaamcaaaaaagtacacctcatcaaaaaaaacctggccaattttggctgggcatggcgtgatggctcacgcctataacttcccagcactttgggaggccaaagtgggaggattgtttgagcatagatccctgtctcaaattcagaaattaaaaaaaaagacactagcaactcaaagtcaaaatcagttagtatcaaagagatcagcatttatcttaagtgaagtgtggaaagattggaaaaaaaaagggaatggagtaaagacttatagaagagaaatgagtggcaggtaattcaccgaaagat

SEQ ID NO: 27403 - DNA, 601 bp, Human
aggtctgcacactggggatgctacaattgaccctgacaccatcagtgctttggaacagtatgcagcaaaggtatagcatttcacaatgtcaagaatgttgcagatatagcttctttatttttcatgaaaagaaaagaaaacaaaaaagtacacctcatcaaaaaaaacctggccaattttggctgggcatggcgtgatggctcacgcctataacttcccagcactttgggaggccaaagtgggaggattgtttgagcatagatccctgtctcaaattcagaaattaaaaaaaaagacactrgcaactcaaagtcaaaatcagttagtatcaaagagatcagcatttatcttaagtgaagtgtggaaagattggaaaaaaaaagggaatggagtaaagacttatagaagagaaatgagtggcaggtaattcaccgaaagatatacgaggatgaagggctataaaagaaataataaagtgtaaatggaactgcttatgaattaagaagtaggaactatagattaggaaaagtaaagtctcaagttttatatcaaaagagctgattttttttttcccctgcattgaacatgtatctctcatata

SEQ ID NO: 27404 - DNA, 601 bp, Human
tcaaattcagaaattaaaaaaaaagacactagcaactcaaagtcaaaatcagttagtatcaaagagatcagcatttatcttaagtgaagtgtggaaagattggaaaaaaaaagggaatggagtaaagacttatagaagagaaatgagtggcaggtaattcaccgaaagatatacgaggatgaagggctataaaagaaataataaagtgtaaatggaactgcttatgaattaagaagtaggaactatagattaggaaaagtaaagtctcaagttttatatcaaaagagctgattttttttttcccctgcattgaacatgtatctctcatataacttaaaaggttttatttcacttttgttagggacattttctttttttttttctttacaaacaaaataaatagagacagggtcttgctcttttgtccaggctggtcttgaactcctgggctcagatgatcctcctgcctcagcctcccaaagtgctaggattactggcatgagccaccatgcccagcctattatggaaattttcaaatatacacaaaaataaatgataatgaagccccatgtacttttttttctttttctttttttttgca

SEQ ID NO: 27405 - DNA, 601 bp, Human
ctagtgcctcagcctcccgagtagctgggattacaggcgctcgtcatcatgcccggctcatattttgtatttttagtagagatgaggtttcactatgttggccaggctggtctcaaactcctggtctcaagtaatccgtccgcctcggcctcccaaaatgctgggattacaggcgtgagccactgcacctggcctgcctgctgtgtttgatacttttcactcctccacattctgtttattttagcgggaaaataaaagccaagctttaaaggctgtcatagactctaacatcaggacaggmcttagcaatgggatgaggcctttgcatccagcagggctgggactggcaccaggcctgctgacttccattcttcattccatgtcttgattccactttgagctcttggggtatgagaacaactgataaaactgaggcactttagaaaagaaacacacaacctcttttagacagaaatgaaactattgaattttcagcatggcagtcccgagctatgatacttttgtacatttttttgtttgtttttgagacagaatctcactctgtcgcccagcctggagtgcagtgacgtgatctcggctc

SEQ ID NO: 27406 - DNA, 601 bp, Human
attggtaaagcagatttttttgtttttgagacagtgtctcacttcagtgcccaggctggtgtgcagtggcacagtcacagctcactacagccttgacttcttgtgctcatgtgatccccccatctcaccctcccgagtagctgggacttaccactgtgcaccactacacccagctaattttttgaattttttttgtagagacggggtttcgccatgttgcccaggctggtcttgaactcctgagctcaagtgatccgcctgccttagcctctcaaagtgctgggattacaggcatgtgctrctgtgcctggccagactttttataagcttagattatgagggtagtagtagtatgtccagcaggtatttttgacatatgtgctaggcactagattttctttttttttttttggttcaataacacaagtatgtattgaacacctactatttcctgacacagttaatattaggcattatcttgttgaacattagttaaaacaccatttttttttctcttgagatggagtctcgctctgtcgccgaggctggagtgcaacggtgtaatctcggctcactgcaacctccgcctcttgagttcaag

SEQ ID NO: 27407 - DNA, 601 bp, Human
tagtatgtccagcaggtatttttgacatatgtgctaggcactagattttctttttttttttttggttcaataacacaagtatgtattgaacacctactatttcctgacacagttaatattaggcattatcttgttgaacattagttaaaacaccatttttttttctcttgagatggagtctcgctctgtcgccgaggctggagtgcaacggtgtaatctcggctcactgcaacctccgcctcttgagttcaagcgattctcccgcctcagcctctcgagtagctgggattacaggcgcccrgcaccacgcccagctaattttttgtatttttaatagagaaagggtttcaccatgttggccaggctggtcaaaacaccatatttttaaagagcaaaaattattttcctgcaagatattgtagaataaatcaagtaggatacaagcttttagggaattctgggtttgttctaatttaattcatattcctgactgtacttttcttttatatttcttatgtttttctctctgcttttctcagctcattttttgcctacctggatgattccatcttggagagctatgtaatcagtgattagtttt

SEQ ID NO: 27408 - DNA, 601 bp, Human
tccagcaggtatttttgacatatgtgctaggcactagattttctttttttttttttggttcaataacacaagtatgtattgaacacctactatttcctgacacagttaatattaggcattatcttgttgaacattagttaaaacaccatttttttttctcttgagatggagtctcgctctgtcgccgaggctggagtgcaacggtgtaatctcggctcactgcaacctccgcctcttgagttcaagcgattctcccgcctcagcctctcgagtagctgggattacaggcgcccagcaccaygcccagctaattttttgtatttttaatagagaaagggtttcaccatgttggccaggctggtcaaaacaccatatttttaaagagcaaaaattattttcctgcaagatattgtagaataaatcaagtaggatacaagcttttagggaattctgggtttgttctaatttaattcatattcctgactgtacttttcttttatatttcttatgtttttctctctgcttttctcagctcattttttgcctacctggatgattccatcttggagagctatgtaatcagtgattagttttgaatacc

SEQ ID NO: 27409 - DNA, 601 bp, Human
tcaaaacaccatatttttaaagagcaaaaattattttcctgcaagatattgtagaataaatcaagtaggatacaagcttttagggaattctgggtttgttctaatttaattcatattcctgactgtacttttcttttatatttcttatgtttttctctctgcttttctcagctcattttttgcctacctggatgattccatcttggagagctatgtaatcagtgattagttttgaataccattcccagtttcttatgtagatttaagtttggagtggaagatgctgtttccccaacccccscaaaaaaatgcctgaaagggaagctcagcacaagaaggctagagtcttgagcataatcctaggcaggactgaaggataagacattttaatcctctatatatttttgcaccatttaatgtattaccctttatatttgcaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgcaacaaattataaaaac

SEQ ID NO: 27410 - DNA, 601 bp, Human
atacaagcttttagggaattctgggtttgttctaatttaattcatattcctgactgtacttttcttttatatttcttatgtttttctctctgcttttctcagctcattttttgcctacctggatgattccatcttggagagctatgtaatcagtgattagttttgaataccattcccagtttcttatgtagatttaagtttggagtggaagatgctgtttccccaacccccgcaaaaaaatgcctgaaagggaagctcagcacaagaaggctagagtcttgagcataatcctaggcaggaytgaaggataagacattttaatcctctatatatttttgcaccatttaatgtattaccctttatatttgcaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgcaacaaattataaaaaccatgtgaggatacacacaggtaacaatctctgatcttttggtcttttatctttcaaggctcagtttaac

SEQ ID NO: 27411 - DNA, 601 bp, Human
gtgtatgggccgggcgcggtggctcacgcctgtaatcccagcactttgggaggccgaagtgagcggatcacgaggtcaggatatcgagaccatccttggctaacatggtgaaaccccatgtctactaaaaacacaaaaaattagccgggcatggtggcgggtgcctatagtcccagctactccggaggctgaggcaggagaacagcatgaacccgggaggcagagcttgcagtgagttgagatcgcaccactgcactccagcctgagcaagagcgagactccatctcaaaaaaaaaaaaaagtatgtgtttcagtgttttttagtatattcacaaggttgtgcaaccatcaccacaattcaattttagaatattttcatttcccctaaaagaaattccatactcagaagcagtcctttccccaccccgccccccaggtgtaagcaatcacgaatctactttctcttctatgggtttgcccattctggatattttcatataaatgaaatcatgcagtatgtggggggtttttgtctgacttcgttctctttgcataatggagtgcagtggcgcaatctcggctcactgcaagctccgcctcc

SEQ ID NO: 27412 - DNA, 601 bp, Human
agaccatccttggctaacatggtgaaaccccatgtctactaaaaacacaaaaaattagccgggcatggtggcgggtgcctatagtcccagctactccggaggctgaggcaggagaacagcatgaacccgggaggcagagcttgcagtgagttgagatcgcaccactgcactccagcctgagcaagagcgagactccatctcaaaaaaaaaaaaaagtatgtgtttcagtgttttttagtatattcacaaggttgtgcaaccatcaccacaattcaattttagaatattttcatttcccctraaagaaattccatactcagaagcagtcctttccccaccccgccccccaggtgtaagcaatcacgaatctactttctcttctatgggtttgcccattctggatattttcatataaatgaaatcatgcagtatgtggggggtttttgtctgacttcgttctctttgcataatggagtgcagtggcgcaatctcggctcactgcaagctccgcctcctgggttcacaccattctcctgcctcagcctcccaagtagctgggactataggcgcctgccaccatgcctggctaattttttgtatg

SEQ ID NO: 27413 - DNA, 601 bp, Human
attggtacatggggaactgtttctctatacttttgtgtatatttgaaattttctgtagtaaaaagttctaaaaatatgtgtactgcctataatgttctcaagctgtttcatgggacaaaaattaaagtatttacttccctatgtattgcctgcttgctattagtgaatactcagtagcttttgattggatgtaagaagtcaggttaagttaaatgaaacatgtttgtccttttagttgtattgacatatctaactaggtttaatagacttttaaagacaatccttttttattatctttatraaattcttaggaagctgcataagttacgataatagcatttattattattaatagactataacagtatctagattatctaattatgggaaacaaattacagtttcattaaagttagagttaaactgggcaacatctccatccttttctcattccttgagattaaggagaacctggtgttgatgcatggagacagcactaaggatcatactaccttttgagtcaagtcaaaaccatagttagggaatcttttcttgtgtgctgcctcatggtgggatgaggaggggtttggcaattctttat

SEQ ID NO: 27414 - DNA, 601 bp, Human
tcaattggggagatactggtcaaagagtacagtttcagttaggaggaataagttctggagatctgcacagcatgtgactacagttaataataatgtactgtatatttgacaattgctaagagaaaggaagtaaataagaagatcctacaacaactgctgagtctttttagttagaaagcaggctttaatgatatcagacttaagtttgcaagactctttttctaagcttcctcaagtctcttccttaaatgttgatatttcaggttatcagaagttcctatattctttttttttttttttwatttttgagatggagtctcgctctgttgcccaggctggagtgcagtggtgcgatctcggctcactgcaagcttcgcctcccgggttcattccattctcctgcctcagcttcctgagtagctgggactacaggcgcccgccaccatgcctggctaattttttgtgtttttaatagagacggggtttcaccgtgttagccaggatggtctcgatctcctgacctcgtgatccgcccacctcggcctcccaaagtgctgggattacaggcgtgagccaccgtacccagcccagaagttcctat

SEQ ID NO: 27415 - DNA, 601 bp, Human
ccattctcctgcctcagcctcccgagcagctgggactacaggcgcccgccaccatgaccagctaattttttgtatttttagtagagacggggtttcactgtgttagccaggatggtctcgatctcctgacctcgtgatccacccacctcagcctcccaaagtcctgggattacaggcatgagccaccgtgcctggcctaacagcctcttaagtgaatgcgagaatttagtgcatacttgctgtatttgaagggttatttgctagttttcctgtacagttcctcccctctccgcccctaatrcacatatagtatcaagtaattactccaactaagagaataaaacaggtccctgaaaatcagaacacttaaatttgatgcagaaagattttttgtttggtctgctttgatgtagtttgcctttgcaaaagtggaggtggaggaattggaaggaggtcctggaagccattttcgtgacttagaatataatacatgtacattttaattatgtaattttctctttaatatttaaaatgtcctattttctaaacaaattggttggttggtcaaataaatgattcatttgttttaaacaggtcaagg

SEQ ID NO: 27416 - DNA, 601 bp, Human
caaaagtactggatccatgtgaaacacagatcagaaaagggataggatttggtggctgattagatgcaggaggtgagattgagaaaacagagatttggctgaggtgatcagcatatgatggcaccattaagagatcaggaatcatgagagttcactcaactagcctcacagagtcggtagaataggtatcttgatttccccccaggaaaagcacagtgtaatggttgttctctgttagccaaacttgttattattttctagatgtcactagcctaaaattattccaccttgattccatttytaagctctagcaaagactgtcttaatacctggtggaaatatgcacaatgtgcttctttacccttctgtgtcttcctctttcatggagaacgctctccttacccatctctcagagtttaatgattaatatgctctgttttgatactcaggattagaaaatacaaagctcttacaccttctcatttatctccttcctcactttgacgtcactaatttcacactatactctctgtcctctgactggtatgcaagattattaaccaagttttaattctgcatcagccttaacactttttcttga

SEQ ID NO: 27417 - DNA, 601 bp, Human
tcgggaggctgaggcaggagaattgcttgaatccaggaagcagaggttgcggtgagccgagatcatgccattgcactccagcctgggcaacaagagtgaaactcctcaaaaaaaaagtctgaactataggtgatgggcagtcacaggggatttcagcagcagagagcataataagattttgttttgttttgttttagaaagatgtcaacatagaggatggttagggaagggttagactggatacctggagagaagttggattctcgtagaaattcagatgggagaaaaataaggatctaamttagcaacaggaatggagaggaggaaatgcaattaagaaatactgtattgccgggtgtggtggctcatgcctgtaatcccagcactttgggaggccgaggtgggcggatcacaaggtcaggagatcgagaccggcttgtctaacacggtgaaacctcgtctctactaaaaacacacacaaaaaaattagctgggcgtggtggtgggctcctgtagtctcagctacttgggaggctgaggcaggacagtggcatgaacccgggaggcggagcttccagtaagcagagattgcgccactgca

SEQ ID NO: 27418 - DNA, 601 bp, Human
gcatgaacccgggaggcggagcttccagtaagcagagattgcgccactgcactccagcctgggcaacagagcgagactctgtctcaaaaaaaaaaaaaaagaaaaagaaaaagaaaagaaatactgtattgccgggcacagtggctcacacctgtaatcccagcacttttgggaggctgaagtggtaggatcacttgaggccaggagtctgagaccagcctgggcaacatgttgagaccccatgtctacaaaaaaaatgacaagtaattagtcgggagcaatgggtcatgcctatagtcasagctacttaagaggatgaggctagaggatcacttgaacccaggagttttagacttcagtgatttatgattgcatcactgccctccagcctgggcaacagagtgaggccttgtctccaaaaataataataataaaaaaataataaaaatataagaattgttaaaagaaatattgtattgatttttctgatgactgaatgagtttatttcattctaaaaggcttatttacatccacagggcaaacttatacaaggattagtcctggtccttatggaagattgtcagctataacaagaaacat

SEQ ID NO: 27419 - DNA, 601 bp, Human
tgcaaccttaaagattacttggactgtattcaaaatgtactaacaatgaaagaaaaaactgataaattggacttaatcaaaattaattctgctcaccaaaagacactgttaagaaaaagatcagacaacccccagactgaggaaaagatattcacactatatacacacactatattgaatataagtctaaaaacggactgtattgagaatgtgcaacaaacttctacaaatcaacaatgaaaagatgaacaaccgttaaaaatgagccaaaaaagtgttttaaaatgtacaaatcattccrttgctcattgaacagacctcccacaaaagattcataactcaaaaagtgcacatcttttatcatcaaagaaatgcaaattaacatcacaatgagagagcatttcaaacccaagaagatggctaaaatcaaagactaacaaaaccaaatgttgatttctcctaagaaactggtgaggaaacaaccaccaccaccacctccaaatgttggcaaagatgtggagcaactagaatattcatatactgctagtgggaatgtaaaatgatcaataagcacatgaaaagatgttcaacatcattagtc

SEQ ID NO: 27420 - DNA, 601 bp, Human
gccgaggtgggtggatcacctgaggtcaggaattcaagaccagcgtggccaaacatggtgaaaccccgtctctaataaaaatacaaaaacattagccaggcgtggtggcagggtgcctgtaatcacagctactcaggaggctgaggcaggagaatcgcttgaacccaggaggcagaggttgcagtcagccgagattgcaccactgcactccagcctaggcaaaaagagtgagactccgtcttaaagaaaaaaaaaaaaaagcttctggttattttcataggaaacaaatttttgtattaamggtttaagctattttaagctgcttgttacatattgccaaattatttttcagaaaggtttagtaatcgtgttatggatctaaaagctttctttttcactgtactcttgcattgaggattttttaaaatatttacagaattaacaagcaaaagttaaattctgtttattttcatttgaccactggtgaagttaagcctgtttttcatatttgcctgcaatctggttttttcttaattgaggtaaaatttacataacaatgaaatgcacagatcttaaatttacaattcaatgagttatgtta

SEQ ID NO: 27421 - DNA, 601 bp, Human
agagatggggttttagcatgttggccatgctggtctcgaactccggacctcaagtgatctgcccgcctcggcctcccaaagtgctaggattacaggcgtgagccaccgcacccagcttggttttgcctattcttgaacattacataaatggaaccacagtatgaactcttttgtgtctgggtttttctacttaacgttttggatatttattcacattgttggcatgtaataacagttcattcttttttattgctgagcagtgttctattgtaagaatataccacaacttgttgatatattytccccttggtgaacatttgaaatgcttccagtttttgactattatgaataagatggcagtaaaaatatgtttgtagacatatactctcatttgtcttggataaatacctatttgtggaattgctgggtcatagaatagaggcatatttacctttctatgatagtaccaaacaattctccaaagtggctgggctgtcatacactcccactagcaatgtctaagagttccatttgttcagtgctgcttcttgtggttaaaacgtttttaaaaaataggctgggcgcagtggctcacacctgt

SEQ ID NO: 27422 - DNA, 601 bp, Human
tattgctgagcagtgttctattgtaagaatataccacaacttgttgatatattctccccttggtgaacatttgaaatgcttccagtttttgactattatgaataagatggcagtaaaaatatgtttgtagacatatactctcatttgtcttggataaatacctatttgtggaattgctgggtcatagaatagaggcatatttacctttctatgatagtaccaaacaattctccaaagtggctgggctgtcatacactcccactagcaatgtctaagagttccatttgttcagtgctgcttyttgtggttaaaacgtttttaaaaaataggctgggcgcagtggctcacacctgtaatcccagcactttgggaggccaaggtcggaggattgcttgagcccaggattttaaaaccaacctgggcaatgtagcaagacactgtttccaccaatttttttttttttttttttttttttttttgagacggaatctccctctgtcgcccagactgcagtgcagtggcccaatctcggctcactgcaacttccgccttccgggttcaagtgattctcctgcctcggcctccttagtagcaggattac

SEQ ID NO: 27423 - DNA, 601 bp, Human
gatcatactctattagagtatttttactgcccttaaaatcctctgtgacaatttgctaatatcttgttaaggattttggtgtcaatgtttatgaaccatattgatctataatttattatgaaattataagaaaaagtttcatctcctgtttcaatatcagggttaggcttgcctcataaaacaagttgggaagtgttctcttctgtactattttctgatagttgtgtaagattggtattatttctccataaaagcttgatagagttaattaggacaccaccatctatgcccagagttttcyttttgcggaggtttttttttgttttttttttgttgttgttgttgttgttttttactatggattcaagtttttaagtggatctatactattcaagttatctatgtttttttgtatccattttgctaagttttgtttttgtaagtttgtctgtttcatctaagttttcatatttattgatataaagatgttcatactatttccttattatctctttaatatacataggatctgggggccgggtgcggtggctcatgcctgtaatcccagcactttgggaggctgaggcaggtggatcacctg

SEQ ID NO: 27424 - DNA, 601 bp, Human
tttactgcccttaaaatcctctgtgacaatttgctaatatcttgttaaggattttggtgtcaatgtttatgaaccatattgatctataatttattatgaaattataagaaaaagtttcatctcctgtttcaatatcagggttaggcttgcctcataaaacaagttgggaagtgttctcttctgtactattttctgatagttgtgtaagattggtattatttctccataaaagcttgatagagttaattaggacaccaccatctatgcccagagttttctttttgcggaggtttttttttgktttttttttgttgttgttgttgttgttttttactatggattcaagtttttaagtggatctatactattcaagttatctatgtttttttgtatccattttgctaagttttgtttttgtaagtttgtctgtttcatctaagttttcatatttattgatataaagatgttcatactatttccttattatctctttaatatacataggatctgggggccgggtgcggtggctcatgcctgtaatcccagcactttgggaggctgaggcaggtggatcacctgaggtcaggagttcaagaccaac

SEQ ID NO: 27425 - DNA, 601 bp, Human
gccgggtgcggtggctcatgcctgtaatcccagcactttgggaggctgaggcaggtggatcacctgaggtcaggagttcaagaccaacccagggcaacatggtgaaaccccatctctactaaaaatacaaaattagccaggtgtggtggcgcatgccagtagtcccagctactcaggaggctgaggtgggaggatcatttgagcccaggaggcagaggttgcagtgaactgaggtagcacagctacactacagcctgggcgacagagggagaccctgtctcaaaaaaaaaaaaaaaaaaaagtcagtggaaggtaaagcaattcttagaggaaaatttcttttaaatgcttgtattggaaaaaaaaggtttaaattgaatgatcttagtttctaccttaagaaaaattaaacaaaaaaagtaaatggaaggaaataaggactgggcgcagtggctcacacctgtaatctcagcactttgggaggctgaggcaagtgttcccgagtagctgggacccaggctggcctcaaactcctgggcttcagggatccctcagcctcagcctcccaagaagctaggactgcaggtacaagccactgctt

SEQ ID NO: 27426 - DNA, 601 bp, Human
caagccattgcattccagcttgggcgacagagcgagactacctcaaaaaaaaaaaaaaaaaaaaggatttgaggacagtttatacaaagatttgggggcttcccactcaaattctttgctttctgggctattcttctctgtactgctattctggcagccctggactccattatctttaaccttaagttgccccaggctgctcaaactgggtagtgccctcagtgtgaaatctatttaaacacagatataacacagtgtgactcccttcttttgagaatcccctctagtttcttcctgcttktcattgctcctcaaagccttcatatagttgctttttcatatttttgtcaagggtttataattgttatctgcaggaaggttagcccaatataagctacttagacattgctggaatgaaatctgtttttcttatagaattagggaacattattgggattgatccaagctaaatatctattagcttaaaatgtagcatttttagtggatgaatagccaagtaaaacagcagttttcatttttaatctattctttctctgaatttggctgagtaaaattttagaatatcatctaacagaaatag

SEQ ID NO: 27427 - DNA, 601 bp, Human
gaaatgagtatgagatgagatgctgtttgtcagtagtaccactggtcctttcagttttcctagttaaatggaaatctaattttaaatacgacaagtaaagaggaaaaaaatcatttattttctcctatgagccaatctcaggaaaaaaaaatggacatttgaggtgcaaattagtccacatacataacttcccaagcagtcacttaggggtaatagaatctaggtacagccacatctccctggctaatggggcctggcatagcagatccatttctccagtgttctctaccctattttgccrttggctcacttcataaccttagataatgagcctcaacttcctcaaataaacctcctttcaatataggctttgacaagtctatggtcagaggagtttttccttttcaatttgaagaaatccattgtattaagtggactttaacctatttaaatcgcaggtttaattctttatgtgtatggtttgttttgttttgcttaaggttgcaattgtagctcaagacttggcagcattccatactgcctcatcagaaatggggcaccagcagcatagccatcacttagtaaccacagaaaccagacc

SEQ ID NO: 27428 - DNA, 601 bp, Human
gtgtgcacccacccaggcatctttactctcaaaataaaagtctaattaggcaggggtctgtaaagcacttaagagctactccttagagaaaaacctagtggaaacacaaatcctaaataagtcctctgagaatccttgcacagcccccattttaaagtggggaatgtcagaagacttagaaggaatcattctctgggaagcagagaatttagaatcttaggtgcagccgggcatggtggctcatccctataatcctagcactttgggaggctgagacaggtaggtagcttgagcttaggarttagagaccagcctgggcaacatggtgaaaaccatcactacaaaaaacacaaaaattagctgggtgtggtgacggctgcctgtagtgcccagctacttggggggtgctgaggcaggaggattacttgtacccaggagatttgaggctgcagtgagccaagattgtgccactgcactcccgcctgggtaacaaatgagaccccatctcaaaaaataagagaccagcccaggcaacatgacgaaaccccatctctacaaaaatacaaaaattagccaggtgtggtggtgtgcacctgtagtc

SEQ ID NO: 27429 - DNA, 601 bp, Human
agccaagatcgcaccactgtactccagcctgggcaacagagcgagaccctgtctcaaaaaaaaaattagaatgtaaagtaaaatagaatcctaggggctaggtgcagattacctgtccttagggagattttttttccgcccacgtgtttacttgataaagagttagaacacactccaggaaatgtcagctgttggctttatgtagtttatgggtatagaagctaaaggctcaagaagctctcttttgttggctgaggtaagcatcttttgtctcttgcatgtatgaattttttttttttttagtttttatttatgtaaaaataaatagagatggggtctcactatgttgctcaggctggtcttgaactcctgggctcaagtgatcctcctgcctcagcctcccaaagtgctacgattatagtcatgagccaccatggccagactgtatgaagattttatcaaaatcccaagtaaattgcaggccaggcacggcaggctgggagtacaggtgcacgctgccatgcgcagctaatttttgttttttgagacggagtctcgctctgtcacccaggctggagtgcagtggcaccatcttggctca

SEQ ID NO: 27430 - DNA, 601 bp, Human
gccttcaaaataaaaaaggcagacacttctggcagtgccaagggtgaccttggtgtgagttaattgagcaacttttcctctataacaggaaggactttacggcaggaagagcagctgggtgggaaagggattcaggggaacattggtgaaagaagccacagtcctggcaagacgagggacttgagccctcctggagcccccaacctggctgactgtcctgctcttttcctgcccactccaggctggcctgccactcctcctgctatgatgcctgggcagatcccggacccttcggtgaccrcaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgaggtgagcgagccttttacccctggcagattccaggtctggccttaaacccaccatgggaccttaaccttgctgttcaaagtgtggtctgaggaccagtatcatccgtaccaccctggggttatcagaaatgtggaat

SEQ ID NO: 27431 - DNA, 601 bp, Human
aagctccttcccttagctgcaggtgtcttatccagccctgcatgccatctggccagcccctcagctccactgaaggtgacctccaagctctttgctgctacctctgggaataagaggtcagctctgcatgtagaggtcagccaggggttgcttttcctcctggccctacctgccctttcatttggaatgtgccaagcaggatgtttgttctttttctcccaagtcctgcctctcagagcttccctgcatctcagaaatggtggctggcagtgagggaacatgaccagaaagctaatcagtscaggccaggagtctctggtctttccacccctaatcattggttcattgctgaataataataacgataatgtataataataacataggggcgggtcctattctgtaagtacacagtaactaacaatagttgccactatttgtaaagttgggtgctgtgctgaatgctgtatgtacattatctcattttattgggataataaccatatgaagtgggtaccttcattagtctctttctacagataaggaaactaaggaagtgtggggctgagtaatttgcccacatctctgctatattggcatt

SEQ ID NO: 27432 - DNA, 601 bp, Human
ccatctggccagcccctcagctccactgaaggtgacctccaagctctttgctgctacctctgggaataagaggtcagctctgcatgtagaggtcagccaggggttgcttttcctcctggccctacctgccctttcatttggaatgtgccaagcaggatgtttgttctttttctcccaagtcctgcctctcagagcttccctgcatctcagaaatggtggctggcagtgagggaacatgaccagaaagctaatcagtccaggccaggagtctctggtctttccacccctaatcattggttcwttgctgaataataataacgataatgtataataataacataggggcgggtcctattctgtaagtacacagtaactaacaatagttgccactatttgtaaagttgggtgctgtgctgaatgctgtatgtacattatctcattttattgggataataaccatatgaagtgggtaccttcattagtctctttctacagataaggaaactaaggaagtgtggggctgagtaatttgcccacatctctgctatattggcattcattcatttgtttgctcttttgttcattaattgattcaacgggt

SEQ ID NO: 27433 - DNA, 601 bp, Human
gcagtgagatggaggccctagggggttatgaggaatggaagggttcaagcaaaggcaaaaggtgctgtttaaggatgtgtttaaggcattgaaaaggataccagctggagtttagagtaccaagtagtggggtggagaggcaggcagggcccagatccctcataatagggtgatgctagatgctgggttgcctgaggcatgcccattctgtgcctgttgtcctggcctaatgattagtagccccttccttcactctcacaagtgctgctctaggatgatgaattatatggtcatggagagycactgaagggctgcaggaggggagacgcacaccttcaaaagatccctctggcggcaatgtggggcacagattgaggtagaaggatcagttttggaagtgtcatgttgttccagtgagacagaagtgcgcggccttggggtctgggaggagatttgggcagcattgtctgggcccaagcccagtcctcccctcacccctgtgttctcctcctcctccccagccttggaagcagaggtttggtgtgaagtttagggcatgaatgcaggcggctgtgttgacagtcagtgcctgcagacctgg

SEQ ID NO: 27434 - DNA, 601 bp, Human
gtcctcccctcacccctgtgttctcctcctcctccccagccttggaagcagaggtttggtgtgaagtttagggcatgaatgcaggcggctgtgttgacagtcagtgcctgcagacctgggggattctcttgtagtttatttttaataggtaaaatacaaggctcagagatacatatgttaattgttaataaatagtaattatttaagtaaggggatatatacagttgggacaaatatctacaggcggcctttcatagccaagggttctgcatctgtgatttgaccaacagtagatcaaaartattcagaaaaaaaagcatctgtactgtttattccctaaacaatgcagcatagcagctatttacatagcatttacatcgtattagtcattataagtaacctagagatgatttaaagtatacgggagatgtgtataggtgatatccaaataacacgccattttatgtaagaaacttgagcatcctcggattttggtatcctcggggagtcctgggaccagtcgcccatggctactgagagacaactgtatatatgtcataggtaaaaagccaccgtcccacccttgacccctggacaacca

SEQ ID NO: 27435 - DNA, 601 bp, Human
cacgccattttatgtaagaaacttgagcatcctcggattttggtatcctcggggagtcctgggaccagtcgcccatggctactgagagacaactgtatatatgtcataggtaaaaagccaccgtcccacccttgacccctggacaaccagatccacacctggaagattcttaactgcatctcagagttcgcctgcctagactagccgaggccctgaaccccggggaaggggcaggccttgggaggggtcaggtccacaccccacaggccctggggctgcctcagtacatcctccatctgcrgtcaggagcagtggccctgaggcttctgccttgtataatgctggcagcttctgtctctctgctgtcctaacccaggttctctagatgttagtagcaataatgctatctcacactcccgtgatgccctctggtcttcatagccactctctcctgatggtcacagtggccctgggaagaggaaaggcagtcctatccattgatgaagttcaaggtcacccagtggccgagtcaggacgagaacctggggcttcctctgtgccccacacaatattcaggttgcccagactcaaaagaaattag

SEQ ID NO: 27436 - DNA, 601 bp, Human
cgtcccacccttgacccctggacaaccagatccacacctggaagattcttaactgcatctcagagttcgcctgcctagactagccgaggccctgaaccccggggaaggggcaggccttgggaggggtcaggtccacaccccacaggccctggggctgcctcagtacatcctccatctgcggtcaggagcagtggccctgaggcttctgccttgtataatgctggcagcttctgtctctctgctgtcctaacccaggttctctagatgttagtagcaataatgctatctcacactcccgtgrtgccctctggtcttcatagccactctctcctgatggtcacagtggccctgggaagaggaaaggcagtcctatccattgatgaagttcaaggtcacccagtggccgagtcaggacgagaacctggggcttcctctgtgccccacacaatattcaggttgcccagactcaaaagaaattaggaaactcgtttgtggaagcatagctagcaagtagcagagtcaggattttaatccagacaggtctttcaggctcaaaggggcatatcaggctgcttctcagctcttacaaaaacttagtgga

SEQ ID NO: 27437 - DNA, 601 bp, Human
aacaaaaatgcagccggaggtatatgcttcataattaatgtgagaaagatcttcgctcagttccttcattaattaggaaaacaaattagataattgttgttataaagtcacaaaccacttctacaatcatggtttaaaaaaaaaagattcttctgaactcaacttatatttacacaataaataaatatgtagagccaactaataactctttgagtgtggaaggcagtaaaactaaaaggcagttagttacattctggctgggcgcggtggctcatgcctgtaatcccagcactttgggagrccgaggcaggcagatcacttgaggccaagagtttgagaccagcctggctaacatagtgaaaccctgtctctactaaatatacaaaaattagccaggcgtggtggcacatgcctgtaatcctagctacttgggtggctgaggcacgagaattgcttgaaccttggaggcagaggttgcagtgagccaagatcatgccactgcactccagcctgggtgacagagtgagactctgtttcaaaagaaaaaaagcagttagttacattctgacagccagacagtcagaattcaggatattcaatg

SEQ ID NO: 27438 - DNA, 601 bp, Human
ttaatgtgagaaagatcttcgctcagttccttcattaattaggaaaacaaattagataattgttgttataaagtcacaaaccacttctacaatcatggtttaaaaaaaaaagattcttctgaactcaacttatatttacacaataaataaatatgtagagccaactaataactctttgagtgtggaaggcagtaaaactaaaaggcagttagttacattctggctgggcgcggtggctcatgcctgtaatcccagcactttgggaggccgaggcaggcagatcacttgaggccaagagttygagaccagcctggctaacatagtgaaaccctgtctctactaaatatacaaaaattagccaggcgtggtggcacatgcctgtaatcctagctacttgggtggctgaggcacgagaattgcttgaaccttggaggcagaggttgcagtgagccaagatcatgccactgcactccagcctgggtgacagagtgagactctgtttcaaaagaaaaaaagcagttagttacattctgacagccagacagtcagaattcaggatattcaatgatgtaccctaacatttaaaacccacagaatataa

SEQ ID NO: 27439 - DNA, 601 bp, Human
ccctaacatttaaaacccacagaatataatgttctttgtatgatagctgcatgagtaaagcaagttaccctacactgcactgatctttgtgtgtgatacagacgctcccacatagagttggtttgacacgtggtaatttctaggaggcagatctatgtgtgcagtgctgttgaattctgcctgtcagaggcttccccttgcatgtccagttttaacttcaaactcactgtacccaaaacaaactcctccttttccttcccaccgctttccagaacagctgccctcccaggcttcattcctsagaccctccattgggttcatagtcagctctctgccctatctccttccttctccaaatccagctagtcaccaagatcagctgatttttctttgagacgtcttccttctcttcctctctttcttctttatgctattctcttgcttataagttacagtaagcctctctggtttacagagtgctttttccctgtgagttcatctaatccccaagagcctcacctgtctacagaggagataactgaggctcagagaagttaagaaacttgcttctagactcagattctgaacccacaagctttcc

SEQ ID NO: 27440 - DNA, 601 bp, Human
gactgatacaagttgctcaatctcttacgctatcgccattttggactaaatacttgtggggctggcctgtgcattgaagggtgtttagagcatctctggcatctacctgctagatgctggtagcacagctccctctgagttgtgacaatcaaaaatgtctgcagacattgccaaatgtctcctgggaggcaaaaatcagtcctagttgagaaccactggtctgaaactttgctggccctcgaataaatgccaagtctcaaagttttcagacataatccaagaaaaatcattcagatgctgytttactgttcaatcccccaagccttgaatcgatatgcccatctcccatctacacgatggacatgtaaccctcgccacctcccgaatcaaatcgtcaacattccttccttcccctggaacctctccagctgagccggaagttccctggaaatctcactcaaggtctattggaaacctcatttgggatccagcaggatgactgctgattccctgtctgtgggcaaagcttccagattatagggataaggaagaggctattgaaataattatagactaatagctaggaagcacatgttttagg

SEQ ID NO: 27441 - DNA, 601 bp, Human
aggaggcggcagccgggcgcaccctcgccagccctgctggagtttgctgtgggcactgaggcgcgggcgcccttccaaagcacatactcaccgaatgtttacagactggctgtcctggcagggctttcaactgcacatgttttttatactttcctttttttttttttttttaatattttttacaaaaaaaaagattttatacaagcaatatatatatggatttctataatcactcgatgtgatacagtataaatatgctatggtttgtttgttatgaacagatagccaccagttacggccrttgtgtgtaactcctaagtactgtagtctctgggtgtcgggggtggccagggcgggggcggggtgcatttccatccttgtaaacccttcatagtactcagtcctgtatcgctcagtaaacattgctcttacttacatagccgccttgcgtggtgtctgcctggggaatgggtgcaaggccctctcagggtcggagactgtttggagcctctgctataggcctgttcattttcacaacagctctcctatttcacagatgaggaagctaaggctcagagacattaagccacctgcagttact

SEQ ID NO: 27442 - DNA, 601 bp, Human
ccgctcagtccttccaccggaagtgtccgatcggaatcagccctgtccgagaggtgagtccgggtttggggatccagatgtccagccccgtgtccccctccaaacatccagtccctctcatattgcctttgaaattagcagcctctgggtgaccagaccttggccctcagaggaatcccggagaaaggtagaaccagcttcggcgttgggaacgcaggcgcgcttacgcatttagtgagggtttggcggtctccatagttaccgccgccgcgcgtgacgtcatagtggagcgctgagggcktggtggcgtggggtgggggctgtcctactgatcctgaatttggggtcactggtaagaggagttgcccattccagccaggtggaacggggaggggtgccacatgtctcagatctgccattgtctgcgaaaagaaactgctgcgaggaccatccccaatcccctgcttcccttgggaagagtaaccgccgttttgtaggacacttggggacaaccccgcttgtcctgaaatttattgacacggtaaatagtatttcctgtgtgccgaggatgcagttaaaccaacactgaccccctgccctt

SEQ ID NO: 27443 - DNA, 601 bp, Human
tgtcatagaaccagctgctcagcataattgaaatttcattcggattatatgggcctactttacacccatcttactatggtaaatgagatcatgctcattaagcattaggacactacttggttagcgcatctaggaaacataaccagaaatatcaaagaaatggcccagtaaaatataagggattgagactctctggttaatataccatggaactaaccccccttttttttctttatcattgataaattttgttcttacttatactcaaattgtttgttttccaaggttcagtctgaacctwgtgatatttatttcatactcttggagaattaatactgttacatatcttcaactacccttttcatgaatcttgtctgccaagacaagctcggtcatggagaccctaacccagtggcgctagaggaattaaagacacacacagaaatatagagtgtggagtgggaaatgaggggtctcacagccttcagagctgagagccttgaacagagatttacccacttatttattgacagcaagccagtgataagatttactgaaagtattccttacgggaaataaagggatgggccgaaataaaggg

SEQ ID NO: 27444 - DNA, 601 bp, Human
aaatttcattcggattatatgggcctactttacacccatcttactatggtaaatgagatcatgctcattaagcattaggacactacttggttagcgcatctaggaaacataaccagaaatatcaaagaaatggcccagtaaaatataagggattgagactctctggttaatataccatggaactaaccccccttttttttctttatcattgataaattttgttcttacttatactcaaattgtttgttttccaaggttcagtctgaacctagtgatatttatttcatactcttggagaatkaatactgttacatatcttcaactacccttttcatgaatcttgtctgccaagacaagctcggtcatggagaccctaacccagtggcgctagaggaattaaagacacacacagaaatatagagtgtggagtgggaaatgaggggtctcacagccttcagagctgagagccttgaacagagatttacccacttatttattgacagcaagccagtgataagatttactgaaagtattccttacgggaaataaagggatgggccgaaataaagggatgggctctggctagttatctgcagcatga

SEQ ID NO: 27445 - DNA, 601 bp, Human
ttcggattatatgggcctactttacacccatcttactatggtaaatgagatcatgctcattaagcattaggacactacttggttagcgcatctaggaaacataaccagaaatatcaaagaaatggcccagtaaaatataagggattgagactctctggttaatataccatggaactaaccccccttttttttctttatcattgataaattttgttcttacttatactcaaattgtttgttttccaaggttcagtctgaacctagtgatatttatttcatactcttggagaattaatactgwtacatatcttcaactacccttttcatgaatcttgtctgccaagacaagctcggtcatggagaccctaacccagtggcgctagaggaattaaagacacacacagaaatatagagtgtggagtgggaaatgaggggtctcacagccttcagagctgagagccttgaacagagatttacccacttatttattgacagcaagccagtgataagatttactgaaagtattccttacgggaaataaagggatgggccgaaataaagggatgggctctggctagttatctgcagcatgaacatgtcc

SEQ ID NO: 27446 - DNA, 601 bp, Human
catgtcacagtgctgcagagattttgttcatggccagttttggggccagtttatggccagatttgggggcctgttcccaacacttgtcaaaatctgtcttcccattccaaattcttttccattattgaaatatcattgtttctgttggaaatatttttccaagtagatgtcttattatcatcttaaatacagatcatccaaaacagaagtcatctgaaactttcctaatttttcctttcaatcataaatatgaagccttaagaacaattaataatgcatgatccttaacctcatggaacakcaatcagttgataaaaaaacagccaaacaactaaaaataatacaaggacttatatattcatatgtgtatgtgttaggaattgtaagaactcagactagagttgagcaatttcttaacagaggcagtagaattcttagtcactccagccatcacaccctgcaagttgatctcaccatcagtctgctgctcattcctacttcctctactctgttcctttcctttctgaatctttctcatcctttattgtccaatttaagccccatgttaaatacagtgagttctaaatttctcttcaaagaa

SEQ ID NO: 27447 - DNA, 601 bp, Human
acacctttctatagaagcaaaattgccttgatgagaaaattcatgttcgagtgctatttcttttgctgcaccgaaaatttatttctaatacccaccacctctaggaaataccttctaccattcacagtctcttcccacctcaggaccgttagaacattcagtatctccaccataaactcattttatacttcaacattcaacatttaacaaacatgtacaatgtatatgtcatgtgaaacgttttctcatttaaatcttttgtatccatgttttataatttcttcccaactagttcttcccrctgaatttatttctttctctcccgcatccttgtcaaatcttttctattcttcaaactcaaagactttttgtttaatccattaagctgtatattagaatacagattttccaggcatatactatactgaccaagttaccatctctaggagcaggcccctagtctgcatctccagaggtagggcccaagaacctgtttctaccaaagatcccatatgatgattaggcagcaagcccagtgtcatattcagactttcttgtaaaccattgctgtacaacttctagcccaatgctttgcttgtga

SEQ ID NO: 27448 - DNA, 601 bp, Human
tgagaaaattcatgttcgagtgctatttcttttgctgcaccgaaaatttatttctaatacccaccacctctaggaaataccttctaccattcacagtctcttcccacctcaggaccgttagaacattcagtatctccaccataaactcattttatacttcaacattcaacatttaacaaacatgtacaatgtatatgtcatgtgaaacgttttctcatttaaatcttttgtatccatgttttataatttcttcccaactagttcttcccactgaatttatttctttctctcccgcatcctwgtcaaatcttttctattcttcaaactcaaagactttttgtttaatccattaagctgtatattagaatacagattttccaggcatatactatactgaccaagttaccatctctaggagcaggcccctagtctgcatctccagaggtagggcccaagaacctgtttctaccaaagatcccatatgatgattaggcagcaagcccagtgtcatattcagactttcttgtaaaccattgctgtacaacttctagcccaatgctttgcttgtgataagattcttaataaaatgtgtgttattgca

SEQ ID NO: 27449 - DNA, 601 bp, Human
atattcatctccacagtgtttagcaggtcattctgctcagaagaattgactcctcttcagtgactccccagtgcctaaaagataaactccaaattcatgaacttcacagttgatgttttctacaataacatctccaagctttgcctctataattttcttatacaaacctactaaacgttttgctttccctcttctgtattcctactcttacccaattgttcagactgtttctctgttcgtaatttcctatttctttccctcccacatcctagtcaaatcttttctattcttcagaatttcmtgtttgcattaagcttcccttgaccattgcaaccatctgtatttttctcatctcctattttatgaagcacttctatcatttttcttttttatccttattttctctgtgacttttaaaatttaataacatgtacattgttaatatttagcattacatttaagtttattgtttctaatttatcttatttttaaatttaaaaattaagctatcttgaagtagaaatcattaacagttgtattctagaaaccaagtatgtcagtgcttttgcatatagtaaatgcccagtaaatttttgtgtaa

SEQ ID NO: 27450 - DNA, 601 bp, Human
aacctgggaggcggagcttgcagtgagctgagactgcgccactgcactccagcctgggcgacagagcaagactccatctcataaaggaaaaaaaaaagagagagagaacttgttttcctgtgagtctttggccaatggtaggggaaaagataattttgttccttatccagaatatttccaaaacacagaacatttttatgatatgaccaaattaaaggaaataaaagtgaatgagttgagaaaatatcatgaaaagagaaaagaaggaaaagaaaaagaaatacatggacagaagcaaaayatgttcatagagaagtacatataatgatcaagagaaacagatacatgatgatatactgagaaatagtatataattcacaagtaacatagaccgtgatccatatttttcctgttatgctcttggtcttataaagctcttttacacttttatagaaagttagctatagttctagagactacttccacagaatactcatctctgttctaaaactcatctatttaaaagattcatagatgcagtatcacttaaggtgtgaattgtccctatagtaaacccaagaataacttaccgttaattttt

SEQ ID NO: 27451 - DNA, 601 bp, Human
agccacggagcctggccacaattaatttttaataaatttctacatattctgccttcagttttgttctggaaacatctccatctgtcgtatataaaattgtaaatttccctcaccccatgaacagcactccctaaccctctttcctgccctagcgtattgtagacaaaggacagcttataataaagaagggcggttcaattccagcacagtatagagtgggatttgtgaagactggatcataaatggatcttggaaaccaggcttgggaatttagacttgaacaaaaaaagagagagagaggttcaaggtttttgagtagggtatgaaaggatggcagtgtttaatgaccattagtctagtaaggatctttaggataactaggaagaagaaaagtgcagagtcaaaacagcaaggaggcagttaaagtctagataggaaatggtaaggttcgagactatggcgatggtagcagaaatataaaggaagggatttatacaagggacacttagtggacagtgatgacagaatttagaagactgattaaccatggaatatgaggaagaaatagacaataggtggatggaagttttctcacacatac

SEQ ID NO: 27452 - DNA, 601 bp, Human
atgaagtgtttgtgccaaaaatgtttgacttgaatgaatctagtcaagactttagatctaacttccagtttataaaaaatataaaggaaaggaatactctgaagtatgttataactgaaaaagtaccgatggaggaattaaaccacaccataaggaaagaaccagataaatccagaatgctggacattgcacatggcaactggcctagtcttttaaaaagtcaatgtcataaaaaaaaaccttcgaaagaactgcttttgatttttacagactaaagagaaataataaccaaatgcaataygtgaaccttgattggatcctgtaaaaagaaaaaaaaggttataaaaatagtcttggaactattgtgggaaatttgtaagtaggctgggtgttagatcatattaaaaaattatttcctctctttctttttttttttttttttttgagacagggtcttactctgtcccccagagtgcagtggaactatctgggctcactgcaacctcggcctccctggctcaagcaatcttctcatctcaggctcccgagttgctgcaacaacaggtgcatactaccacacttggctaatttttaaaggttt

SEQ ID NO: 27453 - DNA, 601 bp, Human
ccaggctccatgctggggtttgatggtctctaaacctcctgaaactgtctaaaaattattgcatatgtactagatacctaaaattgtctggggattacagaagaataaccttctgtaagattaatcagcaaataagtagaagagggataacagaattagaaaatcattttgcgactgccattataatagcacaaggatcatcaatagatgctaaaactattaggtgaaaagttttgggggatgagatagtacccatggtgccaaagcaccaatgaatggattacttcctgacataccttcrtaaggaagagatccagtggttatcttaactaagtgaccaaatccagcgtcatcagcagacggggcaaagtggcatgtgctttctggcatggcactatatgaatcacacaacattacctatgaagtgtttgtgccaaaaatgtttgacttgaatgaatctagtcaagactttagatctaacttccagtttataaaaaatataaaggaaaggaatactctgaagtatgttataactgaaaaagtaccgatggaggaattaaaccacaccataaggaaagaaccagataaatccagaatgctg

SEQ ID NO: 27454 - DNA, 601 bp, Human
gaagagtgatacttacctttaagggtttctaagcaggtcatgtgaaagaattatgggaaaagtgctaagcacaagcctggtacacagacggaaatctaggagagaacccacaacccctggtttccaaatccagtgagtgtccaaaccacaaacaaagagttaaattcaaaagtggcagcaaaagaggaagtgagcagaaccagccacagtgacacacgtgctacagagttcaacaacatcgtcacagggcagtacctggaggacttgctctcctatagatccatggaaggcaactacagcrgcgctgggaagacaaccagcagggcacagaggtgactgcgaggctggaatgaagcaacctgaattacaggcaaatcaatactattaatgattatgtatggtgaaagtccatcacaacagagttcagtggcctctgtcagtagtgacattaatgggacagaaataaaacccccagtctataagacccaagagtaaacaaaacagggatataacgtccactcattgagggtctagtacaataatacataaaaagtgttttataacgtaaaaggactacataaatataagagattcttatagt

SEQ ID NO: 27455 - DNA, 601 bp, Human
gtgagccatgattgtactactacactccagactgggcaacagaataagagactgtctcaaaacaaacaaaaaaccagaaaacattaaaaaacaaacaaacaaacagcactgaggttctttaccaaaactcgagaagcatcaggaagcttcaggagtctgactgtcagcatttccctttgtgagtatttccctgggctgttctatagtttgggtttaatttgcttcccctagaaggctggactctaaacacagccctccagaggagcacagcttagcctcagtggacttgttcttggctgtractgcctcgtctagatggcaggaatcctcaggtggctgtggctgctatgtgctgtgaggccttggcttgtacagggagcggggacacacagaaaggactctgcttctgtttacctttgtagtcctgacccagttccaggctgaggttatgagcctcagcacatctaacccaagagcagcctcctgcccctgactctgtgtgacaatacagaagtcacttaagtactgagcctcagtgtatccatctgtaaaatgggaagagtgatacttacctttaagggtttctaagcaggtcatgtga

SEQ ID NO: 27456 - DNA, 601 bp, Human
ctcactgcaacctccgcctcccaggttcacaccattctcctgcctcagcctcccgagtagctgggactacaggcacccaccaccacacctggctaattttttgtatttttagtagagacggggtttcaccgtgttagccaggatggtcttgatctcccgacctcgtgatccacctgcctcggcctcccaaagtgctgggattacaggcgtgagccactgcacctggccaagagaccccttttgtttgctcctcaaggtttcaggtttcaagaactaagagagggcaatgtgacatggctcmccctgtaaatccaacactttgggtggctgaggcaggaggatcacttgaaccgaggagtttgaaaccagcctcagcaacatagtgagaccctgtctcaactaaaaaaatttaaaaattttttaaaataccccagtgtagtagcatgcatctgtagtctcagctactgaggaggctgtggcagaaggattacttgaatctgggaggtggaggctacagtgagccatgattgtactactacactccagactgggcaacagaataagagactgtctcaaaacaaacaaaaaaccagaaaacatt

SEQ ID NO: 27457 - DNA, 601 bp, Human
taccttgctgttgggagagcctcaacaccctttccttctatctgttggaaaatcgctgtaatgcaccaactgtaataaaaaatctctcactacctgctgggaaactcataatgatacatatataaatctacaatgtctactgtggacacagtgctccttcactcaactgtgcaaagcacaagacacacgagcagtcatgggggtcctgacagagtcaagagaccgcccgttttttttttttggtttttttttttttgagatggagtcttactctgtcgcccaggctggagtgcagtggcgygatctcagctcactgcaacctccgcctcccaggttcacaccattctcctgcctcagcctcccgagtagctgggactacaggcacccaccaccacacctggctaattttttgtatttttagtagagacggggtttcaccgtgttagccaggatggtcttgatctcccgacctcgtgatccacctgcctcggcctcccaaagtgctgggattacaggcgtgagccactgcacctggccaagagaccccttttgtttgctcctcaaggtttcaggtttcaagaactaagagagggcaatgtga

SEQ ID NO: 27458 - DNA, 601 bp, Human
aaattgtgtgacgtctgtgcttagggactatgtcctttcctgcctccaaatctcctccccagctggggttgggggagtcctcagtggccctgttgactggtgctgagctgggggcagccatgcacactgagggcctggaggggtccttggacttggctgtctctagcttactgtttccctctccctaggcctaatgactcaccactggccctgaccccactactcctccactgcccacttcctcaacatacacagttccccagaaaatcagaaccatttgatcagttccccccaaccccawctctaatcaagtacataatgtgctgcctgttttctaactacagttgtcccttggtatcagtgggtgatgggttccaggatctccctccccaaggataccaaaatccaaggatgctcaagttcttatgtaaaatggaataatagttacataaaatctactatatactttaaattatcactagattacttataatgcctaatataatgtaaatgctatataaatagctgttacactgaattgtttagagaataatgacaagaaaaaaaatctgtacatgttcagtagagacgctttttcttt

SEQ ID NO: 27459 - DNA, 601 bp, Human
accccacccctgccatgtaagactgcatcctgtttcctcagcaaaattgtgtgacgtctgtgcttagggactatgtcctttcctgcctccaaatctcctccccagctggggttgggggagtcctcagtggccctgttgactggtgctgagctgggggcagccatgcacactgagggcctggaggggtccttggacttggctgtctctagcttactgtttccctctccctaggcctaatgactcaccactggccctgaccccactactcctccactgcccacttcctcaacatacacagttycccagaaaatcagaaccatttgatcagttccccccaaccccatctctaatcaagtacataatgtgctgcctgttttctaactacagttgtcccttggtatcagtgggtgatgggttccaggatctccctccccaaggataccaaaatccaaggatgctcaagttcttatgtaaaatggaataatagttacataaaatctactatatactttaaattatcactagattacttataatgcctaatataatgtaaatgctatataaatagctgttacactgaattgtttagagaataatgaca

SEQ ID NO: 27460 - DNA, 601 bp, Human
gagagaatcatacaggagaaagaagagtcctctaaaggttaaaggttgtgagcagcccagagagggtgggtcccgagagccagggcagggctggccctgcggagaagaggctgaaagactcaggagcccccatccacagccacatacagggcctctggagggaagtgatccgcccaagtctcctggaggactcttctcacccaagacatctgaagctgtcatgaaacaggcagagccgagcagtggggctgcggcaatgagtcatggcaagctcccggaggggatgtgcccggttactaasagagagcatcaagaaagttcttcacgggggtgtacagcaggagaagcagggtacaagcatgccacctgatcctgcagggcctgcccgggttaccagggcaggatgcagtgtctctctgggcctctcctgtcaccccaatccctttaatgtcttcttgatgctcccagcccataggtttgtctttcctttcctatcacctctatcaaaaggtctcttctattttacacattttgtcctgctgcttctccctctcacctgtatttctattttattttaatttttttgagacaggatctcact

SEQ ID NO: 27461 - DNA, 601 bp, Human
aagtcctctaacatgcccctcaaaacatgtaagtccaaggcggcttcagaggacaggcaacaaaacagacagtgtgtcctgacagctctgctgacaaaggtggcataaaagagcaaatgaatggagcagtagctggagtgtgggccagaggcccatttgggcatatttcctgacatggaagttcctagaacagtagaaagggagagaatcatacaggagaaagaagagtcctctaaaggttaaaggttgtgagcagcccagagagggtgggtcccgagagccagggcagggctggccctgmggagaagaggctgaaagactcaggagcccccatccacagccacatacagggcctctggagggaagtgatccgcccaagtctcctggaggactcttctcacccaagacatctgaagctgtcatgaaacaggcagagccgagcagtggggctgcggcaatgagtcatggcaagctcccggaggggatgtgcccggttactaacagagagcatcaagaaagttcttcacgggggtgtacagcaggagaagcagggtacaagcatgccacctgatcctgcagggcctgcccgggttaccagggc

SEQ ID NO: 27462 - DNA, 601 bp, Human
gggggagaatggtggtgctatctctgtgacagacaggtggtagggcagggtgagtgggaagagggctattctgagatgctcagattcccttttgtgagtcaaaagcctccttaataccctgtattaattgatttttgccttcctttcactcattccacaaatatttattaagtgcttcctaggtaccaggcactcatctagaagcctcagaacagttaaaaaaaaaaaaaaaaaagagagagagagacaaatccctacttctgtagagctgacattctagcagggggaagcagacaataaycaatgtagcaaatacatcatactacgtgagtgatacgcaccacgggaaaagagagcagagtgaagggggatgggagcaggggccggtggggtgcaggctggcttcctggagagggtgagatttgggaaacaaatggaattaacaaattgtggctgctgatgactgcttccaaaagtttgggaagagttgtgagctttactccagaggaataagacaagaagtcagaggcacatcccaaccccccgctatgaagcaagtgcccagagactggtagcacatttctggccaagtcctctaaca

SEQ ID NO: 27463 - DNA, 601 bp, Human
ctcacttggctgccccacagagaagggactaaggaggcaagaggaacatggggaggttggtccggaggcttttgccgtggaccaggggagagctaaagatggcctgaactaaggtggtggcagtagggagaaaaagagagaagcaatacattccaggtattttagagacagattcaactggacatactggtcaaggataaacaagaacagagcatggtttgtacaggggggagaatggtggtgctatctctgtgacagacaggtggtagggcagggtgagtgggaagagggctattctgasatgctcagattcccttttgtgagtcaaaagcctccttaataccctgtattaattgatttttgccttcctttcactcattccacaaatatttattaagtgcttcctaggtaccaggcactcatctagaagcctcagaacagttaaaaaaaaaaaaaaaaaagagagagagagacaaatccctacttctgtagagctgacattctagcagggggaagcagacaataatcaatgtagcaaatacatcatactacgtgagtgatacgcaccacgggaaaagagagcagagtgaagggggatggg

SEQ ID NO: 27464 - DNA, 601 bp, Human
tcaccatcatcctcataggattctctataattagaataacctgataggtaaaatttgacggtattcacagacagctcagacattaataaagaagctacaaccacctaaggtttaaccactgctaactcagttctgctatgggattttatcctgtgaactagatgaagctctcagggcctcgtttgctcccagacaggccgacctcctcaatggttctcacgaaagcaagtgtgaaagtgagccaggaggagaccaccagtcttcacaatccaaggggcaccattcacatcttggtctatgwggatggcgctccttggtggttggtatgcagtgtacaacctaactgcagggctgagagggggcacaatagtggggcctgtggtggatatggcctctggtcttaggttgcccctgctgtttgctctgaatataggagccatgcagccaggaagatgagagaaagctcggccacaggaaaaggactggtggtaggacctgtgaggataggaaaaagaaaagcaaacacagggcagagaaggatcagactagcaagcagaggcctctactgcagactaaagagtaggctgattagaaagtgcaa

SEQ ID NO: 27465 - DNA, 601 bp, Human
tatgcttcttggtaatccggatcagctgcagtgaaaggaacactatgaaacacaataactatgtgaatgaccactataaaatgttggttcattcacatagtaattgggatcttttttggctgttgtatttctgtatgatgaagttgcatggactctaccccaattactgcactggagttctacaagcttcaagagcatctgtttcatgtctctgccacagcttgcatctataacaacattttcaatttcctgaataatttcttccatatcagtccttccttttccttccaagcatcttccwaaactgaccctgtcaacttcagcaattttattgcacaaattaagctgtcatccatgggattagaaaagagggcattcgggcattcggcaactcctgaagaccaacctgaagaatatctgcccttgtaacctgtccatttgttcctctgatctccaggttatgataaagctctcccagaaagggtacaaatgcatgaaattgttttggagtaacttcatccccttttgcagcttgatctttaatgtcatattcagtccgatatctttgaagtagaaattggcggaaggtgctactctctgt

SEQ ID NO: 27466 - DNA, 601 bp, Human
tctctggatctctgggtccaactcatcattaatatcatccaagtgtggatcaccagtccctgaaaaatctgttccattttcttcataatccagaaaaaaagtcctctttttcaagtaactcttgatatgcttcttggtaatccggatcagctgcagtgaaaggaacactatgaaacacaataactatgtgaatgaccactataaaatgttggttcattcacatagtaattgggatcttttttggctgttgtatttctgtatgatgaagttgcatggactctaccccaattactgcactggrgttctacaagcttcaagagcatctgtttcatgtctctgccacagcttgcatctataacaacattttcaatttcctgaataatttcttccatatcagtccttccttttccttccaagcatcttccaaaactgaccctgtcaacttcagcaattttattgcacaaattaagctgtcatccatgggattagaaaagagggcattcgggcattcggcaactcctgaagaccaacctgaagaatatctgcccttgtaacctgtccatttgttcctctgatctccaggttatgataaagctctccc

SEQ ID NO: 27467 - DNA, 601 bp, Human
atcctctggccgcagggagaggtctcccttcctcttcacagagtctctagccacccccaccatgcagctttccagaacttcctcctcttcctcctcctcttcttcctcttcatcgcccaacgattcctcatcttcgtccgtttcccagtcgtcatatccatccccatagccggcctcctcttcctcctcctcctcttctccctcttcctcctcatccccctcttcttcatcctcagaccagccctccctctccacttccacttcccagtagaccttgccccaggtgaagcccttgctgccyagcaccccaggctcacagtcaaactgctgggggtgcaggtaggcactcttgtacaggctggtgtaggtcacgcacttccagtcctctgacagctgcaggtacccactggccgactgtgggtccagggtgacgctcactgtggggacaagggaaaaaaaaaaaaaaacagcatcactgttttgttttgttttttaagtcagagggaataaaatttattttggcagatagcgttaaacaaaattaaagttgcatacattagtaatataactcaacatccttaatttggtataagtgtgacac

SEQ ID NO: 27468 - DNA, 601 bp, Human
ctgtgactctgcgttggtgaaagtcacggtgcccccttcataatccagggcgatgcccactctccggggccgcagtgctgggaaaagctcagcctcggggctggtgttggcccagatgccggaggaggagaggcgcagcgcccacacgccatcctctggccgcagggagaggtctcccttcctcttcacagagtctctagccacccccaccatgcagctttccagaacttcctcctcttcctcctcctcttcttcctcttcatcgcccaacgattcctcatcttcgtccgtttcccagtcrtcatatccatccccatagccggcctcctcttcctcctcctcctcttctccctcttcctcctcatccccctcttcttcatcctcagaccagccctccctctccacttccacttcccagtagaccttgccccaggtgaagcccttgctgcccagcaccccaggctcacagtcaaactgctgggggtgcaggtaggcactcttgtacaggctggtgtaggtcacgcacttccagtcctctgacagctgcaggtacccactggccgactgtgggtccagggtgacgctcactgtggggacaagg

SEQ ID NO: 27469 - DNA, 601 bp, Human
cttggatgaacaggggctggcagagcacttggaatgggtaaggacaagactgggagatcaatttggctggagcaggggagcttgtgttaaactgtgatgatgaggggcacctggacagaggttgggtccgtgggcaatgagaagacatgttactccctctcttgacatgaagacctggtgggcttgtggcctcctgctgccttcctttccctgtcttcccatctccactctctcctaggaaagtggaacctggatgctggtagggccagagacagaggcttaacaccctgctggggaaccyggtcagaactcccgaggcaggagaggttctgctccactggatgtttgtcttggtgtttttggatgtgctgatcaagagcaagatgttctggattcttaaaactcccctcacaaggaccaatctagagataatttattgatcagtgatcacagcttgtaccccaaagccgtgtatgtctggatccttccctaagaccacagatagctccagggagtcccacctccttggctatggaaatatgctcagccctggtttcagagaagcctggactccactctggaccccatgagatgatatgcg

SEQ ID NO: 27470 - DNA, 601 bp, Human
gcatgtgtgcagagaacagaaagcaaagttacactgttacagaaggcacagaaggaaaaccttcggctactgctatcagtggaatttctctgtagccagactgaggtctggtggcatttgagatataatatagatatagacctacaaatacagatctccaggctgttcattcaacaagtctttattgagcacctactctgtgcccagcactgcactaggtgccatgagaatacaagagtagtataagatgttatccgccctccaggagcttacaaaactagaggcagaaataagatgtacrtgtgactcaggcagcatgtgacacacacaaagtgggcagctctgagacaatggtggtcaagtgaccactgaggcccagagccgttggaacagtctcttagaacagggtggaggacttaaaacttggatgaacaggggctggcagagcacttggaatgggtaaggacaagactgggagatcaatttggctggagcaggggagcttgtgttaaactgtgatgatgaggggcacctggacagaggttgggtccgtgggcaatgagaagacatgttactccctctcttgacatgaagacctggt

SEQ ID NO: 27471 - DNA, 601 bp, Human
ccagcaggccaggtccaggtgcgccccactagtgaggccggcggaatcgggagggaaggggtcaagggcacagtgcgcagccccggctgctccagaccttgcctgcagcttcccgccccagcctccggctatcgcggcgtttcttctcagaggccgccggctttggttcctcccggcactgctgggcttggggctgccattccgggcattggttcccgggaggaggcaagtgggttcatgtggtcagagtgcgtcggcggggccttttctccactttctgtacccttctctttaaacgtcstccccagtaggagactattttttctcaagaaaatgctctcttggacctcactttccgttgttagaaggcatatcttgggatgcgcgttattggtttgtggagatcgtccctttttttcccctctgttatgtggatgcaccctagtgcctgatacacatttgagttcctatctgagtgggcttgtgcatgttttttcgtatttgtggacttaggtcttcaaggtttatttttgaaagtcaagttgttgggtcaaagcataaatgaatgtgtaattcctaggtatgaccagatccccctcta

SEQ ID NO: 27472 - DNA, 601 bp, Human
agcaagcagcagaccttagttttcagtttacctgtagtttcttttggatgtttacatattgacatatcgtttatgaataagaactttattctccctttataatcctattacgacccactcctgccctacaaatttactgccctgcctacgacctccgaaacattagaaggagcaatccttgctgccttccaggtctcagaaagaaagctttcagcttgtcactacttacatgtttgctatgtgtttttgatagattaaagacattcccttctgtaacagctttattgacataaaatcatayatttcatctcatttaaagtgtataaatcagtggtttttagtatattgagttgtgcaaccatgactacaatctaactctagaacattttcattgccccaaaagagaatcccatactcatcagcagttactcccccatggttggcaagtttttgggctctattcttgagtttttttatgttgtcatacaccaggtcagattgatttaggtaaaaacaacactcttcatttaagaatatacagatgttctccttttccagcagtaagtcaaggcctcggcggttttggaggacaactgcagct

SEQ ID NO: 27473 - DNA, 601 bp, Human
gtttgatatcagtatgccaatctcaaagaatattcttccttttatactcttaatcacggtaatccctttgataagttaaactgttttgtgaaattagtttaaaagtgaccatatttttttcccttgtaatattgtaaactgctgttaatagaataaccaaaggcaaacatgacattttgaaccatacacaattctggggtttgcataaaggctatattaaataaaaccttccagatacccagctcttgcctatagagtggataagttatctatacctgaaataatgcaaacattagtgacraattacattgaagtgtagtttaagtaaccagtcttcataaatatgcctaatctctggaatattttcatccagactggaattctttcttctttgagtggcataactgactgataaagcctttgagcatggtgttttttggtgaaaacctaaataatctagttttgttttctgttttaaaagaatatctgggcagtgagttaagctgggaagacctagcaccttgctgacgggatcagtctagattcttcttttatattttttaaattgtggtaaaatacctaaagccaaatttgccatttt

SEQ ID NO: 27474 - DNA, 601 bp, Human
agtggcataactgactgataaagcctttgagcatggtgttttttggtgaaaacctaaataatctagttttgttttctgttttaaaagaatatctgggcagtgagttaagctgggaagacctagcaccttgctgacgggatcagtctagattcttcttttatattttttaaattgtggtaaaatacctaaagccaaatttgccattttaatcatttttaaatgtacaagtcagtggcattcattgcattcacagtgttactcaaccatcaccagctagttctttttattgtaatttctacaaagttttggtaagttgtatttctgtaggaatcaatttatttcctgaaagttttgaatttgattaaagttattcatgtcttgttaatctctgcaacatttgtagttgtgtttttctccttttgtctttgaagaattttgcccgatttttttcctagtagttttcaaagaaccagtttgtagcttgagtgatactgttgttttctagttcatcatcgtattttctgctcttcccgttccagctgcttaagttaatttttaagttcacttcttttctaatataaacatataaagcttatttttt

SEQ ID NO: 27475 - DNA, 601 bp, Human
atgtcattacctctaatagtgccttttgtctcaaaatctatgaaattaatttagcaaacaaactttattttggttaatattcacctggtatatctttcttatttttgagactcaatttttatgtgttgttgtggattttagtgcatctaatgaaataacatagagctagtttatcttaatctaccaggacagtctgtttttaaactgcagaatttagcccatctgtacacttactgttattgatacagtcagacattttttaccatcttacattttacattgtgcttttcatttgacctattttttttgtttcatttcccttatttttcttacctttggaattgagatttttttttaacctaattccattttctcttctagactgtgagttaaactcactatgtccatcctttgaattgttaccctagctattttatcatgcatacttacagtctaaacctaatcaatattgtgagtccccagtggaagaatacaaggaacatactactcaatcacctccttcccaatttatatattatttagtattaggattgagcttatttttccatgtcacgaatttggtattattaccattttatat

SEQ ID NO: 27476 - DNA, 601 bp, Human
tcaatattgtgagtccccagtggaagaatacaaggaacatactactcaatcacctccttcccaatttatatattatttagtattaggattgagcttatttttccatgtcacgaatttggtattattaccattttatataataaaggtttgcttaattttatccattttacctttgttcattctacttaacattttgggtcttccagttcctatctcctgaagtacttttaagttacttctgtgatggtctttttggatgggtaagttgtctcaggtctttattttaaaatgcctttatttractctccatttatttttcttaagcttttaatcatgaaaatttttaattctccacaaaagtagaatagtacagttgtctctcatatccatgggggactggttccaggacccccacatggcttccaaattccacagtcacaaattccttatataaaatagcattgtatttgcatagaacctacacacatcctcccatagatgctattttttccctcccatttactttaagtcatcactagattacttacagtacctagtacaataagtgttatgtaagtggttggtttgttttttttttgtt

SEQ ID NO: 27477 - DNA, 601 bp, Human
gcatagaacctacacacatcctcccatagatgctattttttccctcccatttactttaagtcatcactagattacttacagtacctagtacaataagtgttatgtaagtggttggtttgttttttttttgttttttttttaagagatggggtctcattctgttgctcaggctggagtacagtggtgtgatcatagctcactgcagcctgaaactcctggactcaagtaatcctcccacctcagcctccctagtagctgggaccacaggcatgcgccaccacgcctggataatttaaaatakatacatatttttgtagagacagggtgctgctttattgcccaggctagtctcaaactcctggcttcaaggcatcctcctgccccagctttccaaagtgctgggattactggtgtgagccactgtgccgggccataaatagttatgctgtattgtttaaggaataatgacaagggggaaggtctacatgttcagtacagacacaagcattcatcttttttccacatatttttgatctgtggtcgagtagccaacagatacagagggctgactgtataatgaattctcatgtccttaacaccc

SEQ ID NO: 27478 - DNA, 601 bp, Human
tctcaaactcctggcttcaaggcatcctcctgccccagctttccaaagtgctgggattactggtgtgagccactgtgccgggccataaatagttatgctgtattgtttaaggaataatgacaagggggaaggtctacatgttcagtacagacacaagcattcatcttttttccacatatttttgatctgtggtcgagtagccaacagatacagagggctgactgtataatgaattctcatgtccttaacacccagctttgacagttaccaatattttgcacatcttgcatcatctagcgcwgagctgtccaatacagtagccactagcctcatgtggctattgaagtttaaatgctcatttcaagtattcagtagctatccgtacatgattagtggttactgtattagatactgcaaataaatattgaataatgctgggttttccccccagatttgtttttaaagcaaattccagacatcctgtcatttcatcagtatattactaactgtgcatctctagttggttcatcaccactactccattatcccacctaacaaagtctgacgttccctgattggctacagaatatctttttacatt

SEQ ID NO: 27479 - DNA, 601 bp, Human
tcaaggcatcctcctgccccagctttccaaagtgctgggattactggtgtgagccactgtgccgggccataaatagttatgctgtattgtttaaggaataatgacaagggggaaggtctacatgttcagtacagacacaagcattcatcttttttccacatatttttgatctgtggtcgagtagccaacagatacagagggctgactgtataatgaattctcatgtccttaacacccagctttgacagttaccaatattttgcacatcttgcatcatctagcgctgagctgtccaatacartagccactagcctcatgtggctattgaagtttaaatgctcatttcaagtattcagtagctatccgtacatgattagtggttactgtattagatactgcaaataaatattgaataatgctgggttttccccccagatttgtttttaaagcaaattccagacatcctgtcatttcatcagtatattactaactgtgcatctctagttggttcatcaccactactccattatcccacctaacaaagtctgacgttccctgattggctacagaatatctttttacatttggtttgttcaaatga

SEQ ID NO: 27480 - DNA, 601 bp, Human
tttacttagaactttgtatataagattttttctcaagacctgacttaaagttgattttccagagataggtcgatttgcttgcactagttgcttggggacaatgccacttaggaccctctttaagtgaaattattcccttgaggttgtttgaactacagaaatgaatttggactgaaatctaaaagagagcacttgtgtatacagatcctcaagagagatttgctttttattatacctgatgggtacagttccttgcttcacgctttcatatggaaattttactttctttttaaaaaactgytcactgtggattttcagtcatacctaggaatagagtgctataaagccactatgtacctaccacccagcttcaatgattgtcaccattttgccattcttattacatctgttctctcccttgcttcctttcatcattgagctttcttttccttttttttttttttttttttttttgagatggagtcttgctctgtctcccaggctgaggtgcagtggcatgacctcagctcactgcaacttctgcctcccaggttcaagcaattctcctgcctcccctcccgagtagctgggattacaggca

SEQ ID NO: 27481 - DNA, 601 bp, Human
tagaactttgtatataagattttttctcaagacctgacttaaagttgattttccagagataggtcgatttgcttgcactagttgcttggggacaatgccacttaggaccctctttaagtgaaattattcccttgaggttgtttgaactacagaaatgaatttggactgaaatctaaaagagagcacttgtgtatacagatcctcaagagagatttgctttttattatacctgatgggtacagttccttgcttcacgctttcatatggaaattttactttctttttaaaaaactgttcactrtggattttcagtcatacctaggaatagagtgctataaagccactatgtacctaccacccagcttcaatgattgtcaccattttgccattcttattacatctgttctctcccttgcttcctttcatcattgagctttcttttccttttttttttttttttttttttttgagatggagtcttgctctgtctcccaggctgaggtgcagtggcatgacctcagctcactgcaacttctgcctcccaggttcaagcaattctcctgcctcccctcccgagtagctgggattacaggcacctgcc

SEQ ID NO: 27482 - DNA, 601 bp, Human
aacataatgttttgatctacctgtccattctgaaatgatcatcacagtcaagctaattaacatatccatcccctcacttacttttgtaagatgcactctcttggaaaatttcaaatatacagtacatcattaactatagtcaccaagccatacatcaggtctccaaaactcagccatcttataacagcaaatacatacccattgaccaacatctccccatttcccttgccccttggtaatcacctttctaatgcttctaggagtttgacttttctagattccatgtaagtgaggtcatgcrgtatttgtctatgtccgccttattttacttagcatgatgttctccaggtttccttcttttttaagactgaataacccactgtgtgtatatatatgacattttctttacgcattcagcaatcgacaaacacgttgtttccatatagcagctattataaataatgctgcaatgaatatgaggtcacagatacctctttaagatattgatttcacttcctttggttatatacccagtagcaggattgctagatcatatggtagttctatttttaatattttgaggcacctccactactgcttt

SEQ ID NO: 27483 - DNA, 601 bp, Human
ttggttatatacccagtagcaggattgctagatcatatggtagttctatttttaatattttgaggcacctccactactgctttccataatggctgtaccaattttcacttctaacaacgatgtataagggttccctttctccacatccaacacttgttatcctttgactttttgataatatctattataacaagtgtgaggtagcagccaactatggttttgattggtacgtccctaataatgtgatgttgggcactttttcatatacctactggccatttttatttcttctttggaaaamtgtctatttagatcctttacccattttttattccatttttttctatcgaactgtatgtatttcgtaaatattttaaatattgtgcagattctttctcccattccataaggttgctttttcattttgttcattatttcctttgctgtgcagaaactttttagtttgatgtagtttcacttatttttgcctttcttgcctgtgcttttggtgtcaactctttaaaaaaaaaatttgtcaaaattaatatcaaagagcttttcccctgttctagaagttttatgatctcaggtcttacattta

SEQ ID NO: 27484 - DNA, 601 bp, Human
tgtcaactctttaaaaaaaaaatttgtcaaaattaatatcaaagagcttttcccctgttctagaagttttatgatctcaggtcttacatttaagtctttaatccattttgagttgatttttgtttgtagtttaaggatctaatttcactttttcacatgtggatatctagttttccttacaccatttgccgaagagactgtcctctccccattgcttattcttggcatctttgtccaagattagttgaccatacatgccagggtttatttctgggcttcctattctgttacatttgtctcygtttttatgccagtaccatactattttcattacagtacctttgtaatatatttgaaataaggaagtgtgatgcctccagtattgttcaagattgctttagctatttggagtttttgtgtttccatatgaattttaggattgttttttctatttctgtaaaaaatatcattggaatttcataggaattgcattaatttgtagatcacctttcatagtgtgacatttgacaatattgattcttccaatccatgaacactgggtggcttcccatttgtttgtgtcttctactttcaccagtgt

SEQ ID NO: 27485 - DNA, 601 bp, Human
tttcttcctcccttgtcttcctttgtgatttgatgactttctgtagtgatacgctttgatttctttctcttttctccataatataggttcttgctttgtggctactatgaagcttaaaacatcctgtagttttaatagtctgttttaagctgttaacagcttagctttgattgcatacaaacaatttatactcttccatttcccacattttatgtttttgatgtcacaatttacatctttctatattgtatattaacaaattattataactttttaatatttttatcttttaatcttttayactagagataagttatttagataccactgttacagtattagggtaatctggattgagtatataattacctttaccccagtgggttttataatttcatatggtttcatgttactaagtgtcctttcttttaagctgaagaatttactatttcctataaatcagctccattactgatgaagcccctcatcttttgtttgtccaaggaagtttttatctctccttcatttctgaaggccatttttggcaggtaaaacattcttggttggcagtacagtcatgcactgtgtaaagacattttgg

SEQ ID NO: 27486 - DNA, 601 bp, Human
ttttaatagtctgttttaagctgttaacagcttagctttgattgcatacaaacaatttatactcttccatttcccacattttatgtttttgatgtcacaatttacatctttctatattgtatattaacaaattattataactttttaatatttttatcttttaatcttttacactagagataagttatttagataccactgttacagtattagggtaatctggattgagtatataattacctttaccccagtgggttttataatttcatatggtttcatgttactaagtgtcctttctttwaagctgaagaatttactatttcctataaatcagctccattactgatgaagcccctcatcttttgtttgtccaaggaagtttttatctctccttcatttctgaaggccatttttggcaggtaaaacattcttggttggcagtacagtcatgcactgtgtaaagacattttggtcagtgatggtccacatatgtgacagtgctctcataacattttaatagtgctaaaaaattccaatcacctaatgacatagccagtgtaacattgtaaagcacattactcacatgtctgtcatttaaacc

SEQ ID NO: 27487 - DNA, 601 bp, Human
aatctggattgagtatataattacctttaccccagtgggttttataatttcatatggtttcatgttactaagtgtcctttcttttaagctgaagaatttactatttcctataaatcagctccattactgatgaagcccctcatcttttgtttgtccaaggaagtttttatctctccttcatttctgaaggccatttttggcaggtaaaacattcttggttggcagtacagtcatgcactgtgtaaagacattttggtcagtgatggtccacatatgtgacagtgctctcataacattttartagtgctaaaaaattccaatcacctaatgacatagccagtgtaacattgtaaagcacattactcacatgtctgtcatttaaacctgctgcactgccagtcatgtaacagtagtaaatatggttatgtacagtagattatatacagtacataataatgaatagtaataagtgaccacattactggtttatatatttttatactatttattgttattttagaatgtattccttctacttactaaaaaagaaaagttaactcaaaaacaagcctcaagcagatgcttcagaagacattctaga

SEQ ID NO: 27488 - DNA, 601 bp, Human
gtgctaaaaaattccaatcacctaatgacatagccagtgtaacattgtaaagcacattactcacatgtctgtcatttaaacctgctgcactgccagtcatgtaacagtagtaaatatggttatgtacagtagattatatacagtacataataatgaatagtaataagtgaccacattactggtttatatatttttatactatttattgttattttagaatgtattccttctacttactaaaaaagaaaagttaactcaaaaacaagcctcaagcagatgcttcagaagacattctagaagkcattgtcaccataggagatgtcagctccgtgcatgttattgcccctgaataccttaagtgggacacggtagaaggtgtcagacagtgatactcaagatcctaaccctatttaggcctagattaatgcgtatgtgtcttcgtttacaacaaaaaagtttaaaaagtaaaatcgggcaggcaaaaagggcctggaaggtaggctactgagttaagaagacagagtcctagctctgctataagatttgcagcactagattttgatacatatacagctaagtgtactaaatgttgttctggaat

SEQ ID NO: 27489 - DNA, 601 bp, Human
tctgtcatttaaacctgctgcactgccagtcatgtaacagtagtaaatatggttatgtacagtagattatatacagtacataataatgaatagtaataagtgaccacattactggtttatatatttttatactatttattgttattttagaatgtattccttctacttactaaaaaagaaaagttaactcaaaaacaagcctcaagcagatgcttcagaagacattctagaagtcattgtcaccataggagatgtcagctccgtgcatgttattgcccctgaataccttaagtgggacacrgtagaaggtgtcagacagtgatactcaagatcctaaccctatttaggcctagattaatgcgtatgtgtcttcgtttacaacaaaaaagtttaaaaagtaaaatcgggcaggcaaaaagggcctggaaggtaggctactgagttaagaagacagagtcctagctctgctataagatttgcagcactagattttgatacatatacagctaagtgtactaaatgttgttctggaatgtcacccttttattatgaaatgcaaatatgctcacctttatggtccttatgagttactccttattgt

SEQ ID NO: 27490 - DNA, 601 bp, Human
aagtatggcaatcagttttgtggaatatttaattctcacacatttctcccacatccttgctttctgcgtgagcagggtatcagctctgcagacacagtctgatctccaaggtggatcaagaacagctgaagacagatgaaagaggaattttacaaggtgactgtgcaggtgagccttgggcagaacagggtgcagccttggccagtgagggttagtacatttgggaatgtcactcagtgaaggaaaagaaatctgaggccatgacatgagcttccttcctgtttcaccatctattcaatcrttcatacgttcatttggtctccgagaaagaagttttaattcctctttaaatgtaatgtctccatgaatgctttttgtttagttctccctattttccagataatactgtcttatttcccaacctccacaatcctttctaactaaaatacctcccatttctactgcttgttcctatcactggtgaatcactggttgtgtcttctttcttacatttctctacttagaagatattatttgaaaacaaatccatagggtctccctccctttttctttgatcccaaccttttctcccaataattat

SEQ ID NO: 27491 - DNA, 601 bp, Human
actgtcttatttcccaacctccacaatcctttctaactaaaatacctcccatttctactgcttgttcctatcactggtgaatcactggttgtgtcttctttcttacatttctctacttagaagatattatttgaaaacaaatccatagggtctccctccctttttctttgatcccaaccttttctcccaataattataaaaattcctgtgctatttcagactgggaaactcaacttaaaccaaaagatacaattgctatgcagaacattcctgggggaaaaacatccaatggcataaacayggtaagacttactaggaagtattcctggtctttgtagtagaagtctgggaatctgaatgagttaaaacatcagcacccaaagcaggggtaagaattcaggcaccaggctttcaccagaaagctgtctcgggagagtttggagtttgattttcatgaaattggagaaatctgtaaacctaggttaacacttgctggctcacagagaataaccacaagtaaacatctatgtaaatatgattttagagttaagtatttagtacataattcattcattcttcactcagtattagaaaaactgta

SEQ ID NO: 27492 - DNA, 601 bp, Human
tcaggcaccaggctttcaccagaaagctgtctcgggagagtttggagtttgattttcatgaaattggagaaatctgtaaacctaggttaacacttgctggctcacagagaataaccacaagtaaacatctatgtaaatatgattttagagttaagtatttagtacataattcattcattcttcactcagtattagaaaaactgtattaaagaagccctttgctgggaaggaatagagccttggacagaggagtgagcttattcaactcgaaaaagctaatagggcaaaagtcatacgcacstactgaaaatggtacacatgtcagtcatgatcatgtgcttcctatatatggcagaatcctcatggaagagaattcctgtgaataaggtgaaagtgaaaaagcctctagtcaccacttactcccttttcaacaggcagaaaatcaacctggtgagcactccctggagtgtaaccattgtgggaaattcagaaagaacactcgctttatttgtacaagatattgcaagggagagaaatgctataaatatataaagtatagcaaagtcttcaaccatccctcaactcttaggagtcatgtgag

SEQ ID NO: 27493 - DNA, 601 bp, Human
ctctggagagatgccctatgaatgcagtgactgtgggaaagccttcatttttcagtcttcccttaagaaacacatgagatctcatactggagagaagccttatgagtgtgatcactgtggaaaatcctttagccagagctctcatctgaatgtgcacaaaagaactcacactggagagaaaccctatgactgtaaggaatgtgggaaggctttcactgttccttcatcccttcagaaacatgtgagaacccacactggagagaaaccctatgaatgcagtgactgtggaaaagccttcatygatcagtcatcccttaagaaacacacacgctctcacactggagagaagccttatgagtgtaaccagtgtggaaagtccttcagcacaggctcttaccttattgtgcacaagagaactcacactggtgagaaaacctatgagtgtaaagaatgtgggaaggcctttaggaattcctcttgcctgagggtacacgtgagaactcacactggagagaagccttataaatgtattcagtgtgaaaaagcctttagcacaagcactaaccttataatgcacaagcgaatccacaatggccagaaa

SEQ ID NO: 27494 - DNA, 601 bp, Human
cttcagaaacatgtgagaacccacactggagagaaaccctatgaatgcagtgactgtggaaaagccttcatcgatcagtcatcccttaagaaacacacacgctctcacactggagagaagccttatgagtgtaaccagtgtggaaagtccttcagcacaggctcttaccttattgtgcacaagagaactcacactggtgagaaaacctatgagtgtaaagaatgtgggaaggcctttaggaattcctcttgcctgagggtacacgtgagaactcacactggagagaagccttataaatgtwttcagtgtgaaaaagcctttagcacaagcactaaccttataatgcacaagcgaatccacaatggccagaaactccatgaatgaaatgactcagggaagtgtttgttgcccctcatgcctcctttctcactttagaacatatattggagagaagccctgttatggtcacctggaaacagccttctggcccaactctggatgcctgttatactgggacaaaccttataaatgttatagctatgattgtttttatcagtgagtatttcattcttatatgtgtcacaactgtagatcctatgaa

SEQ ID NO: 27495 - DNA, 601 bp, Human
tcccattttgttagttcttctagtcaatggcaaataaactggtgttggtgcctgtggatccaatataaggtatgataatttatctcattatctcctccccttccaggtacctgcagaactgtgagcttaaaactggcaagagtgtaaatgtgcatcctgcttcacctgtttagtatggcttatgcccagtggttcttcaaacaaattctctgtggtacagaggtaactagggcacacctgtgacagagcagtaagaagagcaaccatctctgagtctccagagctcctctctgcaggaagrtctgggtcctcgggcactgggacctctatgaagaaaagaaggcaaagatcagtaatatgcagcatgccccaataatgggcaaaaatctgggcatcccccaccatctttggtaggaaggtggccctatcctttctattatgggaaccaagaaactggcctaagggtagctcccatatcccaatcccatcacctatgagactatcagaatgccaagagaacaagcaacaatctgctgtctaagcttggccctgtttatgggggactctagctggcggtactgtctcctcttgacatcctgga

SEQ ID NO: 27496 - DNA, 601 bp, Human
cagctccctacttgacactttaacgctatatacatttctgcaaaattcatcttttctagtacactttccctaaagactctaatcactttcaatagtttctatactctatagccaaaacaagacttttttcctcagttagattacaatctaaaaccatacatgaattctatttctttttctccagccacatggcttagtttcagagctttgatcatggtgaatacttcctaaatgtctcagcagtacagtctgtcatacttacaaatgactatcaaatttattcctttaaaaaaaaaaaaaactaaaaaaccctcatttgacaacttcgcagttgtactggagtgttacaaaataatcccattttgttagttcttctagtcaatggcaaataaactggtgttggtgcctgtggatccaatataaggtatgataatttatctcattatctcctccccttccaggtacctgcagaactgtgagcttaaaactggcaagagtgtaaatgtgcatcctgcttcacctgtttagtatggcttatgcccagtggttcttcaaacaaattctctgtggtacagaggtaactagggcacacctgtgacag

SEQ ID NO: 27497 - DNA, 601 bp, Human
tcactgcatacaatctaaggtctaagatcccccaaaatttccagcaggaaaaagatctctgggcttagaacactctagaatacttgaaattccttacacagagagacaacaattccacagtcttcttccaagacatattctccatagaactctttctgtgttgggtccagatcactccactggtcctgggaaaagcatacggccacatccttgaacgttaccagtccctgaaaccacataaggatttcatcaaaacgtgatgctacgggtagcctcgtattttgtccctgttgaaggtcayacaataggtggactcctctaggagatgaaaggagcttgagtggcgggctgcttaaactcattctcgggggagccatgtgtcccctgtggcactggccctgccccctccaactccaccacttttcctgaggaccagcttatgttcttcttctttaaggtattgtttaaaatttaggaaaggtcttaaaaatcatcattcagctccctacttgacactttaacgctatatacatttctgcaaaattcatcttttctagtacactttccctaaagactctaatcactttcaatagtttctata

SEQ ID NO: 27498 - DNA, 601 bp, Human
tggtggggaaggcataagagaagttcactgcatacaatctaaggtctaagatcccccaaaatttccagcaggaaaaagatctctgggcttagaacactctagaatacttgaaattccttacacagagagacaacaattccacagtcttcttccaagacatattctccatagaactctttctgtgttgggtccagatcactccactggtcctgggaaaagcatacggccacatccttgaacgttaccagtccctgaaaccacataaggatttcatcaaaacgtgatgctacgggtagcctcrtattttgtccctgttgaaggtcatacaataggtggactcctctaggagatgaaaggagcttgagtggcgggctgcttaaactcattctcgggggagccatgtgtcccctgtggcactggccctgccccctccaactccaccacttttcctgaggaccagcttatgttcttcttctttaaggtattgtttaaaatttaggaaaggtcttaaaaatcatcattcagctccctacttgacactttaacgctatatacatttctgcaaaattcatcttttctagtacactttccctaaagactc

SEQ ID NO: 27499 - DNA, 601 bp, Human
tattagaggtttccatttccatccatttatcttttacttgaaaggacaccatatttttcacctaatccctcaattttattggtggggaaggcataagagaagttcactgcatacaatctaaggtctaagatcccccaaaatttccagcaggaaaaagatctctgggcttagaacactctagaatacttgaaattccttacacagagagacaacaattccacagtcttcttccaagacatattctccatagaactctttctgtgttgggtccagatcactccactggtcctgggaaaagcayacggccacatccttgaacgttaccagtccctgaaaccacataaggatttcatcaaaacgtgatgctacgggtagcctcgtattttgtccctgttgaaggtcatacaataggtggactcctctaggagatgaaaggagcttgagtggcgggctgcttaaactcattctcgggggagccatgtgtcccctgtggcactggccctgccccctccaactccaccacttttcctgaggaccagcttatgttcttcttctttaaggtattgtttaaaatttaggaaaggtcttaaaaatcatcatt

SEQ ID NO: 27500 - DNA, 601 bp, Human
gggcaaatacatagctagctcaggtgatgaaatctttcatctctttagtttgtgtacttttaaccaaggactgcgtatctcttgcctttcttgtggttttcacctgcaacttaataattataccattgtacaccttatcctcttttcccatattcaagaaagattatctccaactcttactgttttaaaactcatgtgcttacttcaaatatttctgcactaaagctgtcatattacaagtttgttttcctattagaggtttccatttccatccatttatcttttacttgaaaggacaccrtatttttcacctaatccctcaattttattggtggggaaggcataagagaagttcactgcatacaatctaaggtctaagatcccccaaaatttccagcaggaaaaagatctctgggcttagaacactctagaatacttgaaattccttacacagagagacaacaattccacagtcttcttccaagacatattctccatagaactctttctgtgttgggtccagatcactccactggtcctgggaaaagcatacggccacatccttgaacgttaccagtccctgaaaccacataaggatttc

SEQ ID NO: 27501 - DNA, 601 bp, Human
aaataggatatcacgattggctcaacaattccctgtgttaagagcggtccttttctatttggtaggttgtggggcaaatacatagctagctcaggtgatgaaatctttcatctctttagtttgtgtacttttaaccaaggactgcgtatctcttgcctttcttgtggttttcacctgcaacttaataattataccattgtacaccttatcctcttttcccatattcaagaaagattatctccaactcttactgttttaaaactcatgtgcttacttcaaatatttctgcactaaagctgtmatattacaagtttgttttcctattagaggtttccatttccatccatttatcttttacttgaaaggacaccatatttttcacctaatccctcaattttattggtggggaaggcataagagaagttcactgcatacaatctaaggtctaagatcccccaaaatttccagcaggaaaaagatctctgggcttagaacactctagaatacttgaaattccttacacagagagacaacaattccacagtcttcttccaagacatattctccatagaactctttctgtgttgggtccagatcactc

SEQ ID NO: 27502 - DNA, 601 bp, Human
aggttcacaaaactattcacttgagaaatattagtaccaaatcttctttcattaagtctacctggattgtcctcaaagactatttcccaatctggagtctggtgaatttctggttctcccaaaacaggcctgtgtatatcctccaaactcagatcttcctgctccagacactcttcctcatctttactcctatctcctgtagaaagggtgagaggaaaaagggggtcactgtagcggcaacaatgccttctacacaatggggagatttttacaaagggttttgagatggcaagactaaatrgaatgcctgtcctgtgccaagcactttctcatattgttatgctatcaacaaaccttggtatgcacaaatataatcttcattttacaaatgcagagattgagaatcgagggtttaagggaattgtacagtaaatggtatagctgcaattccaaaagttaacatttttctttcacccttttgtattacattgctatcagacaaatgatgggaggagaaaagaggagggcaatgacagaagaaatggctgtcagagggagaaagcagtactggctgacatgttagaagaactgatgagagcgg

SEQ ID NO: 27503 - DNA, 601 bp, Human
catacgacccctgtgaaggggggtgtgaaggggttggtgggcttgtgcatatgagggaatgtgaacgatttcattatgaccgaattatgctttactcaataagcactcaaacactaccatctcacttgtagtagaagtgctagggatgcaaccaagagactggttgaataacgggaaggttaaatgcatgagtattttaatagaaaaaaatattaaaaacaaaaccaaaactcgtatggaaagaggcttctgactaggccctcctttctagcagtgtttggcacctgataacaatttgacrctgggggagggagcagcttgacaaggtccacatgaagcagccttgagatttttcgcccacttccatttctcctcagcatcaaaggaaagtgcatggtaagaagtgaatcagacagcgagggatctatgcagttatcctgtgaatgtgtggcaaagccatcaggacgcaaacctcctgtcttgagtccagagctgtgtgctttaagatttgaccccagtaaagacagaatccttcaggctcgtcccttcccaaacctaaggggctgtccttggccactttcaacttgaagctgttgagcag

SEQ ID NO: 27504 - DNA, 601 bp, Human
ttactaactgggaggtggaaagcaccagcattcaggaaacagggctgtgattttgagggtggctcatggtggcaccccatctgtcctgccagaatgcttcctgccactgcaggaaatggggctgtggggcttctgaggtcactttgagtcatggataagccaagaaatgggacaagccaataggagagaagaagggcatggtgttttaccgtggtaggggatggggaaacaggagctgagagaagaggtcttcgaatggaggtgagccaacctctattttattagggtggtggtgggcagrggagcaagcaccttgggagcagctctacccactgcttgccctcttgcaggaaggtcctagtgggtgactggaagtaggatagggatggggagttgggtgtggctggaaaaagcgatgacaccagctctgagccatgaagcatctttctaattccaagatggagctggatggggtggggtagggtggagcagagcaggggccttccggtccagtgcccctcacccttccttcttcccaggactgcgggaagcccctgtcgattgaggcagatgacaatggctgcttccccctggacggtca

SEQ ID NO: 27505 - DNA, 601 bp, Human
ggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccragcagcctttgtactctgcttgcggagggctgggagaccctccaggacattcccaccctcccccatgctgccaagttgtagctatagctacaaataaaaaaaaaccttgttttccagaattctcagtagtcagctcttttgtagtgcctgcagccctcatgggtgggatggaggcagaaaatcagttcctgtttatttacaaaaatatatatatgtgtatgtatgtatatatattaacccctcagctccctcccatgatcatccttttacttctacccccacctcccttttaaaacaaag

SEQ ID NO: 27506 - DNA, 601 bp, Human
caaccactatattcttggcaacttgagttcctcaccccttagcagatgtttggagtaaaacgataacttccatctgttttttcaaagattttctataataagcatgtgctaattttttagtcagaaagattaatgttcagtatttacatccatccatccatccatcaatatttggcccttggtccagaaaaatattgtgatttgttgttaacccacagacacgagagatttaagatgcacctccttgagtgctggtgtcaaatggctgtctcccagcccagtctcattggctcttatggaygccgatctgcaaaccacctccaaaccctcaggcagctgcagggtctagcaggcttccctatccgtgtgttattatggtttgccctccaggtcagcatttatggggagatagatgggcaagctctagaccctgccatttccctcaaaccagtgcagccaagggggcacacaggatgtcccagctgctttaaaacagctgccatctttaaacagaaaaagtcaggttttttcgagtagtaaccagtttttacctaaggcaggaagggaggggacccagtgctgtaaacaaaccagagcctct

SEQ ID NO: 27507 - DNA, 601 bp, Human
ttcttctccctggaaaaaagttgcccatcctcaaggaagaggtggatatggcaaaaagtggaactccattcccctggaagctggtatgttggagcctttctggagggggctgggctccaggtggcttgcgtggtagtgccatcccatggctgtctcctctgaggccctgtttcagggcataaccagggaagaagtcaaagggcagcagggccctttgagaggaagaaccatttcaaatcagaaaccttccccagaaatgtggtcggggaacccaggcacaggtgctcttcctcgaagtcckatgccagcagtggtcttttatccagctgaggtgataggagggagggggctggtggacaaagctgggcaggaggccatgctacaggcactgcaactcccagctgtttggtccaaaggtctcaaaaggtaggccctagatcaacatcgtcctcacctggcaaagcaagacaaattattgggcccaccccagatctaccaaatcagaaaattcggggttggggtccagcaatgtgctttaacaaggtctcaggtgattctaatgtttgcagaagtttgagcatcactgttctggaaagatggc

SEQ ID NO: 27508 - DNA, 601 bp, Human
ctgagttcctcagttcttcctggattagcaacaagagcaaaccaaataccttagcatgtttctaacatttaaaagcaatcttgtaatctccagggtgaaagattctttagaagttggcatttttaaattttttttcttttgagacggagttttgctcttgttgcccaggctggagtgcaatggcaccatctcaactcattgcaacctctacctcccgggttgaagtgattctcttgcctcagcctcctgagtagctgggattacaggcatgtgccagcacgcccggcaaatttctgtattytgaatagagatggggtttcaccatgttggccaggctggtcatgaactcctgacctcacatgatctgcccaccttggcctcccaaagtgctggaattacaggcttgtaatacaggaagtgagctatttttattggctcaaaactgcattgcaaataaagcagctttgctgtccccaggatagacctacctaaagatctgtccagtattattttattggctaccagaggaacatagtaaataactcccaagtgtcttaagctttacataaagagggacagctctcggctgggtgtggtagct

SEQ ID NO: 27509 - DNA, 601 bp, Human
ccattattgtgttgaaaccaggacagctctggcttctcctcatatactaaagactgtatgccaagctagaaactagctaatctagaaaatatggatttggggatcaaggggaaaaagaacccttggagtgacagcatgtggattcttcttcccagagatttgatcacctctcagctatttgtatcaggctgcaagtttcaagtattaatggagcttgtttttgtttttcaggcccaactggaaggcattattgcaccaaagaagtgataatttccacatgattaatttccaacaagacacytgggagttatttactgtgttcctctggcagccaataaaatcatcataagccctttgtaataaaaagctagtttcctgagtgaacaagccataacctcccctaaacaccacctaggtatttgttagaagtcacactattactccaatgtcatcagacacctaaggtctgccagccaggctcctggctgggcaatggaagatggtgtggccctgttagtctccgtgtgtggcttactagccagccttgggaactgccaactcaaattctaagaaagccactgctttctcatcatcactctat

SEQ ID NO: 27510 - DNA, 601 bp, Human
taagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttttaccaagtcttacagtgattattttacgtgtttccatgtatctcactttgtgctgtrttaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatactt

SEQ ID NO: 27511 - DNA, 601 bp, Human
gggttaagtaaaataaaaactttcacaattctacttgtcccacaaacacctcaaattagtaaaaagaataataaatcacagctacaataaaactattaggggataaaatttctacaacatcatgtttttaaaaataatttgtctagaacaaaacatgggattctttcaactaccaactcttccccaagcattactgtgttggccacttacagtatatttacatgacttctctaattttttcctgacatgaagaaaattcaccatttctttggcatctcaaccctgcccccaccagaagacyaaaatacaaacaaaaaattggagaaaaagtgcagagcctctttggctagcagcgagatagtgcagccaattttgttgttgtattaaaaataattttaaaataacatgttgttaagcaatagtttatgtgaaaacttatatttaaaaagccatgctttacttaaatatgcccttcttagggcacataccactttaaacaaacaaaaggcacaccttgtaatcttaacccagattgtgaccacaggctggttgaggcttaaaaaaaatccgggtttaggaagagcgcttcaacctcttccca

SEQ ID NO: 27512 - DNA, 601 bp, Human
caggctcataggtggaagaaactcatcttcagatgaaactctggacttacagatttgggacttctgtgttaatgctgaaacaagaccggactttgggggactactgcgaaggcacaactgaatcttgaaatgtgagaaacatatgagagttgggggaccgggggtgcaatgatatgctttggatgtttgccccctccaaatttcgtgttgaaaagtgatttgcaatgctggaggtgaggcctggtaaggtgattaaatcatgggggcagatccctcatgaacggcttagcatggtaatccrtggtggtgagtgagttctctcaagatttgtttaaaagagcatggcacctccctctacaacttgctcccactcccaaatgaaatgcctgctccccctttgtcttctgccatgattggaagtttcctgaggctttcaccagaagcaaatactggcgccatgcttcttgtactgtctgcagaaccacgaatcaataaaacctattttctttataaactaccctgcctcaagtgtttctttatagtaacgcaaaaaaaaaaaaaagcctaatacagaaagtatttcactgtctggcttccatga

SEQ ID NO: 27513 - DNA, 601 bp, Human
gatttctaagttcatcggttttcttcttacttagaaaaaaatgtatcctctcaatttcacaaagtttctgcccctttcctggggaaaaaaaaaaatcacaattaaatacctatggcttactaatacatttacaaagttaatttaatgagaattattttcacagcataatttacatgtaactctgctcttacagagcaaattaaataaaattataccaaaagtataaaacactaccttgctgatactaagctacaaaccatcattttcacaaatttaggcactttcaccacaaaatgaaagraagctagaataaacttaccttgtgcaattgtaaatggctctctctgtaaggaagagacttgcattgtcaacctctctacttttttcttttccctcttgccttccacgatgagactcttttctagaaattaatttagtatttcttaattaacaaaaagcttaaacattgtattaactttattagatacacatgtagaacaaagtccccaaaacctaatactttattcttcttctgagcatggttttggaaagcaaatgacataaaagaggaaaacacttgattaattaatagagcaccatg

SEQ ID NO: 27514 - DNA, 601 bp, Human
taaaacaattagccagacacagtatggtggcatgcacctgtggtcccagctacttgggaggcttaagcgggaggaacacttgagcccaggaggttgaggctgcagtgagccatgtattgcacactgtactccagcctgggtgacaaagtgagaccgtgtcttaaaagaaagaaaaaaaaaagaaaaagaaaaagaaaaaagaagacagagccctggatattataatccaagtgctaatatccagctgtgtttcctgtgataaatcatttaataagtatatacctcagtctgctcagtcatraagtgtggaaattgaactagtggatcactaacatttacagaaattgattccattgtgaagtaatatacaagtaggtttaaagtgtaaaaaggtcttacagtgcctggcctgttgtaaagcagtttgtgtagatttctaagttcatcggttttcttcttacttagaaaaaaatgtatcctctcaatttcacaaagtttctgcccctttcctggggaaaaaaaaaaatcacaattaaatacctatggcttactaatacatttacaaagttaatttaatgagaattattttcacagcataatt

SEQ ID NO: 27515 - DNA, 601 bp, Human
gtaatcccaacactttgggaggccaaggtgggaggaccacttgagctcaggagttcaagaccagcctgggcacatggcaaaaccctgcctctacaaaaagtaaaacaattagccagacacagtatggtggcatgcacctgtggtcccagctacttgggaggcttaagcgggaggaacacttgagcccaggaggttgaggctgcagtgagccatgtattgcacactgtactccagcctgggtgacaaagtgagaccgtgtcttaaaagaaagaaaaaaaaaagaaaaagaaaaagaaaaaakaagacagagccctggatattataatccaagtgctaatatccagctgtgtttcctgtgataaatcatttaataagtatatacctcagtctgctcagtcataaagtgtggaaattgaactagtggatcactaacatttacagaaattgattccattgtgaagtaatatacaagtaggtttaaagtgtaaaaaggtcttacagtgcctggcctgttgtaaagcagtttgtgtagatttctaagttcatcggttttcttcttacttagaaaaaaatgtatcctctcaatttcacaaagtttctg

SEQ ID NO: 27516 - DNA, 601 bp, Human
ttcatacctgtctgtaagttacaatactggctgaacagtcaaccaattcaatatgggttcaatattcaacatttcttattcaaaactgaaaaatgtatttgtcattaacatattaacattataaaaatcctacaaacttaagtctctgaaaagaacaatttgaacaaattttcactggggagtttttaccacaaccaaaagttacctgacagtaccaggggatgtggaaagttactatttaaaaatatatccttttcataagtaataaagttactagtaattcttcttttccaaatcaagraggactttattctttcaaagtaaagaatagcgagtaccacaaaaagctaataccgttcactagttatgggacttgtgtaaattaaattggtttaaggattaaatgagattaacagactcactgaaaataaattatgtcatgcaccagacattctattctacttcagacattctaacacccaactttactttgcccacgtacaacctaaagcagttccctcgattatataatatactaagtcatatgtacagtataataacaatcctttagcaaagaactatcatccaatttatcaggtat

SEQ ID NO: 27517 - DNA, 601 bp, Human
ccttattattaatggtatttattacccagtaatgtacacaagaataaattcaaagccaattcaaagtcaacatctttattttcatacctgtctgtaagttacaatactggctgaacagtcaaccaattcaatatgggttcaatattcaacatttcttattcaaaactgaaaaatgtatttgtcattaacatattaacattataaaaatcctacaaacttaagtctctgaaaagaacaatttgaacaaattttcactggggagtttttaccacaaccaaaagttacctgacagtaccagggratgtggaaagttactatttaaaaatatatccttttcataagtaataaagttactagtaattcttcttttccaaatcaagaaggactttattctttcaaagtaaagaatagcgagtaccacaaaaagctaataccgttcactagttatgggacttgtgtaaattaaattggtttaaggattaaatgagattaacagactcactgaaaataaattatgtcatgcaccagacattctattctacttcagacattctaacacccaactttactttgcccacgtacaacctaaagcagttccctc

SEQ ID NO: 27518 - DNA, 601 bp, Human
aatgcagaagcaaatggtaatcaagctgttttctcttaagccagacattaaacagatgtacaaaaacataaaatgccactctttcattcttttgaaaagttatttttcctagaaaatattatttttaacattttaaaataaaaatttttcagttctaatgtcaaatacagtgaagatcaaaataactcatattaaaaaaagctcttggggtcctcactaattttttaagagggcaacagtatcctgaaaccaataaattggaaaaccactgagaaaaagataaatataaaaatatctgtcrtaacaacctagtaaattgcttctgaggaaatagtgatcaccttgcctcacactaaatccttaaaaagtacaagtatagctatagtaaaagttagaaaataagaagtattttgtctttaaacaagccaatttaaaacaccaaaaatcatcataccccttgcgtttgtagttgtataacaaaagtttacactttaactgctgtttatctgtcctcgtgcagctaatggtaataaggaccaagggcggacgaaaacgaagtcctagagctattttctggttttgattaatgccatctcccatc

SEQ ID NO: 27519 - DNA, 601 bp, Human
aagacataattcagggaaccaatatttacaagcggtaaatgcatgttacaaaactatacatacaagacccaagttaattaacctggtttcagacctacattaaacattacaactaatctttaggaaactacaacttatgtagagttttggtattgtatggtatcaaaaagagaatatacacaattatctaaaaagactttaaaaatattctttttatgtgaggctcggttttcttcatatacttattattttgagagaggatctcattctgtcacctaggatggaatgcagtggcatgaawatagctcactgcagcactgacctcctgagttcaggcttccacctcagcctcccaagtggctgggattacacgagcgtgcctcagcgcctggctaatttcttcttgagacagtctcactctgtcacccaggctggtcttgaactcctgagctcaagtgatccacctgcctcggcctcccaaagggcagggattacaggcataagctactgcatcaggcccttcatagattttaaacaaaacaatacattgcaaaagactgaatgcggccaggcacggtagctcacgcctgtaatcccagca

SEQ ID NO: 27520 - DNA, 601 bp, Human
tgttaagctccaacggctgttaatactttgtcatgataatattttaagttagatttgtaatttatttcatccctacaagcattaaaactgtcactgccaacccagcactttgggacgccgaggcgggcagatcatgaggtcaggagatcgagaccatcctggctaacacggtgaaaccccgtctctactaaaaatacaaaaaattagccgggcgtggtggcgggcgcctgtagccccagctactcgggaggctgaggcaggagaaaggcgtgaacccaggaggcagagtttgcagtgagcygagatcgcgccactgcagtccagcctgggcaacagtgtgagactccgtctcaaaaaaacacaaaaagcaaaaaacaaaaaactgtcactgccaaagaagctccttgctttagaaggcccaacactccaatcgaaggaatgggagaaaaacctttttttttttttttttttttttttttgagacagagtctcattctgttgtgcagtagctgggattacaagtatgcaccatcacgcccagctaatttttgtatttttagtagagacagtgtttcaccatgttggccaggctggtctcaaa

SEQ ID NO: 27521 - DNA, 601 bp, Human
accaggaggtaattccatacccgacctcgtgtgacgggtcgcagtcaaaacttggtttcaggccaagggcagtggtccaagcctgtaaacccagtgctctggggggccaagataggagactcgcttgagtccagcagttcaaggctacagtgagctgtaacggcaccactgcaataaataatttatttagttaaaatattaaactaccttcaggctatttaagatgaatatgaaacatgaatgaatttcatgtttagactgggtcccatccccaagatatctctctctctgtctctctctmtatatatatatattgcaaaatctgaatcacttcctgtcccaagcatttcagataagggatattcaacctgtattacttctccccgcaatgttctctgcagtttacctgtttctcccacacacttaaatactatgtacaacatattaatatatgctatatctttaaagttgctgattaatgttatttctaacataccttttttggaactgttttgattcttcttggtggtgctgctatctgctttcttaacattggcacttttcacagattttttacttttagaagtagctttctgtttag

SEQ ID NO: 27522 - DNA, 601 bp, Human
tgtccttcaaaaatcagttgagatcaatacagaattacagctacctgctgatcttcccctcacctttgcctcgtagacaggaacttcctcaagtatttgtgagagcaacgttgagatgcccagctacccaggtacaccatgaggccacatcataatctgagttcaggtcttatcactaactgttcaaactttaattttaagctttaaagtgggaatgagaagaaataaatttccctattatgaagaaatgtgaggatcaaatgtgatatttagtgacatgaatattttgaaaaatatggartattttatgtaattacttttgtcttatatttctaaagtcaaacttgaaagactgaaatatttacctcttttacagttgtttttatgaaatcttttctttcagttaaatcataagtaggataattttcatagacctatgtatagtgaaaaggaaaaataatgttaaaagcagattttaaaatccagtaatattgtctttgaataaaagcaggaaatctgctacgtgcaaatagccacaaccatcccaacagtactctggttaacccatatggaattctattccaaatgagtattttaataa

SEQ ID NO: 27523 - DNA, 601 bp, Human
ttccaaatactctatgcatgactacttaccttctttatagcaaatggtcataaaattaaccttaattattcagttttgtgaagtcactccaagaaaatggtccattaccacaaaagagtattccaaattgtataggttatagggctgaatcaatttaaaaatcccttttcagaattattccccataaggaaatgctatatacacctataagatatcaaatgcaagtgacttaaaacaccagtgatttagatttatttttattgacaaggtttataagaacaaatatttaaaatcgaaggcyaattattaggtctcatttagttgcttattttgttcacttgtatttacctttccctagtgtctgagtaactatcaagaaacaaacctgtgaaaatacctgttaacattcaacatatatttttatatatttctgttctatgatgcaaagatatttttcaacacttaattggtgcaacaaatgtgtcattgtgtcataaacagcatgttttaaaattcagatttaataaactgatttaagacagtaaatttgaaagacaaaattaagtctcattcaggagtggtccattatgttgatcatcta

SEQ ID NO: 27524 - DNA, 601 bp, Human
aggttgtgagcacctgccatagaaactcttagaaacatactagcaaacagaagacgtgagggttacacaagtagaatacctggactgaaagaatgaatgtaaaattagagttaaaagtcctgaactggttccgataagagcagttttaggggaacagacatctatccacaggtatgaggggaattctaagaattagaaggtatcatttgggataacccctactgtttccaactagaaaaatgatttagaatgaaccaagaataatattcattaaatattgagtgctaagcagtggtctacygaaattcaagttaggagacaacaacgggttaggagaaacctagaagaaatgttctcggacagtcaaatataagcacaagcgacatcctatctataaattttcttgatttcttatcaacagaggaacaggaaatccagaaatggaaaatcaggaaattgttgataatttcctatctgtttctgctcatttaaattcagggcctccagccaaatgttgggaacgattgcctttaatccttattaaaagagctctactgtagcctctgttgcccacataatgccagagagaaaaggggcaggc

SEQ ID NO: 27525 - DNA, 601 bp, Human
acgacaaacatatttgagtgtcatttaagccatcaaattataaatcttgtaacgtgggcaacgtgcattcaacaaggtactcaaagcaaagagcctggaaaacaaaatgcaaatgttctacttgtttatgaccggtaaagctacagcttaatcacatcttctccaaggtttggaatcaaaggcaaaagcatttgaagagtaaaataaacctgccgtgggaccccagaggctgatctttaaatccaccactaagacaggtagcggggagaagcacaagttgaaaagtctcttgagcttgtargggtagaggttgggggggtaattttcaagctctgttccttgggattaggatacagtgttctgccaccaagcagccatgtcaaggtgagccacagtaccagatgggagagttcctccccttcctgtgatggggcaggaaacgaaaaagaggttgtgagcacctgccatagaaactcttagaaacatactagcaaacagaagacgtgagggttacacaagtagaatacctggactgaaagaatgaatgtaaaattagagttaaaagtcctgaactggttccgataagagcagttttagggga

SEQ ID NO: 27526 - DNA, 601 bp, Human
atggctggcaagtacagaccaagtgtgtacttctatatgaaacgacaaacatatttgagtgtcatttaagccatcaaattataaatcttgtaacgtgggcaacgtgcattcaacaaggtactcaaagcaaagagcctggaaaacaaaatgcaaatgttctacttgtttatgaccggtaaagctacagcttaatcacatcttctccaaggtttggaatcaaaggcaaaagcatttgaagagtaaaataaacctgccgtgggaccccagaggctgatctttaaatccaccactaagacaggtwgcggggagaagcacaagttgaaaagtctcttgagcttgtaggggtagaggttgggggggtaattttcaagctctgttccttgggattaggatacagtgttctgccaccaagcagccatgtcaaggtgagccacagtaccagatgggagagttcctccccttcctgtgatggggcaggaaacgaaaaagaggttgtgagcacctgccatagaaactcttagaaacatactagcaaacagaagacgtgagggttacacaagtagaatacctggactgaaagaatgaatgtaaaattagagtt

SEQ ID NO: 27527 - DNA, 601 bp, Human
cgcaccattttcattatatacatgcattttaagtccaggatgctttctcttccataaaaaccatcacggtgctttctagagagaaatattgagaactgagttgaccggcattgatgccttcccttttcaatttaaaggttcatttgcacttcaatatgcattattaacaaagcaccgttgttattcccattctccccatttctccacaagtcaaaatgactggaaattacaatcatgcttctagaaagctgtaagctaaaagaattaaaatatggctggcaagtacagaccaagtgtgtayttctatatgaaacgacaaacatatttgagtgtcatttaagccatcaaattataaatcttgtaacgtgggcaacgtgcattcaacaaggtactcaaagcaaagagcctggaaaacaaaatgcaaatgttctacttgtttatgaccggtaaagctacagcttaatcacatcttctccaaggtttggaatcaaaggcaaaagcatttgaagagtaaaataaacctgccgtgggaccccagaggctgatctttaaatccaccactaagacaggtagcggggagaagcacaagttgaaaagtctc

SEQ ID NO: 27528 - DNA, 601 bp, Human
atagttaacatttagtgggggcagaaaaatgcagggaaaaagcaaatgcagttgctgcattgcataaacaagattagttagcagcctttctattgatttttttttaagagtgaaataaaggcagcataagtggggcaggaaatgtccctttcatatttaccgtaggtgctaaccaaaacaatctactatataattccaattcacaaggattccacatatttgaaattatttttcgcaccattttcattatatacatgcattttaagtccaggatgctttctcttccataaaaaccatcacrgtgctttctagagagaaatattgagaactgagttgaccggcattgatgccttcccttttcaatttaaaggttcatttgcacttcaatatgcattattaacaaagcaccgttgttattcccattctccccatttctccacaagtcaaaatgactggaaattacaatcatgcttctagaaagctgtaagctaaaagaattaaaatatggctggcaagtacagaccaagtgtgtacttctatatgaaacgacaaacatatttgagtgtcatttaagccatcaaattataaatcttgtaacgtg

SEQ ID NO: 27529 - DNA, 601 bp, Human
cagtatgcctgtcatatttaaggagttttcaaacagttctggccagttcctgatattcaactctcattaggctctacatataatgtgctatatactgctatggctacaaataccccaccactactgtgccttctattaaacaaatacgataggctgtctagaaacacaaaagcaatagcaccagttcatttcagaatggccaccttcgaggaagcaaaacagcacctccccaactcgctgtcctatatgtacacagtacccaagcaaacatttcttttcagagaaggcagcaacttttctrtttgactcataattatccatactaacggaggggaacaatggcacagataatccctaaagaaaaggcaattcaaaaataatttgcatttgcctttgggatgtcttatgtgattttctccagtagatttaccatctttgccttgctcagagcttgcttaggatgatgttaaaattagtttgcattcttgaatgagtagccgatggagagggaaggagtctgctgtgggggagctgaacagtaaggaggcttcaggatggagactcaaaaatccacagagagaacgagctgactgtgacgctc

SEQ ID NO: 27530 - DNA, 601 bp, Human
ttctgctgaatcatggattattggagcagcaaatcaagattattaaacaaaacgagcacataaacaaacaaaaccaaagcactctctagaacaggagccagtcaaaagtcatttatttcagaccacgtgtaggtcttctctgatgaccacatttgaaggtcatcagagaagacgacggagttcaatgcactgtggctgttccctttgtctttatggtccaagtgtacctgttttgagacttaagaaaagtggaggagaatacattttgaacaggaactgtataatcattttttaaatgatmatgtaaaaatctagttagaagcaatggaagaccggggtggtctggagaaaaggaaactgtcagactaatgaacagagaagtgagaaaggtatgaggagaaaaaaaaaagagcaaagagaaagagaacggaaagaaacagagttaagaaaaaactaagactgcaatatgcccctggagaacagggatttcgtaagagtgagacagttgagagaacatggaaagtggatatggaagtggatgaatggagatgattcaggcagcagaaataggaaccccgtcccccacaaaggcagctcctga

SEQ ID NO: 27531 - DNA, 601 bp, Human
ttgccaggaagtttgacctgcttcaaaggtggacaagggcaatatcatcccaggatatcaacggccatgtgggtttttctgacttccagaaagttccatgtagccatagcctctctctgagtggcaaacccagatctctgactgttcagagtgcccttcaaactcctcttcctgctccccctttcctggggtatgaagcatcgtctacctgcccctccactccaacgaaactggcggtcatgtggtctcccactcgccctcagcctctgcttggtcatcatgaggtcccgggactcacagyagggggagtagagtcaaagccaagagcccctgctgctgggagttggcaagactagcactcatccctcgtcctgcaaatgaataacctctgcccatctcagcctcctctgctttaaaaataagaacaatagtgtgtacctgagagtgtgtgcaaagcacttagagcccggcacacagtaactggtaaaaataataatcaggaaacacatcccttcgagcctctctcaatccttgtccttctcacttccccacttcccctgccctgggtcaggtcaggcctttatcccttctttttcttctt

SEQ ID NO: 27532 - DNA, 601 bp, Human
agagggccaggatgagcggtcagggtagaggtatgacctacccattgtcctcataggcatcacatagacaagcagatggctttgtactcatggttgagggggctaggacatggtgtcacctggtgggctgtcaaatctttcaatgcccctagtgtatgaggcagcacacagggagaaagccctcatcttctgagatcccaggtagccacggagaaaagggtggctagtgatagcagccaaagccaagcaccagatgaaagcaggtcctattctcagttgctggaagcatctggccaataayaaaacttatagaagttctgcatttgctagttaggcaccattccaacatggtgaactaaagtagaagaaactgctcaaagttgaacatctgaccctagattctaacccacataaggtgagctcatcttttcccttgctggtccccacagtcatctggtgagcattgggttagcaggagaatatgaccgggatacaaagtgcatcacagaatatatgctgattgcattggtccaacttggtttcaaacagatcacaattacagacattacattaatgagttaacgagacgattacatgacta

SEQ ID NO: 27533 - DNA, 601 bp, Human
aacaaaaaacaaaacaaaaaaataggctactcagaacaactttacatcacagctaaaatcagaaaaattggtatagaagaaaatgtccgggttctagaagaaggaaatgagagttctgtagagggacaggttttccagggtgttcagagggagactttcctagcagaccttcagttccaggtgagggtggcatctgcccccctggtgtgagctgagaagcccccttgcacaaggcagtgtgctctgcagaaaggtggcagctcctggggctgtgcaggtgaaacgaagggcttcgccgagrgcactccttttttttttaagcagacaagacgtaactccctacctgacaagctgcgcattgtcatgggatttgcgaggtagaagcttcatcttcctccagtccagaaattcatggaggctggtgaatgggtcctgacttacagagcatttgtccatgtcattccacacttccacgcctaccaacacgatccgaatgttcagtggtctgtaaaactgggcaaaacaggcaaaactggcattggagttgggatcacgttaataaaaactcgaaatgaaaattagaacagatttgcgttatttg

SEQ ID NO: 27534 - DNA, 601 bp, Human
ccaaagtactgtccttagatattgtataaacatacattttccactaataatgatgaatctttaaaaacaggctcctcggcctggcgcggtggctcatgcctgtaatcccagcactttgggaggccgaggtgggcggatcatgaggtcaggagattgagaccatcttggccaacatggtgaaaccctgtctctactaaaaaaaaaaaaaaaaaatacaaaaattagctgggcgtggtggcgtgtgcctgtaatctcagctactcgggaggttgaggcaggagaatcacttaaaccagggagytggaggttgcagtgagctgagatcatgccactgcactccagcctggtgacagagagagactctgtctcaaaaacaaacaaacaaacaaaaaacaaaacaaaaaaataggctactcagaacaactttacatcacagctaaaatcagaaaaattggtatagaagaaaatgtccgggttctagaagaaggaaatgagagttctgtagagggacaggttttccagggtgttcagagggagactttcctagcagaccttcagttccaggtgagggtggcatctgcccccctggtgtgagctgaga

SEQ ID NO: 27535 - DNA, 601 bp, Human
ctctgatctagaaaaccaaagagtcacagccacaacaggaggaggaataaagtcttttttccctccaggaatctgacagtattcacccaaagtactgtccttagatattgtataaacatacattttccactaataatgatgaatctttaaaaacaggctcctcggcctggcgcggtggctcatgcctgtaatcccagcactttgggaggccgaggtgggcggatcatgaggtcaggagattgagaccatcttggccaacatggtgaaaccctgtctctactaaaaaaaaaaaaaaaaaatmcaaaaattagctgggcgtggtggcgtgtgcctgtaatctcagctactcgggaggttgaggcaggagaatcacttaaaccagggagctggaggttgcagtgagctgagatcatgccactgcactccagcctggtgacagagagagactctgtctcaaaaacaaacaaacaaacaaaaaacaaaacaaaaaaataggctactcagaacaactttacatcacagctaaaatcagaaaaattggtatagaagaaaatgtccgggttctagaagaaggaaatgagagttctgtagagggacaggt

SEQ ID NO: 27536 - DNA, 601 bp, Human
tgctatgcttcccggtattctctgatctagaaaaccaaagagtcacagccacaacaggaggaggaataaagtcttttttccctccaggaatctgacagtattcacccaaagtactgtccttagatattgtataaacatacattttccactaataatgatgaatctttaaaaacaggctcctcggcctggcgcggtggctcatgcctgtaatcccagcactttgggaggccgaggtgggcggatcatgaggtcaggagattgagaccatcttggccaacatggtgaaaccctgtctctactaaaaaaaaaaaaaaaaaatacaaaaattagctgggcgtggtggcgtgtgcctgtaatctcagctactcgggaggttgaggcaggagaatcacttaaaccagggagctggaggttgcagtgagctgagatcatgccactgcactccagcctggtgacagagagagactctgtctcaaaaacaaacaaacaaacaaaaaacaaaacaaaaaaataggctactcagaacaactttacatcacagctaaaatcagaaaaattggtatagaagaaaatgtccgggttctagaagaaggaaatgaga

SEQ ID NO: 27537 - DNA, 601 bp, Human
tgagagcagggagatttacagtgttggtcaccactgtgttcaaagccccccaaacactctttggttcctaacgggtgatgcatattgatttaaagagggaacacaaggttaatgtgctatgcttcccggtattctctgatctagaaaaccaaagagtcacagccacaacaggaggaggaataaagtcttttttccctccaggaatctgacagtattcacccaaagtactgtccttagatattgtataaacatacattttccactaataatgatgaatctttaaaaacaggctcctcggcckggcgcggtggctcatgcctgtaatcccagcactttgggaggccgaggtgggcggatcatgaggtcaggagattgagaccatcttggccaacatggtgaaaccctgtctctactaaaaaaaaaaaaaaaaaatacaaaaattagctgggcgtggtggcgtgtgcctgtaatctcagctactcgggaggttgaggcaggagaatcacttaaaccagggagctggaggttgcagtgagctgagatcatgccactgcactccagcctggtgacagagagagactctgtctcaaaaacaaacaaa

SEQ ID NO: 27538 - DNA, 601 bp, Human
tccagttgatcctgctgaaattgtcctctttattgttgtctctcagtagagtggagacttctgagagcagggagatttacagtgttggtcaccactgtgttcaaagccccccaaacactctttggttcctaacgggtgatgcatattgatttaaagagggaacacaaggttaatgtgctatgcttcccggtattctctgatctagaaaaccaaagagtcacagccacaacaggaggaggaataaagtcttttttccctccaggaatctgacagtattcacccaaagtactgtccttagatmttgtataaacatacattttccactaataatgatgaatctttaaaaacaggctcctcggcctggcgcggtggctcatgcctgtaatcccagcactttgggaggccgaggtgggcggatcatgaggtcaggagattgagaccatcttggccaacatggtgaaaccctgtctctactaaaaaaaaaaaaaaaaaatacaaaaattagctgggcgtggtggcgtgtgcctgtaatctcagctactcgggaggttgaggcaggagaatcacttaaaccagggagctggaggttgcagtgagctga

SEQ ID NO: 27539 - DNA, 601 bp, Human
atgccctggctcaccccagtgctgcgaggaattcctggtttggaaagtcctggttgaaaatgtttctccataaaagaggtaggcttgcctctgctgagctattttacatgcccacctttcctgtgtgcaatttgcttttaaatggttcctaaaacactgtgggatatataaaattataaatacagctacagtaaaaatagagttaaatctaaaaagcattaaaggaaaggatctatcttcacaaagtctgataaaagtagtgacttcctggggaatcattatcaaggggaaccagctcccratgcccttggcttaccatgacaattcccccagactggtctgccgtgcacatgctcatgattggggccatgccgatggtggtcccttggaaataaaccccactaggaaataaaagagaggactttctttaatcaaattagaacgggggcattctctaatatttaaaaattctgttggatattcctgcaataaaatacgcaaaaataaaaatagctgtatgagggtatattcacatgtgattttatcttttttccctgaaaattttatttctgcagttgcgtcatggttctgtcatttttta

SEQ ID NO: 27540 - DNA, 601 bp, Human
ctgaggatactccctgtctgaggtctggtgcagaggagacactaaattttcagagcagggacagcatagggtgaaaacctctcctttaattatctgatgaagtggagcacaagccccctgctggcaagcctatcaaagctacctccctcctacattcataacgagacccaaatagttttcccactgtatttcctttcacaaacatatatagcttatatatgacaaaatggtccttgtaaagcaataaacctgggtttctgacttccaagaataaggttattttaaagacaaactgtatacyggccagaaggcatgtaaagcatttgcagtggtaaaaagctaaaaacctcagactttgggccattgggcttggagacagaaccatcagaaaaccatccaaacgggaacgtctggtgagaccacagggcgtcccaacagctgcatgacgagggcaaccccaatgccctggctcaccccagtgctgcgaggaattcctggtttggaaagtcctggttgaaaatgtttctccataaaagaggtaggcttgcctctgctgagctattttacatgcccacctttcctgtgtgcaatttgcttttaa

SEQ ID NO: 27541 - DNA, 601 bp, Human
aaattcaaggaattcacccttaaaaaatattcttctgattcttttgtgtcattgaatgtcttggtttttagttgccagattgttttacattctttcatgcatcaatgattataaacagaatgtctcttaaaagaccttgataaacagtttacatttgtagtaagaaaaaatatctctttattcatgttattaatattatttccaaagcaaggctgttttaggccagttagataaaaaggaatgactttcagtcactaaaattaatgatttgctctatattggaaaatacagaaatggtacyacaatcctgttttcaattttatgaggatctctgcttccttgctacattgattccttcctcttagatttgtggtcctctaatgaagcacagtcacacgggatgcccgtgaatgtaactttacagacacaggagaagaaagtgagtctagaagtttttggtctggtcaagatgttgatcttgctgatttcatgacttttgtagaaatcaaaggtgctgaggcatttttatcctatttgatgtttctgttatatgtggaacgtgtaagcagtgtgtctaaggatgatgttaactgctgtcaaa

SEQ ID NO: 27542 - DNA, 601 bp, Human
taataaattactttgtttagattttagagtttcctgttgtaggaagtttacaaatatgtttcaggaaatcggttctcgaaaataacacaatggtgaagagaatgtagtcagtctaagaacataggggctgaagttaccatgctctggcacaaaattcaaggaattcacccttaaaaaatattcttctgattcttttgtgtcattgaatgtcttggtttttagttgccagattgttttacattctttcatgcatcaatgattataaacagaatgtctcttaaaagaccttgataaacagttyacatttgtagtaagaaaaaatatctctttattcatgttattaatattatttccaaagcaaggctgttttaggccagttagataaaaaggaatgactttcagtcactaaaattaatgatttgctctatattggaaaatacagaaatggtactacaatcctgttttcaattttatgaggatctctgcttccttgctacattgattccttcctcttagatttgtggtcctctaatgaagcacagtcacacgggatgcccgtgaatgtaactttacagacacaggagaagaaagtgagtctaga

SEQ ID NO: 27543 - DNA, 601 bp, Human
cttccattgaatgaagcaaaaagtcatcctgcatcataggaaaagctcattccttcatgggccatagaagtatcattttacctttgattgagatgatgctgatataaaggtgacaggtgcaagcacgcttaatgacattctaaatgagccctgagaggttgtcattgagcctgcctcttcctgtgtgcttggtcggggaggacagttggaaaattcacaatacttcataataaatctgaccacattgagtcatctgtttgaagagccattcatttcatttaagattataaaccagctatawcttattcttgctggctctttgtgttgccaggcagactttggaaatgggaggtgtcccgattctctgactcttgcggctgggggttcattaaccttttgcttggatatggaaggcggcttctccattcaacaagcactacttggccacccctaacttagtggagtgcctggatggcttggctcaaacagatactagaaattaactaaaaaatatagttacttaacttttacaaactgaaattagttaattagcatatatgatctacagaaacagtgcctatatacaacatttctgaaaagg

SEQ ID NO: 27544 - DNA, 601 bp, Human
attcatatctccttggccttatttcccaggtctccctccccacagaaatatacctttcattaacatttgacttaatgtaattccttataagggaccaaggtaaaacgctatcatttagtttaaacttaaaaagatataatttgacatttcattaagccagtttggggtcctttcggctgaggaatgtctgtatgccgcacgtatacatgtgtgattctttatgtttttacatgacatcttcaaggcagggtctccattctgcttcctacaattgccccacaaaactcttccattgaatgargcaaaaagtcatcctgcatcataggaaaagctcattccttcatgggccatagaagtatcattttacctttgattgagatgatgctgatataaaggtgacaggtgcaagcacgcttaatgacattctaaatgagccctgagaggttgtcattgagcctgcctcttcctgtgtgcttggtcggggaggacagttggaaaattcacaatacttcataataaatctgaccacattgagtcatctgtttgaagagccattcatttcatttaagattataaaccagctatatcttattcttgctgg

SEQ ID NO: 27545 - DNA, 601 bp, Human
tgtccagtgtgtcatgattcatcccgaaattgtggcccagctcatgtgccagggtcacggctgcaccaaggggattgtctgaatggtcctcaaagaaaacacaaaagtacaggtgtataattcatatctccttggccttatttcccaggtctccctccccacagaaatatacctttcattaacatttgacttaatgtaattccttataagggaccaaggtaaaacgctatcatttagtttaaacttaaaaagatataatttgacatttcattaagccagtttggggtcctttcggctgagkaatgtctgtatgccgcacgtatacatgtgtgattctttatgtttttacatgacatcttcaaggcagggtctccattctgcttcctacaattgccccacaaaactcttccattgaatgaagcaaaaagtcatcctgcatcataggaaaagctcattccttcatgggccatagaagtatcattttacctttgattgagatgatgctgatataaaggtgacaggtgcaagcacgcttaatgacattctaaatgagccctgagaggttgtcattgagcctgcctcttcctgtgtgcttggtcgg

SEQ ID NO: 27546 - DNA, 601 bp, Human
tgaatgctgcttattcagattcccctctggtagcacaccttatgaagaaaaagaaatggtgcttattagctatttgaagctagaattccagggctttcttctctgtcaaactcaaagctaaacacttttttttattgtttttggcctcatcttgctgagaatgctgtacccttcgataggattatttatctttttaaatgaagtgatcacttattccatgcaatagttaaaattcaagaaagccaccctagctcacggggcttgttcaggatgggcagataggactcttccttcctgagtwctagtactttcatctggctgtacagttcctccaagttctctcttctttgcctagccgaggatacaagtcttcttgtatccttgttctgggaatggttcttacctctggctccccacagtcacactcctctccttcttccacaaatctgttcccacacttctggcccccgaaagactccctgacttccggcaggttaaacaggcacacccccattcctttctccaggctggtctccaagtccttcctgctgcaactgctgaacaccatgggaaatgggtacctgagaaaggagagcccaga

SEQ ID NO: 27547 - DNA, 601 bp, Human
gaactttttttaaaaaaagtagtccattaattgcatttttaaatcagtgtcatcaaatgcacaccactgctatcctggtccttatggtctaaatggctctatggatgacacatttaccaaattacaagttttcttgaaattccatgttaaatcagccatcctaaatctgggtcctaaaattctttaagaaatatcttcccccctctctcaaatcacccagtaatataagcagcagctcaaatggaaatgcagccatgccaaatggctctgacttcaaaggggatgataatgtgagaaagayaactaagtttaaaagatattcgcaagctactggcatcctattgactttaaacaaggagataaggctgctttcccaatcctgttagctggaagaatgagtgagttgtcaggatttccttatgttgatataaatccaatgccctgtccgggaaggcttcagcaatcaacctgccttcaaaccacccaggatctatttcttctgcagtaccatatttctcagaagagacacattcttcatctgctgctacattgattattttagtcctcaatagagaagtccaacagagccaatgaataccaa

SEQ ID NO: 27548 - DNA, 601 bp, Human
accagaagtcatagctgtaacttttatgacagtaagggtttctaacttgtggacttacaattctaaaagagtttaggaactttttttaaaaaaagtagtccattaattgcatttttaaatcagtgtcatcaaatgcacaccactgctatcctggtccttatggtctaaatggctctatggatgacacatttaccaaattacaagttttcttgaaattccatgttaaatcagccatcctaaatctgggtcctaaaattctttaagaaatatcttcccccctctctcaaatcacccagtaatrtaagcagcagctcaaatggaaatgcagccatgccaaatggctctgacttcaaaggggatgataatgtgagaaagataactaagtttaaaagatattcgcaagctactggcatcctattgactttaaacaaggagataaggctgctttcccaatcctgttagctggaagaatgagtgagttgtcaggatttccttatgttgatataaatccaatgccctgtccgggaaggcttcagcaatcaacctgccttcaaaccacccaggatctatttcttctgcagtaccatatttctcagaagag

SEQ ID NO: 27549 - DNA, 601 bp, Human
tctagtcagcagtacactggggctctgtagaggggtgtccaggcggatctcattgcagtggactgcatcaggatccctggaggactttgaaattacccaatcaaaaatatacatagatgcatacaatctgtactcttcaaaaatgaaccttttttgatttagagagtactggcaggaaatgaagtcaaaccagtggtttcaaccacaattccctgcaatctcgccagggttgtggatgagacccttgagcagcccgggtaagttgtctggcctgacaattccatcactcggaaagtcagamatggaccttataacaagcaagtggccggcaggaggcctgtgggctgtgcccattgatttgcgagggatttaaatggatagttcaagcattagatgtactgtcctctctgaaacaaaagtgagaaaagaaagtaactcctttataatgctgtgctccacacgtacccattgcttccattttttcctaacaaaaacaagagattgacatttttcgctcagttctcaacaaaaggcctgcacgcatttatcaagtgaagtccttgtacttgagaacattcaagtaactgcagtttacacattt

SEQ ID NO: 27550 - DNA, 601 bp, Human
ggggacatcactctagtcagcagtacactggggctctgtagaggggtgtccaggcggatctcattgcagtggactgcatcaggatccctggaggactttgaaattacccaatcaaaaatatacatagatgcatacaatctgtactcttcaaaaatgaaccttttttgatttagagagtactggcaggaaatgaagtcaaaccagtggtttcaaccacaattccctgcaatctcgccagggttgtggatgagacccttgagcagcccgggtaagttgtctggcctgacaattccatcactcrgaaagtcagaaatggaccttataacaagcaagtggccggcaggaggcctgtgggctgtgcccattgatttgcgagggatttaaatggatagttcaagcattagatgtactgtcctctctgaaacaaaagtgagaaaagaaagtaactcctttataatgctgtgctccacacgtacccattgcttccattttttcctaacaaaaacaagagattgacatttttcgctcagttctcaacaaaaggcctgcacgcatttatcaagtgaagtccttgtacttgagaacattcaagtaactgcag

SEQ ID NO: 27551 - DNA, 601 bp, Human
aggtggtggcattgcagcagcgattcatacattcctggaaaggggaatggcatttgtttgacagggtcttatggagtatgcactcactgaatgcaaacatcacaccttaaatggctgcaaaaagcaagaaagaccaagagggcccagctcctgaactgcacacctgcctgtttccgtctgttaggaaagcaaagcttctgctgtttatgaaccaactgggtctacgagtccctggaaaaagccagtagcacacaagtgccctcatgaaaggtaaagcagttgtaacataggctggccggcyggggacatcactctagtcagcagtacactggggctctgtagaggggtgtccaggcggatctcattgcagtggactgcatcaggatccctggaggactttgaaattacccaatcaaaaatatacatagatgcatacaatctgtactcttcaaaaatgaaccttttttgatttagagagtactggcaggaaatgaagtcaaaccagtggtttcaaccacaattccctgcaatctcgccagggttgtggatgagacccttgagcagcccgggtaagttgtctggcctgacaattccatcactc

SEQ ID NO: 27552 - DNA, 601 bp, Human
agatctgaaccacctgaacctgttggcgacctgggggtcaagttgtagctccggtgactcacctggcagtcttcacagcacagcccatgtgcgcacacagcgtccggcttcagggtacaggtggtggcattgcagcagcgattcatacattcctggaaaggggaatggcatttgtttgacagggtcttatggagtatgcactcactgaatgcaaacatcacaccttaaatggctgcaaaaagcaagaaagaccaagagggcccagctcctgaactgcacacctgcctgtttccgtctgttrggaaagcaaagcttctgctgtttatgaaccaactgggtctacgagtccctggaaaaagccagtagcacacaagtgccctcatgaaaggtaaagcagttgtaacataggctggccggctggggacatcactctagtcagcagtacactggggctctgtagaggggtgtccaggcggatctcattgcagtggactgcatcaggatccctggaggactttgaaattacccaatcaaaaatatacatagatgcatacaatctgtactcttcaaaaatgaaccttttttgatttagagagtactg

SEQ ID NO: 27553 - DNA, 601 bp, Human
tcagatctgaaccacctgaacctgttggcgacctgggggtcaagttgtagctccggtgactcacctggcagtcttcacagcacagcccatgtgcgcacacagcgtccggcttcagggtacaggtggtggcattgcagcagcgattcatacattcctggaaaggggaatggcatttgtttgacagggtcttatggagtatgcactcactgaatgcaaacatcacaccttaaatggctgcaaaaagcaagaaagaccaagagggcccagctcctgaactgcacacctgcctgtttccgtctgytaggaaagcaaagcttctgctgtttatgaaccaactgggtctacgagtccctggaaaaagccagtagcacacaagtgccctcatgaaaggtaaagcagttgtaacataggctggccggctggggacatcactctagtcagcagtacactggggctctgtagaggggtgtccaggcggatctcattgcagtggactgcatcaggatccctggaggactttgaaattacccaatcaaaaatatacatagatgcatacaatctgtactcttcaaaaatgaaccttttttgatttagagagtac

SEQ ID NO: 27554 - DNA, 601 bp, Human
catttctgtgcaccccatgcccagtgcggcctcagaccctccctgggagtcaatcactcccgactgaacacaccggatgctgtgtggacagcgcccgccaggagtgggggctaaccaaaacagagcacatgcccccagtcccacagcccaggtctgccagtgcctctcctgatgccgagcttgtggcggccacgtacctggtccccagagcgtgacacactgctgctcgtgagtctggcagatgccattgtagcagtagccgtccacatcctgacatgagtgcccatcgtgcaggtacacrttggctgggcagtgagggctggcccctgtgcagaactctgggaggtcacaggagttgctggagtccctgcacgctgttcctgcaggcttcagctggaaggagagggccatttatgacacatgcacccggggaaagggagaggcagctctcagcattactcctgggctggagtggacaaggccataagtcccacataaggggtgaggatttcaaaggaagttgcttctaatgtagagatacctcattaaatcatcagattctcgttctggggttcactgttccactctaaagtgggtggga

SEQ ID NO: 27555 - DNA, 601 bp, Human
tattcgcttgctgtcatttagtctgatgagaaagtttggtgaaaaaaaaaaaatcagtatggcagagcatgaaaatctcaaattctttttttcttccaaaaaaaaaaaaagtttgactttatttctaaacctcaaaatatctccatgtatctttctccctgttctctgaaaggactcccctctggttttgagtttcttccactcctttccctctcctattcttctctctacagggttctaaaaatacatctgatttcccattctgttcaggtgaggacaagcccccaagaactctgtgctraaaaccaagccacatatccaaaaccaatagaatatgcgattgtatttctttccaaagtaatttcctggctagaagtcctcatgccacctggagtgtagaaatgacttattaacactcaaggcctaagaagacaggcttgatttttccccaatctgcattttaatagtcagaccaggatctaggatttattgactttttcttctaggtgcatctgagaagaagtagatttaggaaaaccaacaaaccttgtaacccagttcttgctgtttttcaatgggccctgttccagacttacattta

SEQ ID NO: 27556 - DNA, 601 bp, Human
cgaccccaacagctcatataagggcaagaggcatagcctttgggagaagcgctggcccaagcagcactgagggattcccactcggtgggtgcgaatcctggccaaggggatggtcacattccagctgataaaagaacctgtcctggattacagtgaacacagcaggaccctcatgggaatcactgcggatccctgagccctcagagaaccaaggttctgagatcaaagcacatttcatcttgaacgtggaaaacaaatttgatgataaattgagcccttggaattggaatgtccagatgcmcctggccctggctgttcaggctacagtttaaaaaaaaggtgtcagtcagaatggctgttattaaaaagtcaaaaaacaacagatgctggcaaggttgtggagaaaaaggaacacttatatactgctggcggagtgtaaattagttcaaccattgtggaaaacagtgcagtcgttcctcaaaggcctaaaacagaaattaccatttgacccagccaacccactactgggtaatacccaaagaaatataaatcattctatcataaagacacatgcactcatatgttcattgcagcactactc

SEQ ID NO: 27557 - DNA, 601 bp, Human
acagagagagattccgtctcaaaaaaaaaaaaaaaaaaaaaaaaaagatataggggagggcgagacagattactccttatcccagggcctggatagacatagatggagactccaagaatccagggttgaagagtcttttaagggagaggttgaaatatgggaactttttccagatactgactgacaagtagtatcatcaatgacataaaccatcagcaacgaggctcagcagaggaaaacagacggctccttgaatttatcaagctgttgtagtggtaggcatttcctaagtgatactggkctggctgaaagaactcagcctcatttcaaatgtgcataatatactccagactcaagggatgcagccctttatctcctataagattttacaaatccgtggagtcaaaggaaaaagagtctaacgttcaaatggcagaagaatttttaatcaagtagaaccttcctattgaggaggtcaccatccgaccccaacagctcatataagggcaagaggcatagcctttgggagaagcgctggcccaagcagcactgagggattcccactcggtgggtgcgaatcctggccaaggggatggtcaca

SEQ ID NO: 27558 - DNA, 601 bp, Human
ccagggagttggaggttgcagtgagccgagatcatgctactgcactccagtctggcgacagagagagattccgtctcaaaaaaaaaaaaaaaaaaaaaaaaaagatataggggagggcgagacagattactccttatcccagggcctggatagacatagatggagactccaagaatccagggttgaagagtcttttaagggagaggttgaaatatgggaactttttccagatactgactgacaagtagtatcatcaatgacataaaccatcagcaacgaggctcagcagaggaaaacagayggctccttgaatttatcaagctgttgtagtggtaggcatttcctaagtgatactgggctggctgaaagaactcagcctcatttcaaatgtgcataatatactccagactcaagggatgcagccctttatctcctataagattttacaaatccgtggagtcaaaggaaaaagagtctaacgttcaaatggcagaagaatttttaatcaagtagaaccttcctattgaggaggtcaccatccgaccccaacagctcatataagggcaagaggcatagcctttgggagaagcgctggcccaag

SEQ ID NO: 27559 - DNA, 601 bp, Human
ccctccagcatgcatacatacctgtattcaaacaaaaagcaagcaaaagaaagcttggagaagacccaaccttgtctcagttaatacggatggagcataacaatacattttatactggactcaggcatggatcttattgcctgactcctccaaactcagcacattttgagactaagttcaatgtcaacactattaaattattttgcattttatggcttttaatataactttcagttgatcctaaaattataactgattttcttatgagttttgtttggagcttgtaaagaaatctatgtaytgcagtatttttttcttccattaaaagatacaggagagggcgaggttgggcacggttgctcactcctgtaataccagcactttgggaggccgaggcaggcagaacacgaggtcaggagatcgagactctcctggaaaacatggtgaaaccctgtctctactgaaaatacaaaaattagctgggtgtggtggcacgtgcctgtaattccagcttcttgggaggccgaggcaggagaatcgcttgaaccagggagttggaggttgcagtgagccgagatcatgctactgcactccagtctgg

SEQ ID NO: 27560 - DNA, 601 bp, Human
acatgtgtttaatatgatctgttgtccttgttttaattccttttggaaatatttcagttcagacactggttctgaatgttggtagtaagaggaacagcacagtttgaaatgttattttgaaactcttcatgaaggaaggttgcttttcaaattactttgaacaacaaaagtcttttttaaaatcatagaatgttaatttaaaaggtaattacagctcagtctgattttctttgttaaataaaagtcacatgaaaaggtcaaaagaaatgaatacctttagaagaaaatatttcaaacacamtaactgctctatttaaaaaatgctatggattgcaaaaccttttacaaatgaatgtattattacttaacttgttatgggctggctgtaaaagggcagctcagcctactcacccctctgccgtggcactgcattgcacactcgtgaaccccaaagacactaatattttgacattgacgattcaggcagatctgtaggaggaggaaaacacagcaaatctcttagtatttctccaacccctccagcatgcatacatacctgtattcaaacaaaaagcaagcaaaagaaagcttggagaagacc

SEQ ID NO: 27561 - DNA, 601 bp, Human
ggcacaccatccccacagctcagggcctggcttcttcagtaaaataataggactggacttgatcatctcttaacagccatcagaaaataatctatgatccaatgaagacataagaagattccattgtatattgggagttagctaaccttaccgtcaacacccccatctgaggtgacactgtgatcctttatggttccagcatgatggtaatttacaaccccctccccccatgcacccggtaattctgtgtaagaatcattggcaagtgtctacaagttttaaaataaagaatttggagcakgatttctgtaggaaaggtttcaggaaaacaaatgaacctctggtgtggttaatcaagactaatatgattccattggaaataagcccatcaagaaaaataaattatgttttcagcaattagagtcctcttctaccctaaaggttctctgaactaaaataacagccttctttagttgaaacccattgtgtgtgatttcaagaacatgtgtttaatatgatctgttgtccttgttttaattccttttggaaatatttcagttcagacactggttctgaatgttggtagtaagaggaacagcac

SEQ ID NO: 27562 - DNA, 601 bp, Human
gctgtggacgtactagccccagattcatgcctgcccctcatggcttctctctgcaacttgtggtcatgcgccttgttttaaaacccacaggaaggtgctgccgggagcctgcccttgttagggtgggactgtggccaagctacccttcagcaaggctgggtaggctccacctacccagcaaatgcgggcctctccgctcccatgtgtggataaggccaaggggtattggaaagggagtggtccagggtcctcaaccagcttgcagcttgccggccatattaccttgggcacaccatccccacagctcagggcctggcttcttcagtaaaataataggactggacttgatcatctcttaacagccatcagaaaataatctatgatccaatgaagacataagaagattccattgtatattgggagttagctaaccttaccgtcaacacccccatctgaggtgacactgtgatcctttatggttccagcatgatggtaatttacaaccccctccccccatgcacccggtaattctgtgtaagaatcattggcaagtgtctacaagttttaaaataaagaatttggagcaggatttctgtaggaa

SEQ ID NO: 27563 - DNA, 601 bp, Human
atgctgctgtggacgtactagccccagattcatgcctgcccctcatggcttctctctgcaacttgtggtcatgcgccttgttttaaaacccacaggaaggtgctgccgggagcctgcccttgttagggtgggactgtggccaagctacccttcagcaaggctgggtaggctccacctacccagcaaatgcgggcctctccgctcccatgtgtggataaggccaaggggtattggaaagggagtggtccagggtcctcaaccagcttgcagcttgccggccatattaccttgggcacaccatccccacagctcagggcctggcttcttcagtaaaataataggactggacttgatcatctcttaacagccatcagaaaataatctatgatccaatgaagacataagaagattccattgtatattgggagttagctaaccttaccgtcaacacccccatctgaggtgacactgtgatcctttatggttccagcatgatggtaatttacaaccccctccccccatgcacccggtaattctgtgtaagaatcattggcaagtgtctacaagttttaaaataaagaatttggagcaggatttctgt

SEQ ID NO: 27564 - DNA, 601 bp, Human
aagtgtcttgcctgtcccctcaaagatgctgctgtggacgtactagccccagattcatgcctgcccctcatggcttctctctgcaacttgtggtcatgcgccttgttttaaaacccacaggaaggtgctgccgggagcctgcccttgttagggtgggactgtggccaagctacccttcagcaaggctgggtaggctccacctacccagcaaatgcgggcctctccgctcccatgtgtggataaggccaaggggtattggaaagggagtggtccagggtcctcaaccagcttgcagcttgcyggccatattaccttgggcacaccatccccacagctcagggcctggcttcttcagtaaaataataggactggacttgatcatctcttaacagccatcagaaaataatctatgatccaatgaagacataagaagattccattgtatattgggagttagctaaccttaccgtcaacacccccatctgaggtgacactgtgatcctttatggttccagcatgatggtaatttacaaccccctccccccatgcacccggtaattctgtgtaagaatcattggcaagtgtctacaagttttaaaat

SEQ ID NO: 27565 - DNA, 601 bp, Human
aagaaggccgactgtcaagataggctttaataagttagaaagtagactgctataaagcagaaattgagtagaacttgtcagcaagtggcagagcctatgtcaaatgtaagtgtcttgcctgtcccctcaaagatgctgctgtggacgtactagccccagattcatgcctgcccctcatggcttctctctgcaacttgtggtcatgcgccttgttttaaaacccacaggaaggtgctgccgggagcctgcccttgttagggtgggactgtggccaagctacccttcagcaaggctgggtagkctccacctacccagcaaatgcgggcctctccgctcccatgtgtggataaggccaaggggtattggaaagggagtggtccagggtcctcaaccagcttgcagcttgccggccatattaccttgggcacaccatccccacagctcagggcctggcttcttcagtaaaataataggactggacttgatcatctcttaacagccatcagaaaataatctatgatccaatgaagacataagaagattccattgtatattgggagttagctaaccttaccgtcaacacccccatctgaggtgacac

SEQ ID NO: 27566 - DNA, 601 bp, Human
tgctttcctgcttcaaccgacttgttttgatgaatcaaccacctaccctcattgcttcagataagaaggccgactgtcaagataggctttaataagttagaaagtagactgctataaagcagaaattgagtagaacttgtcagcaagtggcagagcctatgtcaaatgtaagtgtcttgcctgtcccctcaaagatgctgctgtggacgtactagccccagattcatgcctgcccctcatggcttctctctgcaacttgtggtcatgcgccttgttttaaaacccacaggaaggtgctgcygggagcctgcccttgttagggtgggactgtggccaagctacccttcagcaaggctgggtaggctccacctacccagcaaatgcgggcctctccgctcccatgtgtggataaggccaaggggtattggaaagggagtggtccagggtcctcaaccagcttgcagcttgccggccatattaccttgggcacaccatccccacagctcagggcctggcttcttcagtaaaataataggactggacttgatcatctcttaacagccatcagaaaataatctatgatccaatgaagacataagaa

SEQ ID NO: 27567 - DNA, 601 bp, Human
tatatcaggaagtcgatgcacaatgacattcagtaaatcaatcctaaaggcctcagcccgccatcaaaatatggctgccagatatacactttcatattttaaggcaaaataaaatgcgtagagtatatgtctcccatgtaatgctttcctgcttcaaccgacttgttttgatgaatcaaccacctaccctcattgcttcagataagaaggccgactgtcaagataggctttaataagttagaaagtagactgctataaagcagaaattgagtagaacttgtcagcaagtggcagagcctaygtcaaatgtaagtgtcttgcctgtcccctcaaagatgctgctgtggacgtactagccccagattcatgcctgcccctcatggcttctctctgcaacttgtggtcatgcgccttgttttaaaacccacaggaaggtgctgccgggagcctgcccttgttagggtgggactgtggccaagctacccttcagcaaggctgggtaggctccacctacccagcaaatgcgggcctctccgctcccatgtgtggataaggccaaggggtattggaaagggagtggtccagggtcctcaaccagctt

SEQ ID NO: 27568 - DNA, 601 bp, Human
cttggatgctgttgagtgtctaaggttcccttccacaaaaagaaacgaactagaagttgttgatgatgcatttttgggtggtttatatcaggaagtcgatgcacaatgacattcagtaaatcaatcctaaaggcctcagcccgccatcaaaatatggctgccagatatacactttcatattttaaggcaaaataaaatgcgtagagtatatgtctcccatgtaatgctttcctgcttcaaccgacttgttttgatgaatcaaccacctaccctcattgcttcagataagaaggccgactgycaagataggctttaataagttagaaagtagactgctataaagcagaaattgagtagaacttgtcagcaagtggcagagcctatgtcaaatgtaagtgtcttgcctgtcccctcaaagatgctgctgtggacgtactagccccagattcatgcctgcccctcatggcttctctctgcaacttgtggtcatgcgccttgttttaaaacccacaggaaggtgctgccgggagcctgcccttgttagggtgggactgtggccaagctacccttcagcaaggctgggtaggctccacctacccag

SEQ ID NO: 27569 - DNA, 601 bp, Human
gctgttcttggatgctgttgagtgtctaaggttcccttccacaaaaagaaacgaactagaagttgttgatgatgcatttttgggtggtttatatcaggaagtcgatgcacaatgacattcagtaaatcaatcctaaaggcctcagcccgccatcaaaatatggctgccagatatacactttcatattttaaggcaaaataaaatgcgtagagtatatgtctcccatgtaatgctttcctgcttcaaccgacttgttttgatgaatcaaccacctaccctcattgcttcagataagaaggcygactgtcaagataggctttaataagttagaaagtagactgctataaagcagaaattgagtagaacttgtcagcaagtggcagagcctatgtcaaatgtaagtgtcttgcctgtcccctcaaagatgctgctgtggacgtactagccccagattcatgcctgcccctcatggcttctctctgcaacttgtggtcatgcgccttgttttaaaacccacaggaaggtgctgccgggagcctgcccttgttagggtgggactgtggccaagctacccttcagcaaggctgggtaggctccacct

SEQ ID NO: 27570 - DNA, 601 bp, Human
aggttgaatcctttgggaacactggattaaaaaagagaaatcactaaaagaatttctgaaaaattaggaatgagtgggactactgcacaatgattgggaagagctgcagaggacaaggaggaggctgttcttggatgctgttgagtgtctaaggttcccttccacaaaaagaaacgaactagaagttgttgatgatgcatttttgggtggtttatatcaggaagtcgatgcacaatgacattcagtaaatcaatcctaaaggcctcagcccgccatcaaaatatggctgccagatatacastttcatattttaaggcaaaataaaatgcgtagagtatatgtctcccatgtaatgctttcctgcttcaaccgacttgttttgatgaatcaaccacctaccctcattgcttcagataagaaggccgactgtcaagataggctttaataagttagaaagtagactgctataaagcagaaattgagtagaacttgtcagcaagtggcagagcctatgtcaaatgtaagtgtcttgcctgtcccctcaaagatgctgctgtggacgtactagccccagattcatgcctgcccctcatggcttctc

SEQ ID NO: 27571 - DNA, 601 bp, Human
cctgtctttataaagataaaaaaaaaaaaaagttaaaaaaaattaggttgaatcctttgggaacactggattaaaaaagagaaatcactaaaagaatttctgaaaaattaggaatgagtgggactactgcacaatgattgggaagagctgcagaggacaaggaggaggctgttcttggatgctgttgagtgtctaaggttcccttccacaaaaagaaacgaactagaagttgttgatgatgcatttttgggtggtttatatcaggaagtcgatgcacaatgacattcagtaaatcaatcckaaaggcctcagcccgccatcaaaatatggctgccagatatacactttcatattttaaggcaaaataaaatgcgtagagtatatgtctcccatgtaatgctttcctgcttcaaccgacttgttttgatgaatcaaccacctaccctcattgcttcagataagaaggccgactgtcaagataggctttaataagttagaaagtagactgctataaagcagaaattgagtagaacttgtcagcaagtggcagagcctatgtcaaatgtaagtgtcttgcctgtcccctcaaagatgctgctgt

SEQ ID NO: 27572 - DNA, 601 bp, Human
acgcaccagggtgcgaatccaacagtggattcttttcattgtgaaataagagaatggttctggcacggcgggaaagggagaccaagaaagcccgaggaggctgtgcttcacccttgttgggcccagctcatagaccagagcattccatgcaggggccagcagcccctgcccacctggttaccaagggctactgatggcggccactcccaagcctgtccatgctggttggactcgctattatgccagatgtaactaactgaaagtacatgatccaatggaagatgaccatgaagatgatatrtatttaatatatttttttctatgaaaattaggttgtcaagtccaggcacggtggctcatgcctgtaatcccagcaagtgggaggccaaggtgggcagatcacttgaggccaggagttcaagaccagcctagccaacgtggtgaaaccctgtctttataaagataaaaaaaaaaaaaagttaaaaaaaattaggttgaatcctttgggaacactggattaaaaaagagaaatcactaaaagaatttctgaaaaattaggaatgagtgggactactgcacaatgattgggaagagctgcaga

SEQ ID NO: 27573 - DNA, 601 bp, Human
tagtggctgtaaagagagtgatgaagattatttgggttcatcagcttgcctcccccacccacctcacttccttctccatctccccatcttcctttttcaatctggaaaactgtctgaccatgaggagaagccccctcagcagtgaggagggaccgtgctttggggctacagacccagagccctggggcaccgcgggacctgacagatgcttggcgcatccctgtctccttcagacagaaggctcagagaggctggtgactgccgggtcccacgccaggctggggtccgaggcaggcccccygtttcctgagcaaaggaatcctgtttcctgcaatcctagcagggtgcatgggatttccactaatacttcctgaagcctgtccccgtgtgtccttcctgcaacgcctgcctccttcttgcagaggttcccagtggctgttccctggctcccagtcacgcaccagggtgcgaatccaacagtggattcttttcattgtgaaataagagaatggttctggcacggcgggaaagggagaccaagaaagcccgaggaggctgtgcttcacccttgttgggcccagctcatagaccagagcattcc

SEQ ID NO: 27574 - DNA, 601 bp, Human
gggatgcaggggcttcactgacctgcttgccggatggggccgctgtctgtgcttcctccaaagccaaacttgtcacagaagggaggtgcccagtgggcctcgcagtggcagttcttcctgttgttgcacacctttcagggcagaggggagggacgtggggttagggcatatgctctgtgcatcaccacagcagaagcaaggggggccatggtcagagcccccccccaacactgacacagccagactcagcacacgccatggtgcgaataagcccaaagccggcactacacaccacacaggkgcgaccaaacctgaggctgtgaagatgcatcatctgcctattagtggctgtaaagagagtgatgaagattatttgggttcatcagcttgcctcccccacccacctcacttccttctccatctccccatcttcctttttcaatctggaaaactgtctgaccatgaggagaagccccctcagcagtgaggagggaccgtgctttggggctacagacccagagccctggggcaccgcgggacctgacagatgcttggcgcatccctgtctccttcagacagaaggctcagagaggctggtgac

SEQ ID NO: 27575 - DNA, 601 bp, Human
ggcgagcccacccgcccccaggtgctcagcctcctcccaccgggatgcaggggcttcactgacctgcttgccggatggggccgctgtctgtgcttcctccaaagccaaacttgtcacagaagggaggtgcccagtgggcctcgcagtggcagttcttcctgttgttgcacacctttcagggcagaggggagggacgtggggttagggcatatgctctgtgcatcaccacagcagaagcaaggggggccatggtcagagcccccccccaacactgacacagccagactcagcacacgccatrgtgcgaataagcccaaagccggcactacacaccacacaggggcgaccaaacctgaggctgtgaagatgcatcatctgcctattagtggctgtaaagagagtgatgaagattatttgggttcatcagcttgcctcccccacccacctcacttccttctccatctccccatcttcctttttcaatctggaaaactgtctgaccatgaggagaagccccctcagcagtgaggagggaccgtgctttggggctacagacccagagccctggggcaccgcgggacctgacagatgcttggcgcat

SEQ ID NO: 27576 - DNA, 601 bp, Human
gcattaaacttcacaccttgtcaccctaccacacagatgtcggcctttacaaagtactttgatacagtgatgacattcatacccattcagcagttcactatagaaatgaccttagttaagaaaagtgtcgcaggctaaggaactggcaaactcagccactcagtcaaagcagagagcaaggagcctcagagaagatcgggcagggatgagaggggcatctggaaactgcgggagaccctaggctgtgtagacccatgtggggtccccactgggtttcttgttggctctacctgcacccatrctgacagctggcgagcccacccgcccccaggtgctcagcctcctcccaccgggatgcaggggcttcactgacctgcttgccggatggggccgctgtctgtgcttcctccaaagccaaacttgtcacagaagggaggtgcccagtgggcctcgcagtggcagttcttcctgttgttgcacacctttcagggcagaggggagggacgtggggttagggcatatgctctgtgcatcaccacagcagaagcaaggggggccatggtcagagcccccccccaacactgacacagccagactcagc

SEQ ID NO: 27577 - DNA, 601 bp, Human
ggcattaaacttcacaccttgtcaccctaccacacagatgtcggcctttacaaagtactttgatacagtgatgacattcatacccattcagcagttcactatagaaatgaccttagttaagaaaagtgtcgcaggctaaggaactggcaaactcagccactcagtcaaagcagagagcaaggagcctcagagaagatcgggcagggatgagaggggcatctggaaactgcgggagaccctaggctgtgtagacccatgtggggtccccactgggtttcttgttggctctacctgcacccaygctgacagctggcgagcccacccgcccccaggtgctcagcctcctcccaccgggatgcaggggcttcactgacctgcttgccggatggggccgctgtctgtgcttcctccaaagccaaacttgtcacagaagggaggtgcccagtgggcctcgcagtggcagttcttcctgttgttgcacacctttcagggcagaggggagggacgtggggttagggcatatgctctgtgcatcaccacagcagaagcaaggggggccatggtcagagcccccccccaacactgacacagccagactcag

SEQ ID NO: 27578 - DNA, 601 bp, Human
caccttcttcagagttgtataaggaggggatgacatcgtgggcataaaatgcaccacacagcacctgcacacatcattccatatgcaaaagctgttgcaatgactcccactgctgccgtgactgtcacctttactaagaggtgggtgtctttccagtaagatttttaaaaggcattaaacttcacaccttgtcaccctaccacacagatgtcggcctttacaaagtactttgatacagtgatgacattcatacccattcagcagttcactatagaaatgaccttagttaagaaaagtgtcrcaggctaaggaactggcaaactcagccactcagtcaaagcagagagcaaggagcctcagagaagatcgggcagggatgagaggggcatctggaaactgcgggagaccctaggctgtgtagacccatgtggggtccccactgggtttcttgttggctctacctgcacccatgctgacagctggcgagcccacccgcccccaggtgctcagcctcctcccaccgggatgcaggggcttcactgacctgcttgccggatggggccgctgtctgtgcttcctccaaagccaaacttgtcacaga

SEQ ID NO: 27579 - DNA, 601 bp, Human
aaattacttaacttccctgagcctcaggtcctaggtatgtgagaaaagaatcataccaccttcttcagagttgtataaggaggggatgacatcgtgggcataaaatgcaccacacagcacctgcacacatcattccatatgcaaaagctgttgcaatgactcccactgctgccgtgactgtcacctttactaagaggtgggtgtctttccagtaagatttttaaaaggcattaaacttcacaccttgtcaccctaccacacagatgtcggcctttacaaagtactttgatacagtgatgamattcatacccattcagcagttcactatagaaatgaccttagttaagaaaagtgtcgcaggctaaggaactggcaaactcagccactcagtcaaagcagagagcaaggagcctcagagaagatcgggcagggatgagaggggcatctggaaactgcgggagaccctaggctgtgtagacccatgtggggtccccactgggtttcttgttggctctacctgcacccatgctgacagctggcgagcccacccgcccccaggtgctcagcctcctcccaccgggatgcaggggcttcactgacc

SEQ ID NO: 27580 - DNA, 601 bp, Human
aaaggtcatccgaggagaaatggccacgagttcaagcacagctgctactaagagcttcttgggggacaggcagacctgtgtgtgtgtaaatcttagcgagatcacattaggcaaattacttaacttccctgagcctcaggtcctaggtatgtgagaaaagaatcataccaccttcttcagagttgtataaggaggggatgacatcgtgggcataaaatgcaccacacagcacctgcacacatcattccatatgcaaaagctgttgcaatgactcccactgctgccgtgactgtcacctttmctaagaggtgggtgtctttccagtaagatttttaaaaggcattaaacttcacaccttgtcaccctaccacacagatgtcggcctttacaaagtactttgatacagtgatgacattcatacccattcagcagttcactatagaaatgaccttagttaagaaaagtgtcgcaggctaaggaactggcaaactcagccactcagtcaaagcagagagcaaggagcctcagagaagatcgggcagggatgagaggggcatctggaaactgcgggagaccctaggctgtgtagacccatgtgggg

SEQ ID NO: 27581 - DNA, 601 bp, Human
tcagtgaggcagtagacgcatgctcctgcgatcccacgggctcctggccctggccgcgctccctgttggactctgcagcttcctgccttgcttctttccctcgaaaagaggcatcatttagacttgcccctgaattgcccaataagaactcagagaaaacagcaccgcaccagtaaaccatttctaaaggtcatccgaggagaaatggccacgagttcaagcacagctgctactaagagcttcttgggggacaggcagacctgtgtgtgtgtaaatcttagcgagatcacattaggcaaawtacttaacttccctgagcctcaggtcctaggtatgtgagaaaagaatcataccaccttcttcagagttgtataaggaggggatgacatcgtgggcataaaatgcaccacacagcacctgcacacatcattccatatgcaaaagctgttgcaatgactcccactgctgccgtgactgtcacctttactaagaggtgggtgtctttccagtaagatttttaaaaggcattaaacttcacaccttgtcaccctaccacacagatgtcggcctttacaaagtactttgatacagtgatgacatt

SEQ ID NO: 27582 - DNA, 601 bp, Human
ggtaacctgctactctctcaggagcagcactgaagcatgtccatgttttagcagaagctcaaccaggaagtcgctgcccttccttgcactgtttctgcagacgtgcctggtaggctggacttcccctcctgagccccgagaactgtgttgtgtctgttgtcatggaaacgatggcaaagccacagagtcaatgctgccagtcacaggaggccttggggacgcgtgacctcctctgcagcagcactggtcacggtctccatgtcatgggagggctcagatgagtgtcagtgaggcagtagaygcatgctcctgcgatcccacgggctcctggccctggccgcgctccctgttggactctgcagcttcctgccttgcttctttccctcgaaaagaggcatcatttagacttgcccctgaattgcccaataagaactcagagaaaacagcaccgcaccagtaaaccatttctaaaggtcatccgaggagaaatggccacgagttcaagcacagctgctactaagagcttcttgggggacaggcagacctgtgtgtgtgtaaatcttagcgagatcacattaggcaaattacttaacttccctga

SEQ ID NO: 27583 - DNA, 601 bp, Human
ctgagtactgctggtcacgcatgtccacagcaaagagccagagttcaccgccctttctcctaccttcttctccagtttgtttcaatgccattcagtttgcttggatggagatggaatgggtggcagggtctctgataaattaaaaactaaaaccctgctattttcatataataaatgctaaaagccatatcagagcattaagttgcagccagagaccagtcatcagggctgccaaggctgaggtgtcactggggaaaggggacactgggcccaacccttgcttctcccccactgctgtggrggctcagtgaaaggccagacttttgagtcctcttcctccttgctgcagggctggggcctgccagagtggtaacctgctactctctcaggagcagcactgaagcatgtccatgttttagcagaagctcaaccaggaagtcgctgcccttccttgcactgtttctgcagacgtgcctggtaggctggacttcccctcctgagccccgagaactgtgttgtgtctgttgtcatggaaacgatggcaaagccacagagtcaatgctgccagtcacaggaggccttggggacgcgtgacctcctc

SEQ ID NO: 27584 - DNA, 601 bp, Human
agcagtgagccatgcttgctcatggcctgccttgattttatatatgtatgaacagggtggaggcagcggtatttcaaatgcactctattttatgcagtaatggccacgggggatggagttaggctcttacattgttttcactttttaacattcttacttgttaaatgaagggttggtgactctgtgggttccctggctttctgcaaaccctcaaacctgagtactgctggtcacgcatgtccacagcaaagagccagagttcaccgccctttctcctaccttcttctccagtttgtttcawtgccattcagtttgcttggatggagatggaatgggtggcagggtctctgataaattaaaaactaaaaccctgctattttcatataataaatgctaaaagccatatcagagcattaagttgcagccagagaccagtcatcagggctgccaaggctgaggtgtcactggggaaaggggacactgggcccaacccttgcttctcccccactgctgtggaggctcagtgaaaggccagacttttgagtcctcttcctccttgctgcagggctggggcctgccagagtggtaacctgctactctc

SEQ ID NO: 27585 - DNA, 601 bp, Human
tttccggctgctggtgatcgccgtgatgcagttacctgggctctcctcggccctgcctcccacctggaccctcagctggctgtggatcactgcagcagcagctcctactccagggaaagaatgtctttcacaccttcttggtttctggaccccatcccccactaacaaggcctatcagggatgtgtcttagcctaagcaagacagccaacagatgacagtcttgacttacttgttggtgttactggaaaagcattgcttctggtttcctgggcaaaatgtcactcttttcagacccttagyagtgatcacagggggctctagctagagttctggtgtctcataacaaagttaattaaagttaatttaaaaagtgaacagcaaaaatcttgaactataatttctagttccataaagtgaatccataaatcttcaatacatcaatctatgaaactgaacatttacagggcccccacactgaacctgctgaactccccagggttgctcaagccagaggcccgggcagtgactgactccatttccctcttccccaggaccagcacgagcaccgtgtcctgtgtcccctcctgttggcccagtccg

SEQ ID NO: 27586 - DNA, 601 bp, Human
tgaagcaacagaaatgaagagagtacacccgtgagtgatgtactaataaactgtcttacttcagatgccatgtttgaggttcaatctatgttaccatcattcatttctgacaactctagaacttgctaaacaggaatatatagtcgggtaggtggggtgatggtctggaccacgcaggttccctgaggcgtgacaacggcacagtggaccatggtagccacagaaggtagcagggagccatcactgaagcctcactggaatcacagccatccccaggctcaaatgtttccagtccccagcrcagatttgccattccaaagtgcttttctttactcattctgtagttgggttctgctttatctcttttcgtgtttttaaaaaatgaattgctttcttgctggacatctcaaagtagatagtgaaaaaagagaaagaaaactcatttaaatgaaacacccatgggttttgctttgttatgttggggacttaaaaacacagcctttgtgggggaaacccttttcctgggaggaagctattttctctatgaaaacatcttcttttctatgacctgctgccattttgtttaatacagttaagagcc

SEQ ID NO: 27587 - DNA, 601 bp, Human
ctaaaaaaatgaagtgagaagcagtttgctgtacattttctgagacaccatttctttttttttttttttttttttttttgagatggagtcttgctctctcgcccaggctggagtgcagtggagtgatcgcgactcactgcaagctccgcctcccgggttcacgccattctcatgcctcagcctcccgagtagatgggactacaggcacccaccaccgcgcccggctgatattttgtatttttagtagagacggggtttcaccgtggtctcgatctcctgacctcgtgatccgcccgcctcrgcctcccaaagtgctgggattacaggcttgagccaccgcacccagcctctgagccaccatttctagaacagatgacaagctaaacccagggtaccttagtttttcaatggtggtcttcttatttgtaaacagcagtcgtatcaaggtcttccttttgagataaaccacaaatccggcagcaagaagacacaggatggtcaccagaattcctatggttaaaccttggttatctgaaacaaaacacatggggctcacagaaggaggcagttacaatgaaatatgggaggtatcaagttgtga

SEQ ID NO: 27588 - DNA, 601 bp, Human
aaatttaaaacaagaaaccccccaaaaaagaaccaagtcccaggtttatgatccagaaaatctgacctttgctaaaaaaatgaagtgagaagcagtttgctgtacattttctgagacaccatttctttttttttttttttttttttttttgagatggagtcttgctctctcgcccaggctggagtgcagtggagtgatcgcgactcactgcaagctccgcctcccgggttcacgccattctcatgcctcagcctcccgagtagatgggactacaggcacccaccaccgcgcccggctgatwttttgtatttttagtagagacggggtttcaccgtggtctcgatctcctgacctcgtgatccgcccgcctcagcctcccaaagtgctgggattacaggcttgagccaccgcacccagcctctgagccaccatttctagaacagatgacaagctaaacccagggtaccttagtttttcaatggtggtcttcttatttgtaaacagcagtcgtatcaaggtcttccttttgagataaaccacaaatccggcagcaagaagacacaggatggtcaccagaattcctatggttaaaccttggtta

SEQ ID NO: 27589 - DNA, 601 bp, Human
gagaaaacacatcagtggaatttcctgacaccctgctagcttatgtaataagcagcacattgttgtttgaagggaagtaaaggaggcagctgatctggcagaaatttaaaacaagaaaccccccaaaaaagaaccaagtcccaggtttatgatccagaaaatctgacctttgctaaaaaaatgaagtgagaagcagtttgctgtacattttctgagacaccatttctttttttttttttttttttttttttgagatggagtcttgctctctcgcccaggctggagtgcagtggagtgatcrcgactcactgcaagctccgcctcccgggttcacgccattctcatgcctcagcctcccgagtagatgggactacaggcacccaccaccgcgcccggctgatattttgtatttttagtagagacggggtttcaccgtggtctcgatctcctgacctcgtgatccgcccgcctcagcctcccaaagtgctgggattacaggcttgagccaccgcacccagcctctgagccaccatttctagaacagatgacaagctaaacccagggtaccttagtttttcaatggtggtcttcttatttgtaa

SEQ ID NO: 27590 - DNA, 601 bp, Human
aaatattttaagagtaacagtgggctaaagcagctcacctaaagccaggtggtggcatttggaaaccatggtggggctggcattgggggctggtgtcaggagccagctcgggctgcagacccagtggggccccagaaatgtggctggtctgggtgactgaagggatcacagctcacactatgctgcaccatatcatgcagggggcactgagtgcgccaacaggatctaggtgggcttccatgggggcaccgtggggcctccctctggccccagatcacagagaccctccctcagagcctgytgacctagtgaggctgactcagcatttcacaggcagcgcctctaggatcccattcttattcagtctcgtattgaaaacctcatgtctgcatgtgtgccctgagcactcacatctactcaagactcaccttcggtgggtaggaatctggcggcttcctcatcaggccttttccaaggtggccgaggtgagcctgacagggttggaagccacggggtggccgggaagggcgcacacacctgcaacagaatcccatacctgctgaccaagcgtgtttccccttctcactgacttgacttttta

SEQ ID NO: 27591 - DNA, 601 bp, Human
tggggctgagggacattcaggccgttgaggggtctgctgatgtcaacattctgacactgcagcaatctcctgggattgtcctgtacagtcaaagtaaaaagccatgctatagcgggtttcaaaaatatcagtaactccttaaggaaaaagcagtgctaactcatctgttatagctgaaggccaaggtggggtaaaggaaagaaatcaaggatgtacacaagaggggaattatttttgtatttatttaaacttcaaaattcaaacagaagcatcacctgcctccaccccgccaaatctggartagaaggatcgatttttgtttagattttaaaaaactgtttaacaaataggtgcaaagcacttgaaaaagtaccaagtataaagaaagacacggaccgagatcttagggaagttacaaaagagatgtgaaaataagatacagcttaatgtgttcaaggctcaatgagaactgagaaaaccactggggaaaggagagttgcggcttcaggaagccagggctgaggttggggcttggagttggagacgttctcccatatggtaacccttgttcttagaacaggtgctgcagggacccttatac

SEQ ID NO: 27592 - DNA, 601 bp, Human
caaatacttaaaaaattataactagtaaattaaaatatatgacactcttattattatactccaggcaccaaactaactgctttatgtggattatctcatttaaccatctgagtagctgaattatctccattttacagaggcaccgagaagttaagcaacttatctaagctcacacattaacaagtagcagaatctggatttgaactacatcctatcatattagtactgaaagcatacctgggcctgcctaagtgcaggcttggctggcaggggtctggcagggacgctaggtgcacgtggrgcccggtggaggggaggaagcactcgctgagttgactggggctgagggacattcaggccgttgaggggtctgctgatgtcaacattctgacactgcagcaatctcctgggattgtcctgtacagtcaaagtaaaaagccatgctatagcgggtttcaaaaatatcagtaactccttaaggaaaaagcagtgctaactcatctgttatagctgaaggccaaggtggggtaaaggaaagaaatcaaggatgtacacaagaggggaattatttttgtatttatttaaacttcaaaattcaaac

SEQ ID NO: 27593 - DNA, 601 bp, Human
tccccggaagcatatgctgccatacttcctgtacaacctacagaactgtgagccaattgaacctcttttctttaggaattacccagtcttcgatatttctttatagcaatgtgagaacagactaacacaggtgtccagtcttcatactgtcatgctacttggtagctcctctttttctttgtgtcttacaggcctggctttctgaggtactgtagttttatgacatcttgatttgctctcttaggtccactgtggctgttgataggcactgtgtgccaatgcctgtgattataagctcacrtggactgcttccttcctggtaattgtcatgtctattttacggtattcccagttgtagggggagcaggaagcacggcctagaccactgcacccctgtcctggcttggattagtcgtggttggtcccacaagagtttgagagagaaagagatgggcatggcatgtcacacaaacctgaggggtgccaggcggagcccagtctcccattgtcctggggtcctggccaaggcatgagtgagccgagttgttctggccagaggatctgcaggcagaggcttctgaggggggtttggcttacaggt

SEQ ID NO: 27594 - DNA, 601 bp, Human
gtgataggagttctcattaaatctggttgtttaaaagtgtgtggcacctcccctttttctctttctcctgctccagccatgtgaagtgctggctcccccttccgccatgattgtaagtttcctgaggcctccccggaagcatatgctgccatacttcctgtacaacctacagaactgtgagccaattgaacctcttttctttaggaattacccagtcttcgatatttctttatagcaatgtgagaacagactaacacaggtgtccagtcttcatactgtcatgctacttggtagctcctctttttctttgtgtcttacaggcctggctttctgaggtactgtagttttatgacatcttgatttgctctcttaggtccactgtggctgttgataggcactgtgtgccaatgcctgtgattataagctcacatggactgcttccttcctggtaattgtcatgtctattttacggtattcccagttgtagggggagcaggaagcacggcctagaccactgcacccctgtcctggcttggattagtcgtggttggtcccacaagagtttgagagagaaagagatgggcatggcatgtcacacaaa

SEQ ID NO: 27595 - DNA, 601 bp, Human
cttgctccagccgtatgcctccaacccgactaatgtctcaggacctcaggaactgggcagattctgctgagagttgtggaggtgggcattgagatggtctgaatctgtgttcctgccccagtctcatatcaaattgtaatccccaaagttgaaggtggggccttgtgggaggtgactagatccttcatgaatggtttagcaccatctccttggttctaagtgataggagttctcattaaatctggttgtttaaaagtgtgtggcacctcccctttttctctttctcctgctccagccatgkgaagtgctggctcccccttccgccatgattgtaagtttcctgaggcctccccggaagcatatgctgccatacttcctgtacaacctacagaactgtgagccaattgaacctcttttctttaggaattacccagtcttcgatatttctttatagcaatgtgagaacagactaacacaggtgtccagtcttcatactgtcatgctacttggtagctcctctttttctttgtgtcttacaggcctggctttctgaggtactgtagttttatgacatcttgatttgctctcttaggtccactgt

SEQ ID NO: 27596 - DNA, 601 bp, Human
agcataagttgggattgaggtctctgccttcctagtggaccaagcaggataagctgtgaaaggtgattccttttgcccattgtccctgttttcccagtgtcctgctgccaggcagctgctttcccttactccccatatgtcccttgctccagccgtatgcctccaacccgactaatgtctcaggacctcaggaactgggcagattctgctgagagttgtggaggtgggcattgagatggtctgaatctgtgttcctgccccagtctcatatcaaattgtaatccccaaagttgaaggtggrgccttgtgggaggtgactagatccttcatgaatggtttagcaccatctccttggttctaagtgataggagttctcattaaatctggttgtttaaaagtgtgtggcacctcccctttttctctttctcctgctccagccatgtgaagtgctggctcccccttccgccatgattgtaagtttcctgaggcctccccggaagcatatgctgccatacttcctgtacaacctacagaactgtgagccaattgaacctcttttctttaggaattacccagtcttcgatatttctttatagcaatg

SEQ ID NO: 27597 - DNA, 601 bp, Human
gaccaaaatcagcaactgaccagaggtaagattggccacagcttgagggcatttaagaaaaagggcttcccctcattgttttcatgtaaagtagtgtttcttcctcaaatagaacaagaaaaataacttcaagatcaacatgcaaaccacaatgaaataattaggatgctatgcaatttttctctatttatgaagttgggaattaaacaattgtcctgaccctttgaccgcctttatctctgacatttattaagcagctctttctttcacgggccaaacattcttcccaagagctgtaatraaatcactccagtgtgtcttctccttcagagatacaggattactgaacccagggcctggccaacacagtacctttggttcttttgagctcacaaagcaggcttcctgccaagagggcatgtgtgtcagaagagtactttggctgtgggtttaactcatctgtgtgctggtaaatgttgaacagcccatggggttgggggcaggaaagcctgatttgcagtatttgccaatgtccatggtgtaaatactcctcctgtggctggtttcaagctaccacctgacatcactaaacatggaagag

SEQ ID NO: 27598 - DNA, 601 bp, Human
ttatagtaatgatgttttaaacattaaaaaaaatcctaaaagttggtacaaaaaactccaactggagctgaaagatagtgcaaacttctgtcttcactgttgaaaaaaggtgtcggcttctcacttaatataggcggtgtgggtggatctgggcacttggtgtggatattgtggagcaggtctgaatgaagagaggagaaaaaaaaatgatcagagaccttgagaagtgattctgaggatagagaggtctggggttggagatgtattctgatagtctgaagggttttctgtgtcagatacyactgcccctcataacgggggtgggaaacctgtctccaaagccgcacttcccacccacaagtcaactctagaccagcactgtcccacagaaaaaatgtgagctacacaagaaattttaaattttctagtagccacatgaaaaaagtaaagagaaaggtgcaattaattttagtaatacatttaactcagtatacctagaggattatttcaacaggtcatcatcaatagaaaaaaatggatagttgacattttagggtactaagtcttcaaaatacagtaagacttttaccaggcgcaacat

SEQ ID NO: 27599 - DNA, 601 bp, Human
gccttgagtgacactacagaccccttccaaacatgctcacggctggtcagctcagggtcaagttctggcttgtctagtgttccagtctctatcctggtgtggctacaccttaagattcctgtctgcaacccaggttctcaccaaagcttcctggccagaagccagatttctcccagctgtccctgggagcctgcctgccagttgtcaaggggcacagggcctccctgaaagccaaacacagcctggacctgaagccccttggccctggcctgagatggggaatccagaaaatcaactgagrttctacttgggatctcttgagctgcatctggtaccataagcacagctgggggtagttgggggactgctttccaataaggccttgatcagaaagcaaacacatcctgtccagaatcccatcaagcaggatatttcaagttcactaaaatactaaaagcacaacaagccttcctgccatggaaaactcagtgatggtaaaaatgcctactacagcgcactgcactgtaatcaacattctgcataaattaataatttacaagtacctgagcaagtagacagagcaccatagcacagcacagca

SEQ ID NO: 27600 - DNA, 601 bp, Human
cgagaaaaagaagtgcttggcatttctatcaagcaccgccttgagtgacactacagaccccttccaaacatgctcacggctggtcagctcagggtcaagttctggcttgtctagtgttccagtctctatcctggtgtggctacaccttaagattcctgtctgcaacccaggttctcaccaaagcttcctggccagaagccagatttctcccagctgtccctgggagcctgcctgccagttgtcaaggggcacagggcctccctgaaagccaaacacagcctggacctgaagccccttggcyctggcctgagatggggaatccagaaaatcaactgaggttctacttgggatctcttgagctgcatctggtaccataagcacagctgggggtagttgggggactgctttccaataaggccttgatcagaaagcaaacacatcctgtccagaatcccatcaagcaggatatttcaagttcactaaaatactaaaagcacaacaagccttcctgccatggaaaactcagtgatggtaaaaatgcctactacagcgcactgcactgtaatcaacattctgcataaattaataatttacaagtacc

SEQ ID NO: 27601 - DNA, 601 bp, Human
gcagtgcctgggcagtaggtttcttacagaaacaccacctttcccaagctaaataacctactggtggcagtgctctagaaaggacagcgagaaaaagaagtgcttggcatttctatcaagcaccgccttgagtgacactacagaccccttccaaacatgctcacggctggtcagctcagggtcaagttctggcttgtctagtgttccagtctctatcctggtgtggctacaccttaagattcctgtctgcaacccaggttctcaccaaagcttcctggccagaagccagatttctcccagstgtccctgggagcctgcctgccagttgtcaaggggcacagggcctccctgaaagccaaacacagcctggacctgaagccccttggccctggcctgagatggggaatccagaaaatcaactgaggttctacttgggatctcttgagctgcatctggtaccataagcacagctgggggtagttgggggactgctttccaataaggccttgatcagaaagcaaacacatcctgtccagaatcccatcaagcaggatatttcaagttcactaaaatactaaaagcacaacaagccttcctgcca

SEQ ID NO: 27602 - DNA, 601 bp, Human
ttttgcctccttatttttaatgtgtattgtctactacataatacatttttagttcaagtgtttaaaatgttttagagttaaggtctaatagcctatttttctgtattttctaaattttctgtaatgtgcgttatttttataatggaatattagagcttatgtgaaaagtaagtgaaataaaatgcgtagagctacatatggtagaaacatgactatttagcattgtgtggtatattccctgattgagccaaccagcgtgtttgtttcttaacttccagaacctttactaggtagtatggtrgagcatctaagactgtggactctggaatcaccccgctgactgattcatgttatatctaaaaagttctgccagttattagttacgtaatgataagcaaattcttcatcccctgtgcctttttcttcatgttaaagtagagatgataataatacctacttcataggacagtagggaagattgagagagtacatatatgctcatctcaagacctgttacccaattgctcaataaatgttacttttcccattattagaactgtttcctcagctcttggtgaccattagtccccaagtcagtctg

SEQ ID NO: 27603 - DNA, 601 bp, Human
ctatttttctgtattttctaaattttctgtaatgtgcgttatttttataatggaatattagagcttatgtgaaaagtaagtgaaataaaatgcgtagagctacatatggtagaaacatgactatttagcattgtgtggtatattccctgattgagccaaccagcgtgtttgtttcttaacttccagaacctttactaggtagtatggtggagcatctaagactgtggactctggaatcaccccgctgactgattcatgttatatctaaaaagttctgccagttattagttacgtaatgatwagcaaattcttcatcccctgtgcctttttcttcatgttaaagtagagatgataataatacctacttcataggacagtagggaagattgagagagtacatatatgctcatctcaagacctgttacccaattgctcaataaatgttacttttcccattattagaactgtttcctcagctcttggtgaccattagtccccaagtcagtctgtatgtttgcctaataatttgtattggttggttgcaactggataataagtatccatttgtgcctctggagttcaatttgtacagatgagctgc

SEQ ID NO: 27604 - DNA, 601 bp, Human
tttctaaattttctgtaatgtgcgttatttttataatggaatattagagcttatgtgaaaagtaagtgaaataaaatgcgtagagctacatatggtagaaacatgactatttagcattgtgtggtatattccctgattgagccaaccagcgtgtttgtttcttaacttccagaacctttactaggtagtatggtggagcatctaagactgtggactctggaatcaccccgctgactgattcatgttatatctaaaaagttctgccagttattagttacgtaatgataagcaaattcttcawcccctgtgcctttttcttcatgttaaagtagagatgataataatacctacttcataggacagtagggaagattgagagagtacatatatgctcatctcaagacctgttacccaattgctcaataaatgttacttttcccattattagaactgtttcctcagctcttggtgaccattagtccccaagtcagtctgtatgtttgcctaataatttgtattggttggttgcaactggataataagtatccatttgtgcctctggagttcaatttgtacagatgagctgcatgtctattagcag

SEQ ID NO: 27605 - DNA, 601 bp, Human
cccaagtcagtctgtatgtttgcctaataatttgtattggttggttgcaactggataataagtatccatttgtgcctctggagttcaatttgtacagatgagctgcatgtctattagcagtcccttgtggatgtgtttttatttctgagccaccagcttacctctgctttgagcatagatgtaacaccttcctttgtatattctattcaaagactacacttcagaatgctatactctaactaggtgcaaatctagagacaattttttatttgtttttctttctagaaaatcctcttttccttttttttttttttttagccacttatgttgtatttttaacttcgaatatgtcaaactcctttacttgtcatctctcatattagatactagatataacattccaggttgaaacatgttgataatacagttaacttccttgtaggaatatgaatcaaagcctaaaatttctgtacatttgtaactaggaaaatataaatattcataccaaaaatagttttcttgactaatttatgcagcatattgaaacagattgcttgaattaccatgtaataaacccagctacattttattatgtgtgctt

SEQ ID NO: 27606 - DNA, 601 bp, Human
ccccaattctggattgtttggctgtggaaatcttccagaattgatagcatttttccacttagctgcttagtaatacatttcaaattgctaaccatgtcagtgggtcagcagtgccaattcatctggcccctatgctctgaaaaaggttgggagtgggagtgcatatagttgatagtggctttggtggcacagctattttcttgccaaagaaaagactgtatattttaggcctttgtggctttattattattccacatgctttttggataatatttgggagtctcttcacaacaagatgttrcaattttatcagggacaaactagtaaatctttttttcttctgttttttgtttttgtttttgtttttgtttgagatggagttttgctcttgttgcccaggctggacacgatcttggctcatcacaacctccgcctcctgggttgaaatgattttcctgcctcagcctcccaagtagctgagattacaggcatgtgccaccacactcagctaattttgtatttttagtagagacgggtttctccaatttggtcaggctggttttgaactcctgactcaagtaatctgcccaccttggcctcc

SEQ ID NO: 27607 - DNA, 601 bp, Human
catttcaaattgctaaccatgtcagtgggtcagcagtgccaattcatctggcccctatgctctgaaaaaggttgggagtgggagtgcatatagttgatagtggctttggtggcacagctattttcttgccaaagaaaagactgtatattttaggcctttgtggctttattattattccacatgctttttggataatatttgggagtctcttcacaacaagatgttgcaattttatcagggacaaactagtaaatctttttttcttctgttttttgtttttgtttttgtttttgtttgagayggagttttgctcttgttgcccaggctggacacgatcttggctcatcacaacctccgcctcctgggttgaaatgattttcctgcctcagcctcccaagtagctgagattacaggcatgtgccaccacactcagctaattttgtatttttagtagagacgggtttctccaatttggtcaggctggttttgaactcctgactcaagtaatctgcccaccttggcctcccaaagtgctaggattataggcgtgaaccaccatgccctgtcaaaactagtaaattttgatacaaaaatacttcag

SEQ ID NO: 27608 - DNA, 601 bp, Human
aaactagtaaatctttttttcttctgttttttgtttttgtttttgtttttgtttgagatggagttttgctcttgttgcccaggctggacacgatcttggctcatcacaacctccgcctcctgggttgaaatgattttcctgcctcagcctcccaagtagctgagattacaggcatgtgccaccacactcagctaattttgtatttttagtagagacgggtttctccaatttggtcaggctggttttgaactcctgactcaagtaatctgcccaccttggcctcccaaagtgctaggattayaggcgtgaaccaccatgccctgtcaaaactagtaaattttgatacaaaaatacttcagttattatacatttaaagatcagttcatcagcttattcttaaagttagtatttagcaaattgaacagcagctgttttaaatgataaattaataaagtagaatcttaggatgacatatttggagggtttattagaggttctctaatttggcttccagtgtatttggggttgctatataatttggcacaccaattaggatatttgtgaggatgaaaagggtataagatgtcaaaattatttacat

SEQ ID NO: 27609 - DNA, 601 bp, Human
tgctcgtgggtaggaagaatcaatattgtgaaaatggccatactgcccaaggtaatttatagattcaatgccatccccatcaagctaccaatgcctttcttcacagaattggaaaaaactactttaaagttcatatggaaccaaaaaagagcctgcatcgccaagtcaatcctaagccaaaagaacaaagctggaggcatcatgctacgtgacttcaaagtatactacaaggctacagtaaccaaaacagcatgctactgctatcaactctaattttttcatattgaaatagttatgacasattgtgaggaaagatagtttatattccccatgaatcaaaagctaaattgttacatccactttataccttttaaacttgtttttttaaaatacagacaccatcttgaggtgctgcatgataattttgatcagttggatataatttacagatttgataaattattgatttggtagcgattatattggataccatctctgatgttagactacatttaaatcctgcctctgctacatacttgtcttgtgatcttgagcaagttacataacctcttcgtgccttaattttctcatctataaatgg

SEQ ID NO: 27610 - DNA, 601 bp, Human
tgtcacagaccttactacccattatcgtatatgttgatgtttgccctttagtgctgccagccacatgctaagcctttaagcatgaatttctaacccataccaaggggtcagtcccctgtagtctaatcttgatccatgttgaatgtattgttttaaaaaatccataatttgaaggaaaacaccacagcaataacaacagcaataataatgcctttaacaatgaaaatgaaaacaagttactagctatcagacactattctaagggccttacatataactcatttattcctcataacaacawtgtgaagtagctactgttatttgcatcttacagctcagaaaacaagcatggtgagataaggaaactttactaaggtcacataactagtaagtggtggagccagcgttgaaactcaggaagtctgtacacaactgggagggaaggctaatatttgaaatgatagactcaacattcaatatttcagtatcgatgagctctaagttgatagagctatgtgtaaaaaccctgcatttaatattaagaaatcattggcagaagagtaagagagggctttggtcaagtaagctgagtgcataagaa

SEQ ID NO: 27611 - DNA, 601 bp, Human
tgatagtagaagaaggagaagattggaaacatgttgaaattcccaaagacgtaggtcctccaccaccagtttcaaaaccttcagagcctcgcccctcaccagaaccacagatttccatccctgtcaagaaggaacacatacccgggacactacggtgagtatatatttattcaaaggatgatgtaaaaaaaaaaagttatggcagttcttatggaattgtaatcattatcatattcgcacatcgttgtacatcacgtaggaagttgctgttctcagcacactcagaccttagagtgtgtgtttttttttttaaccatcattgttcattcagtaaataaatagttactgaatatctgctatgttccaggtactctaaaagccctgcttgcacaatggaaaaccaaacagtatgtgtccatgttgaggttgaattaggttttagaagtctaaaatggtattcaatataccaaacttgatactctgttcccatttatggagttctaattactgttacaggaattccaagctcaaatgtctatctgatataaaatagaattcatgttttaacatgcattcgttttcaaactagtctgcattatga

SEQ ID NO: 27612 - DNA, 601 bp, Human
aagacgtaggtcctccaccaccagtttcaaaaccttcagagcctcgcccctcaccagaaccacagatttccatccctgtcaagaaggaacacatacccgggacactacggtgagtatatatttattcaaaggatgatgtaaaaaaaaaaagttatggcagttcttatggaattgtaatcattatcatattcgcacatcgttgtacatcacgtaggaagttgctgttctcagcacactcagaccttagagtgtgtgtttttttttttaaccatcattgttcattcagtaaataaatagttaytgaatatctgctatgttccaggtactctaaaagccctgcttgcacaatggaaaaccaaacagtatgtgtccatgttgaggttgaattaggttttagaagtctaaaatggtattcaatataccaaacttgatactctgttcccatttatggagttctaattactgttacaggaattccaagctcaaatgtctatctgatataaaatagaattcatgttttaacatgcattcgttttcaaactagtctgcattatgactttccggcacagactagagctcaattttgtctgttctgtaacaa

SEQ ID NO: 27613 - DNA, 601 bp, Human
tcatattcgcacatcgttgtacatcacgtaggaagttgctgttctcagcacactcagaccttagagtgtgtgtttttttttttaaccatcattgttcattcagtaaataaatagttactgaatatctgctatgttccaggtactctaaaagccctgcttgcacaatggaaaaccaaacagtatgtgtccatgttgaggttgaattaggttttagaagtctaaaatggtattcaatataccaaacttgatactctgttcccatttatggagttctaattactgttacaggaattccaagctsaaatgtctatctgatataaaatagaattcatgttttaacatgcattcgttttcaaactagtctgcattatgactttccggcacagactagagctcaattttgtctgttctgtaacaaaacagataacttaatacacatcatttcactttagttttacattgctttaatagaagaactctgtaaattctaacatttcatttatttagtattctatataattatacaacattactttttctttacgagaaaaagatcttcataaagtagacctcttcattcttaaacattttttcctttagt

SEQ ID NO: 27614 - DNA, 601 bp, Human
gtcattttagctttattataagatttttttttaattatttgcgaaactgttgacatttagatctatttgaatcaaatgtaagtgttaattggttctattaaccttcatatttttttcttaggttccgtttaagtccagctgcccgcaatattctggaaaaacactcactggatgctagccagggcacagccactggccctcgggggatattcactaaagagtatgtgtttgctttttgtaataaccagttccattatttattatgatcatgtttttttgaaagaaaataaaaagagcttaktcagtcttaagatttaaaaggaggtacactgttcttcttttgtacttttaattgcttttatcattgtaaattgtattctatgcaagagttgttttctgaataattatagcattactgaagaacagctctaatttggtaactaagcaagatccttagaagtggtaataaatgcagaaaattagagcgtagaacagtgaaactttatacagtattaaatatgtgaaatcatgcaataacatttacatttctaaaacaaggaaatatatttttaaaaaattattttcattatccctttgaatt

SEQ ID NO: 27615 - DNA, 601 bp, Human
cattttagctttattataagatttttttttaattatttgcgaaactgttgacatttagatctatttgaatcaaatgtaagtgttaattggttctattaaccttcatatttttttcttaggttccgtttaagtccagctgcccgcaatattctggaaaaacactcactggatgctagccagggcacagccactggccctcgggggatattcactaaagagtatgtgtttgctttttgtaataaccagttccattatttattatgatcatgtttttttgaaagaaaataaaaagagcttattmagtcttaagatttaaaaggaggtacactgttcttcttttgtacttttaattgcttttatcattgtaaattgtattctatgcaagagttgttttctgaataattatagcattactgaagaacagctctaatttggtaactaagcaagatccttagaagtggtaataaatgcagaaaattagagcgtagaacagtgaaactttatacagtattaaatatgtgaaatcatgcaataacatttacatttctaaaacaaggaaatatatttttaaaaaattattttcattatccctttgaatttt

SEQ ID NO: 27616 - DNA, 601 bp, Human
attggttctattaaccttcatatttttttcttaggttccgtttaagtccagctgcccgcaatattctggaaaaacactcactggatgctagccagggcacagccactggccctcgggggatattcactaaagagtatgtgtttgctttttgtaataaccagttccattatttattatgatcatgtttttttgaaagaaaataaaaagagcttattcagtcttaagatttaaaaggaggtacactgttcttcttttgtacttttaattgcttttatcattgtaaattgtattctatgcaagrgttgttttctgaataattatagcattactgaagaacagctctaatttggtaactaagcaagatccttagaagtggtaataaatgcagaaaattagagcgtagaacagtgaaactttatacagtattaaatatgtgaaatcatgcaataacatttacatttctaaaacaaggaaatatatttttaaaaaattattttcattatccctttgaattttattcacttgtgctgttataaagcaatttccatatacagtttggtctctttttagattttcttttctatttcactgatccatctgt

SEQ ID NO: 27617 - DNA, 601 bp, Human
tgttagtctctaccagtctgtgccttagtagcactctctgtaaaaatgggagaaagcaactatttttataacaaagtagatttgccttgctcataattctgaggattaggaataagagtctgtatttaattcattaatctttgaggatttggtgaaatgtaaaataatgattgctgcaccttagggggatcagttctgcaaatttgtgtaagataaactggagcagaaaaagatgagataaggagataaattaataggctcctaaagtaatccatgtaagaggtaatgaatacttgaatgyggttagaagaactaaaagggagatccctgatacagacaacattgtaaggataaagtccagaagcctttgcagattaaatgtggagtgtaggccagagtagcaacaagtaagggaatgaatttggatctggtctaggtgatgatagtttggtctccataaatagaaataatggatttgggaagcatttgttttggtggagttagtaatgtttgaagcttattgtcaggacttagaagccatgtaggtattgggatcaatgagatgaagatgtatctcaggagatagttggggattagagag

SEQ ID NO: 27618 - DNA, 601 bp, Human
gtgaggacatgctccataccatgtccactaaaagtctgggtagaaaaatcagttccaaatgctgaaggaaatgcctccagcccactgtatttgtgaagaaaatcttgggtatcagggctgctattttaattttgccttaaaacaagcattgctcagaatacatgttgtaccaaagaatatagacttgactttgcttgtacatgtgactgttttaagaaagcagtgtcgaggccacaattagaagcagaacacatttagtttctttgcctgcagccccaatgtctttggtacatctgtgtcytaaatcatagttgtagtaatgtttgtattcatcacacagcatcaaaaattaggtaagtatgacaggcaagtgcctagtgtgttttagtggtattttcaaaatgaattcatgtcacacccaaatgaattgctctctcagggaacccagtagagaaggttgtacctgagttaacttccagagcatcctctgcctatctgcctatttctgccagtggccagaatgaatttgtgtggtatatttttctcctaatttttatagcttttaatgtctacctaatgctccaagtttagtctgattatt

SEQ ID NO: 27619 - DNA, 601 bp, Human
atttggagcctcatatatctataaaatgccaccaattttgtcacataataggacctaataatgggagtgacatccatcatattcacaggccagatacagtcaagagggatgatatggggcatgtacaccaggggcaggaatattggggccatctcagaattcttcctaccatgttgccataagtaaaggggtcttctcaaatatgctcaacaggtgctagcttttatctttcatcaaatttttggaaaaataataccaaaatattaactgagaaataatttttccttagattttgtgtcaycctgaagttctttttagattatataaaacaattttttttcttaaattggaaaaaatactttccaaaatacttattggatattaaaatgttccaaaaattattttaagaaaatatattgcctaataccactgtaacttagcatagtgagttgagggcttagcatatttagtaatctaattatatcctcttacaagacaaaaatacctttgttttacagagtaatacaaaggcaagtctgtaactagttatttttcattctaaaagatatcataggttagatttgttatattagattgtact

SEQ ID NO: 27620 - DNA, 601 bp, Human
tagtgagctatgtgcactccagcctgggtaatagaggaagaccctatctcaaaaaaaaaaaaaaaaaagttattcaaattaaggaggtaaaccttactttcaaattcttatggtatgtagagagcatttattctacttgaccaagtactttgctaacataaaatgtttaatttcttaatgatatttgtaaaaatgaaatcagccgcactttcatttgctttgtattatcttgaagtgattgtaatgaaatcccaaaatagagtgaaggacaagaaaggaattagatataatttaaaatctrtcatgcttttttgagagatccaaggaacagaatggaaaaactacagtgaagttataggaatattttattatctcattcatactttctattatgaatctgtaagaaataagatactcatgttatttttaaaaattacaaatccaaatagaaataattgaattgcctgtatagaaggtccctaatcttctaatgtcccttgtgatttctttgatccatgagttgtttataagtgtgaatttaatttcaaaatattggaagacccttcagttacctttcatgatttctagtttaactccactg

SEQ ID NO: 27621 - DNA, 601 bp, Human
atgttccatgtgtacttgaaaagatggttcgacttataattttttgacttcacgatggtgtaaaagtgatacacattcagtagaaagcagtgcagtatttccttgcaatgctgggcagtagcggctagccacagctccaagttagccatgtgatcatcagggcaaacaaccactgctctgcagtgtactgtgtagccaggtgattttgcccaactataggctaatgtaaatgttttgagcacatttatggtaggctatgctaaggcttacctgtgatgttcagtatgttaggtgtattaawtgcactttgacttatgatattttaaacttacgatgggttcatcagagtgtcacttcatcataagtcaaagggcaactatatattaatagttggtttgttgatttattggctgttttatttcaggtggttttttttcttttttttttttttcccgaaacaatcttgctctgtcgcccaggctggagtgcagtggcgcgatcttggctcagtgcaacctctgtctccccggttcaagtgattctgctgcctcagcctcctgagtagctgggattacaggcacgcgccaccacactcagctaa

SEQ ID NO: 27622 - DNA, 601 bp, Human
aggcaattactgagttcaattctctgttacatactgagctttaaaaatacaggttgagcaacccaaaaccaaaacttcaaagtgcttcaagatgtgaaactttttgagtgccaacatgaagctcaaaggaagtcctcattggagcttttcagattttggatttttggactagagatgccaaaacagtaaatgtaatattacaaaatctgaataaattttgaaatctgaaacacttctggttccaagtattttggataagggatactgaaatctgaagtactataatttggttggttagttwttttaaaagcaaaagtgggcttaatgttttggtgtgctttagcatttacataggtcaatttttttgtaagaacacatgaatgagttgtgtagaccaaatggttattttttgttttgaatattttttggtatggtatttaaacaaagcagtcaatatttcattaagtttaaaatccaaaacttttaaggatgttttagattataaatatcttatatattcttctttatacaaattttgattttatatttcttgttcagaatgcatttacagattattaaatttgtaatatttcttccaaaa

SEQ ID NO: 27623 - DNA, 601 bp, Human
gtgaaaagttggatcatttatttgagacctttattttttaatataagcatatagtactcttgaattatctttaagcactgctttagctgtatcccacaaatgttgattttttttttttttcttcttgagacagggtcttgctgtgtcacccaggctggagtgcagtggtgcgatctcggttcacttcaaccaccgcctcctgggttcaaatgattctcacgcctcagtgccctgagtagctaggattacaggcacaaaccaccatgcctggctaattgtttgtatttttactagagacggkgttttagcatgttggccacgctggtctcaaactcctggcctcaagtgatccacccacctaggcctcccaaagtgctgaaattacaagtgtgagccaccacgcctggcattatttttccttttattcaattaaaaatgttttctcatttatttattttgtgatttctttgatcgatgagttatttgtaagtgtgcacttaatttcaaaatatttgagaactattcatttctcttttatgatttctagcttaactacattgtgtttagagaacacactttatatgatttcagttttcttaaa

SEQ ID NO: 27624 - DNA, 601 bp, Human
aagtgtgagccaccacgcctggcattatttttccttttattcaattaaaaatgttttctcatttatttattttgtgatttctttgatcgatgagttatttgtaagtgtgcacttaatttcaaaatatttgagaactattcatttctcttttatgatttctagcttaactacattgtgtttagagaacacactttatatgatttcagttttcttaaatttgttgatatttattttatgtttgtagtatggtctgtcttggtatgtgttcttgaaaagaatttttttatttttgcaaaggaaygttctataaatgtcaggccaagctggttaatagtgttgtttatgtcttttgagagcagtgttgatattcctcattataattgtttatttgtggtttctcctttcagctctgtcggtttttgcttcatgtatcctgaagatctattattggccacatacacagttaggaattttgttttcttgaacagaccagttattatgtcatgtccttatctattccttgtaatattccttatcctcaagccttctttatcacatctgtagccactgcagatttctttgactcgtgtttctatagtat

SEQ ID NO: 27625 - DNA, 601 bp, Human
gtttctatagtatatctttttgcatctttttactttttaaatgtaaatatgtttatttaagtaggtttcttgaaggcagcgtgtagttggttcttgctattttatccaattctttagtctcttaagatgtttagaccgctcacatttaatgggatagttggatttaaatctaccattttgttctttctttgcattctctttgtcccacctcttttattcttctttccttatctttttggttacttattttgttatcattctattgtatttattcattttatcttcttttttctcttcttayctgctttgcaatggttttcttagggtttacaatgtaattctttaatttatcacggcctggcttcaaattgtattacaccccactccatgtttaatataagaacctcataactatatacttgcacttcctccctctcatattttgtactgctgttgtcatgttttacttctatatatgatgtaagccccagaatacatgtttaatgttttttgctttagcaaataaactcttttggagttttaaaatgagggaaaaaatgtcttttatatttatctgtactttttttcatttctttgtata

SEQ ID NO: 27626 - DNA, 601 bp, Human
aaatgagaatgtttgatattaccttacaaactgttttctactcagtaaatgtaacagcatctcctttcaatatgtttggaaaatctccattataaagagttaaaaataaaggaattcaaagagaaacctactttacacatgttagatttgagatgcttgtaagcgatgcaagtagaaatttcatgtgagaagttggatatacaagtctgaagcctcagtatctcagaattagaggtagaatttggaagagtcatcattatataaatggtatcaaaaccttggaattggaactggaacttcyagcctggggagatgccaacattgagaggaaaggaataaaaatgagtgagtgggcagaaagtggaagaaaaccaggagagtatagtgacataggagccagtaaaagaatatatttcattcaactcaagaatgttcctaaatgtgggagtatgctgaatacagaattttaagtgaggactgtggacttaggtggtaggtttgggggtcattagctggcagatggttttagaagtcttcactgtgaatacctgtgggtaagtagataaagtgaagagaaagctgagagagccatgaaaggtaa

SEQ ID NO: 27627 - DNA, 601 bp, Human
tgttagatttgagatgcttgtaagcgatgcaagtagaaatttcatgtgagaagttggatatacaagtctgaagcctcagtatctcagaattagaggtagaatttggaagagtcatcattatataaatggtatcaaaaccttggaattggaactggaacttctagcctggggagatgccaacattgagaggaaaggaataaaaatgagtgagtgggcagaaagtggaagaaaaccaggagagtatagtgacataggagccagtaaaagaatatatttcattcaactcaagaatgttcctaawtgtgggagtatgctgaatacagaattttaagtgaggactgtggacttaggtggtaggtttgggggtcattagctggcagatggttttagaagtcttcactgtgaatacctgtgggtaagtagataaagtgaagagaaagctgagagagccatgaaaggtaagcagagtaagttcatgaactgttacatttgaatttgtacaaaccaaatctttctatgtggttatcattaaaagcttgtaagcactgtaagtccatttatatttctattcctaaaggggttttaagcaaaaatgtttata

SEQ ID NO: 27628 - DNA, 601 bp, Human
aggtaagcagagtaagttcatgaactgttacatttgaatttgtacaaaccaaatctttctatgtggttatcattaaaagcttgtaagcactgtaagtccatttatatttctattcctaaaggggttttaagcaaaaatgtttatatatttctggaattctgaattagaggagctttgatactttgcagctgacagttatcgtgacagtttgacagtatttaggtttatggtaattcatctaatccctttctgtagtctccaggatgcctttggaatgagctgttattcacctaaaattccrtgatactttagtaataggataggttttttgccacataccactgactagatctagatcttagagtctttttctataagctcttgcaagaaagaatcaagtgttgtttacattttctaacactgttatacccagtggcaaatgcaaagacataaacaaatactttagttatgatcagctcgtaggaagtgggaggaccccagctttatcttaaaatcattatgtatactggaaagaaattgattcaaatgcattcaccataaaactatggatggagaacctcattttattaatcacactagg

SEQ ID NO: 27629 - DNA, 601 bp, Human
actgtttatatataaagtacctacatgtatcactgttctagtataatcagtatgttataaagcatacagagaataagggtatttgaaaagaacgaggaagaaaatgaatcatcttgtaaacttcctgactgcacacaccacagagagatcatttgtctttttcgagacataggagttagttctttttttctgattatgcttgtaatgggtccttcaggttcttgtgtatgatatctaagcaatttaaaaaattgataaccaaggcccagaagtaaacttacattcatggttaatattattkatccaggacctcatataatgcaagtttttctaatcatgggaaccttattgactaagcaaacaaaagcttgtaattttttatcattgtttgtcagtacattccataatttacaagtttgaagttgtaatggtcaatgttaaagttatattaggaatactaattttactaaccttatttttctttcagatgacattaaagtatcagtaaatgattttatcatcaaggcagcagctgttacccttaaagtaagtagcagacttcaaatgattttgtcttcttaagtagtttcatgtcgtggaa

SEQ ID NO: 27630 - DNA, 601 bp, Human
aggcccagaagtaaacttacattcatggttaatattattgatccaggacctcatataatgcaagtttttctaatcatgggaaccttattgactaagcaaacaaaagcttgtaattttttatcattgtttgtcagtacattccataatttacaagtttgaagttgtaatggtcaatgttaaagttatattaggaatactaattttactaaccttatttttctttcagatgacattaaagtatcagtaaatgattttatcatcaaggcagcagctgttacccttaaagtaagtagcagacttsaaatgattttgtcttcttaagtagtttcatgtcgtggaatttttacaatgacaaatagaactcttatttttaaatcacaaaaattttataattgtcttgctaaaaatatcctatcgtttgatctccctcattttacaaatgaagaaactgtaaatcaaaagggctcacaatgaattagagcaggatgaaaaccatttattctaggcattagagatagagcagtaaacaaaagcttacttgatttctgctgtccctggggcttacattctagttggaggagacaaacactattatatgtca

SEQ ID NO: 27631 - DNA, 601 bp, Human
gaaagagaaacaagcattttggcccaagcaatgggaggaatgagttttccatgtactaagattgggaaaactgggaggggtatagctttgggttaaggaatctagagtttggttttagacatgttacatttgaggagcctaacagatattccagtggaggtggcaggaaggcaggtgaacatatgagcctgcagttcagtggaggtgatgtaaacctagctggctggagttgtaaatctagaacccaggcttcctgccttcctgcctggcactatttttcatcatgcctcctttctgtaaygaggctattttctgggatcactgcttgttaacagactgtatttaaagtacatttataattaactttttatttcttgaaaaatacattaatgagggttccatggtgtaatggttagcactctgtattctgaaaattacattaatacagaacttaaaaagcatgccctttcagcagtatctaattattcatataacttttctcttttgatgaaatattttgaattatattaatgatttaattaattgactattattgtgattgatatcattaattgtgaatcatttttgcactccttaaata

SEQ ID NO: 27632 - DNA, 601 bp, Human
gaagagcaattgaaaagcaatgtgaaggtagccttgcaatggaaatgagcgtagcatgacagtgagccaagtggaaaattcatctcaggggagtggtcacaagtaaaatgggatagatagagtggaatcaaattgtatattgccatgcttaaatgacataccaggaggcctggatctttttctttagaaaacaaagaatttttgagaacagaaatttgttttcagtttctgtttttcagcatcattttcacctgtgatacagggcaagattattaataggcagggtttccaggcatttcaycatttgatgaaatctttttttttattattattatactttaagttttagggtacatgtgcacaatgtgcaggttagttacatatgtatacatgtgccgtgttggtgtgctgcacccagtaacaagtcatttaacattaggtatatctccaaatgctgtccttcccccctcccccaaccccacaacaggcccgggtgtgtgatgttccctttccctgtgtccatgtgttcccattgttcaattcccacctatgagtgacaacatgcggtgtttggttttttgtccttgaggtagtttgccga

SEQ ID NO: 27633 - DNA, 601 bp, Human
gctatactgcccaaggtaatttatagattcaatgccatccccatcaagctaccaatgagtttcttcaaagaattggaaaaaactattttaaagttcatatggaaccaaaaaagaacccgcattgccaagtcaatcctaagccaaaagaacaaagctggaggcatcacgctacctgacttcaaactatagtacaaggctacagtaaccaaaacagcatggtactggtaccaaaacagagatatagaccaatggaacagatatctcttttaaatagggatgtcatgtattgagggcctgctgwtatatatcccagagctgggctagaaagtaaggaataatgtgatctaatattattacctgtttccactctcctcctcccctcaagatcatgttcgttatcatatgaggtaggaagtacaacagacattaaataacttcttgcaatcaggaaagaaagccctttttccccaccatgatataaaggatcaaaacatgtacctcatcagaatttcttcaaacttgcttcaaaaaggtggtatgtttaattattcttggcaaacataaaagataattgacacagaactccataccattttttcaa

SEQ ID NO: 27634 - DNA, 601 bp, Human
ctgccatttattgacatttcagtggctgtggcaacagataaaggcttacttactccaatcataaaagatgctgctgctaaaggtatccaggaaattgctgactctgtaaaggtatgtcttaagaaagagtgtgctttcaaaatgttagcatatacttttggataattactttctgataaagttgtgacgtaatctagtcagactgtgatttttgtgtgtgtgaaggggagagttatttcatcaagtgattgtcacatatatataggtttttaaagtttttatccaagtatgacccattgtwagaaaatttaatattcaaaaattaagagataatatataaacaaattagggaacaacttcatgctaaagacaagctttattttccaaagtccagaattcagccataaagatgctatatcaggtaggttttaaagttgaagttaagctgaaactgtatttctatggacctcaatattaataacattttattcttaaagtgtatttacttcttctctaaaattgagaccattaaaagaacttagcggccaggcgcggtgtctcacgcctgtaatgccagcgctttgggaggccgaggtgggtg

SEQ ID NO: 27635 - DNA, 601 bp, Human
agtgattgtcacatatatataggtttttaaagtttttatccaagtatgacccattgtaagaaaatttaatattcaaaaattaagagataatatataaacaaattagggaacaacttcatgctaaagacaagctttattttccaaagtccagaattcagccataaagatgctatatcaggtaggttttaaagttgaagttaagctgaaactgtatttctatggacctcaatattaataacattttattcttaaagtgtatttacttcttctctaaaattgagaccattaaaagaacttagcrgccaggcgcggtgtctcacgcctgtaatgccagcgctttgggaggccgaggtgggtggatcccgaggtcaggagattgagaccaacctggccaacgtggtgtaaccccatctctactaaaaatacgaaaattagctgagtgtggtggcgcgtgcctgtaattccagctactcgggaggctgaggaacaagaatcacttgaacccaggaggcagaggttgcagtgagccgagattgcgccaccgtactccagcctggcaacagaatgagactccatctcaaaaaagaaatggacgtaatgt

SEQ ID NO: 27636 - DNA, 601 bp, Human
ggctgcacatggtggctcatgcccgtaatcccaacactttgggaggctgaggcaggcagatcacttgaggtcaggaatttgagaccagcctggccaacatggcgaaaccccatttctactaaaaatacaaaaattagctgggcatggtggcacacacctattatctgaactattcgcgtgacggaggcatgagaattgcttgaacctgggaggcagaggttgcagtgagctgagattgtgccatttgcactgcagcctggatgacagagcaagacactgtatctcaaaaaaaaaaaaaaagaaagaaaggtagcgtttatttggtcagttcaaaagtcaaagtaatagagattggtttactgagatatagtatgttccttgtgtttatcaagggttttcagcgacaatgagaatatttgtgtctgtgtttttgtgaaggttaaatgagattaagtgttgaaacaacctgtaaaatataaagtactattataatgttatggaactttattgtagagctagaatttccttatttttatatacattaaattttaaaaattaaccattataggaagatttccttgattctgagcaatttaccaaa

SEQ ID NO: 27637 - DNA, 601 bp, Human
ggaggcagaggttgcagtgagctgagattgtgccatttgcactgcagcctggatgacagagcaagacactgtatctcaaaaaaaaaaaaaaaaaaagaaaggtagcgtttatttggtcagttcaaaagtcaaagtaatagagattggtttactgagatatagtatgttccttgtgtttatcaagggttttcagcgacaatgagaatatttgtgtctgtgtttttgtgaaggttaaatgagattaagtgttgaaacaacctgtaaaatataaagtactattataatgttatggaactttatygtagagctagaatttccttatttttatatacattaaattttaaaaattaaccattataggaagatttccttgattctgagcaatttaccaaatttactgctataatacataagtcgtaagtagttatgttagctttctctattccttgcatcctgaagactctaagtttaagaggtaagaacgcagtctcaccagcctctcagttgggcctcacagcaatgggaagggcagtcataccactttggagtgtagtggtctctggcgggccttgggcatttcctgtaacccccaacagggact

SEQ ID NO: 27638 - DNA, 601 bp, Human
agctagaatttccttatttttatatacattaaattttaaaaattaaccattataggaagatttccttgattctgagcaatttaccaaatttactgctataatacataagtcgtaagtagttatgttagctttctctattccttgcatcctgaagactctaagtttaagaggtaagaacgcagtctcaccagcctctcagttgggcctcacagcaatgggaagggcagtcataccactttggagtgtagtggtctctggcgggccttgggcatttcctgtaacccccaacagggactcaggrtttgctgagctatggctgcccgttagcttctcattctacctgcttctctttcccaccctgctctcttcactcttgttcttacgctatgccaggcactgggctaagtgcttcatttaatcctattaacccagtacaattggaaccttaacttctccatgaaattgaggagattcagttttagcaactttgataaatttgcccaaggcaatacagctagaaagcagtggcaatgaggactagttaacccaggcagtttgattctagagccactgcttaatgagctttctattataccacctc

SEQ ID NO: 27639 - DNA, 601 bp, Human
gcactgggctaagtgcttcatttaatcctattaacccagtacaattggaaccttaacttctccatgaaattgaggagattcagttttagcaactttgataaatttgcccaaggcaatacagctagaaagcagtggcaatgaggactagttaacccaggcagtttgattctagagccactgcttaatgagctttctattataccacctctctccttgcttttactgtttacctttcttttttcctgtctaatcattcacttctttacctcccctttgtctttttctcccgcaaagttaccaraaaggagggtttggtttggtcctcaagtagtactttcttgtatgaagtactcttgctgggcaggtctgtcatgccaggccagtgtgtcacatggtacagagcataacaacctgatgaatataatcacctttggttgtactcggaaaaaataaggggacattgaagcacactgaggcctctcatgagaaacaggcaccttgcatggcctatttaacataatagttctgtagtttacaggagagagagagagcaaaagagaaagaaagtttatgtgtgtgtgtgtatgtgtaagagagagag

SEQ ID NO: 27640 - DNA, 601 bp, Human
tttggtttggtcctcaagtagtactttcttgtatgaagtactcttgctgggcaggtctgtcatgccaggccagtgtgtcacatggtacagagcataacaacctgatgaatataatcacctttggttgtactcggaaaaaataaggggacattgaagcacactgaggcctctcatgagaaacaggcaccttgcatggcctatttaacataatagttctgtagtttacaggagagagagagagcaaaagagaaagaaagtttatgtgtgtgtgtgtatgtgtaagagagagagatctgagctyctgcaaaattagttttttgttgaagtggtttatcttgtaagcatgattatcttaaaaacttaaatgttggattgtttaaacggtggcttaaaaactaaatattttagataggctctatagagatatgttcatttagctgctgtggatgaataggcattaaaaataagtatgcaccaagtagaaaccctgagtgtgtgtgtgtgtgtgtgtatgtgtgtgtgtgttcttcacgtccaatatagattttgactcaattccaagttaagcaagattatattgaattcagctttactgtgcaaa

SEQ ID NO: 27641 - DNA, 601 bp, Human
catactagttacataactactgtatgactatagaggtcaggttatcagccttctagaatcagtaatgttttctgtcaaaaaaaaaaaaaaaaagaaacttgagaagcagctcctggattttcagaaattaacaagaagaatagctaaggactcaacagttataccaaatgcaccataattagttgattcaccaggtagaagaaaaggagtacaatcattggttttctgtgtctgtaagaccaatcttttggtttggaatttgaaatattggagttctctcttatccaaggtttcactttgygtggtttcagttacccgtggtcaaccacagttgaaaatagatgagtactgtacaagctattttgagagagaccacattcacatgatttttagagttataattgttctgttttattattagttattgttaatctcttaccatgcttaatttttaaattaaactttatcataattgtgtatgagtaggaaaaaatagtacagtcatgcatcacagcagggatacattctgagaaatgcatggttaggcgattttgtcattgtgtgaacaccatagagtgtgcttacacaaacctagatggga

SEQ ID NO: 27642 - DNA, 601 bp, Human
tagctaaggactcaacagttataccaaatgcaccataattagttgattcaccaggtagaagaaaaggagtacaatcattggttttctgtgtctgtaagaccaatcttttggtttggaatttgaaatattggagttctctcttatccaaggtttcactttgtgtggtttcagttacccgtggtcaaccacagttgaaaatagatgagtactgtacaagctattttgagagagaccacattcacatgatttttagagttataattgttctgttttattattagttattgttaatctcttaccrtgcttaatttttaaattaaactttatcataattgtgtatgagtaggaaaaaatagtacagtcatgcatcacagcagggatacattctgagaaatgcatggttaggcgattttgtcattgtgtgaacaccatagagtgtgcttacacaaacctagatgggatagcctgctacacgcctaggctttgtatggtacaaacctgcagtacagcctattactgtactgaatagtataaggaaatagtgatacaatggtacgtatttgtgtgataggaatttttcagctccattttaatcttatgg

SEQ ID NO: 27643 - DNA, 601 bp, Human
atgagataaagtacccactgcaatctggtgtccatttaaaaaaatgatgtatagttcttatttctggatatacagacctttataggatatatattgtttcaaatagctttcacactctgtgacttgcctttgggactctctcggtgatttttttaaatgaacggaagttctgagttttaatgaattcctatttatcagtatttttctttgtagttggtactgttcattttctgttaggaatttttgcctatctcagagtcatgaagttactcttctgtgttatcttctaaaagcatttacrttacttttcacatgtagatcacaattcaactgaaattggattttgtatataatgtgaagtttcaagtgctcttttttccccatatggatactaaatttacacagcatcatgtattgaatattgatttctcctttttcatagcattgaaaaggtgattatatatgtgttggtctagttctgtgctattttttttccactggcctgtttgtctatcctttgtttactaccaccaagctataactcttgatagctggtaatgaagtcttccaattttgttcaccctcaagattgtcttctggc

SEQ ID NO: 27644 - DNA, 601 bp, Human
tttcacatgtagatcacaattcaactgaaattggattttgtatataatgtgaagtttcaagtgctcttttttccccatatggatactaaatttacacagcatcatgtattgaatattgatttctcctttttcatagcattgaaaaggtgattatatatgtgttggtctagttctgtgctattttttttccactggcctgtttgtctatcctttgtttactaccaccaagctataactcttgatagctggtaatgaagtcttccaattttgttcaccctcaagattgtcttctggcttttcrtatttccaaataaattgtaaaattgatttgccatttttcacacacacaccccttgctggtttcttgattgggattgcattaagtcttttgatgatttgagaattgacatccttacagtattgagtattctaacctgtgaatatggtagaaaccattgtgtattcagttatttgatttctttcagttatgttttataattttctgtgtagaggtcttgtatatgtttcattagatttattctttggtatttgttttttgatactattataaatggtattgttttaaatttttattttctaa

SEQ ID NO: 27645 - DNA, 601 bp, Human
atgatgataaactctaactaataaaggaaagagaatatttggttactcagatccatttttaacctctggtgctgtataaagggaatattaaactagatgtaaatcaaagtatatgtttggctcatttgagcattttggaatatttgagaatgtatgatacatgtaaaattaaaaaaactattagaactgtaccataattatgttgaaggtagaagtgatcttcaaagagatggccattaacttagcagtgggacctcacttttacaagcactgctctagatatacttgaagaatttaatakgtacagaagtttattctggataataaataaataaggatcacactgtattaggggttatggcaacattattgaattttttatgtacataaagccatatgtttagggtggtttctatctgtcttgtttttcacttatataacactgtgaacttctaaagcaagaggataaaagaagcatgaatgaaaagaatgacatttcaaaaaaatggttcaatgaaaaactatagctaaaatatgtaaacctttctaggtaaaccgcttgccttcatcttgagtcggaatatatttaaataaattgtgt

SEQ ID NO: 27646 - DNA, 601 bp, Human
acatgtaaaattaaaaaaactattagaactgtaccataattatgttgaaggtagaagtgatcttcaaagagatggccattaacttagcagtgggacctcacttttacaagcactgctctagatatacttgaagaatttaataggtacagaagtttattctggataataaataaataaggatcacactgtattaggggttatggcaacattattgaattttttatgtacataaagccatatgtttagggtggtttctatctgtcttgtttttcacttatataacactgtgaacttctaaagmaagaggataaaagaagcatgaatgaaaagaatgacatttcaaaaaaatggttcaatgaaaaactatagctaaaatatgtaaacctttctaggtaaaccgcttgccttcatcttgagtcggaatatatttaaataaattgtgttatctcttgccaaacattttgttagtgtttatttaaaaacaaaatgttgtttcttaatgcatttaaatcagttttgtattgtgcagtaaaatgtgagaaaatataaacatttctattgtattttaaatgttaaaacacaaaagttcaataaaccttga

SEQ ID NO: 27647 - DNA, 601 bp, Human
aagaggaaaacaatggctaaagaaaataaaaatagaaacaaatgtgtatgtgaggcaattacaagcgtacttggtttatatgagtgaattcagacaccatttacttggttctaatatggcccatggaaactgtactgaaatagaatttaagatgttttgttcagttcttgtttcattattaatgtttgtttacctactttatattcacagggatgtgcatgcagtctgtctttgggatgataaaggcccagcaaaaattcatcaggctttaaaagaagatattcttgagtttattaagcargcacaggcagtaagttctacatgcttattttagacttgttttaaaactactcagataatatcatattttattattttgaaagtagaacttcttgaagtaatttcaaaatattgcattgacttttgacacatttgttaaataaatttattaatgaaatgatcgtcattagttggattatttttttcccacagtgatacttctgtcaagagagtacatattatatttaattaaaagatgctatagcgaattcagttttttatattttttgggagtccccaccaccattattttttggctaca

SEQ ID NO: 27648 - DNA, 601 bp, Human
gctgaggcaggcaaattgcttgagtcaaagagtttgataccagcctgggaaacatggtgagaccttgcctctatacaaaataaaaaattacccaagcatgatggtgcacacctgtggttgcagccactcgagaggctgaggcaggagaattgtgtgagcctggaagattgaggctgccgtgagccgtgatcatgccattgcactcagcttgggcagcagagtgagaccctgtctcaaaaaaaggcaaaaaaacaaaaaggtctggtctgatggctagaaggctaggctagaatttcttatwttttagttggatcattccattaatgtcttgtacaacattagtaaaagttgtttgttaaatcgtgttattaaatactaaaaggtgcttagcagttgaaaattaaaactgagttttttctatgtatgacttaagatattgaaatcaagtatatgattggcatatattttaattttgctagtagccactaccatgatggagtaagactaatctattggatattacttaagaaattaagtgttttattgatagtttcttgacaaattttttaaattgtagttttataggaagttatcttttaat

SEQ ID NO: 27649 - DNA, 601 bp, Human
ataaacttatgaagaattaccttggatgttcttaacagatgttaaaaaatatgctgaacactggcaaaaaaaagtaggggagggtttcacggtaacatgactgaataaagtctggaaatgtagacctcagcaagaacccaagaatgggatttagcaccactaattctgagcagttaataggagtagcaatgccagacatgggtcttaaaaagacccatcttaaaaagatttttaaacgcttaagaaatttttttttttttttcatgaatcattttacttaggcaatcttcagttgaacatrccttgttaggaaggaccaaatctcccagatggttgaaaggcaatatgcattgaaatgtttataacattttttaaagaacaaaaaaaaaagtaaaaataataaacataggtggagtcttttttgtttaacctagattaacacaactgttttatttgttcacaattctgtggcttagcaatttgggctggtctcagctgaatttgcctaagcttattaatgcagcagcagtgggctgttggacatggtggtctaagagagcattaaaactcatatatggtttttgatgtggctttcttttca

SEQ ID NO: 27650 - DNA, 601 bp, Human
agatttttaaacgcttaagaaatttttttttttttttcatgaatcattttacttaggcaatcttcagttgaacataccttgttaggaaggaccaaatctcccagatggttgaaaggcaatatgcattgaaatgtttataacattttttaaagaacaaaaaaaaaagtaaaaataataaacataggtggagtcttttttgtttaacctagattaacacaactgttttatttgttcacaattctgtggcttagcaatttgggctggtctcagctgaatttgcctaagcttattaatgcagcarcagtgggctgttggacatggtggtctaagagagcattaaaactcatatatggtttttgatgtggctttcttttcactgtgtggtttgtcattctcaaggagaccagcctttgagatgaaagtggaatctacaatacctattcatggatagactgagaaatctttcactgttacatcggtggcattctgttggtcaaagtaaatcacaggaccagcccaaactctaatagtggggaaatagactccaccacctttttttttttttttttttgaggtggattctcactttgtcgcccaggct

SEQ ID NO: 27651 - DNA, 601 bp, Human
atagtggggaaatagactccaccacctttttttttttttttttttgaggtggattctcactttgtcgcccaggctgcagtgcagtagcgcgatctcggctcactacaacctccgcctcctggattcaagcgattctcctgcctcagcctcccgagcagctgagattacaggcgcatgccaccatgcctggctaatttttgtatttttagtagagatggggtttcaccatgttggtcaagctggtctcaaactcatgacctcgtgatctgcccgccttagcctcccaaagtgctgggattayaggcatgagccaccgcacctgccgtgactccaccaccttttaaaaacttgagatataattaatataccataaaatttactctcttaaaggatatgattcagtgggttgtagtatatttcataaaattgtgcaaccatcacccaataatcccagaatattttcatcaccctaaaaagaaatcctatacctatgaacagtcactcccttctcccaacccactaaatcactaatctgttgtccctatggatatgtctatatttgacattttctgtaattggaatcataatatgtggccttttg

SEQ ID NO: 27652 - DNA, 601 bp, Human
atgagttacatgcagacaatacatagagcagtcccaggtatagaatgagtgttataaaactgttaactcttgttgttattgttgctgtcattaatgtatctcctacatctgaccaagtttcttggagtactgatataatcaccaatgtttatataccatttttatcattttaatggaacatctaaacagtagatttgcagaccttttataaggtccagtatcagattttcagttggtcctttttacattttttatgtgtctttacaaacatatgcatatgtctatttcaaacacaccaatrtatctgaaattcaaccatggaactataggagaataaacattttccatgtattatcatagttaatttttacaaccactgaaatttgcactattattttgaccattttatacataagaaagcagataaataagtaacagctgggattcaaatccagttggattctgaaacacttgttctttatttacttttgttttgtttgaaatgggctcttgctgtgttgcccaggctagagtggaatagtgtgatcttggcttgctgcagccttgccctcctggacttaagtgatcctcccacctcagc

SEQ ID NO: 27653 - DNA, 601 bp, Human
tgctgcagccttgccctcctggacttaagtgatcctcccacctcagcctcccaagtagctgggactacaggcacatgccagcatgcctagcaaatttttgtattttttgttgttgttgagatgggtcttactgtgttgccgaggctggtctcaaactcctggcctcaagtgatcctcccaccttggcctcccaaggttttgggattagaccacgcgcagtcgacccttctttaccattatgctaaatatactgcttccccgaagtattcaagtgaatgcaacctaagttattttgagacarggtcttactctgtcacccaggctggagggcagtggcgtggtctcggctcactgggactacaggcgtgcaccaccacactgggctattttttttgtatttttttgtagagacaggattttgccctgctgcccaggctggtcttgaactcatagactccagcgatccacctgcctcggcctcccaaattgttgggactacaggcgtgagccactgcacctggcccaggcctacaaatttgatttccttttttggtgtttgtacatgatactttgtatattaataattgaaaattatgttaca

SEQ ID NO: 27654 - DNA, 601 bp, Human
attcttttagttatcaagcctttagattttcattagcagtgctcctgaaatttgtttttaattgaactgccaccagacattaaacttcacatgcagagttttgaaatagtcgtcttataatcatcttattgctgttgtttaacccatatggtgttcataagattaatgtttaagcactattttattggtattttttctacttaccccttaagtggtataccatgctttttttttttttttttaagagatggggttttgctctgttgcccaagctggagtgcagtggcgtgatcatggctcrttgagcctccacctctcaggcttaagcagtcctcctatctcagtgtcctgagtagctgggactgcaggcatgcaccaccacacctggctaatttgtttctttttttttctttttttgagacagagtctcactctgtcacccaggctgaagtgcagtggcatgctcgctgcaacctccacttcccaagttcaagcaattttcatacctcagcctccagaatagctgagattacaggtgtgtgccatcactcccagctaatgtttgtatttttagtagagacggggttttgccatagtggcc

SEQ ID NO: 27655 - DNA, 601 bp, Human
gtgcttttctgcttctgaatatttacttaccttactaatctccgtttatgcaaattctagtttattctttaagattcagtttaaatcccattgcttctgtgaatgttttcttgattattcagttagaagtcagtttcttacctatgcaaaaatagtctatattatctgtattatttatttgttactttactgctttatgctgttatctttataagtttcttatggagaaggattttgtcttatataattatatgttctcttgagcattgttaccttgcacataatgactcctcaatatttrtttcatttattatactcaaaatactgattttgatcataattggagtaatactttattttctgtttttcagttaacctttgttctaatcctgaggataaacttcaaatttatagggacaattttgagaaggcatacttggattcaacagagagattttatagaacacaagcaccctcgtatttacaacaaaatggtgtacagaattatatgaaatatgtaagttagaacttagtatatgtgataatttgagcaattcccttgatattcttaaaatgattgctattttgcttctggacaggc

SEQ ID NO: 27656 - DNA, 601 bp, Human
aaatgaaactgaaagtaggtaaaacatcacataaagttatcataatcttctaagagggtatctttgaaacaaatcacttactaagttgctcttagttaattcttttccacataggtatatgtggaactgttagagtgaactatacttaaggaaatagataaaatatttaacacagaggcactgctaagagtatataaacttaaattttaagcattttccctcttagctatcaacatctgtgtatgtgtatggtgaatttctacttttttctcaaaagcaagacactgcttttaaaggccartttaaactggaaacatatgttatagattagaaccaggtatttgacttttgtgtggaaccttgtgatgaatctttttagaatgtaataaaacactccctgttaatagtcatctctgtccccaaaaatactttataagatttctaaaggattttttttattacttcaatgttttcttaaaaagatgtgttttgagaggtagcaagtatataacaaactaaaaaaaaaaattgtacatatacctactaccccagtaaaactgcttttaacatttttttgcttttgttttttaaataacgtact

SEQ ID NO: 27657 - DNA, 601 bp, Human
gaggtagggtttttgtgaaggtcaataaaatggcataacatgaaaaagtgctttgtaaattgaaaaattatttatgaatacagttttatattctaatctctaatatagttgctttcgtaattattactcatgttttttaccttttgatgatatggctgtatatgtagtattacaactaccttatgaaataaactaatcttgtgtgtaaataaatattcctttgcattgaaaaccaaatgactcaccttttcttttgagactgggtctcgctgtgttgcccaacctggaattcgatggcacratcacaattcactgtagccttgacctcctgggctcaagcgatcctcccacctcccagcccactgagtagctgggactacagccgtgtaccaccatgcctggctaatttttgtattttttgtagaggcagagccccaccttgttgcccaggctgatctccactgcttctggccaaatgactgaccttttaaagaaaggagttgggttttgcagtatttgatcactttttttatttttattttttgagaccgtcttgccctgtcacccaggctgagtgcaatggtgcaatcacggctcactg

SEQ ID NO: 27658 - DNA, 601 bp, Human
aagactctgagccatgggaaggagttagtttttactgtgagtaggatgggaagtcatttaaaaattttaaacagaatggtagaatgtgatttatgtattaacaggatcattctggctgttgtaaaaaatatactgaagggaagaaggaagaaagaataccagttaagaacttatttaaataattcaattaagtgatgatggaggcttgtcccagagtgatggtagaggtggtcaaaagtagttcgataattttttttttttttaatgcaagtagcttatttgggaaatgcagggacgatakcgtggcgtattagtaagtcagatctacagtgagctacttgaacttaattctgcaaggaaacttatttaaaaccctgctcaaaattacctcacctatcaagtgttgagttcttgaagtttcctgcctgccacttgcataggcaacacatatttctgcagttttaggaaaaaacagctctttgggtgcatgtgcagatactaatagtgggaaaagtataagggatgtgggaaggtttgacagcatttgttacaccaggtatgtggcttggaattggaaaataaaaatgacagcaggctctag

SEQ ID NO: 27659 - DNA, 601 bp, Human
gcgatccatccaccacagcctcccaaagtgctgggattacaggcatgagccaccatgcccagcccagtataattttactacctatagttctcatgctgtacattagctctctagactttttccatcttgtgtgtctgctactttgtatcatgtcacctacatttccttgtttctttcccacccattttgccactggtactactctttcattcctctttctgtatatttgaattttttttaggttctacctataagtgagatcatgcagtatttttcttcctgtgtctggcttatttttaakgtcttccaggcttccgtcatatatatgtaccagtttctttatccattgatggacgctgaggttgtgtccatatttttgctattgttaataatgcagtgaatgtgggagtgcagttatctttgtgaagtggtgatttcatttcctttgggtatatgcctagaagagggattgctgggattatgattacattatgaagatagactattcaggatttgctattgaatcagaagtagaatgtgatagagactagtcagggatgacactcagattcgtgttctgatcaattagaaggatatgttc

SEQ ID NO: 27660 - DNA, 601 bp, Human
atttccttgtttctttcccacccattttgccactggtactactctttcattcctctttctgtatatttgaattttttttaggttctacctataagtgagatcatgcagtatttttcttcctgtgtctggcttatttttaaggtcttccaggcttccgtcatatatatgtaccagtttctttatccattgatggacgctgaggttgtgtccatatttttgctattgttaataatgcagtgaatgtgggagtgcagttatctttgtgaagtggtgatttcatttcctttgggtatatgcctaraagagggattgctgggattatgattacattatgaagatagactattcaggatttgctattgaatcagaagtagaatgtgatagagactagtcagggatgacactcagattcgtgttctgatcaattagaaggatatgttcactgcgatagggaagactgtaagagaaatagtttttggagagatggttgcagagagatcagaaactcggtattgaataagttaactttgaaatatctgttaaacatccatatggtaatgttgagtctggagcttaagagaaagaatggagctggaaaaat

SEQ ID NO: 27661 - DNA, 601 bp, Human
gaagagggattgctgggattatgattacattatgaagatagactattcaggatttgctattgaatcagaagtagaatgtgatagagactagtcagggatgacactcagattcgtgttctgatcaattagaaggatatgttcactgcgatagggaagactgtaagagaaatagtttttggagagatggttgcagagagatcagaaactcggtattgaataagttaactttgaaatatctgttaaacatccatatggtaatgttgagtctggagcttaagagaaagaatggagctggaaaaayatgtttggcagcttcagcatataagtggtttttaaagcactgacacaggctctaatcaccaaagtaatgattggagatagaaaagaggacagatccaaggattggcctagggcattctgatatttcattgttagaaaaatgaggagtcgtctttcatgagaagggagaaatgatccaagagaatgttatgtgctagaagacaagtgaaaaaagtactttcaggaggagggtgtgatccgctgtttttaaatgctgataataaataagatggagataaaccattgtcttcagcaacatgga

SEQ ID NO: 27662 - DNA, 601 bp, Human
ttgtcttcagcaacatggaggttgccagtgactttaacaagaacagttgtgtaggctgggtgtggtggcttacgcctgtaatccagcactttgagaggctgagacaggtggatcacttgaggtcaggagtcaacatgatgaaaccctgtctctattaaaaatacaaaaattagccaggcacggtggtgcgcacctgtaattccagctactcaggaggctgaggcaggagaatcgcttgaacccaggaggtggtggttgcagtgatctgagatcagcaccactgcactgcagcctgggcaaagagtgaaactctgtctccaaaaaaaaaaaaagaaaaaaaatctcacttgaggccaggcatggtggctcacccctgtaatcccagcactttgggagaccaaggcaggcagatcacctgaggtgaggagtttgagaccagcctggccaacatggtgaaactccgtctctactaaaaatacaaaagttagcctgatgtagtggtgggcacctataatcccagctacccaggaggccagctaagacaggagaatcacttgaacccaggaggcggaggttgcagtgagtggagatcatgccactg

SEQ ID NO: 27663 - DNA, 601 bp, Human
ctttaacaagaacagttgtgtaggctgggtgtggtggcttacgcctgtaatccagcactttgagaggctgagacaggtggatcacttgaggtcaggagtcaacatgatgaaaccctgtctctattaaaaatacaaaaattagccaggcacggtggtgcgcacctgtaattccagctactcaggaggctgaggcaggagaatcgcttgaacccaggaggtggtggttgcagtgatctgagatcagcaccactgcactgcagcctgggcaacgagtgaaactctgtctccaaaaaaaaaaaaagaaaaaaaatctcacttgaggccaggcatggtggctcacccctgtaatcccagcactttgggagaccaaggcaggcagatcacctgaggtgaggagtttgagaccagcctggccaacatggtgaaactccgtctctactaaaaatacaaaagttagcctgatgtagtggtgggcacctataatcccagctacccaggaggccagctaagacaggagaatcacttgaacccaggaggcggaggttgcagtgagtggagatcatgccactgcactccagcctggtcgacagagtgagacttc

SEQ ID NO: 27664 - DNA, 601 bp, Human
cgtcagttaggccgggcgcactggctcatacctgtaatcccagcactttgggaggccgaggcaggtggatcacctgaagtcaggagttcaagactagcctgaccaacatggcaaaaccgcgtctctactaaaaatacaaaaattagctggatgtgctggtgcactccggtaattccagctgcttgggaggctgaggcaggagaatcacttgaacccaggaggtggaggttgcagtgagccaagatcgtgccattgcactccagcctgggtaacagagtgggactccatttcaaaaaaaaaagaatataccatcaattatataaaataaagtgatatctaataaatgttcttaatactttcagtaaagtatctttgttcttgagttgtttctactgtttcactcccatttgtacctcaactctcatttaaactgaccttattaataaatagactacaggggctgggcacggtggctcacacctataatcccagcactttgggaggccaaggcaggtggatcacaaggtcaggagatcgagaccatcctggctaacacagtgaaacccagtctctattaaaaatacaaaaaaattaacgaggc

SEQ ID NO: 27665 - DNA, 601 bp, Human
caaaactaatacatatttactacgagaaacctttagaattaaattttctttctttctttctttttttcttttttttggagatgtagtcttgctgtgttacccaggctggattgcagtggtgcaatcttgactcactgaaacctctgtctcccagattcaagcaattctcctgtctcagcctcctaagtagctgggactacaggtttgtgccatgacgcctggctaatttttgtatttttagtagagacacggttttgcatgttggccaggctggtcttgaaatcctggtcttaagtgatcygcctgcctcggcctcccaaagtactgagattacaggcgtgagccaccacacccggcctatgttatttctttgttaaaaaaaaaatatcaagacccaacagtaaaatgacaaacaaggctaggcatggtggctcacacctgtaatcccagcactttgggaggctgaggagggcagatggcttgtgctcagagtttgagatgagcctgggcaacgtggtgaaaccccatctctacaaaaatttaaaaaattagctgggtgtgatggcatgcaccttagtcccagctgcttgggaggctgagg

SEQ ID NO: 27666 - DNA, 601 bp, Human
tagcaaatttcataggtattagacaataaaattctaataaatgagaaaaattttgtattaaaacatttaagacttagtttttctattaaaatttttcccagtaatatatcagattatgtatttattacctcttccttctttggtttatatttataggaagttggtatgccagcggattatgtaaacaagcttgctagaatgtttcaggacataaaagtatctgaagatttgaaccaagcttttaaggaaatgcacaaaaataataaattggcattaccaggtattattttataattacatrtatatattttttaaacttagaagaatatctttgttttccagtaaattaaaaataaacctcagcagtaatagatcgaaagatgttatgaagtccatttccgtggagacagctatcaaagcagtgtgttagatttacagatctttatttcaaaacaaaaggacacttttaacaaaatctttatagtcttattgatttttcacccaaagttaccctgtatttattttgaattttatccattgttaatttactttatattcctgatattcttctctatagctgattcagttaatataaaaattc

SEQ ID NO: 27667 - DNA, 601 bp, Human
ctcttccttctttggtttatatttataggaagttggtatgccagcggattatgtaaacaagcttgctagaatgtttcaggacataaaagtatctgaagatttgaaccaagcttttaaggaaatgcacaaaaataataaattggcattaccaggtattattttataattacatatatatattttttaaacttagaagaatatctttgttttccagtaaattaaaaataaacctcagcagtaatagatcgaaagatgttatgaagtccatttccgtggagacagctatcaaagcagtgtgttrgatttacagatctttatttcaaaacaaaaggacacttttaacaaaatctttatagtcttattgatttttcacccaaagttaccctgtatttattttgaattttatccattgttaatttactttatattcctgatattcttctctatagctgattcagttaatataaaaattctgaatgctggcgcctggtcaagaagttctgagaaagtctttgtctcacttcctactgaactggaggacttgataccggaagtagaagaattctacaaaaaaaatcatagtggtagaaaattacattgg

SEQ ID NO: 27668 - DNA, 601 bp, Human
aagctcgttagttgatctaaaataaaaacaccttgtttgaattttagcactttgttttttgcaaaataattgttttccttacattatatttaaaacattatatactgtcatcactctaaacttacatcatttagttgtttatggaaaatattaatcagatgtttacttttctatatttttcattgatacatttttggtctctgacattatactgtattgcatttcatctttcaggttgatatctttttgtgctctaaagcaactttattcagagaaagcgttttttgtgttgttttgtttygtttttgtttttgtttttgtttttgtttgttaagacccagttaggcaataacactgaatcctaacccatatatcttcaattagctagtcactttcatggcaatataaaatattaactttgtttttacagagaatgtagtcacttgttttattaacaggttagttatcatgtttaaggaaaatacatagagtttgttttaaagcaatatgtaggttatttgtcatttaacctttaaacagttctgatattttagcatatttttaaatcttttctctcagacattgttgctataataggatt

SEQ ID NO: 27669 - DNA, 601 bp, Human
aattttagaaatagtccttttaaaaccaaatttttcaacttttactattttcatttaatactatttgaaacttctggccagtgtactttttttttttttttttgagacagggtctcactttgttgcccaggctagagtgcagtggcaccatcttaactcactgcagcctcaactccctgggctcaaaggatcctcccacctctgcctccggattagctgggaccacaggcatgcgccaccacactcagctaatttttgtatttttagtggagacagggttttgccatgttgcccaggctgstctcgaactcctgggctcaagcaatatgcctgcctcggcctcccaaagtgctgggattacaggtgtgagctaccatgcccagcccagtgtactttttaaaatataaaacaagacgaaaagattaaaaatgcatattacctatagatcatgtaataggataatgtggcagagaaaagatgaatgaataaaaaccaattgcatttctatggggcaataaataaaaggagaataaaataagaaaaatacatacacattttttaaaaagtactgtgtaggagctgtatgaaaagagtggccctt

SEQ ID NO: 27670 - DNA, 601 bp, Human
gctgggactacaggcacatgccacggcacctggcagctaggctgaataacataaaagattggtttttctgatattaatatcaagttcaaaattttaaaatttcacatgaaaattcaactaggaatatttttggaattttacaaattgttttttatcagaataaataagaatgattgagaaacttaaaaaaataaaaaaaaggtggtagtggtggaacttgccctgccaaatacgaaaatattttaaaaatctgtagtaataaaacagtatggcaagaagattaattgaagaaaataacttkaggctcggcgcggtggctcacacctgtaatcccagcactttgggaggccgaggtgggcagattgcctgaggtcaggagttcaagaccagcctagccaacatgttgaagccctgtctctactaaaaatacaaaaactagccagctgtggtggcgcatgcctgtaatcccagctacttgggggtgctgaggcaggagaattgcctgaacctggcgggcagaggttgcagtgagcctagattgcgccactgcactccagcttgggcaatagagtgagactccatctcaaaaaaagcaaacaaa

SEQ ID NO: 27671 - DNA, 601 bp, Human
gtaaagagagagctggtactggaaaaggtaaaagagaaaagaatatttaatgattttctgataactcttattgtaaacttaacagtaattaaggaaatcatcaagaaaaattttgataaaatgacctagatgaaaaagatttatttctttagaaacttaaaagtgactgggcatcgtggcttacacctgtaatcctagcactttgggagaccagggcaggggagtatttgagtctgggggttcaagaccaacctggacaacatagcaaaaccttgtgtctgtatttaaagagaagaagggraaaaaaaaaaccttaaaaacatttaattgagtcaatataaactgaagataatatttgtagcaaatataattaattaatctggtaaatatataaagagtactacttaatgacttttaaaacagaccccacctgacctgtactgctatacaaagaaataactgaatacaagggaaaaatttggtgtaaggggtttgttatattttaattaatgtttaacatgataccaggttatatacacattgttttcacaggtaagataacttttaagaatgtgaatggcatgggaaaaaaggaattgaa

SEQ ID NO: 27672 - DNA, 601 bp, Human
ggctggaaagcttgttttgaaaaatgaagcttatattaattgttgcttcaatagtttaaaaaatttatggagataggtaggtcattatgattgcagagccaaaatagcaaaacaaacatattaagtgtgtttactaaacatattgtgtgtttactaacacacttaatgtttatatacctaatatttattatgccatatctgaatttattaaaaacaacacagaaatctcctgctctgatatagttatgtaactgatctcttaatctgtagcatagaagtattttggtattttaaggtctcwtgattagggatttgtagcctcaggtttgaatcagtcacctaggggtaagagaaaaaccacaacataagacctgaaaaacagaagcaaaattgttgcactcttaatacgagcagtaaacttgccaaatatatgtacatatatatttatatattttaaaaataaacattttttaaatcgtcagaaggcaacatttaccatgttcctttcagtctatccaaagtagcaacttaactagttgctggcaactgaatacccagagtagtggaaattttaggacttgaggacgtgaacaacttgaaa

SEQ ID NO: 27673 - DNA, 601 bp, Human
tcacctaggggtaagagaaaaaccacaacataagacctgaaaaacagaagcaaaattgttgcactcttaatacgagcagtaaacttgccaaatatatgtacatatatatttatatattttaaaaataaacattttttaaatcgtcagaaggcaacatttaccatgttcctttcagtctatccaaagtagcaacttaactagttgctggcaactgaatacccagagtagtggaaattttaggacttgaggacgtgaacaacttgaaagagaaaattgattccccttgaggaaagaatggctyaacgtggatttttattcattgtggtgcacgtttcaaattttcttgcaaattattttatatcttatttgatgttaagtaatatttttaaagtatggtttttgaagatagtaggaaatggagtacagaaaggcatacagtattatgttacagtggagtgctttcaagagcatttcgtaggatctgtccccatccgaagaggctttgtgaactgcctgctgaatggaaggaaagcaactttaaaacatttagagttttgctgagtatagccaaatgcctgttctgaaacttataggaaattgg

SEQ ID NO: 27674 - DNA, 601 bp, Human
aatttttaatagccaattatgtcctaattgtattttggggaatgaacagcagcaaatactgtaaatgtacagttttctttttttttttttttgggttatgtatacaaaagttttaactactttttggtgtttatgaaaatcatttagttgacaaggtgcctatgccattgttaaattttctttaagtaatttaacaacagatttgctaatttaaaaaaaaatgaaaaaaaaaatcttaccagcagtttgtaaaggtctggaatcacagttggcatcctttattcaggtctcttctctccarcgtacacttaaaattggtgccgagcagggatataacctgcagttaagtgaaaagaaaatccagcctccccctccaaaaaaaaaaaaaaattttaatttttaaaaattagtggtatggcaataagacacttcagaggctatcttaacctctgaatacccatcttctagtttaaagacagagacatcccatctggaaaatgttaacttgtgttgccatctcgttgccggagtaagtagacataagacagagtttaagaagtaaaaatatagaaaaattttgatggtcacaatgagataaata

SEQ ID NO: 27675 - DNA, 601 bp, Human
tttgggttatgtatacaaaagttttaactactttttggtgtttatgaaaatcatttagttgacaaggtgcctatgccattgttaaattttctttaagtaatttaacaacagatttgctaatttaaaaaaaaatgaaaaaaaaaatcttaccagcagtttgtaaaggtctggaatcacagttggcatcctttattcaggtctcttctctccagcgtacacttaaaattggtgccgagcagggatataacctgcagttaagtgaaaagaaaatccagcctccccctccaaaaaaaaaaaaaaattttaatttttaaaaattagtggtatggcaataagacacttcagaggctatcttaacctctgaatacccatcttctagtttaaagacagagacatcccatctggaaaatgttaacttgtgttgccatctcgttgccggagtaagtagacataagacagagtttaagaagtaaaaatatagaaaaattttgatggtcacaatgagataaatattagaatattactattccaatgattaaatgaggatcttgaaataaattctgaagtcttccaatttttacatttattggaggggtccctg

SEQ ID NO: 27676 - DNA, 601 bp, Human
gggaggtctgctcaagactaagttcagtgacattccccattgccccctccagccctttcacacacacacagacatacacacattccctctgtctctttagggtttcaggtaatcaaataactcactgtctatggtgttctgctctttccaccgagtcctttggctgctgaatgtgtctctctcctcttacgctgttcctactttggctggcgaataagatgaacagagccactccctggaaaggacttcagatttggcctccgctgaaacaatgagatgagggagagcaagaaagccaggstaggcgtagaatgtgtgttacaatgaggctggaatgagaagggagatgggaatttgcagttgctcacaccctcattccaaatgttatgactacactggtgagagctcttgctgctccctggaagtgttggccccagctcatgtattgcctttcttccattagcctattttccctcctctcacgatctggtcccagctcccctttgttccttgggttctttcttaccgaaaagttccgtctcctccttggtgtgttttaatgcacattatagatgctgtttctctctctctggctatcttc

SEQ ID NO: 27677 - DNA, 601 bp, Human
tgtcagtatggcatatattttttgcatgcatgtgagtatacctgcatgcatgatggtaatagtgtatgtattcccactgttcttcttcaagatttacatttggtccagtttctttttttcttttttcctttttttttttaatggagatgaggttaactcatctcactatgttgcccaggttggtctcagtgatcctctccactcagtctcccaaagtgctaggagtataggtgtgagcccaccatgcccagcccaggtccagtttctttctaggtagtccctcctctatgtttgtgtatgyatttgtatatcagcttcttttttgctttgcaatttgtttactcatatgtgaccctctttgggtggttaatatgcatttgtgtgtatcttagttgcaccttagtttcataattcttgggaggcctttcccctagtctgaagtctagtcacattcctgaactttttttcttaacacaaaatctgttcttctaataggaattccagagctcaataccaagcatctctactgctattcctcttcgacctcattccatcccatctcctgccacacacgtgtatagctgaggagctgagggtttag

SEQ ID NO: 27678 - DNA, 601 bp, Human
atataaaattactgagaccattagtgctatgaacaaaaccaataggaatagaaagacttcagaaagacaagttccttcactgctgtgcatttgtttggtaaaaagaaaaaaaagacaagttcctgagaacaaagccctgctgccctcttaccctcattcctggccaggaatgaagtccagctccactgagaggcctggcagcccttctagccccacggcttccccgctagctatgctagtgaacaagacagaagaattatttttctcaatctgtatcggaagaaggagggaaaaaaatagmgtaggacatctttacagcctaaagttcactttctgtggccagtcttctagccagattctgggaaatctgtgaagatcacttttctcttgtgtgtcagtatggcatatattttttgcatgcatgtgagtatacctgcatgcatgatggtaatagtgtatgtattcccactgttcttcttcaagatttacatttggtccagtttctttttttcttttttcctttttttttttaatggagatgaggttaactcatctcactatgttgcccaggttggtctcagtgatcctctccactcagtct

SEQ ID NO: 27679 - DNA, 601 bp, Human
atcctatttctcacactttggcaatgcatctctttgttgtaggaaatattcttttttttttttttttggcagcgatagataagcaggaaggattttttaactctgttcatctaaattttcctgataagaaccccaacagagccgctatccaagggttcacctacctcctcgttgactattgacccccaggggtatccagtctatagcaaaggaagagaaaagagatgtgagtgactgcagctctatacctcgtaacccttttatgagacaaatcagaaaatcatggagaaatggttatacwttatctttgtgacttattcctatatagctcaatataaaattactgagaccattagtgctatgaacaaaaccaataggaatagaaagacttcagaaagacaagttccttcactgctgtgcatttgtttggtaaaaagaaaaaaaagacaagttcctgagaacaaagccctgctgccctcttaccctcattcctggccaggaatgaagtccagctccactgagaggcctggcagcccttctagccccacggcttccccgctagctatgctagtgaacaagacagaagaattatttttctcaa

SEQ ID NO: 27680 - DNA, 601 bp, Human
agaggatgtcttgggaaggtgtttcagtagtttaaaaacacacacacaagaagcttttatgaatgggataataggattgtggaaactggtgaagttgatcctatttctcacactttggcaatgcatctctttgttgtaggaaatattcttttttttttttttttggcagcgatagataagcaggaaggattttttaactctgttcatctaaattttcctgataagaaccccaacagagccgctatccaagggttcacctacctcctcgttgactattgacccccaggggtatccagtctawagcaaaggaagagaaaagagatgtgagtgactgcagctctatacctcgtaacccttttatgagacaaatcagaaaatcatggagaaatggttatacattatctttgtgacttattcctatatagctcaatataaaattactgagaccattagtgctatgaacaaaaccaataggaatagaaagacttcagaaagacaagttccttcactgctgtgcatttgtttggtaaaaagaaaaaaaagacaagttcctgagaacaaagccctgctgccctcttaccctcattcctggccaggaatg

SEQ ID NO: 27681 - DNA, 601 bp, Human
ggtgaaatcccgtctctactaaaaatacaaaaattagtcaggcatggtgtcgggtgcctataatctcagctactcaggaggccaaggcaggagaaccacttgaacccctgaacccaggaagtaggggttgccatgaaccaaaattgtgccactgcactccagcctgggcaacagaatgagactccctctcaaaaacaaacaacaataacaaaaaacaaaagcaaatataaaagcacagaatgaattcaagagctggaataaatattgtgaatattaacaagaaccatgccattttttttttaactgcggtaaaacttacctgtttcatctgtagcgggatcattcaccagatctgcaaagacacataacaaggaatgaaaaaatgcagtcaggaaaagtagctaaggaaagcaggataaggggacgatgatctcaaaggaggcaagaaaggctgaagtgaaagcctgtggactcgggcagatgagggactatcgcagaaagaaatggaagagagagtaagactgggcatgcgtacagagatgctggcatctaaggtgacaacagaactctgcatgagctcagagcaccctccaacccttct

SEQ ID NO: 27682 - DNA, 601 bp, Human
ggcaggcgcctgtaatcccagctactcaggaggctgaggcaggagaatcacttgaatgctggaggcagaggttgctgtgagctgaggttgtgctgctgcactctagcctgggctacagagctagactctgtctcaaaaaaaaaaaaaaaaaattagcactgtcactgaacaacactctcacaacctcagtatccaaagatagaagcaggctggacgctgtggctcatgcctgtaatcccagcactttgggaggctgaggccaggagttcaagaccagctcggccaacatggtgaaatcccrtctctactaaaaatacaaaaattagtcaggcatggtgtcgggtgcctataatctcagctactcaggaggccaaggcaggagaaccacttgaacccctgaacccaggaagtaggggttgccatgaaccaaaattgtgccactgcactccagcctgggcaacagaatgagactccctctcaaaaacaaacaacaataacaaaaaacaaaagcaaatataaaagcacagaatgaattcaagagctggaataaatattgtgaatattaacaagaaccatgccattttttttttaactgcggtaa

SEQ ID NO: 27683 - DNA, 601 bp, Human
agcctggccaatatagtgaaaccccatctctagtaaaaatacggaaattagcatggtggcaggcgcctgtaatcccagctactcaggaggctgaggcaggagaatcacttgaatgctggaggcagaggttgctgtgagctgaggttgtgctgctgcactctagcctgggctacagagctagactctgtctcaaaaaaaaaaaaaaaaaattagcactgtcactgaacaacactctcacaacctcagtatccaaagatagaagcaggctggacgctgtggctcatgcctgtaatcccagcaytttgggaggctgaggccaggagttcaagaccagctcggccaacatggtgaaatcccgtctctactaaaaatacaaaaattagtcaggcatggtgtcgggtgcctataatctcagctactcaggaggccaaggcaggagaaccacttgaacccctgaacccaggaagtaggggttgccatgaaccaaaattgtgccactgcactccagcctgggcaacagaatgagactccctctcaaaaacaaacaacaataacaaaaaacaaaagcaaatataaaagcacagaatgaattcaagagctg

SEQ ID NO: 27684 - DNA, 601 bp, Human
gtcctgggtggggcgcagtggctcgcacctgtaatctcagaattttgggaggctgaggcaggtggatcacttgaggtcaggagttcaagaccagcctggccaatatagtgaaaccccatctctagtaaaaatacggaaattagcatggtggcaggcgcctgtaatcccagctactcaggaggctgaggcaggagaatcacttgaatgctggaggcagaggttgctgtgagctgaggttgtgctgctgcactctagcctgggctacagagctagactctgtctcaaaaaaaaaaaaaaaaaattagcactgtcactgaacaacactctcacaacctcagtatccaaagatagaagcaggctggacgctgtggctcatgcctgtaatcccagcactttgggaggctgaggccaggagttcaagaccagctcggccaacatggtgaaatcccgtctctactaaaaatacaaaaattagtcaggcatggtgtcgggtgcctataatctcagctactcaggaggccaaggcaggagaaccacttgaacccctgaacccaggaagtaggggttgccatgaaccaaaattgtgccactgcactccagc

SEQ ID NO: 27685 - DNA, 601 bp, Human
acaaaacagcaggtatgaggagggcttcaaattgcaaacacaaggcagagtaagaaaagggagaatggagataccgtggcaggtggaagactatgtctggctttgtgttttatgtataagggaatagaattaattaaataattataaatttttttaaagaatattagtcctgggtggggcgcagtggctcgcacctgtaatctcagaattttgggaggctgaggcaggtggatcacttgaggtcaggagttcaagaccagcctggccaatatagtgaaaccccatctctagtaaaaatacrgaaattagcatggtggcaggcgcctgtaatcccagctactcaggaggctgaggcaggagaatcacttgaatgctggaggcagaggttgctgtgagctgaggttgtgctgctgcactctagcctgggctacagagctagactctgtctcaaaaaaaaaaaaaaaaaattagcactgtcactgaacaacactctcacaacctcagtatccaaagatagaagcaggctggacgctgtggctcatgcctgtaatcccagcactttgggaggctgaggccaggagttcaagaccagctcggccaa

SEQ ID NO: 27686 - DNA, 601 bp, Human
aactactggaaatatgtgctccataaactgtcatcctgtctttttaggatccttcagcagctgcacactatccagaatgggctctggggaaagcctagaatggccctgatgacctgggggtcccagatctgaactcacccaagtcatctgtggaaggtgcaatatcagccaaaacagccaaaactgaaaaggcacaaaacagcaggtatgaggagggcttcaaattgcaaacacaaggcagagtaagaaaagggagaatggagataccgtggcaggtggaagactatgtctggctttgtgytttatgtataagggaatagaattaattaaataattataaatttttttaaagaatattagtcctgggtggggcgcagtggctcgcacctgtaatctcagaattttgggaggctgaggcaggtggatcacttgaggtcaggagttcaagaccagcctggccaatatagtgaaaccccatctctagtaaaaatacggaaattagcatggtggcaggcgcctgtaatcccagctactcaggaggctgaggcaggagaatcacttgaatgctggaggcagaggttgctgtgagctgaggttgtgc

SEQ ID NO: 27687 - DNA, 601 bp, Human
aactttgagagaaagattagcacagttcctgtttgtcaggtgttcaacaatgtcattaatttgaattgaactactggaaatatgtgctccataaactgtcatcctgtctttttaggatccttcagcagctgcacactatccagaatgggctctggggaaagcctagaatggccctgatgacctgggggtcccagatctgaactcacccaagtcatctgtggaaggtgcaatatcagccaaaacagccaaaactgaaaaggcacaaaacagcaggtatgaggagggcttcaaattgcaaacmcaaggcagagtaagaaaagggagaatggagataccgtggcaggtggaagactatgtctggctttgtgttttatgtataagggaatagaattaattaaataattataaatttttttaaagaatattagtcctgggtggggcgcagtggctcgcacctgtaatctcagaattttgggaggctgaggcaggtggatcacttgaggtcaggagttcaagaccagcctggccaatatagtgaaaccccatctctagtaaaaatacggaaattagcatggtggcaggcgcctgtaatcccagctac

SEQ ID NO: 27688 - DNA, 601 bp, Human
tgaaactgaataaagttatctgtttatttgtctatcttgtatattacacaaaagatgtctagtagaagaaaatcagttttgttcacttttatatccttggcacctagtagcaagttttcaataatgatttgttaaaaaataatctagccgcctataatcccagcactttgggaggccgaggcaggtggatcacctgaggtcaagagttcaagacctgcctggccaacgtggcgaaaccccatctctactaaaactacaaaaaattagccaggcatggtggtaggtgcctataattccagcyacttgggaggctgagaaaggaaaatcgcttgaacccaggaggcggaggccgcagtgagcggagatcgcgccattgcactgcagcctggacgacaagagcaataatccgtctcaaaaaaaaaaaaaaaaaaattcagtcaaagcattacttcttctaccctttatcctccaaaacgtgtttatacttttatcttgcctttacccatcaagtcttgaaactttgagagaaagattagcacagttcctgtttgtcaggtgttcaacaatgtcattaatttgaattgaactactggaaatatgt

SEQ ID NO: 27689 - DNA, 601 bp, Human
aaccccgtctccactaaaaatacaaaaaaattagccaggcttggtggtgggcgcctgtaatcccagctacttgggaggctgaagcaggagaattgcttgaacccgggaggcggaggttgcagtgagccaagatcgcgctattgcactccagcctgggcaacaagaccaagactctgtgtcaaaaaaaaaaaaaaagaaaaaagaaaaagaaaactggatgtcaactcaacaatcccctctcccttatagctcacatttaattctccctatctctaccttgattcagggcagcatcttttaytgggaacactgcaacagtggccctgctggttttccgggttccaggcgatcaatcacggtcaaatcagttttccacactgccctgggagtacagtagggggtttggaagtggggtgtgatccttccaatgcacaaatctaattataatcttaccttgcataaacgtctctctggttggttttcgtgtccaccctacaccttttgatttatattgttttccttacctaaaagctcttccctcttctattaacttagttcacttttacttgtctttcaggaagcagcttagtcaaatgtgccc

SEQ ID NO: 27690 - DNA, 601 bp, Human
tggctgggcgtggtggctcatgcctgtaatcccagcactttgggaggccagggtggttggatcacctgaggtcaggagctcaagaccagtctggccaacgtgttgaaaccccgtctccactaaaaatacaaaaaaattagccaggcttggtggtgggcgcctgtaatcccagctacttgggaggctgaagcaggagaattgcttgaacccgggaggcggaggttgcagtgagccaagatcgcgctattgcactccagcctgggcaacaagaccaagactctgtgtcaaaaaaaaaaaaaaagaaaaaagaaaaagaaaactggatgtcaactcaacaatcccctctcccttatagctcacatttaattctccctatctctaccttgattcagggcagcatcttttactgggaacactgcaacagtggccctgctggttttccgggttccaggcgatcaatcacggtcaaatcagttttccacactgccctgggagtacagtagggggtttggaagtggggtgtgatccttccaatgcacaaatctaattataatcttaccttgcataaacgtctctctggttggttttcgtgtccacccta

SEQ ID NO: 27691 - DNA, 601 bp, Human
tatcccatggtttctaggcaggtgtatatgctgataattcccaaacctgtatttccaacctcatctctctcctaaactccagacctataaatccaactgcctttttatggaagagttcttgaatatttcaaagatctttcacattcaatgtatatccaacagacttaattatctttcccttcactaattctagttgttatacagtgaatgagaccaccatccacccaatagccacatctagaaaactggatgtcatggctgggcgtggtggctcatgcctgtaatcccagcactttgggasgccagggtggttggatcacctgaggtcaggagctcaagaccagtctggccaacgtgttgaaaccccgtctccactaaaaatacaaaaaaattagccaggcttggtggtgggcgcctgtaatcccagctacttgggaggctgaagcaggagaattgcttgaacccgggaggcggaggttgcagtgagccaagatcgcgctattgcactccagcctgggcaacaagaccaagactctgtgtcaaaaaaaaaaaaaaagaaaaaagaaaaagaaaactggatgtcaactcaacaatcccctct

SEQ ID NO: 27692 - DNA, 601 bp, Human
aggggcaaatttaacatgggccttattcacagaatgaagaacaagccaaggagttagatgaatagactagtcaggggagttaccagggaaaatgtcactggaagtgttgcaaatagaatactaggacctgtgttatgagatctcatctatcccatggtttctaggcaggtgtatatgctgataattcccaaacctgtatttccaacctcatctctctcctaaactccagacctataaatccaactgcctttttatggaagagttcttgaatatttcaaagatctttcacattcaatgtatmtccaacagacttaattatctttcccttcactaattctagttgttatacagtgaatgagaccaccatccacccaatagccacatctagaaaactggatgtcatggctgggcgtggtggctcatgcctgtaatcccagcactttgggaggccagggtggttggatcacctgaggtcaggagctcaagaccagtctggccaacgtgttgaaaccccgtctccactaaaaatacaaaaaaattagccaggcttggtggtgggcgcctgtaatcccagctacttgggaggctgaagcaggagaat

SEQ ID NO: 27693 - DNA, 601 bp, Human
cctctctactaaaaatacaaaacttagttgggtgtagtgatgtgcacctgtaatcccagctactcaggaggctgaggcaggagaatcacttgaacctgggaggcagaggctgcagtgagccaagatcgtaccattgcactccagcctaggtgacagagggagactccatctcaaaataaataaataaataaataaataaataaagaataatgagagtcatcctaacctaggggcaaatttaacatgggccttattcacagaatgaagaacaagccaaggagttagatgaatagactagtcrggggagttaccagggaaaatgtcactggaagtgttgcaaatagaatactaggacctgtgttatgagatctcatctatcccatggtttctaggcaggtgtatatgctgataattcccaaacctgtatttccaacctcatctctctcctaaactccagacctataaatccaactgcctttttatggaagagttcttgaatatttcaaagatctttcacattcaatgtatatccaacagacttaattatctttcccttcactaattctagttgttatacagtgaatgagaccaccatccaccc

SEQ ID NO: 27694 - DNA, 601 bp, Human
gtaatcccagcactttgggaggccaaggcaggtagattatttgaggtcaggagtttgagaccagcctggccaacatggtgaaaccccctctctactaaaaatacaaaacttagttgggtgtagtgatgtgcacctgtaatcccagctactcaggaggctgaggcaggagaatcacttgaacctgggaggcagaggctgcagtgagccaagatcgtaccattgcactccagcctaggtgacagagggagactccatctcaaaataaataaataaataaataaataaataaagaataatgagrgtcatcctaacctaggggcaaatttaacatgggccttattcacagaatgaagaacaagccaaggagttagatgaatagactagtcaggggagttaccagggaaaatgtcactggaagtgttgcaaatagaatactaggacctgtgttatgagatctcatctatcccatggtttctaggcaggtgtatatgctgataattcccaaacctgtatttccaacctcatctctctcctaaactccagacctataaatccaactgcctttttatggaagagttcttgaatatttcaaagatctttc

SEQ ID NO: 27695 - DNA, 601 bp, Human
acttctgtaactgccacactgcctcacttaggacctgcttggagtgcccataaatagggagcaaatgaattaataactcttagcaacttctaaaagaaaacccttattgagctgatttgctccacaaaattgaagacattaggaggcaggatgggatttttttcctttctcctttcctttctaaagagttgagaaattcattgtattgtgagtatctctgtattgttgacaagaagcaaatttagtaggaacacaaggcaaagagttacatgcccagaggagcttcttcctagagctaagyagagaaaagattattatcctgtacaagctcttccttataagagaaaatttattttctgtagattagatacatcatcataaattctcttgatagaagctgttgggtaaagaataatgagggtcagctgggcacaatggctcacacctgtaatcccagcactttgggaggccaaggcaggtagattatttgaggtcaggagtttgagaccagcctggccaacatggtgaaaccccctctctactaaaaatacaaaacttagttgggtgtagtgatgtgcacctgtaatcccagctactcagg

SEQ ID NO: 27696 - DNA, 601 bp, Human
ttttcactgagggaggctgaaaggcagaaattttattccactgttaccaattctagaagttactacttctgtaactgccacactgcctcacttaggacctgcttggagtgcccataaatagggagcaaatgaattaataactcttagcaacttctaaaagaaaacccttattgagctgatttgctccacaaaattgaagacattaggaggcaggatgggatttttttcctttctcctttcctttctaaagagttgagaaattcattgtattgtgagtatctctgtattgttgacaagaagmaaatttagtaggaacacaaggcaaagagttacatgcccagaggagcttcttcctagagctaagcagagaaaagattattatcctgtacaagctcttccttataagagaaaatttattttctgtagattagatacatcatcataaattctcttgatagaagctgttgggtaaagaataatgagggtcagctgggcacaatggctcacacctgtaatcccagcactttgggaggccaaggcaggtagattatttgaggtcaggagtttgagaccagcctggccaacatggtgaaaccccctc

SEQ ID NO: 27697 - DNA, 601 bp, Human
caacctgggaggcggaggttgcagtgagccaagatcacgccactgcactccagcctgggtgacagagtgagactccatctcagaaaaataaaataaaataaaacaaaatagtaaaataaaatagaaatgctgataatcccattctgaaagaatcagatttcttaggcaggttgctatttctctgttccagtagttttcaaccctagctatatatcagaattatcagtacattaggaaatgcaattttaaccatggcctccgtggtaatatggagtccttgaagttaaattgatttcacttyccaatccactaaccaccacataatgtgcaagggtactttagggagagggctatttggggaccatgcaacatttgttccattctttccccttgacttttatgacaggtgctcatttttttaaaaaaaagagtaagggagtgaagaacactaatactctttgagaaataattggaagtaaactagaagatgtgccaagtaccctccaaagaacaaggaggtaaggaatccacaggaagaaaaaaaggcttaagaaggcatgcaagcaacaatcatacctgcagtggtatttttttcactgag

SEQ ID NO: 27698 - DNA, 601 bp, Human
gttatgaaatataaaataggctgggcacggtggctcatgcttgtaattccagcactttgcggggacgaggcgggcagatcacctgaagtcaggagttcgagaccagcctggccaacaaggtaaaaccccgtctctactgaaaatacaaaaattagccaggagtggtggcagttgcctgtaatctcagctactcgggaggctgaggcgggagaatcacttcaacctgggaggcggaggttgcagtgagccaagatcacgccactgcactccagcctgggtgacagagtgagactccatctcmgaaaaataaaataaaataaaacaaaatagtaaaataaaatagaaatgctgataatcccattctgaaagaatcagatttcttaggcaggttgctatttctctgttccagtagttttcaaccctagctatatatcagaattatcagtacattaggaaatgcaattttaaccatggcctccgtggtaatatggagtccttgaagttaaattgatttcacttcccaatccactaaccaccacataatgtgcaagggtactttagggagagggctatttggggaccatgcaacatttgttccatt

SEQ ID NO: 27699 - DNA, 601 bp, Human
taatgacctccagctccatccaagttgttgcaaaggccattgttttagttattcttcttagtgacactttgcacactctacctaaagtcaggcttaatattcctccccactattttctaccttagagctgggccattctcttcagtctccttctatcaggtaataaattgagcatgccagtatttccctcatgacccttcttcctccagcgcccaccttcatttcccttctaagttctattactctgcctgttctttgtacacttcagcccatactccaggttctagttggtacattcagmaataactaggagggttgtgctaaaaactttggccccatcaaagtttgcaattccatagtgggtgctcattaaatagttatcaacacagaaacactaccatggaagatgctttttgggcattctgggatcccttacctggtgaagcataactgatgaatgcattgtttaaccggccgatgcacagagtagagccttgtgcaggtaaatttctcatcccagcactctgaggaagcccaatacaaaaaaataaggaggtccaaatagaagcagcataaatgaaggattgaaggaattgggaag

SEQ ID NO: 27700 - DNA, 601 bp, Human
tgtttttgcctcctcatagcttagctcccacttataagcgagaacatacaatatttggtttttcattgtttagttacttcatttagaataatgacctccagctccatccaagttgttgcaaaggccattgttttagttattcttcttagtgacactttgcacactctacctaaagtcaggcttaatattcctccccactattttctaccttagagctgggccattctcttcagtctccttctatcaggtaataaattgagcatgccagtatttccctcatgacccttcttcctccagcgcycaccttcatttcccttctaagttctattactctgcctgttctttgtacacttcagcccatactccaggttctagttggtacattcagcaataactaggagggttgtgctaaaaactttggccccatcaaagtttgcaattccatagtgggtgctcattaaatagttatcaacacagaaacactaccatggaagatgctttttgggcattctgggatcccttacctggtgaagcataactgatgaatgcattgtttaaccggccgatgcacagagtagagccttgtgcaggtaaatttctc

SEQ ID NO: 27701 - DNA, 601 bp, Human
tccattatatcattcttatgtttttgcctcctcatagcttagctcccacttataagcgagaacatacaatatttggtttttcattgtttagttacttcatttagaataatgacctccagctccatccaagttgttgcaaaggccattgttttagttattcttcttagtgacactttgcacactctacctaaagtcaggcttaatattcctccccactattttctaccttagagctgggccattctcttcagtctccttctatcaggtaataaattgagcatgccagtatttccctcatgayccttcttcctccagcgcccaccttcatttcccttctaagttctattactctgcctgttctttgtacacttcagcccatactccaggttctagttggtacattcagcaataactaggagggttgtgctaaaaactttggccccatcaaagtttgcaattccatagtgggtgctcattaaatagttatcaacacagaaacactaccatggaagatgctttttgggcattctgggatcccttacctggtgaagcataactgatgaatgcattgtttaaccggccgatgcacagagtagagcct

SEQ ID NO: 27702 - DNA, 601 bp, Human
gagcagatctccttgttgacgatgtacatacgtcgtaaactgcagacgtcccagtgtcataggcaaggaaggagatggaagaaagccttgagaggagaactcacctgggtctgggatgcctcttcaactctcatattccccactttccctatctgcttttccccaactgtattttcttaagtatttcagacttttgccccccaactggaaaataggggagggaatggtattaattactcttctgttttttaaattttatttcaatagtttttggtgtacaggtggtttttggttacatggrtaagttctttagtggtgatttctgagatttgggtgcacccgtcacccaagcagtgtacactgtacccaatgtgtagcctttatccctcattcctctcccactctttcccctgagtccccaaagtccattatatcattcttatgtttttgcctcctcatagcttagctcccacttataagcgagaacatacaatatttggtttttcattgtttagttacttcatttagaataatgacctccagctccatccaagttgttgcaaaggccattgttttagttattcttcttagtgacactttg

SEQ ID NO: 27703 - DNA, 601 bp, Human
tctgacggcaaagctcatctagaagagaagcagaacatcatgggaagagaatgcagaagataacaaaggctcttgttttaagggatagagaagacttttcagtgtggtgtagtgaaaaggttggagagaaaaagatccgggttttaaccagctctgccacttactttagttatttgccacttcctagaaagtttcttaaattttataaacctcactatccctttctgtaaaatgagaattaaaatacctacctcaacagtatatttctgagtattaaaatgaaatcatgtatgcaaagtamctagcacaggtgagcagtaaatgttagtttcctttatatatccagctgccaattcttctaatcatggatctattaaatagaaaaatgagatccaatcattcagtatacatttacgtgcttactatgggcaaacagctaactttaggaagtcccttgagatacttgaaagtgcctagagtcccaaatacccatcctcaatctcaaggtgcttcccttgcaggtggcttgcacaaagccaatgggggcacacagcaagtttccttctgcgaagttaactacagctcttactcaggaactcag

SEQ ID NO: 27704 - DNA, 601 bp, Human
tgaggaaaataaatgaaattctatggttagcccaaatagacaaagatagcttcttcaaccctaagatctatatcagacagattcaatagtaaagattattagcctaaagtttagtctcccttgaaattgtacatagaatgtttgtatataagccatatagtcatcatctattcactgtgtctatgatattgagaagcagcaaaattatgcaataatatagactttgtattttaagtgctagaaaatgagataaatgttatcagtttgggtgaaaaagtagagagtaggggtaaaagctggrcattgcaaaaggattggtttaagaaatactgtctaagggttagctgtcaatggttggagaagaaggagatcctccttcctctcacccatacattttttcttctttcctctttttcaatgatcacagaccattgggtctctgcaaatccacattttcacagggaggaagtcggaagtaattggagcgacggagtctcctagggggcagaccagccatctgacggcaaagctcatctagaagagaagcagaacatcatgggaagagaatgcagaagataacaaaggctcttgttttaaggga

SEQ ID NO: 27705 - DNA, 601 bp, Human
cactcacacacactcatcccacttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctgtctctstctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcc

SEQ ID NO: 27706 - DNA, 601 bp, Human
gttatacatcaatttaaaaagcaaaaaaaaaaaaggggggggcaatctctctctgtgtctttctctctctctcttcctctccctctctcttttcattgtgtatcagtttccatgaaagacctgaataccacttacctcaaattaagcatatgtgttacttcaagtaatacgttttgacataagatggttgaccaaggtgcttttcttcggcttgagttcaccatctcttcattcaaactgcacttttagccagagatgcaatatatccccactactcaatactacctctgaatgttacaaygaatttacagtctagtacttattacatgctgctatacacaagcaatgcaagaaaaaaacttactgggtaggtgattctaatcatctgcagttctttttgtacacttaattacagttaaagaagcaatctccttactgtgtttcagcatgactatgtatttttctatgtttttttaattaaaaatttttaaaatacttgtttcagcttctctgctagatttctacattaacttgaaaattttttaaccaagtcgctcctaggttcttaaggataattttcctcaatcacactacacatcac

SEQ ID NO: 27707 - DNA, 601 bp, Human
aatgaaactcaaaaccatctctcttccagctgcttcagggaggtagtttcaaaggccacatacctctctgagactggcagatcgctcactgttgtgaatcaccaaaggagctatggagagaattaaaactcaacattactgttaactgtgcgttaaataagcaaataaacagtggctcataaaaataaaagtcgcattccatatctttggatgggccttttagaaacctcattggccagctcataaaatggaagcaattgctcatgttggccaaacatggtgcaccgagtgatttccatctctggtaaagttacacttttatttcctgtatgttgtacaatcaaaacacactactacctcttaagtcccagtatacctcatttttcatactgaaaaaaaaagcttgtggccaatggaacagtaagaacatcataaaatttttatatatatagtttatttttgtgggagataaattttataggactgttctttgctgttgttggtcgcagctacataagactggacatttaacttttctaccatttctgcaagttaggtatgtttgcaggagaaaagtatcaagacgtttaactgcagttga

SEQ ID NO: 27708 - DNA, 601 bp, Human
gggccttttagaaacctcattggccagctcataaaatggaagcaattgctcatgttggccaaacatggtgcaccgagtgatttccatctctggtaaagttacacttttatttcctgtatgttgtacaatcaaaacacactactacctcttaagtcccagtatacctcatttttcatactgaaaaaaaaagcttgtggccaatggaacagtaagaacatcataaaatttttatatatatagtttatttttgtgggagataaattttataggactgttctttgctgttgttggtcgcagctamataagactggacatttaacttttctaccatttctgcaagttaggtatgtttgcaggagaaaagtatcaagacgtttaactgcagttgactttctccctgttcctttgagtgtcttctaactttattctttgttctttatgtagaattgctgtctatgattgtactttgaatcgcttgcttgttgaaaatatttctctagtgtattatcactgtctgttctgcacaataaacataacagcctctgtgatccccatgtgttttgattcctgctctttgttacagttccattaaatgagtaat

SEQ ID NO: 27709 - DNA, 601 bp, Human
ggcctggtccatcagtttctgagccagaccgaggcgccggtgggaacgcttcacagcctggtgggagaagagcagagatggggtgagggactgggaccttgagggctgccccaactaacccccacttccacccccaccagagagcctgggtggaccttacataccaatgaggtgatatgtccatggggcacatcatctgggtcctcttccctggagagggagaaaggagaggctgcaaaggagctcagtgtaggcacagccacctccagcccccctgccatttgtagagtggacatgcacyacagccccctaagaccccagctgggggagagccgggagcctcttggatcagagcagccgatcctgccaccctctgctgcctgaaaaccccaagcctgccgggtgtggggcacacgcctatagttccagctacttggcaggccggggcaagaggactgcttgagcccaggagttcgagaccagcctggacaacacttttttttgtctctacaaaaaaaaaatcaaaaaattagctggatgtggtggcgcatgcctgtggtcccagctacttgggaggcagacatgagaggatcacttgagc

SEQ ID NO: 27710 - DNA, 601 bp, Human
catcgtcatctgggtcacagatccctcttgccagcatccagcccagaggccaccgcccttcccaacagtccctcttcttcatcccctaccaaacgggctgagtgcagttagtgtccctccacaggcagcccaccccagcttcacttgcaagcacttttttccactgtctactgggcatgccaactgccaggttctctctagtgtgctaggcacacggggcctcctggtcctcaggcagacctcccccatccactaggctgcctggccactggcccttccttcctgaatgtgcattctcctygattctgctctctcttggattcttctaggtgcttggtcatgcttgagtcctgctcctcagcatctgctcacgccagggacccacacctctctattcccaaacattactaaacagcccgtgtgcccttcgccagcctcagccatcatgggccagagctcctccatcacaacacatggagcacgtttcagcaggcaggtgctgtctccatgccggcttttcaaccatcagccgccgagtgaatgtggaggtatcctggcagtgctggggtccacagcctcttccccacagccggcccacccc

SEQ ID NO: 27711 - DNA, 601 bp, Human
gctgttgagctttgagcctgagcagccccggcttgtgccacaaaacacattcagcgtggccaagcagacctccaaggcagggtctctcccataagtccagggcctccttccccggggccacagctgctgaaggtcatgagactagggagtcccacctccaaagctctttccttgtactcgggcctggcaggatgctctgggtcaaaaggccaaggctcacatccccaccagaggacctggagaaacacaccctctaaatgtgcgcgcgctcacacacaaagttccccagtgccacggagcraatttattgtgaaagctcgtggggtgaggaggggatggggcaggctctaggaggctgagtcggaggcctctgagctgtccttgacatctgtgctctctgtggtctcgctgacctcgctgaggtccttgctgtccccaccactatcctcggcagccaggcccttctcctcgcgacaggcctctcctgagctcggaggtgaattgcctttgctctccaccttgttctcgatggcacccagcaccacgtgcctgcccttctctttcagctccaggtgccgcctcagctgccaccaggaaccca

SEQ ID NO: 27712 - DNA, 601 bp, Human
taaccataaatgctaaaggcctggaggtgacagtgcctgctgtttaaacgcgtgcgggagagtctggggcctttagccaggagattgtcaggcttcccagggcttccctgaaagaccccagacccaggggccagtgctgttgaggtgttggctttcccatgccaggcgctgggggaagctgtgacgagatttgagtgtcacataataaggatcatggcaattcaaaggtacagggaagctaggctataaggtaaccagctcggttttcctgggggtcttggacaggtgctttgattacatkgtcactgtcagcccgtacccccggtcagatagactgaacccctgcagccggaaagaggagttgctttccatgcccttcctggagttcttcctcgatcaagttgacagtgtttgactcttgttccagctctccgccctgcttgctggcaggcaggagggtcagactagcatgggtgccatggggccctaggtgggtgcagggaaggacctgtagacgccatgcggggcctcagctggtgtctcagctggagtcaggagctgaacggggaagtgcctgagaggaaatgacagctgagtcaag

SEQ ID NO: 27713 - DNA, 601 bp, Human
gtgctgttgaggtgttggctttcccatgccaggcgctgggggaagctgtgacgagatttgagtgtcacataataaggatcatggcaattcaaaggtacagggaagctaggctataaggtaaccagctcggttttcctgggggtcttggacaggtgctttgattacatggtcactgtcagcccgtacccccggtcagatagactgaacccctgcagccggaaagaggagttgctttccatgcccttcctggagttcttcctcgatcaagttgacagtgtttgactcttgttccagctctccrccctgcttgctggcaggcaggagggtcagactagcatgggtgccatggggccctaggtgggtgcagggaaggacctgtagacgccatgcggggcctcagctggtgtctcagctggagtcaggagctgaacggggaagtgcctgagaggaaatgacagctgagtcaagggcaatggccaggcgaagtgggcaaagggcttccaggacagagctgggcctgaggagctcacagggctggatggggatggcactttaagtctggccaagactttgggacatgatccaggacatggaatgggaa

SEQ ID NO: 27714 - DNA, 601 bp, Human
tctgcagaggctgcgtattgaaggctgctctctgaagctccctgccccaggtcacgccgccggttccagatgaatccagagtgggggcaggccttcgtgcacgtggccgtggccggtggcctctgtgccgtggctgtgttcacgggcattttcgacagtgtttccgtgcaagtgggctatgagcactacgccgaggcgcccgtggccggcctccctgccttcctggccatgccgttcaactcactcgtgaacatggcctacacgctgctggggctgtcgtggctgcacaggggcggcgcgrtggggctgggtccccgctacctgaaggacgtgttcgcagccatggccctgctctatggccccgtgcagtggctgcgcctgtggacgcagtggcgccgtgccgcggtgctggaccagtggctcacactgcccatctttgcatggcccgtggcctggtgcctctacctagaccgcggctggcggccctggctgttcctctctcttgagtgcgtctccctggccagttatggcctcgctctgctgcatccccagggcttcgaggtcgcactgggtgctcacgtggtggccgctgtggggcagg

SEQ ID NO: 27715 - DNA, 601 bp, Human
tggaatttcaagggcaaagtttgttatttggaagcagaactgctaatgaaggactcttcttacaagagaagcatggggcataaaacagatgtcccattccccagcttccccttaccaactttcctgcggagtgcagtgttctgggcacctccatcaaggatgttggtgagccgttccacgtcaaaggactgcatatacctctcgctctctatgtcggggtgcatttgcctgctccaggtatcccccaatgacactcggtgcactgggctgcccatcctatcctggatctgtctggtgactrtggagagacacttccaacccggctgctccgagggtctgctctcagcattggtcagtgcaaagaacctgtgtgcaagaggaactgcctagggctgggtgtcagccagggctggttggtagaagaaagacatccctaagtacctgaatgccactccacctccccactccccctgtggacactggctgtggaccaggcactgtgtgcatggtaggcatggtatgcagccattgcttggtacatgtttgttcaatacttgttagccaagattggacagggcctgaccccaaagattgggctcta

SEQ ID NO: 27716 - DNA, 601 bp, Human
caccttcaaatcttctcacccacttgcttcatggatctggaaaggaagtcagacattattgttattttacagatgacaaaactgaggaccaaggtgggaaagtgaattgcccaaggttacaaagctatgcagtggcagaattttaggaccagaatccaggtcttctgctgcctaggactcttctatcccctaggtgggctcaggcaatattgacatgtgaagattgtctttacagttcgaaggaatgaatctctaacagtggaatttcaagggcaaagtttgttatttggaagcagaactrctaatgaaggactcttcttacaagagaagcatggggcataaaacagatgtcccattccccagcttccccttaccaactttcctgcggagtgcagtgttctgggcacctccatcaaggatgttggtgagccgttccacgtcaaaggactgcatatacctctcgctctctatgtcggggtgcatttgcctgctccaggtatcccccaatgacactcggtgcactgggctgcccatcctatcctggatctgtctggtgactgtggagagacacttccaacccggctgctccgagggtctgctc

SEQ ID NO: 27717 - DNA, 601 bp, Human
gaaatggctcatggggctagggggtttccaggtgatcccaggtagatccctctctagtggggctgctcgaggagtgagcacctgtaagcgtagcctaattcacgaccatcttctaaccaacccaggcgccgagctatcaaccggatgtggaatgccctccgcatggcagccttataacgctcattctgggtcatgaaataattgtccttacagctaaactccgggtaactgtggatgatgctctctgcagaggacagagaacagagggcttagggacctgggtgaggtttctggcaccttsaaatcttctcacccacttgcttcatggatctggaaaggaagtcagacattattgttattttacagatgacaaaactgaggaccaaggtgggaaagtgaattgcccaaggttacaaagctatgcagtggcagaattttaggaccagaatccaggtcttctgctgcctaggactcttctatcccctaggtgggctcaggcaatattgacatgtgaagattgtctttacagttcgaaggaatgaatctctaacagtggaatttcaagggcaaagtttgttatttggaagcagaactgctaatg

SEQ ID NO: 27718 - DNA, 601 bp, Human
aaatgggcctcgggcaggacagcagcagaagccccttcttcccagtggccctgtcctccagagaactcttgcagcccagattctgaagcccaggccaggcgagggcgctgtgagcttgccagaggaaaggaccctgggctgaggacttaatgtgccttactgcatttcaccctccacaccacactgaaaggccacttctgccacacccattttgtagctgaggaagctgaggtatgaagtgaaatggccgagctgagtgttcacagagggttcaggcagcccttgctattctgtgctgtgrggtggagggagtggtagcaacacaaccaattacaacaaaagggatccagactagacataccagtgggatgctgacagcacagctggacagaacgagctcagccacacacagtcgatatgatattggattttgctaggctcggcctgacagaatcaactcagccagccatagtctgatgcagctggcaactggctgacccagacccgtccaacccgtcacagccgcacagaacacggctggactcggacagacacagagtcagacagacctggtgctacagggccaaagacactatcacat

SEQ ID NO: 27719 - DNA, 601 bp, Human
aagaagcttcacctcccaagtctctgtttctctagctctaggtggggaggacagttctcatctgattgagggtttgtgaaatggaatgagatgatatttgtagagtgcttggcacagtgcagagtacataatatgtgctattgtactccttttctaatttggaaaaaaaccaagggatgttatatatttttaaaaatataataaatgttgtttttcatatttgccagtgaacttctttctccttgcatagggaagcatttgccctgtttgttcacctgagaataggtgaggatgaggctcwgtcggcctccagggcccacagacctaagagggatgaaaagaaatcgcctgtgtggaggaagctgacttggccattgcttggagcctctgtgtgcaggctctgcaccaagcttaggcgatgctaaagcgagcaaggtaggggtagtccctgccctcagggagctcctaatctagttggagagtagagctaaaaaggtgaacaaaaaaatgagacaatgatagattgtgaaactgctccaaaggaaacaaggccatgttgggtgggaggggatcaaatgcaaaggcctcctggacagaaaga

SEQ ID NO: 27720 - DNA, 601 bp, Human
ccaggtcaggtgcggtgagatatgcgacagatggagagagagatctctgtggcgtggagccaggggacatctgagtctgcaggtagctcttcaccaggaacctgggggttggaagaggaggcaggtgagagggcagagactctgtgagacagcccagcacccctcactcccagagacaggcaagctcatgctaggttccagccttcccgtgggagagccaggtcaccaggcctctgcctggcctccctcctgagggttccccctcgggccgtcctgcctcgaggccctcagtcaggcataycccaggacctgtggagctgggccagacactctctgatcctgaacataaacccttctgtgatctgagcaaacagaattttccatcagaacactgtgattttgggatttataatgacttgtacagtgactgggtggaaattaaattttcttagctgaaaaaagaaggatagaggcaagaatgctaacaggagtaggaggattataggtgactctcaactgctgctttaggataatccagtggttacaggttctgggcttagacagccctggattcccatacagcctcgccgagacctgtgtg

SEQ ID NO: 27721 - DNA, 601 bp, Human
attctatcccgtggtgtagtcatattttcaaaaattatttttagattatgggatatttcaaacgtacgagtgagtattgctttatttattggtatttgcatatcaatacatttggagtatttacatatgggtacattcgttgtattgcaaatcaccataggaccctagagattttaaaaatatctcactggccagaggtgtgatgtccttctactactgtgaccaggatggggaagtgacgggggtccatggctgatgggggggacatcccctctctctgcccatggtggcaggaactgasaggaccggggaggctaggcatggggtggtttttagaactgaatccacgaatgtccacccaaccaatccaaaggccctagtgtggcatggagcctgtgcccaggtgggatggctgatttctcagcactggcttaccttactgccacatgtgcccaggccgtggtgtagagctccgggcagaggaagtcggctgccctctgggctggacacctggccaggtcaggtgcggtgagatatgcgacagatggagagagagatctctgtggcgtggagccaggggacatctgagtctgcaggtagc

SEQ ID NO: 27722 - DNA, 601 bp, Human
agcttcagctggcaggcgctcaccttagcagcctggaggtgtatgacagtggtctggttccaagcctcgtgctggtcagctccggattgcgtcagggtctgtaaatgctgcactgagtcctttatgagcctgaaagccaaagcaaaaaaggttcagcttcctgactgagtggaaaagacaactgatgggcttcctgtggtccctcagaagtagaaataatgcctgtttattgaccacttatgtgccataaagctaaatgattgatatttattatctttttaactcttttaagggcaggcamcccccagtttgcaatggggaaaactgagtcccagagaggttaaccaatttgtccagggtcacacagctagtaaggagtggagccaggattttgacttgttgttaatcgccatgttataaagcctcagggccacaggccaggagctgtcccctatttctaatgcagattccagcctcacaccagtatgttcaggcctttttgttgactgacgtcctgtggcctgagcaaggagaatggtttttctgtaaaggctagagaggcccgtcggtcacctagcctgctgcaggttctacccaaggg

SEQ ID NO: 27723 - DNA, 601 bp, Human
cggtaaaaaatctagatgaatcacaggttgtctgaccagaagatccctgacaatgggctgtttactttagagaaaggagctgaaccctgaaaactgaatgtgcgaaattctaattatcaaaaaacccacggcgcatcaggtagacatgatcatctgcatttcttttccacgctgcaaatcaccgcgatcccagattagtccagccggccgggtgcctccctcccgtccgcctgggcagttgaggccaatcagcagtttaggcgcacaggtgcgggctcagaaagcagcagcaatctccggygtgttctggaatcagaagttgaggtccacgtctgattagttcccttcgtttcattagacttggctgaatgtgtgccagtcccactagagcttcgatttcagacttcctatgacaggtttgttcacagaaaactctggccaccaggatgcccgctccaacaccttgctttcctgcaggacagcgccccagaggtttttgtagagctgcaaacaacacgtacacagcaagtgaagacaaagaaataagaaggaaaagattcctagatggctgagtgtgcaaatgcaactcctcaaagttttt

SEQ ID NO: 27724 - DNA, 601 bp, Human
caggtgcgggctcagaaagcagcagcaatctccggtgtgttctggaatcagaagttgaggtccacgtctgattagttcccttcgtttcattagacttggctgaatgtgtgccagtcccactagagcttcgatttcagacttcctatgacaggtttgttcacagaaaactctggccaccaggatgcccgctccaacaccttgctttcctgcaggacagcgccccagaggtttttgtagagctgcaaacaacacgtacacagcaagtgaagacaaagaaataagaaggaaaagattcctagayggctgagtgtgcaaatgcaactcctcaaagtttttgttaaaaacacaggaaattcggctgggcacagtggctcacgcccgtaatcccagcattttgggaggccgaggtaggcagatcacctgaggtcgggagttttagatcagcctgaccaacatggagaaaccccatctctactaaaaaaaaattcaaaattagccaggtgtggtggtgcatgcctgtaatcccagctactcggaaggctgaggcaggagaatcacttgaacctgggaggtagaggtttcagtgagccgagattgcacc

SEQ ID NO: 27725 - DNA, 601 bp, Human
ttcccttcgtttcattagacttggctgaatgtgtgccagtcccactagagcttcgatttcagacttcctatgacaggtttgttcacagaaaactctggccaccaggatgcccgctccaacaccttgctttcctgcaggacagcgccccagaggtttttgtagagctgcaaacaacacgtacacagcaagtgaagacaaagaaataagaaggaaaagattcctagatggctgagtgtgcaaatgcaactcctcaaagtttttgttaaaaacacaggaaattcggctgggcacagtggctcaygcccgtaatcccagcattttgggaggccgaggtaggcagatcacctgaggtcgggagttttagatcagcctgaccaacatggagaaaccccatctctactaaaaaaaaattcaaaattagccaggtgtggtggtgcatgcctgtaatcccagctactcggaaggctgaggcaggagaatcacttgaacctgggaggtagaggtttcagtgagccgagattgcaccactgcactccagcctgggcaacaagagcaaaactccgtctcaaaacaaacaaacaacaacaacaataacaaaaaa

SEQ ID NO: 27726 - DNA, 601 bp, Human
ccactagagcttcgatttcagacttcctatgacaggtttgttcacagaaaactctggccaccaggatgcccgctccaacaccttgctttcctgcaggacagcgccccagaggtttttgtagagctgcaaacaacacgtacacagcaagtgaagacaaagaaataagaaggaaaagattcctagatggctgagtgtgcaaatgcaactcctcaaagtttttgttaaaaacacaggaaattcggctgggcacagtggctcacgcccgtaatcccagcattttgggaggccgaggtaggcagaycacctgaggtcgggagttttagatcagcctgaccaacatggagaaaccccatctctactaaaaaaaaattcaaaattagccaggtgtggtggtgcatgcctgtaatcccagctactcggaaggctgaggcaggagaatcacttgaacctgggaggtagaggtttcagtgagccgagattgcaccactgcactccagcctgggcaacaagagcaaaactccgtctcaaaacaaacaaacaacaacaacaataacaaaaaagcacaggaaattctctgtcactttttagagaaattttaaaa

SEQ ID NO: 27727 - DNA, 601 bp, Human
tagagctgcaaacaacacgtacacagcaagtgaagacaaagaaataagaaggaaaagattcctagatggctgagtgtgcaaatgcaactcctcaaagtttttgttaaaaacacaggaaattcggctgggcacagtggctcacgcccgtaatcccagcattttgggaggccgaggtaggcagatcacctgaggtcgggagttttagatcagcctgaccaacatggagaaaccccatctctactaaaaaaaaattcaaaattagccaggtgtggtggtgcatgcctgtaatcccagctactcrgaaggctgaggcaggagaatcacttgaacctgggaggtagaggtttcagtgagccgagattgcaccactgcactccagcctgggcaacaagagcaaaactccgtctcaaaacaaacaaacaacaacaacaataacaaaaaagcacaggaaattctctgtcactttttagagaaattttaaaatggtttaaatttatatgaatattttctttttttttctagtagaaaacaattaggacaattcaattataaagtactataaaacacatttataatgaaaatcacccctcgccctcttctt

SEQ ID NO: 27728 - DNA, 601 bp, Human
gcacgtggccaccagcagcaggatgccctcgccgagtggcccttactggctgatttctggacctgggccaccacaccctgctcctctggtcctgccccgggccagcactcccctacgggaggtgcagacttcactgctctcagcctaagtggcctcactgggaagatggggagagacgctcctgtcttggaggaaggttgtacaaatgaagggcgaagggcagctgagcagacacttcacccgtgcagggtggaaaggggcagcccagaccatctccagggcctggggaggtggtctattktgcatccagcttacgctgacccattttattgagaagaaacccctctgcctgcacccgctaaatgcacttagcaacccctcctccccactctgctactctgggctccacagacacagacccaggctgctgctccacagggcctaggttccagcttatgtttcacagtttggagcagcgggcttgatttaaggatggtctcaactcccctgcagctctgtttgttcgcttatagtgaatttctcacctggcagctcctggttaatacaccagttccttgcaactggaaggaatgcacttttt

SEQ ID NO: 27729 - DNA, 601 bp, Human
cgtggccaccagcagcaggatgccctcgccgagtggcccttactggctgatttctggacctgggccaccacaccctgctcctctggtcctgccccgggccagcactcccctacgggaggtgcagacttcactgctctcagcctaagtggcctcactgggaagatggggagagacgctcctgtcttggaggaaggttgtacaaatgaagggcgaagggcagctgagcagacacttcacccgtgcagggtggaaaggggcagcccagaccatctccagggcctggggaggtggtctattttgyatccagcttacgctgacccattttattgagaagaaacccctctgcctgcacccgctaaatgcacttagcaacccctcctccccactctgctactctgggctccacagacacagacccaggctgctgctccacagggcctaggttccagcttatgtttcacagtttggagcagcgggcttgatttaaggatggtctcaactcccctgcagctctgtttgttcgcttatagtgaatttctcacctggcagctcctggttaatacaccagttccttgcaactggaaggaatgcactttttttt

SEQ ID NO: 27730 - DNA, 601 bp, Human
ccctgcagctctgtttgttcgcttatagtgaatttctcacctggcagctcctggttaatacaccagttccttgcaactggaaggaatgcacttttttttttttttttgagatgaggtctcaccctgttggccaggctggagtgcagtggcgcgatcactgcccaccacagcctcgacctccccaagctcaggggatcctctcacctcagtttttgtaatttttatggatggggtttcagtatgttgcctaggctggtctcaaactcctgggctaaagggatccgcccgcctcagccttccwaagtgctaggataacaggtgtgagccaccatgctcagccaggaatgcacgtttaataaaccatcctgccagcgacacctccagctggctctggttttaactatggaacccagagccagggggcccctccatcatgggcaaggtctctcctttccttggtcgttccctgcctcagagacgggcctgcctctgcagagcaaggcgcagcaggtagacgctcaaggccgctccggcttctcctgcacggggcagacagtcccgtgtgcttgggggtcctccatggcgggtctggctccagtgt

SEQ ID NO: 27731 - DNA, 601 bp, Human
cctcagtttttgtaatttttatggatggggtttcagtatgttgcctaggctggtctcaaactcctgggctaaagggatccgcccgcctcagccttccaaagtgctaggataacaggtgtgagccaccatgctcagccaggaatgcacgtttaataaaccatcctgccagcgacacctccagctggctctggttttaactatggaacccagagccagggggcccctccatcatgggcaaggtctctcctttccttggtcgttccctgcctcagagacgggcctgcctctgcagagcaaggcrcagcaggtagacgctcaaggccgctccggcttctcctgcacggggcagacagtcccgtgtgcttgggggtcctccatggcgggtctggctccagtgtcccttcgaatgcctgtctgcctggtgagcccccacctcctggggagactgcctctcccaggaaggtgggtagggcaagtccctctcctatgcgctcccccaggacccaaggctcccgccaagtcttctctccctacagcagggcacagtctcttcaaatcctggctctgccactccctggctgggaaacccactgggcttctc

SEQ ID NO: 27732 - DNA, 601 bp, Human
gcaggccctctgcagagatgaccatccctgcctctcctactacggggaactctcacctcctgccctgcccacccggctcctggcactacctgcctcttggcacacctagcccaacccaggtgtagcctgggccgcgctgaggccaggcgctgggccctccctggctaagccggtaagggctcatgtacagacttcagcattccctgaggactgagggagggtcctgcccactaaggctcaatctccatttgggcagagacccaggtgcttcagcaggtgcttcagcagaaataactcagtygcggggccagggggcagggatggggtcaaacccctctgtgactcacagccaggggacctcaggcacgggacatgagcattgacacgccgagtccctctagcagaagacagacacagccccataagcagtggggtgctggaaggcacccagtggacctgtgagcatcgctcctcgagggcatcatcaggtgggagggagacacaaggtcagtgatgaggccagcaagggcagcactacagtgcctgggggcactgcctcagctggaggccagagaaggcctctccaaggcagcaatagtca

SEQ ID NO: 27733 - DNA, 601 bp, Human
gcccacccggctcctggcactacctgcctcttggcacacctagcccaacccaggtgtagcctgggccgcgctgaggccaggcgctgggccctccctggctaagccggtaagggctcatgtacagacttcagcattccctgaggactgagggagggtcctgcccactaaggctcaatctccatttgggcagagacccaggtgcttcagcaggtgcttcagcagaaataactcagttgcggggccagggggcagggatggggtcaaacccctctgtgactcacagccaggggacctcaggcaygggacatgagcattgacacgccgagtccctctagcagaagacagacacagccccataagcagtggggtgctggaaggcacccagtggacctgtgagcatcgctcctcgagggcatcatcaggtgggagggagacacaaggtcagtgatgaggccagcaagggcagcactacagtgcctgggggcactgcctcagctggaggccagagaaggcctctccaaggcagcaatagtcagcttatactgaaagaatggaaggcactccaggcagcccgagcagcaggcacaaggccctggggtgg

SEQ ID NO: 27734 - DNA, 601 bp, Human
cgctcctcgagggcatcatcaggtgggagggagacacaaggtcagtgatgaggccagcaagggcagcactacagtgcctgggggcactgcctcagctggaggccagagaaggcctctccaaggcagcaatagtcagcttatactgaaagaatggaaggcactccaggcagcccgagcagcaggcacaaggccctggggtgggcatgggcctggcgcgacagacggggaggccagtaaggctagatctggtgggcaggaggggagcgtggggtgaagggccttggaaggattcagtggctgygtggggctggggcgtggcaggcagtcgaggaggctggtggaggctccctcaggggggcggcctgaccccatctgctatgaaggaatcattatggaacatggggggcaggaggagagctgaggagccacagggaggcggttgggggaaagcggggcaggggagagtaaccccggtgacaaccatggatggtcagaggggacagaggggcctggggattccaggacagggatgggggaagaggcctgcagggccaggagcatggtcagatgggggtaagacctgggaccggggaggccgggg

SEQ ID NO: 27735 - DNA, 601 bp, Human
agccccgtgtgtggttgccaggacccactagcaacgggtcacctgagcggcacgtgcggctctgctgcccatgcgtgatctcttcaccggcctggattcgaggcccttgctgtgcactggaatgttctcaccatgctgcttttcactcaggacttctagggcttgtttcttcccaacaaggtagaaaaggcccttaaaagtgacgaccctgaagctcgtgaattagcaactgcattcagaggctcgtttctaagccttggcttatctgggcaactgctgttccagtaaaggaaaatatgtycagaaaacatgtaatagagaaggcatttatgagcacttggaaaagccataagcatatgaagcctcctcggttggcggtggttttattactctcccattccactggacaaattattcttcaatatgacacatgaaatttatatgagtggactctcaagaattttcttaagatgcaaaacaaaaattatccttaaaatatgatgaaatgccgtggctacactgcatagaacccaggaatgggagacaccgctaatgatatggatcaaaggcaatcagtcagtacagagtaagaaaggccaca

SEQ ID NO: 27736 - DNA, 601 bp, Human
ctacactgcatagaacccaggaatgggagacaccgctaatgatatggatcaaaggcaatcagtcagtacagagtaagaaaggccacaatggaggaactgagtgcacctctgcgcttcagcgccgcgctctgcagggcgtggccacctggtcctggtccacgtgcctcagcacagaggccgcagacaaatgccactgctcccggagagaagctctcggcagagcacaggcgctgagcccgacaaacgtgttccgtaagggtccaggtgggagatgttaccggctttgcgggccacggtctckggcaactgcctactgtgccgtggaagcacaaaggcacccacagacgacactcaggtgaacggcaggattggactgagtttgctggccctggtctagtggatcgctggcaacttctccacctggctgaccttggcctccccaagacagtggtatggatgggcacacacagagtggcacacaacggtcatccagccttggccatagcctcactgggaaatcagttgtggctttcatttttttgagacggggtcttgctctgttgtccaggctggagtgtgatggtgcaattacggctcactg

SEQ ID NO: 27737 - DNA, 601 bp, Human
gcacctctgcgcttcagcgccgcgctctgcagggcgtggccacctggtcctggtccacgtgcctcagcacagaggccgcagacaaatgccactgctcccggagagaagctctcggcagagcacaggcgctgagcccgacaaacgtgttccgtaagggtccaggtgggagatgttaccggctttgcgggccacggtctctggcaactgcctactgtgccgtggaagcacaaaggcacccacagacgacactcaggtgaacggcaggattggactgagtttgctggccctggtctagtggatsgctggcaacttctccacctggctgaccttggcctccccaagacagtggtatggatgggcacacacagagtggcacacaacggtcatccagccttggccatagcctcactgggaaatcagttgtggctttcatttttttgagacggggtcttgctctgttgtccaggctggagtgtgatggtgcaattacggctcactgcagcctcgaacacctgggctcaagccaccctacctcagcctcttgagcagctgggactacaggcatgtgccaccaagcctggctaattttttaaaattattt

SEQ ID NO: 27738 - DNA, 601 bp, Human
ctgagcccgacaaacgtgttccgtaagggtccaggtgggagatgttaccggctttgcgggccacggtctctggcaactgcctactgtgccgtggaagcacaaaggcacccacagacgacactcaggtgaacggcaggattggactgagtttgctggccctggtctagtggatcgctggcaacttctccacctggctgaccttggcctccccaagacagtggtatggatgggcacacacagagtggcacacaacggtcatccagccttggccatagcctcactgggaaatcagttgtggctktcatttttttgagacggggtcttgctctgttgtccaggctggagtgtgatggtgcaattacggctcactgcagcctcgaacacctgggctcaagccaccctacctcagcctcttgagcagctgggactacaggcatgtgccaccaagcctggctaattttttaaaattattttttgtagagatgaagtctcactacgttgcccaggctggtctcgaactcctggcctccagtgatcctcctgccttggcctcccaaagtgctgggattacaggaatgagccaccacacccggacactttt

SEQ ID NO: 27739 - DNA, 601 bp, Human
cacggtctctggcaactgcctactgtgccgtggaagcacaaaggcacccacagacgacactcaggtgaacggcaggattggactgagtttgctggccctggtctagtggatcgctggcaacttctccacctggctgaccttggcctccccaagacagtggtatggatgggcacacacagagtggcacacaacggtcatccagccttggccatagcctcactgggaaatcagttgtggctttcatttttttgagacggggtcttgctctgttgtccaggctggagtgtgatggtgcaattayggctcactgcagcctcgaacacctgggctcaagccaccctacctcagcctcttgagcagctgggactacaggcatgtgccaccaagcctggctaattttttaaaattattttttgtagagatgaagtctcactacgttgcccaggctggtctcgaactcctggcctccagtgatcctcctgccttggcctcccaaagtgctgggattacaggaatgagccaccacacccggacactttttatcaacaacacctccccgctatgcccccctctctggcgaggagacccccgtgctttcctt

SEQ ID NO: 27740 - DNA, 601 bp, Human
tccagtgatcctcctgccttggcctcccaaagtgctgggattacaggaatgagccaccacacccggacactttttatcaacaacacctccccgctatgcccccctctctggcgaggagacccccgtgctttccttggtgcacctgcatactctgaaggcctccatggggtcaacactgccccaagggggtaaaatttggctcttggaggagccaaggaaaacccctccctgtggccagttcgatgttaagacgagtaaatgtggccacatacgtgcgccacaatcagacacgcccctctcyggaaccgcaggctcagggaagggctttatacaacgaatcccgagagaggctcagagccagtcacagggacgttccactggtcccagatcaagtgtgaaagcagtgacaggggagatgaaaggccacgtctgcagtcacctgagacattgtgctaaaatgcagcagcactcagtccagttcctagcagcaaaagtggaatgacgtctccacggacacagtggccctgcccaccgcagcagcaccagcaccagcacaagtggctcctcaaaatcagtgcaatgaaaggaaatcggagaccct

SEQ ID NO: 27741 - DNA, 601 bp, Human
tcatcacttagggtttttctcaggcagcagtggggctcctgccctgtgcccgccctctctggcagacacttgtgtcccttccttggtgcacctgagcactgtcaaggcctccacggggtcagcaccaccctccagggggtaaacgctggctcttggggtggggaggatcttattcttcacaagcccagagacacaggacatgaatggatatgcagtgtatcctagtaccaaagatgcatgggtgccagccattgggaaaaaccacctaaaaagcttcctggggggcaaagacgaacaaaamgttgacaaactttggtttagcctattcccaccaatcctccaggaatcagccccagcaccccctcctccaggaagccttccagtattcccaagtctaggcactcctggctcgtgtctgtctgtgccttatgggacctagtgggtgggcttctgctctctgcagagcccggcaggctgcctggcatgagggggccttctggaagtgttctctgaaccgaaccccaagtgaaagaaaaattgggtttctcggcaccaccctgacgctgctctgccccatatgcttctcattatggaactgggc

SEQ ID NO: 27742 - DNA, 601 bp, Human
taaacgctggctcttggggtggggaggatcttattcttcacaagcccagagacacaggacatgaatggatatgcagtgtatcctagtaccaaagatgcatgggtgccagccattgggaaaaaccacctaaaaagcttcctggggggcaaagacgaacaaaaagttgacaaactttggtttagcctattcccaccaatcctccaggaatcagccccagcaccccctcctccaggaagccttccagtattcccaagtctaggcactcctggctcgtgtctgtctgtgccttatgggacctagkgggtgggcttctgctctctgcagagcccggcaggctgcctggcatgagggggccttctggaagtgttctctgaaccgaaccccaagtgaaagaaaaattgggtttctcggcaccaccctgacgctgctctgccccatatgcttctcattatggaactgggcttctcatctgtccacagcgccatccgccgtgctcagtgagtcccgtggaaggaggacgatggtgcaggaagcagcttcctagatacaacacgggggccctgactctggggaggacagcaagcccgcagtcagaagcctc

SEQ ID NO: 27743 - DNA, 601 bp, Human
agcccgcagtcagaagcctcacctcggtagagcagggccgcgtggcggctcagggaccacagggcgtacagagcactgagccgccccagcacggcccgcagcgagggcggcacggaaggctggtgcacgtgctcgtggaacctctggaccaccgtgagctccacgaaggccagcgccaacggacggccgtgggacacctggaacacaggacggcaccgtgaggaccgtgagggtcccagccccgcccagattcccgggggaggaagttctcaggaaacacgaacgcgggtctgcgttcccrtgcatgtcctaggacagtaacataaggtgaggcagagcacagatgcggcgcagcacgagacatgtttccagaacacaatggaagaggcctatgaagatggagctgggactgctctggctccaccgacgccctccaaggcctcagtctcagctcagctcccgtctgggactggggttggcaccagcactgcatacggagcctggagccggcctcgggatgctctgcggctacagagtgggcgcccaccaggaggcccccaagggcccaggacctggcttcttccacacgggaagacacaga

SEQ ID NO: 27744 - DNA, 601 bp, Human
ctgagccgccccagcacggcccgcagcgagggcggcacggaaggctggtgcacgtgctcgtggaacctctggaccaccgtgagctccacgaaggccagcgccaacggacggccgtgggacacctggaacacaggacggcaccgtgaggaccgtgagggtcccagccccgcccagattcccgggggaggaagttctcaggaaacacgaacgcgggtctgcgttcccgtgcatgtcctaggacagtaacataaggtgaggcagagcacagatgcggcgcagcacgagacatgtttccagaacrcaatggaagaggcctatgaagatggagctgggactgctctggctccaccgacgccctccaaggcctcagtctcagctcagctcccgtctgggactggggttggcaccagcactgcatacggagcctggagccggcctcgggatgctctgcggctacagagtgggcgcccaccaggaggcccccaagggcccaggacctggcttcttccacacgggaagacacagaggagctggagaaggggcttgtcaggctcctccctgagctcagaattgacttcacttctccaaagatctgccaccc

SEQ ID NO: 27745 - DNA, 601 bp, Human
cagatgcggcgcagcacgagacatgtttccagaacacaatggaagaggcctatgaagatggagctgggactgctctggctccaccgacgccctccaaggcctcagtctcagctcagctcccgtctgggactggggttggcaccagcactgcatacggagcctggagccggcctcgggatgctctgcggctacagagtgggcgcccaccaggaggcccccaagggcccaggacctggcttcttccacacgggaagacacagaggagctggagaaggggcttgtcaggctcctccctgagctmagaattgacttcacttctccaaagatctgccaccccgtcctccaaagcctccaaagcaggcttctctccctctccccctgccgtaaggcccccgcaggctctgccgctcccatctttatgtccatgagtgccccatgtttagctcccacttgtacatgtgaacatgcagcatttgattttctgttgctgcattagtctgctgaggataatggcgtgcagctgcatccatgttgctgcaaaagacatgactgttcgtagtgatggctgcacggtatcccatggtgtctatgtaccccattt

SEQ ID NO: 27746 - DNA, 601 bp, Human
cagagtgggcgcccaccaggaggcccccaagggcccaggacctggcttcttccacacgggaagacacagaggagctggagaaggggcttgtcaggctcctccctgagctcagaattgacttcacttctccaaagatctgccaccccgtcctccaaagcctccaaagcaggcttctctccctctccccctgccgtaaggcccccgcaggctctgccgctcccatctttatgtccatgagtgccccatgtttagctcccacttgtacatgtgaacatgcagcatttgattttctgttgctgcrttagtctgctgaggataatggcgtgcagctgcatccatgttgctgcaaaagacatgactgttcgtagtgatggctgcacggtatcccatggtgtctatgtaccccattttctttatccagtccaccgctgatgggcacctgcgttgatttcacatttttgctattgtgaatagcgctgcgatggacatacaggtacatgtatctggctggcaggatgattgcttttctttggggtgtatacccagtaatgggatcactgggtcaaggggaagggcaactcttagctctctgagaaattgc

SEQ ID NO: 27747 - DNA, 601 bp, Human
acttcacttctccaaagatctgccaccccgtcctccaaagcctccaaagcaggcttctctccctctccccctgccgtaaggcccccgcaggctctgccgctcccatctttatgtccatgagtgccccatgtttagctcccacttgtacatgtgaacatgcagcatttgattttctgttgctgcattagtctgctgaggataatggcgtgcagctgcatccatgttgctgcaaaagacatgactgttcgtagtgatggctgcacggtatcccatggtgtctatgtaccccattttctttatscagtccaccgctgatgggcacctgcgttgatttcacatttttgctattgtgaatagcgctgcgatggacatacaggtacatgtatctggctggcaggatgattgcttttctttggggtgtatacccagtaatgggatcactgggtcaaggggaagggcaactcttagctctctgagaaattgccaagctgccctccacggtggctgaacgaatctgcgttcccaccaaccgtgtatctgtgtcacttttctctacagcctcgccagcatctgttatttttcttttttaatgaatatcaaa

SEQ ID NO: 27748 - DNA, 601 bp, Human
ccccgtcctccaaagcctccaaagcaggcttctctccctctccccctgccgtaaggcccccgcaggctctgccgctcccatctttatgtccatgagtgccccatgtttagctcccacttgtacatgtgaacatgcagcatttgattttctgttgctgcattagtctgctgaggataatggcgtgcagctgcatccatgttgctgcaaaagacatgactgttcgtagtgatggctgcacggtatcccatggtgtctatgtaccccattttctttatccagtccaccgctgatgggcacctgygttgatttcacatttttgctattgtgaatagcgctgcgatggacatacaggtacatgtatctggctggcaggatgattgcttttctttggggtgtatacccagtaatgggatcactgggtcaaggggaagggcaactcttagctctctgagaaattgccaagctgccctccacggtggctgaacgaatctgcgttcccaccaaccgtgtatctgtgtcacttttctctacagcctcgccagcatctgttatttttcttttttaatgaatatcaaaaacatttgctgataatcatcaactt

SEQ ID NO: 27749 - DNA, 601 bp, Human
gcaactcttagctctctgagaaattgccaagctgccctccacggtggctgaacgaatctgcgttcccaccaaccgtgtatctgtgtcacttttctctacagcctcgccagcatctgttatttttcttttttaatgaatatcaaaaacatttgctgataatcatcaacttcacttattagcctttctttccctgtctcccatttatcatcttaccagattttttaaattaggaaaacaacacacgcattgcttgacttgttaggatgagcaggtgctacttttaaaattaaaaaaaaaaaaatccagccaagtgatgaaatatggtgtatgggggactgactgctgcaggaggacccggctgcatgcctggcctatgacgctgctatgacgctgccccaaatcttcccagaacacagcagggtgaagcacacggcagcagggtctccagtcacaaagccagtgtcctccagggccctgctgggatcaggagcctcgggaaaacagaaaccgggagaagcgcctttcccgctgtgcttcatgccaggctgactggtcctgtcccaagacccccgctgggccccgcacactcctgggtgggccg

SEQ ID NO: 27750 - DNA, 601 bp, Human
cattgcttgacttgttaggatgagcaggtgctacttttaaaattaaaaaaaaaaaaatccagccaagtgatgaaatatggtgtatgggggactgactgctgcaggaggacccggctgcatgcctggcctatgacgctgctatgacgctgccccaaatcttcccagaacacagcagggtgaagcacacggcagcagggtctccagtcacaaagccagtgtcctccagggccctgctgggatcaggagcctcgggaaaacagaaaccgggagaagcgcctttcccgctgtgcttcatgccagsctgactggtcctgtcccaagacccccgctgggccccgcacactcctgggtgggccgtcctgtcggtgccaggaaggcccgtcctgctccctgctgtctgagcatggagcatgccagcatggggccttggggcttcctgccctcttctgatctcacatgcgctatagctctgggccttggttttggtgagtgagggctggtggcaggatctggacttgctctggggcagtagggactgcctgacagaccccagctaggtaggactagcacccaaatttcccagagccctgccgagtgaggt

SEQ ID NO: 27751 - DNA, 601 bp, Human
ttaaaattaaaaaaaaaaaaatccagccaagtgatgaaatatggtgtatgggggactgactgctgcaggaggacccggctgcatgcctggcctatgacgctgctatgacgctgccccaaatcttcccagaacacagcagggtgaagcacacggcagcagggtctccagtcacaaagccagtgtcctccagggccctgctgggatcaggagcctcgggaaaacagaaaccgggagaagcgcctttcccgctgtgcttcatgccaggctgactggtcctgtcccaagacccccgctgggcccygcacactcctgggtgggccgtcctgtcggtgccaggaaggcccgtcctgctccctgctgtctgagcatggagcatgccagcatggggccttggggcttcctgccctcttctgatctcacatgcgctatagctctgggccttggttttggtgagtgagggctggtggcaggatctggacttgctctggggcagtagggactgcctgacagaccccagctaggtaggactagcacccaaatttcccagagccctgccgagtgaggtggggcagccctcaggctcccacctgaggcctctggc

SEQ ID NO: 27752 - DNA, 601 bp, Human
acgctgctatgacgctgccccaaatcttcccagaacacagcagggtgaagcacacggcagcagggtctccagtcacaaagccagtgtcctccagggccctgctgggatcaggagcctcgggaaaacagaaaccgggagaagcgcctttcccgctgtgcttcatgccaggctgactggtcctgtcccaagacccccgctgggccccgcacactcctgggtgggccgtcctgtcggtgccaggaaggcccgtcctgctccctgctgtctgagcatggagcatgccagcatggggccttggggyttcctgccctcttctgatctcacatgcgctatagctctgggccttggttttggtgagtgagggctggtggcaggatctggacttgctctggggcagtagggactgcctgacagaccccagctaggtaggactagcacccaaatttcccagagccctgccgagtgaggtggggcagccctcaggctcccacctgaggcctctggcaggaggctgataatacaggcctgtgggggagctgccaggtgtggtgctgcagctccaggcctcagcccttcctccttccaccttccatgaaacaag

SEQ ID NO: 27753 - DNA, 601 bp, Human
caggaggctgataatacaggcctgtgggggagctgccaggtgtggtgctgcagctccaggcctcagcccttcctccttccaccttccatgaaacaagcgggtgacggcatctgcacccccgtaggctgctcctgtgtccacgagaacacgataattccattgaatcctgcccacaccccaaaacgtgctcccacaccacgagggcctctcctctcgccatgggtcctctgcgaacccagagatgaggccaatcccagcagggcccaggcacagagaggccgtccttgaaccgaatctgagygagccctgtgccccgcaccactctccccgtcgcctgcacagttgctgtgttagagcggcactgcttcagtgtttttccatgaaagtgacacagcttgatacagcgatggcacaggccagacatgctgcgggggccagaaagacagcccctcctggaaccttgctgctgtcaaataatgcatcgcgagtgccagtgagttttgaaacacagcgtcactcggctctgcagctctgcgcgtgagcaaaaggcgtcatggctccaagcctcagcgttgtctcctgcgtggtgctgctggggtca

SEQ ID NO: 27754 - DNA, 601 bp, Human
accttccatgaaacaagcgggtgacggcatctgcacccccgtaggctgctcctgtgtccacgagaacacgataattccattgaatcctgcccacaccccaaaacgtgctcccacaccacgagggcctctcctctcgccatgggtcctctgcgaacccagagatgaggccaatcccagcagggcccaggcacagagaggccgtccttgaaccgaatctgagtgagccctgtgccccgcaccactctccccgtcgcctgcacagttgctgtgttagagcggcactgcttcagtgtttttccaygaaagtgacacagcttgatacagcgatggcacaggccagacatgctgcgggggccagaaagacagcccctcctggaaccttgctgctgtcaaataatgcatcgcgagtgccagtgagttttgaaacacagcgtcactcggctctgcagctctgcgcgtgagcaaaaggcgtcatggctccaagcctcagcgttgtctcctgcgtggtgctgctggggtcagggcggctctctcacaggaagcgcctgcgatggcagctctactgtactcaacggcatctcagtccccaggatttgcctgc

SEQ ID NO: 27755 - DNA, 601 bp, Human
aaccttgctgctgtcaaataatgcatcgcgagtgccagtgagttttgaaacacagcgtcactcggctctgcagctctgcgcgtgagcaaaaggcgtcatggctccaagcctcagcgttgtctcctgcgtggtgctgctggggtcagggcggctctctcacaggaagcgcctgcgatggcagctctactgtactcaacggcatctcagtccccaggatttgcctgcatgatactgcgctgttcttccaggaaaggtccacgtaaggccagcagtcaccgggggggacacaggctctggggawgggctccctaaacagtgtctgccatggcaaccagcagagctgaccacagcattaaccaaggtgggctggggcccaggaagcatcccatgcggtatggactctggcgacccggggggacagtaatgcctcaggtgcagtccctcccccacggacaaagtgtccccacagctacggttagggctggcgcactccagccgagagtgctcacggcacccagacacatccgggagccccactgcccccaccagctgccccctagacagggcggggctgggctctgctctagggggatcttctgga

SEQ ID NO: 27756 - DNA, 601 bp, Human
ggaccttgggcatttctcttggcctcaacttccttcactcccaaagtagacaacgtgaaatgacccaggtacagaatccagcgtgtggctcagggagaacaaatgtcctcgtccttgtccgccttctgatgtgcaaatccctgaaggaaacctcgagcccttgtggcaggggttggtcccaggctggaggcaggctgcggggacgccaccacccatctttttactcccaggctggaagcaggctgcagggacgccaccgcccatctttttactcccaggctggaggcaggctgcggggacrccatcgcccatctttttactcccaggctagaggtagggaggagggacgccaccacccatcttttgtatctactggctgttgaacatgtaaaggtgtcactcagccaaaaaatgagagaaatgcatttttaaagacctttctgtgcatgccaggcttacagtgggtaaatggtggatagcagttactggcaggagccagaaaatgtttaaaagttaatagattttctccaccaggtcaaagagtaagcacatttttaacaaaaatggtcagtaaccttcccaaaggacacagccatcaccc

SEQ ID NO: 27757 - DNA, 601 bp, Human
aggacctaccgggcagttctaagagacacaggtgttgttaggaagggggtccttttgtgccccccatctctggggttcttgtttcataactctttggagaatctctattccattaaaaaaatgttttctttcttttctgagacagggtcttgctctgttgcccgtgctggagtgcagtgatgtgatcacggcctactgcagcctcaacctcctgggctcaagcgatcttcctgcctcagcctcctaaagtgctggcattacagacatgagccagtgcagcagcctattccaccttaacgcraggatgtggcctgcagaggagggagcagtggaagctgacaggcatccactggtttctgaatgacccaacctgctgtgtatcacccaaggtgggtaaacaaggcggcctgttctggaagggtcacttcacgctttggtcaccatggccctaaactacaagttttacagaccctggccacctgctgacttcatttcttttcagttataaattcaatatgggttccttttttttttttttttttgagatggagtcttgctctgtcacccaagctggagtgcagtggtgcgatctcggctctct

SEQ ID NO: 27758 - DNA, 601 bp, Human
tcctaaagtgctggcattacagacatgagccagtgcagcagcctattccaccttaacgcaaggatgtggcctgcagaggagggagcagtggaagctgacaggcatccactggtttctgaatgacccaacctgctgtgtatcacccaaggtgggtaaacaaggcggcctgttctggaagggtcacttcacgctttggtcaccatggccctaaactacaagttttacagaccctggccacctgctgacttcatttcttttcagttataaattcaatatgggttccttttttttttttttttttgagatggagtcttgctctgtcacccaagctggagtgcagtggtgcgatctcggctctctgcaacctccaccttccaggttcaagcgactctcctgcctcagcctgccaagtagctgggactacaggcgcatgacaccatgcctggccaattttttgtatttttaggatacaccaggtttcactgtattagccaggatggtcttgatctcctgaccttgtaatccacccgtctcagcctcccaaagtgctgggattacaggtgtgagccactgcacctggcccaatctgggtttctttgag

SEQ ID NO: 27759 - DNA, 601 bp, Human
cctgcagaggagggagcagtggaagctgacaggcatccactggtttctgaatgacccaacctgctgtgtatcacccaaggtgggtaaacaaggcggcctgttctggaagggtcacttcacgctttggtcaccatggccctaaactacaagttttacagaccctggccacctgctgacttcatttcttttcagttataaattcaatatgggttccttttttttttttttttttgagatggagtcttgctctgtcacccaagctggagtgcagtggtgcgatctcggctctctgcaacctccrccttccaggttcaagcgactctcctgcctcagcctgccaagtagctgggactacaggcgcatgacaccatgcctggccaattttttgtatttttaggatacaccaggtttcactgtattagccaggatggtcttgatctcctgaccttgtaatccacccgtctcagcctcccaaagtgctgggattacaggtgtgagccactgcacctggcccaatctgggtttctttgagcttgacaggagcccatccttcctgccttctctcctcatcccagggcaggtgtgtctagcaggttcctag

SEQ ID NO: 27760 - DNA, 601 bp, Human
cttcacgctttggtcaccatggccctaaactacaagttttacagaccctggccacctgctgacttcatttcttttcagttataaattcaatatgggttccttttttttttttttttttgagatggagtcttgctctgtcacccaagctggagtgcagtggtgcgatctcggctctctgcaacctccaccttccaggttcaagcgactctcctgcctcagcctgccaagtagctgggactacaggcgcatgacaccatgcctggccaattttttgtatttttaggatacaccaggtttcacygtattagccaggatggtcttgatctcctgaccttgtaatccacccgtctcagcctcccaaagtgctgggattacaggtgtgagccactgcacctggcccaatctgggtttctttgagcttgacaggagcccatccttcctgccttctctcctcatcccagggcaggtgtgtctagcaggttcctagaggagctggcctgaggggcggggctgccccccagcagcaggctgtgaggtgctgggccttcccagagacaggcagatgtggacctgggtccccatagcagcttcattactgaag

SEQ ID NO: 27761 - DNA, 601 bp, Human
tccaggttcaagcgactctcctgcctcagcctgccaagtagctgggactacaggcgcatgacaccatgcctggccaattttttgtatttttaggatacaccaggtttcactgtattagccaggatggtcttgatctcctgaccttgtaatccacccgtctcagcctcccaaagtgctgggattacaggtgtgagccactgcacctggcccaatctgggtttctttgagcttgacaggagcccatccttcctgccttctctcctcatcccagggcaggtgtgtctagcaggttcctagaggmgctggcctgaggggcggggctgccccccagcagcaggctgtgaggtgctgggccttcccagagacaggcagatgtggacctgggtccccatagcagcttcattactgaaggtgacccataacctcatgaaccgacgctagggagaaggggtgacagcagctctctccgtatccacggcctccctgcacaacactcatggcctgagtctccccacagctatggttagggctggcgcactccagccaagagtgctcatggcacccacagacacatccgggagccctactgcccccaccggct

SEQ ID NO: 27762 - DNA, 601 bp, Human
tacaccaggtttcactgtattagccaggatggtcttgatctcctgaccttgtaatccacccgtctcagcctcccaaagtgctgggattacaggtgtgagccactgcacctggcccaatctgggtttctttgagcttgacaggagcccatccttcctgccttctctcctcatcccagggcaggtgtgtctagcaggttcctagaggagctggcctgaggggcggggctgccccccagcagcaggctgtgaggtgctgggccttcccagagacaggcagatgtggacctgggtccccatagcrgcttcattactgaaggtgacccataacctcatgaaccgacgctagggagaaggggtgacagcagctctctccgtatccacggcctccctgcacaacactcatggcctgagtctccccacagctatggttagggctggcgcactccagccaagagtgctcatggcacccacagacacatccgggagccctactgcccccaccggctgccccctagacagggtgggggctgggctctgctctagggcagatggctgggacagggctggaaggttcctggcatgacaaggtgttttataacag

SEQ ID NO: 27763 - DNA, 601 bp, Human
tctttgagcttgacaggagcccatccttcctgccttctctcctcatcccagggcaggtgtgtctagcaggttcctagaggagctggcctgaggggcggggctgccccccagcagcaggctgtgaggtgctgggccttcccagagacaggcagatgtggacctgggtccccatagcagcttcattactgaaggtgacccataacctcatgaaccgacgctagggagaaggggtgacagcagctctctccgtatccacggcctccctgcacaacactcatggcctgagtctccccacagctayggttagggctggcgcactccagccaagagtgctcatggcacccacagacacatccgggagccctactgcccccaccggctgccccctagacagggtgggggctgggctctgctctagggcagatggctgggacagggctggaaggttcctggcatgacaaggtgttttataacaggctattttttccctgtggcttcctggaacatgagagacagccctgtccaagtgtgagaaccaaagcgctttccaaggccaacgatgacccactcaccattgccaccccagcccctcgggaaggcg

SEQ ID NO: 27764 - DNA, 601 bp, Human
gtgctgggccttcccagagacaggcagatgtggacctgggtccccatagcagcttcattactgaaggtgacccataacctcatgaaccgacgctagggagaaggggtgacagcagctctctccgtatccacggcctccctgcacaacactcatggcctgagtctccccacagctatggttagggctggcgcactccagccaagagtgctcatggcacccacagacacatccgggagccctactgcccccaccggctgccccctagacagggtgggggctgggctctgctctagggcagatrgctgggacagggctggaaggttcctggcatgacaaggtgttttataacaggctattttttccctgtggcttcctggaacatgagagacagccctgtccaagtgtgagaaccaaagcgctttccaaggccaacgatgacccactcaccattgccaccccagcccctcgggaaggcgagagcaacttgtggaaaaccaagcagggcgctggcatcactcccacgagtcaggagggagtgctctgagtgcccgcaatggtgtctccgccactctgtgcatccaaggctctcacaacccagagc

SEQ ID NO: 27765 - DNA, 601 bp, Human
aggccacaggaacacggtgccgccgctagagtgggcccccgagtgggacggctgcacgttctcgcacgcaccaggctcggtctgtgtgaagcgtggtgctgcctccacagcatcagccaggactgcatgggcagcaggacaactggccggcggtggcgcccagtggcgagaggaaggggtgcttccgttcgcctccccctgcctggcccttggacctcaccgcatgctggagctgtggaactggggactgacatggtgggggaggggggaacctaaggcctcaccccctgcgtggcccctyccacaaagctcaaaagggcaggagggagcagatgttgcagacagggaggccccggggtggggtgtcaggcaggacagctggagaccccccttcgtcctccccttcccctggcagtggtgcccacatctgcggggccccccacagcacagccagagctggcctcccacagtactccgtatggaccaggcatggtcctgagaccccaccaggctgtactgctactaccccactgatgaggacacgggcccagggacccaggtacatggcgagcatgtgagggaggggtgcagaccacccaca

SEQ ID NO: 27766 - DNA, 601 bp, Human
aggcaggacagctggagaccccccttcgtcctccccttcccctggcagtggtgcccacatctgcggggccccccacagcacagccagagctggcctcccacagtactccgtatggaccaggcatggtcctgagaccccaccaggctgtactgctactaccccactgatgaggacacgggcccagggacccaggtacatggcgagcatgtgagggaggggtgcagaccacccacatgtggaggccacgctcacacccaccccctgcccaggcacagagggcctggcgcccagacacgaggcrcctccaggctgcaggggccttctgcctggcagccggtcttgctcagagatcccaggcaggagaatggggatcagccacactgagtctgagcccaaaggctgaactcagtggggcttgggatttccttctatgtcacacagcccaggtcactgggaagaaaatacccaacgttgctgggcgcagtggctcacacctgtaatcccagcactttgggaggcagaggcgggcggatcacgaggtcaggagatcgagaccatcctggctaacacggtgaaaccccgtctctactaaaaatacaaa

SEQ ID NO: 27767 - DNA, 601 bp, Human
cacttcacggcagttacccgagttttccaatctgtctctgcaaccagaattaatccatgaggcttcacgtcgatggccagttagactgtgctgtgggcttcaagtgagagggacgcttgagaaatgagttatgtttgcactgtgttttttccttacactctacttttggttcttggtttttcgtgaaaaaataaatcatgtcagtctgatgtgttcatgtgcaggggagaagatccccaaaaagcacatgaaagcaaacaatgaaaggtgggtgttgtgtgtgtcattttcagagttaatktggaagtgaaaaagtatcgctgaaacaaactaggcaggaaaacgggcactgacgggcagtgaattctcttgctcggaatgcggctgctggcggcctgaggacacacccagcgtcaacaacctctgtcctcaagactctcccagaatcctgggtcaccacggcctttccatgtgcctcacaccagaaggactctcgaaggtgcccccagccgccctgtgcacccaatgactgcccctcgatctgccccctccccagctggggctctgtccttgaccccatggtgagctcttcgcatgcact

SEQ ID NO: 27768 - DNA, 601 bp, Human
tgttgtttccaaggaagtgttcaggactgtggccccccacacgcagcagccccccaccgagggcaccatggcctggcccctgccaggtggcatggggtgaccgcattccctccccactgtctcgcagaaggaaaacaggctcagagagattaaagcctagctcaaggtcacagcggggggcagtgctgacccaatagcctgtgctcccaccctctgggagcactgtctgcaccacgaaccccactgctcacctcatatgaccccactgcccacctcacatgacctcaccatgcactccacrtgacctcaccgctcccccacgtgactccaccgctcacctgtgacctcactgctcacctcacatgacctcactgtgcactccacgtgacctcaccactcaccccatgtgaccccactgctcacacatgaccctatgtcacctctggcccacatcccatgaccttgcagtccacaaatacacacgtgtccgagtagtgaacactgcaactgcttactatgaatgcatacgagccagctaaacaacagggcccactgcaggaagcaacagcacaggcccccaaggcacagggctgtgacactc

SEQ ID NO: 27769 - DNA, 601 bp, Human
agaatggcgagaacctgggaggtggagcttgcagtgagccgagatcataccactgcactccagcctgggcgacagagcgagactccgtctcaaaaaaaaaaaaaaaaagaaagtgacttgcaaacatcagaaataggtcatcaaacgtgtccccgtttcccactggcacccaaaaaggcaggctaagatctgcacggttagttaccgtcagaagctgtaacccagcgcagtgaccacgagaaagcaagcagtgatgcagacgcttcctgatgacgatgctgacggtgcgggcaggggaagrcgccgggaagccggaccggcccaggctccacaccggcttcggccacggctgttgtcctgttctttgccgtgtgaacaaggaagtagcctgtagggctggagacggacaaggacacacgctcgggggctgctatcacatccacggcgtcggtcctgatggctggaacgcgtcctccatgtgtgcctgtcccctgcatgagggaggccagtgctccctcctcccgaggatccaggggcctcccagaaccccagggaagcctcacattctggtctcctgaatgcaaagccaagagcatcctcc

SEQ ID NO: 27770 - DNA, 601 bp, Human
tgagcactgatgtggcgccaagtgctgcactaagtgctttacgtgcatgaactcagtccacggtacaaacaccttatgaagggggtaccatccccgtccccgtgctgcagatgaggaaaccgaggcaggaaggctgagggacttggtgtaggttccacggccagcaggaggagggaccgggatcaaccccggcagcctggcgggagctgacgtctctctcactcaggaaggtgggctactcttccacgtctcgggtgtcacgggagcagtcagtttctacctggcccgccgggacagggcrtcgggacccctctcggcccttctcttctgcacaaataggtgctttggtggcaaagtgaagacattcactaaatactgctgagtgaggcgatggcgagatggaggcgttgctgcggctttgagctgttctctgtgatacgcggctttacagacgggggctgtggtgggaggaaggcatttgacagggacacgggtggcatggaggtgggggcagctccagccctgctcttctgtcaaatcgcacccagaccactgggcaagaagcatccaggagcagtaacgagagatcccgagctttgcg

SEQ ID NO: 27771 - DNA, 601 bp, Human
gcagatgaggaaaccgaggcaggaaggctgagggacttggtgtaggttccacggccagcaggaggagggaccgggatcaaccccggcagcctggcgggagctgacgtctctctcactcaggaaggtgggctactcttccacgtctcgggtgtcacgggagcagtcagtttctacctggcccgccgggacagggcatcgggacccctctcggcccttctcttctgcacaaataggtgctttggtggcaaagtgaagacattcactaaatactgctgagtgaggcgatggcgagatggaggcrttgctgcggctttgagctgttctctgtgatacgcggctttacagacgggggctgtggtgggaggaaggcatttgacagggacacgggtggcatggaggtgggggcagctccagccctgctcttctgtcaaatcgcacccagaccactgggcaagaagcatccaggagcagtaacgagagatcccgagctttgcggtcccacaggcttgggtttgaatcctcgctccgcccctccctgcgctcaggcagctggcaccaagggagccttcaggagtgccctgtaggacacgcagagctcggc

SEQ ID NO: 27772 - DNA, 601 bp, Human
aggaaaccgaggcaggaaggctgagggacttggtgtaggttccacggccagcaggaggagggaccgggatcaaccccggcagcctggcgggagctgacgtctctctcactcaggaaggtgggctactcttccacgtctcgggtgtcacgggagcagtcagtttctacctggcccgccgggacagggcatcgggacccctctcggcccttctcttctgcacaaataggtgctttggtggcaaagtgaagacattcactaaatactgctgagtgaggcgatggcgagatggaggcgttgctgyggctttgagctgttctctgtgatacgcggctttacagacgggggctgtggtgggaggaaggcatttgacagggacacgggtggcatggaggtgggggcagctccagccctgctcttctgtcaaatcgcacccagaccactgggcaagaagcatccaggagcagtaacgagagatcccgagctttgcggtcccacaggcttgggtttgaatcctcgctccgcccctccctgcgctcaggcagctggcaccaagggagccttcaggagtgccctgtaggacacgcagagctcggctgggtgc

SEQ ID NO: 27773 - DNA, 601 bp, Human
gcgggagctgacgtctctctcactcaggaaggtgggctactcttccacgtctcgggtgtcacgggagcagtcagtttctacctggcccgccgggacagggcatcgggacccctctcggcccttctcttctgcacaaataggtgctttggtggcaaagtgaagacattcactaaatactgctgagtgaggcgatggcgagatggaggcgttgctgcggctttgagctgttctctgtgatacgcggctttacagacgggggctgtggtgggaggaaggcatttgacagggacacgggtggcayggaggtgggggcagctccagccctgctcttctgtcaaatcgcacccagaccactgggcaagaagcatccaggagcagtaacgagagatcccgagctttgcggtcccacaggcttgggtttgaatcctcgctccgcccctccctgcgctcaggcagctggcaccaagggagccttcaggagtgccctgtaggacacgcagagctcggctgggtgcttctgtgtgggggcgcagggcagaccccctcacctgtcccagccgcctctcacctccatttccacagagcagccagagtggccttt

SEQ ID NO: 27774 - DNA, 601 bp, Human
ccgtggccagctctgtgcggggccctgggaggacgccccaccccgaccaccgcacccacaggagatgagcctgtgccacaggggccgagtgaaggaggtgcgggaggtgcgccagggcgggaaggggcatctgctgtttggggagccagcagggcctgggagtggggaagactgacaggtgaggtggctgggagggcccagggacagcagcagcccaggcaccagggcagggggcagaggctgcttagtggacagagaccaggccaggtggcctctcacgccctttatcctatgggagggraaggcaagaggcaaggtataaggtggcaagtgggcatccttcaattcatctgtggagtcagcgcctaactcggcgtcaggcacaaagagatagtccatgagccagcccaggacaagctgcatgcggggcctcccaccaccactgctgccccggctggaactgccaagggtcccctcaccgaggcacggtgcgtttcctggtgggaatgacagaaaatcaggaggccaggggagccctccacctgtgtgtttacctgcagagtccaagcagtcggcaacactggagacctcaaacttctgg

SEQ ID NO: 27775 - DNA, 601 bp, Human
cccaggcaccagggcagggggcagaggctgcttagtggacagagaccaggccaggtggcctctcacgccctttatcctatgggaggggaaggcaagaggcaaggtataaggtggcaagtgggcatccttcaattcatctgtggagtcagcgcctaactcggcgtcaggcacaaagagatagtccatgagccagcccaggacaagctgcatgcggggcctcccaccaccactgctgccccggctggaactgccaagggtcccctcaccgaggcacggtgcgtttcctggtgggaatgacagraaatcaggaggccaggggagccctccacctgtgtgtttacctgcagagtccaagcagtcggcaacactggagacctcaaacttctggtcaaggatgccgggataggcgtccagaaagtccactgacttcagcggactgcggaagcaagctccatctaggacacacattccagtgactttggtggaagacgggaacccaaaccattgggaaccccaagctgggggcaccccaaagcacagagagtgtccagaggacccgacggccacagacccacaggcgagggtctgggtctcaaggacc

SEQ ID NO: 27776 - DNA, 601 bp, Human
cagcccaggacaagctgcatgcggggcctcccaccaccactgctgccccggctggaactgccaagggtcccctcaccgaggcacggtgcgtttcctggtgggaatgacagaaaatcaggaggccaggggagccctccacctgtgtgtttacctgcagagtccaagcagtcggcaacactggagacctcaaacttctggtcaaggatgccgggataggcgtccagaaagtccactgacttcagcggactgcggaagcaagctccatctaggacacacattccagtgactttggtggaagacrggaacccaaaccattgggaaccccaagctgggggcaccccaaagcacagagagtgtccagaggacccgacggccacagacccacaggcgagggtctgggtctcaaggaccctccccaccccagcctttgcccatgccttggggagttggtcggcactatctaataacatttctttccttctgcaaacctaggatgcattcacagaacagctgaatcagtgaggccaggagaacccacccctgccccagttgggttccagcgcccccaccagtgtgcagcagagcctcaccgtggacctgg

SEQ ID NO: 27777 - DNA, 601 bp, Human
taaaaagccttaagaggctgggtgcggtggctcacacctgtaatggcagcactttggggggccgaggcgggtggatcacttgaagccaggtgttcaagaccagcctgaccaacatggtgaaacccacctctactaaaaatacaaaaatagccaggtgtggtggtgtgtgcctgtaatctcagctactcgggaggctgaggcaggagaatcgcttgagcctgggaggcggaggttgcagtgagccgagattgcgcaactgcactccagcccgggtgacagagcaagaccctgtctcaacaamaaaaaaaaaaaaaaaaaagccatgagtttgagaccagcctgggcaacatagtgagaccctatctctataaaaaatgaaaaaaaaaattagctgggcatagtggcacgcacctttagtcccagctacccaggaggctgaggtgggaggattgcttaagagcccaggcatttgaggcaaaagtaagccatggtcatgccactgtactccagcctccgggacagggcaagactctgaccaaaaaaaaaaaagccctgaactcagcttgaccagacacaaagaactgccacctgtgcttcatat

SEQ ID NO: 27778 - DNA, 601 bp, Human
aaagccttaagaggctgggtgcggtggctcacacctgtaatggcagcactttggggggccgaggcgggtggatcacttgaagccaggtgttcaagaccagcctgaccaacatggtgaaacccacctctactaaaaatacaaaaatagccaggtgtggtggtgtgtgcctgtaatctcagctactcgggaggctgaggcaggagaatcgcttgagcctgggaggcggaggttgcagtgagccgagattgcgcaactgcactccagcccgggtgacagagcaagaccctgtctcaacaaaaamaaaaaaaaaaaaaaagccatgagtttgagaccagcctgggcaacatagtgagaccctatctctataaaaaatgaaaaaaaaaattagctgggcatagtggcacgcacctttagtcccagctacccaggaggctgaggtgggaggattgcttaagagcccaggcatttgaggcaaaagtaagccatggtcatgccactgtactccagcctccgggacagggcaagactctgaccaaaaaaaaaaaagccctgaactcagcttgaccagacacaaagaactgccacctgtgcttcatatccc

SEQ ID NO: 27779 - DNA, 601 bp, Human
gccttaagaggctgggtgcggtggctcacacctgtaatggcagcactttggggggccgaggcgggtggatcacttgaagccaggtgttcaagaccagcctgaccaacatggtgaaacccacctctactaaaaatacaaaaatagccaggtgtggtggtgtgtgcctgtaatctcagctactcgggaggctgaggcaggagaatcgcttgagcctgggaggcggaggttgcagtgagccgagattgcgcaactgcactccagcccgggtgacagagcaagaccctgtctcaacaaaaaaaamaaaaaaaaaaaagccatgagtttgagaccagcctgggcaacatagtgagaccctatctctataaaaaatgaaaaaaaaaattagctgggcatagtggcacgcacctttagtcccagctacccaggaggctgaggtgggaggattgcttaagagcccaggcatttgaggcaaaagtaagccatggtcatgccactgtactccagcctccgggacagggcaagactctgaccaaaaaaaaaaaagccctgaactcagcttgaccagacacaaagaactgccacctgtgcttcatatcccacc

SEQ ID NO: 27780 - DNA, 601 bp, Human
ttaagaggctgggtgcggtggctcacacctgtaatggcagcactttggggggccgaggcgggtggatcacttgaagccaggtgttcaagaccagcctgaccaacatggtgaaacccacctctactaaaaatacaaaaatagccaggtgtggtggtgtgtgcctgtaatctcagctactcgggaggctgaggcaggagaatcgcttgagcctgggaggcggaggttgcagtgagccgagattgcgcaactgcactccagcccgggtgacagagcaagaccctgtctcaacaaaaaaaaaaamaaaaaaaaagccatgagtttgagaccagcctgggcaacatagtgagaccctatctctataaaaaatgaaaaaaaaaattagctgggcatagtggcacgcacctttagtcccagctacccaggaggctgaggtgggaggattgcttaagagcccaggcatttgaggcaaaagtaagccatggtcatgccactgtactccagcctccgggacagggcaagactctgaccaaaaaaaaaaaagccctgaactcagcttgaccagacacaaagaactgccacctgtgcttcatatcccacctcc

SEQ ID NO: 27781 - DNA, 601 bp, Human
caggtgttcaagaccagcctgaccaacatggtgaaacccacctctactaaaaatacaaaaatagccaggtgtggtggtgtgtgcctgtaatctcagctactcgggaggctgaggcaggagaatcgcttgagcctgggaggcggaggttgcagtgagccgagattgcgcaactgcactccagcccgggtgacagagcaagaccctgtctcaacaaaaaaaaaaaaaaaaaaaaagccatgagtttgagaccagcctgggcaacatagtgagaccctatctctataaaaaatgaaaaaaaaaattagctgggcatagtggcacgcacctttagtcccagctacccaggaggctgaggtgggaggattgcttaagagcccaggcatttgaggcaaaagtaagccatggtcatgccactgtactccagcctccgggacagggcaagactctgaccaaaaaaaaaaaagccctgaactcagcttgaccagacacaaagaactgccacctgtgcttcatatcccacctccagctcctcactgctgtcagcaagccctgcagagccccccctggcatggggtcgctgataggagggagccatctcagc

SEQ ID NO: 27782 - DNA, 601 bp, Human
gggatgggcctagcaggaagggagtggagctgacttctcacactcacgtactgtgactgatggatcctgagagcatgaaaggagtcctattgcagccatactgccaacacgcttgtgattagccttgtgatcacctagaacacctgattttctcctgacttactgtcaaatcatgccacgagcttcctgccacgtaacaggttggccactgaacaagagctgggagaggcctcagcagaaacatttgcaattgattttctaaacctagatggagcctcggtcatattggtctcaatcccarcatatgtatatgtatgtgtatatgtatatgtatgtgtatatgtatatgtatatgtatatgtatatgtattaatcttgattccatcgtctttgttgtctgcagtactgcaagattcaatttccttattcaactatttatagaatcccgatgagttacaaagacaaaaactactaagggcattgcgcagaggacaaagcatgcaaatgagtaacttgtgtacagccatggctacccgcatgtcagtaagtgacaaagacagattgtggtgggagtgaggggccacgttgctaacagcccatg

SEQ ID NO: 27783 - DNA, 601 bp, Human
ctcacgtccaagctctgcctttgggtgagggaatccaacaagaacaggtgaaaagagactttagacaccaaaaagtcataagtcagcaatagcatcaaaccaccatatcacctctagtctaatacaagacatcccgaaaatgacagaagaggaaacctaattgtaattagaaataaaaaagggtctttatccaagtatggatacactgtggtatgctcataccatttcacaacaatgaaaacacagctctacacagcaaatagctctcagggccctaacacgggtcccagaagcaaactgyagaagaatgtgcgtcatggcccactttatataaagttcacaaacgtcaaagtgaatgacacaccatggaaggttgcaattgtttgcagggaaaccatgaagaaaggccagggaaccagactcagcaccgcagacagtgctcgctcccaggacagggaagggccgggaccagtccattcccagaaggctgcaagcgcctcggtaactgatggtctgctctgtgtgggggctcaccgtgcctccctcaggcctaacatgttttattgagactcctttgctgtccatggccaaactaccctga

SEQ ID NO: 27784 - DNA, 601 bp, Human
tagcatcaaaccaccatatcacctctagtctaatacaagacatcccgaaaatgacagaagaggaaacctaattgtaattagaaataaaaaagggtctttatccaagtatggatacactgtggtatgctcataccatttcacaacaatgaaaacacagctctacacagcaaatagctctcagggccctaacacgggtcccagaagcaaactgcagaagaatgtgcgtcatggcccactttatataaagttcacaaacgtcaaagtgaatgacacaccatggaaggttgcaattgtttgcagsgaaaccatgaagaaaggccagggaaccagactcagcaccgcagacagtgctcgctcccaggacagggaagggccgggaccagtccattcccagaaggctgcaagcgcctcggtaactgatggtctgctctgtgtgggggctcaccgtgcctccctcaggcctaacatgttttattgagactcctttgctgtccatggccaaactaccctgaatgagcctgatctcgtgaagctaagcagggtcgggcgtggttagtatttggatgggagaccgcctgggaatagcaggtgctgcaggctt

SEQ ID NO: 27785 - DNA, 601 bp, Human
ttgcaattgtttgcagggaaaccatgaagaaaggccagggaaccagactcagcaccgcagacagtgctcgctcccaggacagggaagggccgggaccagtccattcccagaaggctgcaagcgcctcggtaactgatggtctgctctgtgtgggggctcaccgtgcctccctcaggcctaacatgttttattgagactcctttgctgtccatggccaaactaccctgaatgagcctgatctcgtgaagctaagcagggtcgggcgtggttagtatttggatgggagaccgcctgggaatascaggtgctgcaggcttttttttaaggggaaaaaaaaaagaaagaagactcctttgcttctgcttgatatctaatgatgaaaacttaagaggctgggccaggcacagtggctcacgcctataatgccagcactttgagaggccgaggcgggcagatcagttgagctcaggagtctgagaacagcctgggcaacatggtgacaccctgtctctactgaaaaataaaaaaaattagccaggtgtggtggcgggcacctgtagtcccagctagtctgggaggctgaggcaagagaattgcttga

SEQ ID NO: 27786 - DNA, 601 bp, Human
catgaagaaaggccagggaaccagactcagcaccgcagacagtgctcgctcccaggacagggaagggccgggaccagtccattcccagaaggctgcaagcgcctcggtaactgatggtctgctctgtgtgggggctcaccgtgcctccctcaggcctaacatgttttattgagactcctttgctgtccatggccaaactaccctgaatgagcctgatctcgtgaagctaagcagggtcgggcgtggttagtatttggatgggagaccgcctgggaatagcaggtgctgcaggcttttttttaaggggaaaaaaaaaagaaagaagactcctttgcttctgcttgatatctaatgatgaaaacttaagaggctgggccaggcacagtggctcacgcctataatgccagcactttgagaggccgaggcgggcagatcagttgagctcaggagtctgagaacagcctgggcaacatggtgacaccctgtctctactgaaaaataaaaaaaattagccaggtgtggtggcgggcacctgtagtcccagctagtctgggaggctgaggcaagagaattgcttgaacccaggaggcagaaattgcag

SEQ ID NO: 27787 - DNA, 601 bp, Human
aaaggccagggaaccagactcagcaccgcagacagtgctcgctcccaggacagggaagggccgggaccagtccattcccagaaggctgcaagcgcctcggtaactgatggtctgctctgtgtgggggctcaccgtgcctccctcaggcctaacatgttttattgagactcctttgctgtccatggccaaactaccctgaatgagcctgatctcgtgaagctaagcagggtcgggcgtggttagtatttggatgggagaccgcctgggaatagcaggtgctgcaggcttttttttaaggggraaaaaaaaagaaagaagactcctttgcttctgcttgatatctaatgatgaaaacttaagaggctgggccaggcacagtggctcacgcctataatgccagcactttgagaggccgaggcgggcagatcagttgagctcaggagtctgagaacagcctgggcaacatggtgacaccctgtctctactgaaaaataaaaaaaattagccaggtgtggtggcgggcacctgtagtcccagctagtctgggaggctgaggcaagagaattgcttgaacccaggaggcagaaattgcagtgagcca

SEQ ID NO: 27788 - DNA, 601 bp, Human
aaccctcttagctgtgaagaccaaacccagagcacagggcacgttcgctgtgacagttcatcccccttccatgtaacaatgtctgtgcttttccacgctgctgcctgggctgcatctgtgcatgtcaacagctgccccatctctggggacgtgtagggccaacgctctgtgcccacgccactgttctaaatgccatcacagtgaacagggctgcacgctcagctgctgcttcttccagatcacctgccaggaatcatttcttagggatgggatgaaagtgtcaaagagtgtgcacagggcrtgcaaggccactacccgccaagctgtggcggcctcacctgaacgtgcggccgtgcacacacccacctcccagagccgccccatccttgcttctttctggccgggcacagtgactcatgcccataatcccagcactttgggaggctgaggcaggtggatcactggaggtcaggagttcgagaccggcctggccaaaacagcagaaccctgtctctactaacaatacaaaaattagccgggcatggtggtgcatgcccataatcccagctactcgggaggctgagacacgagaatcacttga

SEQ ID NO: 27789 - DNA, 601 bp, Human
tgcctgggctgcatctgtgcatgtcaacagctgccccatctctggggacgtgtagggccaacgctctgtgcccacgccactgttctaaatgccatcacagtgaacagggctgcacgctcagctgctgcttcttccagatcacctgccaggaatcatttcttagggatgggatgaaagtgtcaaagagtgtgcacagggcatgcaaggccactacccgccaagctgtggcggcctcacctgaacgtgcggccgtgcacacacccacctcccagagccgccccatccttgcttctttctggcygggcacagtgactcatgcccataatcccagcactttgggaggctgaggcaggtggatcactggaggtcaggagttcgagaccggcctggccaaaacagcagaaccctgtctctactaacaatacaaaaattagccgggcatggtggtgcatgcccataatcccagctactcgggaggctgagacacgagaatcacttgaacctgggaggcggaggttgcagtgagccaagatcatgcccactgcactccagccttggtgacagagcaaggctccgtctgggaaaaaaaaaaaaaaaaaaa

SEQ ID NO: 27790 - DNA, 601 bp, Human
agagacagtgaaaggatgcttgaaaacctcatacctgcattggatactcaagcactggtatttcctcctcctctgtgggtccaaactgacgccgagtggctgagaagcgaagagcgatggccacggccagctttaggttaaggatggccaggctcacgatggagacccggcccgaggacaggctccccagggacgctccaaagcgctgcctgacgtcctacgggagggacacagatgataagctcaagcccggctgcgcggccaccttgggcagagtggctcagaggcgaaggtgccctcrtttgttcatccaaagtagacctgtgcccacctgcccaggccccatccccagggcgcccaagacacaggacggtgcggcaggcgggtagagatgtcactgatgaaccgtggatggaatgggggtgccggggaggggacacccagctgcctggagaaggtacagtcctagcagagggaatggtatgacagcgctgggtgagggtgctcccactgtggggacttgcaaaccatctgcctggagattccaaggcccacctttaaccttggcaagaatcagatgtggcctgtactgccagagggc

SEQ ID NO: 27791 - DNA, 601 bp, Human
cagctttaggttaaggatggccaggctcacgatggagacccggcccgaggacaggctccccagggacgctccaaagcgctgcctgacgtcctacgggagggacacagatgataagctcaagcccggctgcgcggccaccttgggcagagtggctcagaggcgaaggtgccctcgtttgttcatccaaagtagacctgtgcccacctgcccaggccccatccccagggcgcccaagacacaggacggtgcggcaggcgggtagagatgtcactgatgaaccgtggatggaatgggggtgccrgggaggggacacccagctgcctggagaaggtacagtcctagcagagggaatggtatgacagcgctgggtgagggtgctcccactgtggggacttgcaaaccatctgcctggagattccaaggcccacctttaaccttggcaagaatcagatgtggcctgtactgccagagggcaggggcggagtccattacaggcagccattccagggggtttcacggacacctcttgatccttgtgtgcctgtgaacaggcagttcctttacgtgcgtctagctggaatcttccgtccactatctcctc

SEQ ID NO: 27792 - DNA, 601 bp, Human
ccaaagcgctgcctgacgtcctacgggagggacacagatgataagctcaagcccggctgcgcggccaccttgggcagagtggctcagaggcgaaggtgccctcgtttgttcatccaaagtagacctgtgcccacctgcccaggccccatccccagggcgcccaagacacaggacggtgcggcaggcgggtagagatgtcactgatgaaccgtggatggaatgggggtgccggggaggggacacccagctgcctggagaaggtacagtcctagcagagggaatggtatgacagcgctgggtragggtgctcccactgtggggacttgcaaaccatctgcctggagattccaaggcccacctttaaccttggcaagaatcagatgtggcctgtactgccagagggcaggggcggagtccattacaggcagccattccagggggtttcacggacacctcttgatccttgtgtgcctgtgaacaggcagttcctttacgtgcgtctagctggaatcttccgtccactatctcctcgcacgcatcagcggcgtcagcagaggctgttgctaaggcctgtccaggctgcggtgggcacatctaatct

SEQ ID NO: 27793 - DNA, 601 bp, Human
acgtcctacgggagggacacagatgataagctcaagcccggctgcgcggccaccttgggcagagtggctcagaggcgaaggtgccctcgtttgttcatccaaagtagacctgtgcccacctgcccaggccccatccccagggcgcccaagacacaggacggtgcggcaggcgggtagagatgtcactgatgaaccgtggatggaatgggggtgccggggaggggacacccagctgcctggagaaggtacagtcctagcagagggaatggtatgacagcgctgggtgagggtgctcccactktggggacttgcaaaccatctgcctggagattccaaggcccacctttaaccttggcaagaatcagatgtggcctgtactgccagagggcaggggcggagtccattacaggcagccattccagggggtttcacggacacctcttgatccttgtgtgcctgtgaacaggcagttcctttacgtgcgtctagctggaatcttccgtccactatctcctcgcacgcatcagcggcgtcagcagaggctgttgctaaggcctgtccaggctgcggtgggcacatctaatctacagcccttgccacg

SEQ ID NO: 27794 - DNA, 601 bp, Human
ggggacttgcaaaccatctgcctggagattccaaggcccacctttaaccttggcaagaatcagatgtggcctgtactgccagagggcaggggcggagtccattacaggcagccattccagggggtttcacggacacctcttgatccttgtgtgcctgtgaacaggcagttcctttacgtgcgtctagctggaatcttccgtccactatctcctcgcacgcatcagcggcgtcagcagaggctgttgctaaggcctgtccaggctgcggtgggcacatctaatctacagcccttgccacgtratctgaccgtccttcctgccctgccccgtgctgccccatcgggccactcctctgaccatctaggtccttcttccaaggcagcatggtaattgtgtgtctgagcgtattaatcacactctcacataggaatcacagtctcgttgtgtttaaaaatgtatttaagccgggtgcggcggctcacgcctgtaatcccaatgctttgggaggctgaggtgggcagatcacctgaggtcaggagttcaagaccagcctggccaacatggtgaaacaccgtctctactaaaagtacgcaaattagcc

SEQ ID NO: 27795 - DNA, 601 bp, Human
tccagggggtttcacggacacctcttgatccttgtgtgcctgtgaacaggcagttcctttacgtgcgtctagctggaatcttccgtccactatctcctcgcacgcatcagcggcgtcagcagaggctgttgctaaggcctgtccaggctgcggtgggcacatctaatctacagcccttgccacgtgatctgaccgtccttcctgccctgccccgtgctgccccatcgggccactcctctgaccatctaggtccttcttccaaggcagcatggtaattgtgtgtctgagcgtattaatcacwctctcacataggaatcacagtctcgttgtgtttaaaaatgtatttaagccgggtgcggcggctcacgcctgtaatcccaatgctttgggaggctgaggtgggcagatcacctgaggtcaggagttcaagaccagcctggccaacatggtgaaacaccgtctctactaaaagtacgcaaattagccaggcctggcggcgggtgcctgtagtcccagctactcaggaggctgatgcaggagaatcacttgaacccgggaggcagaggagaggttgcagtgagctgagatcgtgctgttgcac

SEQ ID NO: 27796 - DNA, 601 bp, Human
tgtgaacaggcagttcctttacgtgcgtctagctggaatcttccgtccactatctcctcgcacgcatcagcggcgtcagcagaggctgttgctaaggcctgtccaggctgcggtgggcacatctaatctacagcccttgccacgtgatctgaccgtccttcctgccctgccccgtgctgccccatcgggccactcctctgaccatctaggtccttcttccaaggcagcatggtaattgtgtgtctgagcgtattaatcacactctcacataggaatcacagtctcgttgtgtttaaaaatrtatttaagccgggtgcggcggctcacgcctgtaatcccaatgctttgggaggctgaggtgggcagatcacctgaggtcaggagttcaagaccagcctggccaacatggtgaaacaccgtctctactaaaagtacgcaaattagccaggcctggcggcgggtgcctgtagtcccagctactcaggaggctgatgcaggagaatcacttgaacccgggaggcagaggagaggttgcagtgagctgagatcgtgctgttgcactgcagcctgggtgacagagcaacactccacctcaaaaaat

SEQ ID NO: 27797 - DNA, 601 bp, Human
agcccttgccacgtgatctgaccgtccttcctgccctgccccgtgctgccccatcgggccactcctctgaccatctaggtccttcttccaaggcagcatggtaattgtgtgtctgagcgtattaatcacactctcacataggaatcacagtctcgttgtgtttaaaaatgtatttaagccgggtgcggcggctcacgcctgtaatcccaatgctttgggaggctgaggtgggcagatcacctgaggtcaggagttcaagaccagcctggccaacatggtgaaacaccgtctctactaaaartacgcaaattagccaggcctggcggcgggtgcctgtagtcccagctactcaggaggctgatgcaggagaatcacttgaacccgggaggcagaggagaggttgcagtgagctgagatcgtgctgttgcactgcagcctgggtgacagagcaacactccacctcaaaaaatatatataaatatatatttaaagtgattttcctttaagggtataaaatatgattccactgtcttcatgcattcactgtcatgtttgagaaatctgaagttcaagtgttttttattccactggagtcagatct

SEQ ID NO: 27798 - DNA, 601 bp, Human
ttctagaattttctcttagaaattcctcaatttctctaccgtgtgtctgggtacgtgcataggtgcttccttacttttcctctttggtcctccaagagtcccttcaaccaaaagccttcttcccctctcatttagagacatttctctcctttatttctctaaacttcatttctttctttctttctcttttgagacagggtctcgctctgttgcccacgctggagtgcagtgatgcaatcatagctcactgcagcctgacttcctgggctctagtgatcctcccacctcccaccaagtaacrgaccacaggcacacgctaccatgcccggctaatttttgcatttttagtagagacggggttttgccatattgcccaggctggtctggaactcctgggctcaagcgatctgcccactttggcctcccacagtgctagggttacgggcgtgagccactgcacccagccttcattttctttaatcctctccttctgccttctagaggacaagcttccaatccctaattcatcctcctgagatagttatcccaaatgctgtgcctgttcttccaatcatttatttttaattgatgttggattaac

SEQ ID NO: 27799 - DNA, 601 bp, Human
caggcacacgctaccatgcccggctaatttttgcatttttagtagagacggggttttgccatattgcccaggctggtctggaactcctgggctcaagcgatctgcccactttggcctcccacagtgctagggttacgggcgtgagccactgcacccagccttcattttctttaatcctctccttctgccttctagaggacaagcttccaatccctaattcatcctcctgagatagttatcccaaatgctgtgcctgttcttccaatcatttatttttaattgatgttggattaacatctcygtttgtgagcagctcctggtctcgtgttgctgttcccactctgcgcaccctgtgtgtctctgggcatccccatcatgctccttttccatccgtgcttcctgatgtcagatgctgcatgctgctggggactgttattccaagggtgcatgctcggggtggcccacctgctgtgagctcatgattcctgagggtcatcagctatgacctgggccatcgctccccaggaccacggtctctcttctgctctccgtgaacttaagccaggcgtgagttctggacaccggggaactctgtttgtcg

SEQ ID NO: 27800 - DNA, 601 bp, Human
ctggtctcgtgttgctgttcccactctgcgcaccctgtgtgtctctgggcatccccatcatgctccttttccatccgtgcttcctgatgtcagatgctgcatgctgctggggactgttattccaagggtgcatgctcggggtggcccacctgctgtgagctcatgattcctgagggtcatcagctatgacctgggccatcgctccccaggaccacggtctctcttctgctctccgtgaacttaagccaggcgtgagttctggacaccggggaactctgtttgtcgtccccctttgtggacrgttcgccaggagacccgtctccttcaaatcctcagggaagcatcactggaagcgagcagtcctctaatcgcagcccccgatggggagtgggcattgtaaggcccggactcaccccctggacaccagcacctggtgctgtggctgccccaagagtccccttctagtgggagcaccagaacccgagccaggagaagtatgccccagcgacacctggcctacgtggaggggtctcctttccaggtgcagggaggagcacagagccaggccctgcagaggaaggcacctgggaagcacggcaca

SEQ ID NO: 27801 - DNA, 601 bp, Human
attcctgagggtcatcagctatgacctgggccatcgctccccaggaccacggtctctcttctgctctccgtgaacttaagccaggcgtgagttctggacaccggggaactctgtttgtcgtccccctttgtggacggttcgccaggagacccgtctccttcaaatcctcagggaagcatcactggaagcgagcagtcctctaatcgcagcccccgatggggagtgggcattgtaaggcccggactcaccccctggacaccagcacctggtgctgtggctgccccaagagtccccttctagygggagcaccagaacccgagccaggagaagtatgccccagcgacacctggcctacgtggaggggtctcctttccaggtgcagggaggagcacagagccaggccctgcagaggaaggcacctgggaagcacggcacacgaacggccccccatgcctgtaccttaaaggggctgacataggtgccctcgggggtgacgtctcccatccggttcagaaggctctggcgaggaactctgaccttgtggaacatggcgaaactgtggggaagcagcagggcttctgttaaacaggggtcctgccct

SEQ ID NO: 27802 - DNA, 601 bp, Human
agagggcaagtagacaggaacattcaaccaactttctattcaaaaaagtagtctagtcaggaacagtggctcacgcccagaatcccaactctttggaagactgaggcaggaggattgcttgagcccaggagtttgagaccagcctgggcaacacagtgagaccctgtttctaaaaaagaaaaaaatgtaggttaaaaaataggctgggtgtggtggcttacgcctgtaatcccagcactttgggaggccgaggtgggtggatcacctcaggtcaggagttcgaaaccagcctgaccaatayggtgaaaccccgtctctactaaaaatacaaaaaaaaattagccaggagtggtggcatgtgcctgtagtcccagctactcaggaggctgagacaggagaattgtttgaacccgggcggcggaagttgcagtgagccaagatcacgccactgcactccagccttggtgacagagcaagactccacctcaataataataataataataataataataataaaagcattgtgtatatggtaagttgtactccaagtacagaactccagatattcaacagaaaagacgggaactgtgtttccaaa

SEQ ID NO: 27803 - DNA, 601 bp, Human
aggtttaaaactcttcagtcaaacaaaataactggtgtgatggcattggtgctccctcggcaaggaaattcacttcttttgaacagctgagcataggattacacacacattgttatggatcatgatgtattaataaccaaagatacctgttatggttgtctggtcaggaaaacctattacacaacagtctagggaataaggctatgctaggttaagaatattacataaactgtgcaaaaaccccccaaaacaaacttcaaaatatcaatagttcctatagcaacttgtctgattcctaagwtcacttgcaatgccttagggcagcagtccgcaacctttttggcaccagggaccggttttatggaagacaatttttccacgaatgagggggaggtgggagtggtttcgggatgattcaagcacattatatttattgtgcactttatttctattattattacatggtaacacataatgaaatgattatacaattagccataatgcaaaattgcaaaatcagtgggagcctgagcttgttttcctgcaactagatggtcccatctgggggtgatgggaggcagtgacagatcatcaggtatta

SEQ ID NO: 27804 - DNA, 601 bp, Human
tgggaggcagtgacagatcatcaggtattagattctcataaggagcgctcgccttagatccctcacatgcgcagttcacagtaggattcacgctcctataagaatctaatgccgccaccgatctgacaggaggcggagctcaggcagtcatgtgagcaatggggagtggctataaacacagaggaagctttgctggctcacccgatgctcacctcctgctgggtggcctagttcctaacaggccacagactagtaccacggggttggggacccctgcctacagaatagtcttttactaaaycacagaagactcatctataaagaataatctcacatgctggaagggaaccagaggcacccgtttcctgcgtgggctcttccttgagtcctgctcaggatgcccccacacccccattgtcacccggtcctgggctgccagctctgctgtgctggcccgattcactttctcccctccatccccacctaggacccagcacctccatccctactcagctctcctgggctgatttcctgcagcaaccatattggctctttcctaactctgcctcttcagcccatcctccctgtgggagctgggccg

SEQ ID NO: 27805 - DNA, 601 bp, Human
ttagatccctcacatgcgcagttcacagtaggattcacgctcctataagaatctaatgccgccaccgatctgacaggaggcggagctcaggcagtcatgtgagcaatggggagtggctataaacacagaggaagctttgctggctcacccgatgctcacctcctgctgggtggcctagttcctaacaggccacagactagtaccacggggttggggacccctgcctacagaatagtcttttactaaaccacagaagactcatctataaagaataatctcacatgctggaagggaaccagargcacccgtttcctgcgtgggctcttccttgagtcctgctcaggatgcccccacacccccattgtcacccggtcctgggctgccagctctgctgtgctggcccgattcactttctcccctccatccccacctaggacccagcacctccatccctactcagctctcctgggctgatttcctgcagcaaccatattggctctttcctaactctgcctcttcagcccatcctccctgtgggagctgggccgtttcccaaaggccttcggaatggcggaggccaatgtggaggatccccccaagc

SEQ ID NO: 27806 - DNA, 601 bp, Human
agaatctaatgccgccaccgatctgacaggaggcggagctcaggcagtcatgtgagcaatggggagtggctataaacacagaggaagctttgctggctcacccgatgctcacctcctgctgggtggcctagttcctaacaggccacagactagtaccacggggttggggacccctgcctacagaatagtcttttactaaaccacagaagactcatctataaagaataatctcacatgctggaagggaaccagaggcacccgtttcctgcgtgggctcttccttgagtcctgctcaggatgmccccacacccccattgtcacccggtcctgggctgccagctctgctgtgctggcccgattcactttctcccctccatccccacctaggacccagcacctccatccctactcagctctcctgggctgatttcctgcagcaaccatattggctctttcctaactctgcctcttcagcccatcctccctgtgggagctgggccgtttcccaaaggccttcggaatggcggaggccaatgtggaggatccccccaagctgacctccatctgcccctctaattgcatcgccaccttgccatgaggt

SEQ ID NO: 27807 - DNA, 601 bp, Human
ggacggggctggagctccttagggaaacctgggtgacctggtgagggaagagctctcggctgctttgccaggcccctgcccacctgcaggaagtgaagggcagcgggggggccagctcctccaaagccctaggcccagctgcccagtttggtagcagcttcccccatgccacagccgcacactcagaacaccccacctcgtgagaaaaaccttgcctcggtgccaatggccccagcgtgctccagcctgttacttgaaagccaaggaatgccttttccagtatgatccggtcacagtcagygccctttttaaggagtggaaattattcccccattctcaccacacagaatatatttatacttgcaaaaacattcccgtgagtttcaaaggaaagcaaacttccacgaattctcaggggatcccttctgttccacaaaagctattacagtggtggtcacatgtggccaactcaaatacaagccagatccagtgtctccagcgggagacgtgtgcgtgtgtcacaggtgtgtgtgtgcacagcacaggagttgtgtgtgtgtgtcactggacatgcacgtggcacgggaggcctgagtgtggc

SEQ ID NO: 27808 - DNA, 601 bp, Human
gctcctccaaagccctaggcccagctgcccagtttggtagcagcttcccccatgccacagccgcacactcagaacaccccacctcgtgagaaaaaccttgcctcggtgccaatggccccagcgtgctccagcctgttacttgaaagccaaggaatgccttttccagtatgatccggtcacagtcagcgccctttttaaggagtggaaattattcccccattctcaccacacagaatatatttatacttgcaaaaacattcccgtgagtttcaaaggaaagcaaacttccacgaattctcargggatcccttctgttccacaaaagctattacagtggtggtcacatgtggccaactcaaatacaagccagatccagtgtctccagcgggagacgtgtgcgtgtgtcacaggtgtgtgtgtgcacagcacaggagttgtgtgtgtgtgtcactggacatgcacgtggcacgggaggcctgagtgtggcacagaaaccctcactccaatcccagaagcgcccagacctcagcacacaccccgcgccctggacatcctgcttcttattgcagcagcttccttcctcctttggggcctggaaggg

SEQ ID NO: 27809 - DNA, 601 bp, Human
ctgcacgccccatccaacccttcagccaggccttggccacaccaacccggtgtcacatgtgtgctgctaaatagatatatgtgggctgattaaacaaataagccagcggaattctctttctaagtgctgtgacactgggattacccggaaaggagcaagcctactctggaggcagaaactgcagatatgggtccctcgagatcagcatggatgtgtgcagaggccgagccgggggaggctcaggatgctgaggaggacctcacacagaggaggcagccccccaggcaggggccccaccagytgtacacagaggtctgggtctgatctgagagtgtggagccgcctgccaaggtgaagctggtttgctgaggtctctgatcaagttggcctcccaaagtggagttcaagcaggacgtggccagtgcatgcacgggggctaggcgtaggtccccaccgcatttgagtctaagagggcagggcatggcatccatggggccagtgagatctcagacatgagcgacaacgcagcctgggccttggcaggaagctcagggctcagcagcctctgtcactcacccattatccagaccgttctgcccga

SEQ ID NO: 27810 - DNA, 601 bp, Human
cctgtcagtggcgaaaaggttttctccctcagttcttttcctgacttcaaaccgcccccggcgctcggcccctcccccacgcggtcccgctggctgtgccggactggcagcctcgccgtttcccactgcgcctgctgctgcgcgggtgcccaagccgggaaattctccctgcagccccctgccggtgtttctgataggtgaaaataaagcacatggaattccttagacaaggccacagtatgccctactgtggaggtttggacacatcgtgcgtttgaaaatgtttgcccctttggggggcagtagcatgtttttagtgcgtggtttagcgagtgatctaaatttctctagtgttctaattttcacagctgctttgctccccctgtggatgtaaccccttagctggcattttgcatctcaattggcttgtgatggaggcgtctttggggattcagatggatgagccaatggctttttctccccagcgtgaccggtttcaggctgaaggctctttaaaaaaaaacgagcagaattttaaacttgcaggtacgtgtttaaatccaaagatgtacagttataaagatttttcaggcaacaattc

SEQ ID NO: 27811 - DNA, 601 bp, Human
aagttgctatggtctcagtattggtaattaagaatgcagaaatttgatgatgcccaaattaaatttctcttttgtatctgtgttcttatctctactcaccacattgccttaagcttaaatgtagaaattgacactggagatcatcacttaagtattcaaaagcagaactcacagacaaaaaaatatgaaatgtttgtagcaataataaagcaccatatctcagtgtacagcatgaaatgttctttgaccgtaaaccagaccttagggtgaataagacagggtcaagcagtgcctgctcttrtacactcgcatgtgtaccttcatttctgctctggcacaggacctgggacatagtaggtatttgttaataataaatatttgttaaatagaggaattctagttgactgtatttttttttttctgaaagggtagccagatcatctttcccatctttgtcttaagtgaattctgtgcttgtctaaaagatacttattttgaccttttgtccatatattctttataaccccaccctagaaaaatatgacatcacatactttctgctttgatggaagtcagttatcccacttacctaaacttgaaa

SEQ ID NO: 27812 - DNA, 601 bp, Human
caaatttttaaaaatacttttttacatgcttgagagctttagtaggccttctctctgaaaatatagtgtgaatatttaatacataaaattttaccaagcctttaagattttgtatctttacgggaaatagttttcaagaacatcgcaatgtgtccttgtcatgccatctagtgatcacagcacaaattgtttagttattttaaaaatttggtgctttttcatgttgtaatctctacagtaacaatgtatctcttagtatataattccagtatagtagaaatttggtgtatttaattctggkactgtcatttttgtctgttcaagaggtgtgtgtgagttatagcaacttgatgggttttaatcttatcacaatgttattaaaacttatgtataattaattactcatattttataatttatttcattgagctttttaaattttaagaaactgtaaaatatactgtcattgattaaaactctaaatttttgtttccttgaaaggtgttaaaaaagatattgagaagctttatgaagctgtaccacagcttagtaatgtgtttaagattgaggacaaaattggagaaggtaatctggggatatg

SEQ ID NO: 27813 - DNA, 601 bp, Human
cttacagccagacttctcaaaaattatctgcatacattgttttcattccacacctctctttcactaaatacctattgcggctgttcttctctatgctaaactggaaactatagagtcaatcattactctaggcatcatttaacacaattgacgtgaacccttgtcttgacttctgtcctgccacaccctccttgttttcttcttccctcatttggcctttcattttcagtgtctttgctagctcttccacttctatctgacccctaaatattggagttcctcgtgcttgctcttaggtttstctgtattcttagtgtcctccatttccacatgatctaaagtaatgattcccaaaagtatatagttaatctcagaccttttatcttaactacaggtttgtgtatatccacctgcctatttaacatttccacttggtgcctgataaatatctcaaacctaaaagacaaaactaaaccttaacataccaaaaaaaaaaaaaaaaacaccacaacaaatgttcttatccacccgtctctgcaaatggcccatctacacacttgtttgggccagaaacctagaaatcatcctcattttctctatt

SEQ ID NO: 27814 - DNA, 601 bp, Human
cttcttccttctccccttaattctgtctttacacagcagccagaatgatctttaaaatataaaatatatatgtatataacttaaattgggtcattagttccaccacttaaaatctttcagtggtttccctatgtactttgaaaaaaaaattcaaccttctcatgcctatcttcccacctccctcactgtgctccatttctttagtttatcaaatttgtctcaagagctttcttacctcagggccactgcccagactgtttccccattcaggaagacctctcccagtcattgcttgctgacscttcatcttctgatctgagcaagagtgaaactggacgcagtagttcatgcttgtaatcccagcactttgggaggattgcttgaggccaggagtttgagacctgcctgggcaacctagcaagaacccatctttacaaaaaacttaaaaattatccaggcaaggtggcacacatctgtagtcccagctacttgggaggctgaggtaggaggatcacttgagcccaggagtttgaggctgtaatgacctgcgatcactccattgcactccatccagcctggtcaacaaaacaagaccctgcct

SEQ ID NO: 27815 - DNA, 601 bp, Human
attatagaagacaagaaaatgagatggcctctataaagaatgcttgcatacattcttgtaccctaaatatgatcatttctttttctatacttttaactgtctccctctaccactttttctttttctgtgcttaaaaaagtacatgctaaaaatgccttcatctgatcttacaatgcagtcaggcaaattgtcttcaggctcagcttccattgtgttatattttccttccttctgttttgtttcttcctttccacttaaattgctgtcttaaaaattaccagttaattattctttgcctaastaaaagccttccctcagttgttattctctttgacttccatgctaataactcttccttcaaaattcctttcttatttggctctctaacttggcttcttccaagctcagttttcttttctcgctattaattttcatgtctgtaggtatcacttctctgcaagtactctcactgacttctcacttgtcttctcacttaaggcttagtcccttgtctagatatctctatcaaaatgatgaggtctggttttagatgcttcttttactggcttctctactcattttttggtatctctattgtttt

SEQ ID NO: 27816 - DNA, 601 bp, Human
gattggaccacatgatagccaatttcctgttttaacacaaaagttttatttttatgtatactttttaatgctgattataattatagagaaattataagctaaaaataacataaatacctctatataatggatcatattaaacataataatattataacttcttttttgagcttttatatgcctgactttttaattttctttaattggatcagattttaaaaccatgattttaatttttttaagctttcttaactagaaattatctgctatgatgccatctctgccaccatcagagaacaayggactgtgtttatgttatgtattcctcttctgccttattaacacagaccactggaaaaagaaaatttgattgtgggacaactcttaattttcaatcctggttagctgttaaattcttactttgtctggaaaacttatttttttttcttttttccagaatgttataaattcctaattgatcccaaaaagaattacagtttttatgaggatggtttgagagtattacaatgttactaagctttaattgctacagataagtaaaaatgcttaattttgtctcttaggtatgccttggtagact

SEQ ID NO: 27817 - DNA, 601 bp, Human
tagaaaaatgagacttttcttttacagctcatgaagcagtcaaagactgtggatgtactgtctagaaagttagcaacaaaaaagaaggctatttctacgaaagttatgaatagtgctgtgatgaggaaaactgccagttcttgcccagctagcctgacctgtgactgctatgcaacagataaagtttgtagtatttgcctttcaaggtaatgtgttttgatggtgttataaaatcaccagcatgctgccattagaaattgcattgacttgggtggataattttgtgagtgcaagggatcarttcagatcagtgaactgcaatgggccttgatgcagagcagtagtatgttgaagagcaaatgataacagttttcatatattatttatttaatatggatatactctggaaaacacatttgctcttatatgcaaataagtgggacggggtggcttttagaagcttagaatcacacattttgattgctgatgtagtcttttctgttttctctttttattcccgcttatgtggagtaaccagaaccaaatagtagagctcctcttttactcccacctccaactctttgactcataaatttcttcc

SEQ ID NO: 27818 - DNA, 601 bp, Human
tatttttgagctaatgctattctttatgaaagtttttaatcctaatgttgcctctctttttttgtttaaacagtttattccatagattacattttgcgtatttatttacaagatgatcttaccatcttgtaaataaatacgcaaaatgtaatctgtggaattttgctgacatcacctttgtgggggaaaaaattatgtttaatagtttttgccagccaaagacttaaagcattttatttgcttgcttaatacctcaaaagtttcctgtgatgtagatatatttgtgtttgattaaaattayttttgttattatataaacaatataatagcagttagaaggttttgaaaaagaaaaatgtcttccgtaatctaaaaacttaccatggagctggaatccaggaaacatcttgaatgaatagatgaatcctgctattcacttggattatgggctttgaagaaatgtattcattcattgaatgtctgttcttgcttgctaatgataacaaataaataaatgagaccatctgttcacactctagtcaggacaccatcaaataattataaaataacctgttgagtatggtaataaaacttattcagg

SEQ ID NO: 27819 - DNA, 601 bp, Human
aagacttaaagcattttatttgcttgcttaatacctcaaaagtttcctgtgatgtagatatatttgtgtttgattaaaattacttttgttattatataaacaatataatagcagttagaaggttttgaaaaagaaaaatgtcttccgtaatctaaaaacttaccatggagctggaatccaggaaacatcttgaatgaatagatgaatcctgctattcacttggattatgggctttgaagaaatgtattcattcattgaatgtctgttcttgcttgctaatgataacaaataaataaatgaraccatctgttcacactctagtcaggacaccatcaaataattataaaataacctgttgagtatggtaataaaacttattcagggtatttaaggagtatctaactatcctaacccaaagagattatgaaaggcaattcatgaaagaaatgacctcttagaatgtaaattgggctgagaagttagcatagaggcatgagccaaggaactcaagaaacagcatacaggaaactaaaaaagtttcattttggccagacgcggtggctcatgcctgtaatcccagcactttcggaggctgagatgg

SEQ ID NO: 27820 - DNA, 601 bp, Human
cccagctactcaggaggctgaggtgggaggatcacttgagcctgggaggcggaggttgcagtgagccgagatcacactaccacactctagcctgggtaacagagccagaccccatctcgaaaaaaaaaaaaaaagaatgaattaagacctagtatttgatagcacagcagggggattatagtcagtaatttaattgtgcagtttaaaataactaaaagagtactttgaggggctgaggcaggcagatcacttgagcccaggagcttgagaccagcctggccaatgtggcaaaacctcgtcyctactaaaaatacaaaaaaaaaaaaaaaaaaaaaaaaaagagctgggcatggtgacatgcctgtaatcccagctactcaagaggctgaagcatgagaattgcttgaacctgggaggcagagattgcagtgagctgagactgtgccactgcactctagtctgggccacagagggagaccttgtctcaaaaagaaaaaaagaaaagaatataattggattgttcgtaacacaaaggataaatgcttgagggaatggataccctgttttccaggatgtgattattacacactgcatgcctgta

SEQ ID NO: 27821 - DNA, 601 bp, Human
acctcgtctctactaaaaatacaaaaaaaaaaaaaaaaaaaaaaaaaagagctgggcatggtgacatgcctgtaatcccagctactcaagaggctgaagcatgagaattgcttgaacctgggaggcagagattgcagtgagctgagactgtgccactgcactctagtctgggccacagagggagaccttgtctcaaaaagaaaaaaagaaaagaatataattggattgttcgtaacacaaaggataaatgcttgagggaatggataccctgttttccaggatgtgattattacacactgcwtgcctgtatcaaaacatcttatataccccatcaatatatacacctactgtgtactcagaaaaattaaagtcttcacagtcacaaaaaaataaaaaagtaattttttaaaagtttctatagcagtagttggtgctagtgtcagctgaagaagagcttctaatgttcattacttttcactaaaatgaaagcactttgaccagtatggtatgtaattctcaaggatcattcagattttttcccacatagctatttttggattccttttgatcctataaaatgtgcgtttacttagtgtttcct

SEQ ID NO: 27822 - DNA, 601 bp, Human
atgtcagaattatctgagaatctttaagaaatacatatgcctgcccactcagcctattcttggaaaatatgattcagaaaaacaagatacttaggaaggctccagccttgttagtttgaaaaagcaagtgattctgactaagaaactatgggtgtttaagaaccactgcaaaaattactgcccttgcttatgcactagtgctatagtctaatctacaagaaaaacttagtggtggttgtgaagaaagcctcatcttaatagaggcttgccaaaatatgtttctacagtaaagtcagtccaygatttgtaactatcttgtacttattgtaagaaaattttatttgaagataataggatgaaataatacaagggaaaaaaagtgaccatgagtggaaagcaagattgatatcttagaaatggcattcttacataataatataacaagtatgtttattctcaactgagaaaactttcatctactattgaataacttcgtgagaggtttatgaacatgaagtttatcagccaataccaacatattttattgaagagcttgaatctcccccattgtaatccaagttataatcagggccaacaatgg

SEQ ID NO: 27823 - DNA, 601 bp, Human
agaaatacatatgcctgcccactcagcctattcttggaaaatatgattcagaaaaacaagatacttaggaaggctccagccttgttagtttgaaaaagcaagtgattctgactaagaaactatgggtgtttaagaaccactgcaaaaattactgcccttgcttatgcactagtgctatagtctaatctacaagaaaaacttagtggtggttgtgaagaaagcctcatcttaatagaggcttgccaaaatatgtttctacagtaaagtcagtccacgatttgtaactatcttgtacttattstaagaaaattttatttgaagataataggatgaaataatacaagggaaaaaaagtgaccatgagtggaaagcaagattgatatcttagaaatggcattcttacataataatataacaagtatgtttattctcaactgagaaaactttcatctactattgaataacttcgtgagaggtttatgaacatgaagtttatcagccaataccaacatattttattgaagagcttgaatctcccccattgtaatccaagttataatcagggccaacaatggaaatacaacatctgacccaaaaatac

SEQ ID NO: 27824 - DNA, 601 bp, Human
gatatcttagaaatggcattcttacataataatataacaagtatgtttattctcaactgagaaaactttcatctactattgaataacttcgtgagaggtttatgaacatgaagtttatcagccaataccaacatattttattgaagagcttgaatctcccccattgtaatccaagttataatcagggccaacaatggaaatacaacatctgacccaaaaatactctagatcaagtgccatgatagcaagcaagagcttttagagatttatcattgtaatacttctcatattaaaaaaaaaatagggccagccgtggtgactcacacctgtaatcccagcactttgagaggcttaggtgggcagatcatgaggtcaggagaccgagaccatcctggccaacgtggtgaaaccccatctctattaaaaacacaaaaattagttgggcatggtagcatgcacttgtagtcccagctactcgggaggctgaggcaggagaaccagctgaacctgggagatggaggttgcagtgagccaagattgcaccactgcactccagcctgacgacagagcaagactctgtctcaaaaaaacaaataataaa

SEQ ID NO: 27825 - DNA, 601 bp, Human
tgatcttctttgagttaaacctacctaagtagattttaggtgggttcctattaggtcagatttttagcttccctaattacctttcactgacatatacagaaaaaggagcagttttagttttaattaattaaaattaacagatgtgatgaggattaaatgaatcaaaagacttaatttgtagattcttttagagttatgagctaggtatagtttggggaaactcaacctggtgctggtgctcttaacaattttgtaaataaagaagataatttccttttctagaggtacatattaggccttytatgaacactaaaacaatgaggaaatgttggtcatggggcaaagtatcacttaaaattgaattcatccatttttaaaaaacacttcatgaaagcattctggtgtgaattgccatttttttcttactggcttctcaattttcttccttctctgcccctacctaaaacattctcctcggaaattacatggtgctgaccacaaagtttctggatgttttattaaatattgtacgtgtttacagttgggaatttaaaataatacatacactggttgataaagggaagctgcaggaccaaggtga

SEQ ID NO: 27826 - DNA, 601 bp, Human
aggggggtgccaagcgccaccgcaaggtgttgcgtgacaacatccagggcatcaccaagccggccatccggcgtctggcccggcgtggcggtgtgaagcggatctctggtctgatctacgaggagactcgcggggtgctcaaggtgtttttggagaacgtgatccgtgacgctgtcacctatacggagcacgccaagcgcaagacagtcactgccatggacgtggtctacgcgcttaagcgccagggacgcaccctttatggctttggcggttaaggttgctgatttctccacagcttgcrtttctgaaccaaaggcccttttcagggccgcccaactaaacaaaagaagagctgtatccattaagtcaagaagctcaatgtgtaattaagatgaatgatactgagctgacatcctaaaaaggaaagattaggggaactccaagtttgccctccactcactacatatgggtaggggagcaacgatattccaactctgaagaaagagtggaaaaaaagtagtgttaaaaatttgtattagtttccaagggacaaagaagcgctgcccaatcaatgagggccattcgtagctgtcaaccaatc

SEQ ID NO: 27827 - DNA, 601 bp, Human
ttgggtttcgttttgtaaatttgggattctaactgagttaaaccgagccgtttttagcgatcttcctaagatggcggatgtgctaaggagaaagggaaggcgaaacattagaaacttgttcaggtatttcgatcgcaaacattcacaggaaaagatggtggaaatggtttgggaataccagcagccttttatgacgtatgtgatgtgttttattcccacgtttctgaaatttactcctatgttaggtggctgggacttaactacactagcattacatgtttagtttttgagatggagttgstcttgtccaggctgtagtgcaatgacgcaatctcggctcaccgcaaccaccccctcccgggtttaagcggttctcctgactcaacctcccgagtaactggggttacaggcatgcgccaccacgcttggctaattttttatttttagtacagaaggggcttttctgtgttggtctggctggtctcgaactcccgacctcaggtgatccgcccttcttggcctcccaaagtgcagggattgcaggcgtgagccaccgtgcccggccttagtgttatttattaggcatagaacgtgagtaatc

SEQ ID NO: 27828 - DNA, 601 bp, Human
gttcataccttccactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctraaacgtcaggggcgcactctgtatggcttcggcggctgaatctaagaatacgcggtctcctgagaacttcaaaaaacaaaaacaaaaaaacccaaaggcccttttcagggccgctcacaaagtcgtttaaagagctgaaatgcgttgcgagaatgagtttggatgacagaaataaccgtgacagcctgcataagaatgaattgtgtttgccatgaccggccacactgtgacaaaatttcaaagcataaagtaggcatagagaggtaagcgctaataaagtgattggctccacaaaaagca

SEQ ID NO: 27829 - DNA, 601 bp, Human
atgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaacaaaaacaaaaaaacccaaaggcccttttcagggccgctcacaaagtcgtttaaagagctgaaatgcgttgcgagaatgagtttggatgacagaaataaccgtgayagcctgcataagaatgaattgtgtttgccatgaccggccacactgtgacaaaatttcaaagcataaagtaggcatagagaggtaagcgctaataaagtgattggctccacaaaaagcattttgctgggcgcagtggctcacgactgtaatcccagcactttgggaggccaaagctagtgtatcacttgagatcaagaatccgagaccagcctggccaaaatggtgaaaccccctctaccaaaaaaaatacaaaacttagccgggcgtggtggtctgcacctgtaggcccagctagcccgg

SEQ ID NO: 27830 - DNA, 601 bp, Human
gccagggtgctctgccccagcaaccaccagacccggctgcccacaggggaggacaaaccctctggggatgacaggcaggggcgcctgaggctgccccaaaggcgcacggatggacctacccacggaaggtcgaggatggcagggaccgggggtggggggtgcctacctgccacctccttggacgatggcagactcgcggcggcagcctcaaggtcggctgggacggtgcctcctctctccatggcgcgcaggagcccgcgcagtcgctcgcactccgcctgcagctggctgtggtcctcgygcaggcgctgcctggccacactggtggggttcaggctcatgtgcagcactttggtcctgctctggtcatagtcaccctgcaggaacacacacagcacaggtcaccatggcccaggcacacacgcagcacgggtcacacacagcatgggtcaccatggcccaggaagacacacagcacgggtcacacacagcacagtgctcagttcttttgtcttcttgagcctgcctggcagccatctctcctggaaggagtggctccttccctgtgccctgtggacaggtgcaggaacaaggcctggcc

SEQ ID NO: 27831 - DNA, 601 bp, Human
atttaacatttaaaaagcctggccgggcatggtggctcacgtctataatcccagcactttgggaggctgaggagggtggatcacgagttccaagagatcaagaccatcctagccaacgtggtgaaaccctatctctactaaaaatacaaaaattagccgggtgtggtggcgcacgcctgtagtcccagctactcaggaggctgaggcaggagactcgcttgtacccgggaggcggaggttgcagtgagccgagatcgcaccattgcattccagcctggggacagggcgagactccatctcaaaaaaaaaaaaaaaaaaagcccacaaatgtaatattttatagtactttagatcggaaatccaaaacgggtctccccgagctggaatcctggtgttggcagggttgtgttccttctgcagattccaggggacagtccacttccctgctctttccagcttccagatgacccacattccttggcttgtggcccgtcctccatctccacacccagcaagagctgccaagtccctctcacatcactctgagcccccaggatggcccaggagcccctccccgccgtgggccagctgaccagtcacc

SEQ ID NO: 27832 - DNA, 601 bp, Human
gattgactgggggagcagagaggatttttaggcagtaaaacttttctgtgtgacactctaatggcaaatatagaacattttacatctgcccgaaccatacactgtcccactccaagagtgaccctcgcatgacccgtggactctgcgtgacactgatgtgtccaggcaggttcatcaccgtcacacgtgctccactctaccagggtaggctgtgtgtgtaggagcgggcgcagggggtacacaggagctttaccttctgctcattttgctgtgaacctaaaattgctctagaaaataccayccattaaaaattaaagtcattgaggtcacaaagttccttcgctaaactgccccaggtcctcagcagcctccatgcctcaggactctcctgtgggaggccttcctgggctgcaccaggggcctcgaagctgcttccaatactgagcctcagcatccactccagggcagctcttcccagcgccgacctcccagccctccgcgtactgggagctggcattcacactgcacactgccgggctgctgtgctcaccacctgccctcggggagctctccaggagcaaaagtctgtctcaagtctggt

SEQ ID NO: 27833 - DNA, 601 bp, Human
acacgtgctccactctaccagggtaggctgtgtgtgtaggagcgggcgcagggggtacacaggagctttaccttctgctcattttgctgtgaacctaaaattgctctagaaaataccatccattaaaaattaaagtcattgaggtcacaaagttccttcgctaaactgccccaggtcctcagcagcctccatgcctcaggactctcctgtgggaggccttcctgggctgcaccaggggcctcgaagctgcttccaatactgagcctcagcatccactccagggcagctcttcccagcgccracctcccagccctccgcgtactgggagctggcattcacactgcacactgccgggctgctgtgctcaccacctgccctcggggagctctccaggagcaaaagtctgtctcaagtctggtccaggatggcactccatggtaaaacatcccacccctcccgtgtcaagcccacttctgccactctagcagcacgtgtgacagctcagtctttccaatagtgaggacaggcttttccctacggtacccagtccccttgggacacagacagctggcatctgtgagcagcaagtcactgaacaggc

SEQ ID NO: 27834 - DNA, 601 bp, Human
tgctctagaaaataccatccattaaaaattaaagtcattgaggtcacaaagttccttcgctaaactgccccaggtcctcagcagcctccatgcctcaggactctcctgtgggaggccttcctgggctgcaccaggggcctcgaagctgcttccaatactgagcctcagcatccactccagggcagctcttcccagcgccgacctcccagccctccgcgtactgggagctggcattcacactgcacactgccgggctgctgtgctcaccacctgccctcggggagctctccaggagcaaaastctgtctcaagtctggtccaggatggcactccatggtaaaacatcccacccctcccgtgtcaagcccacttctgccactctagcagcacgtgtgacagctcagtctttccaatagtgaggacaggcttttccctacggtacccagtccccttgggacacagacagctggcatctgtgagcagcaagtcactgaacaggcagagtatgaaaccacgaccaaaccagacggtcattcaacaaacactaacagagtccatcgccctgccagccagaaaatcctgagaggtggactgagggctg

SEQ ID NO: 27835 - DNA, 601 bp, Human
tgcctcaggactctcctgtgggaggccttcctgggctgcaccaggggcctcgaagctgcttccaatactgagcctcagcatccactccagggcagctcttcccagcgccgacctcccagccctccgcgtactgggagctggcattcacactgcacactgccgggctgctgtgctcaccacctgccctcggggagctctccaggagcaaaagtctgtctcaagtctggtccaggatggcactccatggtaaaacatcccacccctcccgtgtcaagcccacttctgccactctagcagcacrtgtgacagctcagtctttccaatagtgaggacaggcttttccctacggtacccagtccccttgggacacagacagctggcatctgtgagcagcaagtcactgaacaggcagagtatgaaaccacgaccaaaccagacggtcattcaacaaacactaacagagtccatcgccctgccagccagaaaatcctgagaggtggactgagggctgcgaggggccagggaccaccaccaggagcggacatggcagaggccaggctgggggtgccgggcagctctgcagccaggaagagctggtgtg

SEQ ID NO: 27836 - DNA, 601 bp, Human
gcaagtcactgaacaggcagagtatgaaaccacgaccaaaccagacggtcattcaacaaacactaacagagtccatcgccctgccagccagaaaatcctgagaggtggactgagggctgcgaggggccagggaccaccaccaggagcggacatggcagaggccaggctgggggtgccgggcagctctgcagccaggaagagctggtgtgaagcctggaggtgagggtgcataagggctgagagggcacggccagagcacagggtctggaggctgctctccaggcaacaggaggcaggagasggatctggagtcaacgtctccctggcacgtcctccgcagggaaatggcacagcctgagcttgagtcagatgccctgactgagacccagctccagctgtgcaactgtgggcagctttctcaacctctctatgcctgtagcatcttctcacgctcatcagcacttgacgtcatcacacacacggacattttctcttggtgtttgtggtcagtctccctcctctagaatacacgctcccaagagcggaagcatctgcctcattcaccatggcatccctggtgcccagcacagtgcccaacaca

SEQ ID NO: 27837 - DNA, 601 bp, Human
gagagggatctggagtcaacgtctccctggcacgtcctccgcagggaaatggcacagcctgagcttgagtcagatgccctgactgagacccagctccagctgtgcaactgtgggcagctttctcaacctctctatgcctgtagcatcttctcacgctcatcagcacttgacgtcatcacacacacggacattttctcttggtgtttgtggtcagtctccctcctctagaatacacgctcccaagagcggaagcatctgcctcattcaccatggcatccctggtgcccagcacagtgcccarcacacagggcagcagctaacctcacagaaggaccacggagctcggcaccagcgcagaaaggccgacaggggcaggagagtcaaggccaccacagggatgtccacaaggcactgacagggagtgactcaccttaatctgctgctcgtggtctgctcttgcttcttggctggcctggagttcctggattttctgattggcttcctggcattttctattgaaagaaaaatacatcacacacagaaacaggcatgcggcaaggccaacaattctcctcagcctgagacccgccccagcacagac

SEQ ID NO: 27838 - DNA, 601 bp, Human
gcggccagtttctggacccctccaggacccccgctgcacgcccaccccacccctaccacgcctccacccccacaccagcagattttcatgtttcctcttggcaccagcgatcttgatcgccacagacaaaggacaggagaggtcagaagattccaatttccaccagtgcccatgtctgggctgtttctaaaatgcaagcaaccttcaccaggactgcagttcacacaggctccagttcagaggcaattatccgacgccatcagatgcctgtagaccttgcagacagtcaaagatatgcaawtccagacgtgcctccttaagcctcctgacaaaacaacagctatttccagaaaagaccaccatccacgacagggaaggctacggggaaattggagccctcagccaggcctctgagcacaacggctgcagagaccgccatcgctagggaccttataacccagtcctaggggtctgtccaaagtcaacagaagcgagggctgagggaagggctacctgtcgcatacatacatgagcgaacacaaacacactaaacgtccacaaacaacaaaaaacagattcatcatccatttaaattcataat

SEQ ID NO: 27839 - DNA, 601 bp, Human
ttttcatgtttcctcttggcaccagcgatcttgatcgccacagacaaaggacaggagaggtcagaagattccaatttccaccagtgcccatgtctgggctgtttctaaaatgcaagcaaccttcaccaggactgcagttcacacaggctccagttcagaggcaattatccgacgccatcagatgcctgtagaccttgcagacagtcaaagatatgcaaatccagacgtgcctccttaagcctcctgacaaaacaacagctatttccagaaaagaccaccatccacgacagggaaggctacrgggaaattggagccctcagccaggcctctgagcacaacggctgcagagaccgccatcgctagggaccttataacccagtcctaggggtctgtccaaagtcaacagaagcgagggctgagggaagggctacctgtcgcatacatacatgagcgaacacaaacacactaaacgtccacaaacaacaaaaaacagattcatcatccatttaaattcataattacaaaggcaaaaaagtgcttaacttttttttttttttttgagacagagtcttgctgtgttgcccaggctggagtgcaatgg

SEQ ID NO: 27840 - DNA, 601 bp, Human
acagatcacacacacatttatcacaccgtctgctcagcagttgcctctgcagggagagggggcatgggaaatctaaaattcagcattgaccttggggagaagctgagctttcatagcaccagcaaatcctgtctaattacgctctgtccggcactgaaaggagctggcactcccccagcgagcagacaacaggggcagagacaggcagcgtggacaggaggctgtgggcagaagcagtttacactgggctcaaatctgccacacatgcaccccctctcacacaaaccacaaacctccagasccaccccccacgactggccttagggaggccgcgtggctctcactggttgggatgggacatgaccaagcaccacgctcagacctcctgactctaatgacccgcaggccctccagagttcactgccaggtaccggcgtcccaggaggtgaaggcggtgagtcctggtggagcccggcactccgggaccctctcaccctgccttcctcgggaagcaccaagcactcccggagccccgggtggagtacgagcttgtgctgtcctcatccagggtactccagcccaaaacccaggagagctgtga

SEQ ID NO: 27841 - DNA, 601 bp, Human
acacacacatttatcacaccgtctgctcagcagttgcctctgcagggagagggggcatgggaaatctaaaattcagcattgaccttggggagaagctgagctttcatagcaccagcaaatcctgtctaattacgctctgtccggcactgaaaggagctggcactcccccagcgagcagacaacaggggcagagacaggcagcgtggacaggaggctgtgggcagaagcagtttacactgggctcaaatctgccacacatgcaccccctctcacacaaaccacaaacctccagacccacccmccacgactggccttagggaggccgcgtggctctcactggttgggatgggacatgaccaagcaccacgctcagacctcctgactctaatgacccgcaggccctccagagttcactgccaggtaccggcgtcccaggaggtgaaggcggtgagtcctggtggagcccggcactccgggaccctctcaccctgccttcctcgggaagcaccaagcactcccggagccccgggtggagtacgagcttgtgctgtcctcatccagggtactccagcccaaaacccaggagagctgtgacagaggt

SEQ ID NO: 27842 - DNA, 601 bp, Human
ctgccaggtaccggcgtcccaggaggtgaaggcggtgagtcctggtggagcccggcactccgggaccctctcaccctgccttcctcgggaagcaccaagcactcccggagccccgggtggagtacgagcttgtgctgtcctcatccagggtactccagcccaaaacccaggagagctgtgacagaggtggccgccttctgagagaggctgacccgcgcacctcggagggactccagcccttgtgagctgcaagggctgcctcacaacaaccaagagacccttctgtgatgcaggacaagarctggggttggcacggggctccgctcagcaccatcacagccagatgcggcaccgggcctggaactgccagtcccagcgcagacagggcagccagcaggtctttggacttcagacacttaagtctcgcccctaataggtatttccaggtggaactccaaggaacaattggaaaactactggttctgactgttcctggggtcccatgcagctgtgtctgcgggcaaggaaggacagtcctgttagaaggtggctggagctcagcagggagccccaggtgtaagcccagtcacctgcatccttg

SEQ ID NO: 27843 - DNA, 601 bp, Human
tccagagggaagaggaaaccaggagacccagcaaaagaatctgtgccagcaccgcagcctcaatgaacagacacagcaagtgttcccatttcatgccaccctcctctaggacatcaagcataactgatacctgccccacagcatgagtggcctcagaaggaatgtcctggcaaccatgacacagggcgtgtcaggcttccagccagctgggttctcatttcctacggcctggcaggtaccgtgcacagcccccttgctcccagggactgggatctgatttcttaagacctggcaggtaccrtgcacagcccccttgctcccagggactaggatgtgatttcttataacctggcaggtaccgtgcacagcccccttgcttcctggggctgtctgggccgaccctcgccccgcctgaacccacctcgtagttcctggcactggtgctggctgctctctccagctccactcgagccctcttgtgactcagctccatctgcattttctcccgctccacctggatgaggtgggacttcgaacggatctgctctgctctttcctccagctgagcaggtcgcacccaaagaaaaacagaatcctcagt

SEQ ID NO: 27844 - DNA, 601 bp, Human
ctcctgggggccctctcagaagtctgcctaccacacagggctagtgattacaggttagctgagcctcaaagagccccagaagacttgccaaatagttccagagccggcctttgggtacgacctgctcagctggaggaaaaggcagagtcactgactcttcacgtggcccagagccttgcagtgcagcatctcccggcacttaacaaatgcagagtcgcagactacaccccagacctactcagtcagaatcttctctttaggttgggtgtggtggctcacacctgtaatcccagtactttgrgaggccaaggcgggtggatcacttgaggccaggagttcaagaccagcctggccaacatggggaaaccccgtctctactaaaaatacaaaaattagctggtcgtggtggtacgcacctgtaaccccagctactcaggctgaggcaggagaatcgcttgaacccaggaggcgaaggttgcagtgagccaagatcacaccactgcattccagcctggatgacagggcaagagttcgtctcaaaaaaaaaaaaacaaaagaatctaggccaggcgtggtggctcacgtctgtaatcccagcagt

SEQ ID NO: 27845 - DNA, 601 bp, Human
tcagtcagaatcttctctttaggttgggtgtggtggctcacacctgtaatcccagtactttgagaggccaaggcgggtggatcacttgaggccaggagttcaagaccagcctggccaacatggggaaaccccgtctctactaaaaatacaaaaattagctggtcgtggtggtacgcacctgtaaccccagctactcaggctgaggcaggagaatcgcttgaacccaggaggcgaaggttgcagtgagccaagatcacaccactgcattccagcctggatgacagggcaagagttcgtctcaaaaaaaaaaaaacaaaagaatctaggccaggcgtggtggctcacgtctgtaatcccagcagttcggggggccaaggtgggtacataacttgaggtcaggagtttgagaccagcctggccaacatggtgaaaccctgtctctactcaaaactatgaaaattagccgagtgtggtggtaacgcacctgtaatctcagctactcgggaggctgaggagggagaatcacttgaacccaggagacggaggctgcagtgagccaacattgtaccactgcactccagcctggatgacagagtaagac

SEQ ID NO: 27846 - DNA, 601 bp, Human
ggaagttgttaaacagcccacaatgcacaagaaagtcctgagaaaaaagaattacccagcccaaatgccaagcgtgccaaggccaggaaagcctgggacaggggagggaagtttctctgtcctcccacctgtgttctctggtggcccaagcccacacttcctttactcctatgttactgtgtctcgattctcagctgctgctgtttgggcgttcctaagactgcccttcaaactcagcagccttcctggtctcacttctgtgtctgcagtcaagcctgagcctctcgagaagggtgggcascccgcctgcagggggcacgaccggcagggaccaggagtcccagacacacctgatccgtgtgccacctctgcctggagctgactacaacggaaagaaaggaaccctgaaagtttacccttacgttaaatcaacacgatgtgtgagaaaccagacagcacacattcccccggcctgccatgttctccaggccctccctgccacgccgggggctcagcaggagagagagaaccacgacgaagtccaggaatgggatgtgacaggggccagggaccaaggctggtcttgccgccatcactccgc

SEQ ID NO: 27847 - DNA, 601 bp, Human
aagctagcattctaataaacacacattaattcaattatgcaacaaaacaaatgcacacgcacacacagtttaaccaaatgcagcagggcctcatctgggctctgagagcgcaggaagccagagcctcctctaatgcggacagaactacagaacggctctggggaccgcagcagggactgggaaagagggtccaggcagaggagcctagaggagcctgcgcagccacagggcccaggcaaggctggagacactactagccagcactccactccccaccactccctacaacttgggggccccrttatcgcagccccaactgggactgggctcatcactctttggagcctgaagtccttcaggaggcctgaatcctctgcagttgtgtctacagtgagaaaccccaagaacttgtaatgaaacaaaatacaactattttatagaagaaaactgtaaaaatcaccccaaaatctgtaaatggccctccacagtctgagaccacaaaacacccagtccttctgctcactgctgtggctttgtctctgggctgcccaggcactctcagcactgtgtttccaacacagccttcccgacagtcctggtg

SEQ ID NO: 27848 - DNA, 601 bp, Human
ctccctacaacttgggggccccgttatcgcagccccaactgggactgggctcatcactctttggagcctgaagtccttcaggaggcctgaatcctctgcagttgtgtctacagtgagaaaccccaagaacttgtaatgaaacaaaatacaactattttatagaagaaaactgtaaaaatcaccccaaaatctgtaaatggccctccacagtctgagaccacaaaacacccagtccttctgctcactgctgtggctttgtctctgggctgcccaggcactctcagcactgtgtttccaacayagccttcccgacagtcctggtgctcactcccccaggcagtttgggttctgtcctcaattagatgaatgaactggctttccgatcctgtcaccagggtctgtgagtgcacttgtgtgaacgcaatgctgagcgccaggcccactcagggcgctaacaaggcaggcctttaagccaggatggctcagggccccaactagcctccagctacgaccccaaaatgaggagtgcccatagtgagacctgggagacgaatagctgtctctaggctctgctaataccgacccacctcaactacagaag

SEQ ID NO: 27849 - DNA, 601 bp, Human
gaagtccttcaggaggcctgaatcctctgcagttgtgtctacagtgagaaaccccaagaacttgtaatgaaacaaaatacaactattttatagaagaaaactgtaaaaatcaccccaaaatctgtaaatggccctccacagtctgagaccacaaaacacccagtccttctgctcactgctgtggctttgtctctgggctgcccaggcactctcagcactgtgtttccaacacagccttcccgacagtcctggtgctcactcccccaggcagtttgggttctgtcctcaattagatgaatgmactggctttccgatcctgtcaccagggtctgtgagtgcacttgtgtgaacgcaatgctgagcgccaggcccactcagggcgctaacaaggcaggcctttaagccaggatggctcagggccccaactagcctccagctacgaccccaaaatgaggagtgcccatagtgagacctgggagacgaatagctgtctctaggctctgctaataccgacccacctcaactacagaagactggaagaggtcctgcccgggcccagggtctccccagagcagactcccacccaggcacatgccactca

SEQ ID NO: 27850 - DNA, 601 bp, Human
gcccagggcagttttaggggttcaggtcggacaatttagacatgtgtccatttcttaacctggttacaatcagggcgatgtgggactagagagttcggagagcagatactgtcctctagatgcttccattagcctctgtcctatggattgacccgtaaaaaacaacctaatgcattggataggaggcagtgtgatttcttcttcttcttatgtcttgctgtccatgctgtgccattgtctcactaactcatctaagaagggctgtgattatcttaggaggaatgtattcccccactccccscaccatgaggtgactctgagtgtcttcgcaaggtagattctctggatgatagggactggcaagttatggctacctctgtttaaccccacagtgaagggagcaacctgacccctgctcatcactacaatgactttcgtttcaagacctatgcacctgttgccttccgctacttccgggagctatttggtatccggcccgatgattacttggtaagcatctggatatcaggacactgtgactccagtatcagagggatattcccaaaggaaggccccttttctccacagtctcgctctggtt

SEQ ID NO: 27851 - DNA, 601 bp, Human
cattaagtttgtgggagatggaactctgttccttagcactgtatgtcctgggctgtatttaaaataagtcttaattagttcattgccattcctttacatttttactttctccccgtttatcctcccacaatgggatttatttccttctctagctagcctgggcctcacagtcaaatgttctgcttattttcataccaacatcatccttcctcagattttggtcctggctgccaaatccaaatttatattttggaagctgagtgctgctgaagaatattacacaaccgtgtatactggcatytacagaattatgatatccaaccccacttgggctttcaatatcgatcttcagtccatttgctgttgctctcaatagggatttcagatgtttggcattctaatcaaaccattttctgactctcatctccctagctttgtttctcaacaagctaccttaactttttatcctatttcatcctctcatgctgcccctgtcaccaatggataaatgtatctacattttactttattttttattttttgagatggagtttcactcttgtcacccaggctggagtgcaatggcacgatctcgggctca

SEQ ID NO: 27852 - DNA, 601 bp, Human
cagatgtttggcattctaatcaaaccattttctgactctcatctccctagctttgtttctcaacaagctaccttaactttttatcctatttcatcctctcatgctgcccctgtcaccaatggataaatgtatctacattttactttattttttattttttgagatggagtttcactcttgtcacccaggctggagtgcaatggcacgatctcgggctcactgcaatttccacctcccagattcaagcgattctcctgcctcagcctcccaagtagctgggattacaggcgcccatcaccaygcctgggtcgtttttgtatttttagtagtgacagggtttcaccacgttggtcccgctggtttcaaactcctgacctcaaatgatctgcctgccttggcctcccaaagtgctaggattacaggtgtgagccaccgcacccggcctagatatcactcttgacctctgtactcttctgtcatgtgaacacttcccactgttgcacatattaaactgtattgtgtttattttacatttgtatccctttctaaatgtataatgtccttgaagacagaaactctctctttaatatctttatatctc

SEQ ID NO: 27853 - DNA, 601 bp, Human
caagatcgcgccactgtactccagcctggcgacaaagcaagactccgtctcaaaaaaaaaaaaaaaaaaatttagccttacaggttcactgtaaggctaaattaaataattacatcatgaaagctgtcaagccaggcgtggtggctcataccaatagtcccagcactttggaagactgagataggcagatcccttgagcccagaaattagagaccagctgggcagcatggtgaaaccgtctctatgaaaaataaaaaattaggcaggtgtagtggtgtgtgcctgtagtcccagctacttsggaggctgaagtaggtggatattttgagcctgggaggttgcagctacagtgagccgagatcacaccactgcactctagcctgggttacagattgataccctttctcaaaaaaacaaaaaaattgtgagatcctgaaaaatatttttatttcttccaaggctcagatcatgtttttttccttccattaggtgctgcagagcttcaagataatggattacagcctcttgatgtcaatccataatatagatcatgcacaacgagagcccttaagcagtgaaacacagtactcagttgatactc

SEQ ID NO: 27854 - DNA, 601 bp, Human
tgggcagcatggtgaaaccgtctctatgaaaaataaaaaattaggcaggtgtagtggtgtgtgcctgtagtcccagctacttcggaggctgaagtaggtggatattttgagcctgggaggttgcagctacagtgagccgagatcacaccactgcactctagcctgggttacagattgataccctttctcaaaaaaacaaaaaaattgtgagatcctgaaaaatatttttatttcttccaaggctcagatcatgtttttttccttccattaggtgctgcagagcttcaagataatggattayagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccagtaagtgggctcagggccactaggggggagaacataggcccacagcacttttcttttcttttttttttttttttttttttagtttcactcttgttgcccaggctgatgtgctgatgtgcaatgg

SEQ ID NO: 27855 - DNA, 601 bp, Human
gatatggaaaaaccaggctgggtgcagtatctcacacctataatcccagcactttgggagaccaaggcaggaggatcggttaagcccgatagtttggaaccagcctgggcaacatcatgagaccttgtctctacaacaaattttaaaaagataaaaaaatctttacaaagtgataaaaattacaagtatcaattatttagtgctgggcacatacatgctaagaaaatgtagagtgaaagagttatctttcttggcccggcacggtggctcacacctgtaatcccagcactttgggaggccraagcaggtggatcacctgaggtcaggagttcgagaccagtctaaccaacgtgttgaaaccctgtctctactaaaaatactaaaattagccgggtggtggtgagcacctgtaatctcagctactcaggaggctgaggcaggagaatcacttgaacacggtaggcagaggttgcagtgaactgagatagtgccattgcactccagcctggggtgacaagagaggaaacttcatctcaaaaaaagttatctttctcaggttttactataggatactattaaagaaaaaggggggccaagcgca

SEQ ID NO: 27856 - DNA, 601 bp, Human
ctgtttttcggttgaaaggatctgtgaaacataatcttctgaacagccttttgtatgactgaatagcacaatcagccctccgtatccacaggttccacatcccagattcaaccaactgtggactgaaaatacttgagagcctggtgtggtggctcatgcctgtaatcccaccactttgggaggctgaggtgggaggattgcttgaggcagtttgagaccagcctggtcaatataacgagaccccatccctttgaaaaaaaaaaagaaagaaacgaaaaaatactgaaaaaaaaaaaaaaagtcgtgaaaatgttatgttgttgctgatatgtactgtacagttaggcctgtacttaacatgtacagacttttcttgtcattattccctgaacaatatagtataacaactatttacatagcatttacattgtattagttatcataaataatctaggaatgatttaaagtatatggagggccaggcgtgatggctcacgcctgtaatcccaacacttgtgagaggtagaggcggccagattacttgagcctaggagtttaagatcagcctgagcaacatggcgaaaccccatctctaccaaaa

SEQ ID NO: 27857 - DNA, 601 bp, Human
tgtttttcggttgaaaggatctgtgaaacataatcttctgaacagccttttgtatgactgaatagcacaatcagccctccgtatccacaggttccacatcccagattcaaccaactgtggactgaaaatacttgagagcctggtgtggtggctcatgcctgtaatcccaccactttgggaggctgaggtgggaggattgcttgaggcagtttgagaccagcctggtcaatataacgagaccccatccctttgaaaaaaaaaaagaaagaaacgaaaaaatactgaaaaaaaaaaaaaaagwcgtgaaaatgttatgttgttgctgatatgtactgtacagttaggcctgtacttaacatgtacagacttttcttgtcattattccctgaacaatatagtataacaactatttacatagcatttacattgtattagttatcataaataatctaggaatgatttaaagtatatggagggccaggcgtgatggctcacgcctgtaatcccaacacttgtgagaggtagaggcggccagattacttgagcctaggagtttaagatcagcctgagcaacatggcgaaaccccatctctaccaaaaa

SEQ ID NO: 27858 - DNA, 601 bp, Human
gtttttcggttgaaaggatctgtgaaacataatcttctgaacagccttttgtatgactgaatagcacaatcagccctccgtatccacaggttccacatcccagattcaaccaactgtggactgaaaatacttgagagcctggtgtggtggctcatgcctgtaatcccaccactttgggaggctgaggtgggaggattgcttgaggcagtttgagaccagcctggtcaatataacgagaccccatccctttgaaaaaaaaaaagaaagaaacgaaaaaatactgaaaaaaaaaaaaaaagtmgtgaaaatgttatgttgttgctgatatgtactgtacagttaggcctgtacttaacatgtacagacttttcttgtcattattccctgaacaatatagtataacaactatttacatagcatttacattgtattagttatcataaataatctaggaatgatttaaagtatatggagggccaggcgtgatggctcacgcctgtaatcccaacacttgtgagaggtagaggcggccagattacttgagcctaggagtttaagatcagcctgagcaacatggcgaaaccccatctctaccaaaaat

SEQ ID NO: 27859 - DNA, 601 bp, Human
ggctgaggcaggaggatcgctcgaaccccggaggcagtggttgcagtgagccgaaatcgcgccactggactctagcctgggtgacagagcgagaccctgtctcaaaagaaaaataaataaaaataaagtatatggaggatgtgtgtgagttatatgcaaataccatagcattgtatataagggacttgtgcattgtggattttgatattcaaggaggggtcctggaaccagtcccccacagatattgagggatgactatactctgaaccaataccttttgtttttctgaggtcttaataaratgtttcacagtcatatgtttgccttcatctttagaccacattttcttggcagtgctctggagcttatccttgctcaaaagcctttttttttttttttttggtagagatgtctcattgtgttaaccaggctggtcttaaacaatcctcctccctctgcctcctgaagtgagccaccgtatgtggcctgccatttcttaattttagcatcgtttgctctctggagaggcttagaattttcaaaacttatcaagttctggcatttttgtttaatagtccttcccataatttctttatcttct

SEQ ID NO: 27860 - DNA, 601 bp, Human
tgtctcattgtgttaaccaggctggtcttaaacaatcctcctccctctgcctcctgaagtgagccaccgtatgtggcctgccatttcttaattttagcatcgtttgctctctggagaggcttagaattttcaaaacttatcaagttctggcatttttgtttaatagtccttcccataatttctttatcttctcctatattttattataagcatcaagagaaaaccaggtggcaccttcaggactttgcttggaaatctccgtagctagattgtccaattcattaggcacatattctacttytcacataatcacaaatcacattgttgctaaactttgtgctgctgccttactaggatctcctttccttcaagttccaataaaatttttctcactttaagccctcactggtaaccccctttaagtccaaaattctataaacagcatattcaggacactaccttttcactaaaatgctcctccaagccacccccaatgttttgttttgttttgattttgtttttcgagatggagtctcactctgttgcccaggctggagtacagtggcacgatcttggttcactgcagtctctgccaacaggg

SEQ ID NO: 27861 - DNA, 601 bp, Human
tctataaacagcatattcaggacactaccttttcactaaaatgctcctccaagccacccccaatgttttgttttgttttgattttgtttttcgagatggagtctcactctgttgcccaggctggagtacagtggcacgatcttggttcactgcagtctctgccaacagggtctccctctgtcacccaggctagaatggtagtggcactatcttggttcattgcaacttccgcctcccaggttcaagcgattctcctacctcagcctcccgaggagctgggattacaagcgtgcaccatcaygcctggctaatttttgtatttttggtagagacgtggttttgccatgttgctgaggctggtcttgaactcctggcttcagatgatctgcctgcctcaggctcccaaagtgctgggattataggcatgagccactgcaccaggccaccacccccaaattttagatttttgttatagcagcacctcaattccaggtacaaaagtctgtattatctattattgtgtaacaaattacccccaaacttagctgttgaaaacaaacatttgttatctcagtctgggtgtggtggctcacacctataa

SEQ ID NO: 27862 - DNA, 601 bp, Human
tttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgsgggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagt

SEQ ID NO: 27863 - DNA, 601 bp, Human
ccaggtgtggcggccgctagtgtttccaacaatatctgagacaaccttcagacactggtgctaatccaagaagcgacagcagacaaaaatgggaagtgctactctggatagtgccctcgagccccatgctctgcctgttgctcatacaccagccagacagaaaagagcctggcggcatcccagaccaagaacatgcctggcaacctcctgcctcagactaagaccaagatggggccactgctacagcctcacactgaatacctcagctccagagcagctcactgccacctgagctggctcyagatgaatcaccctgggcccagccacatgccccaagggccaccggaggtaggctgataatagagtgagacgacaatactaggatgagaggcacataacgaatgcattttcctagccagtttgtccgctctgagatccaggtgctgctgtcacaccctgccaggtgctgccttggctcccaccatgcatgaggcttcagaagcctctgacttgagggaaaggactgcccacaaaacctgagtccactcagtagacaacttacttattgaagagatgattgtccaccttgatcttgctgtag

SEQ ID NO: 27864 - DNA, 601 bp, Human
tctgggaatggtggggtgacagaacccagctagtgaggtggtggggactgtgagacaatgaagaatagaaccaggattcacatgcagaaaggagaaagtgtaagcagcaaatagtcctggggtggtccacagagggatggaaaatccaggccccaaagggcttaaagcaggcccaaaattgtgccaggtgtggcggccgctagtgtttccaacaatatctgagacaaccttcagacactggtgctaatccaagaagcgacagcagacaaaaatgggaagtgctactctggatagtgccctygagccccatgctctgcctgttgctcatacaccagccagacagaaaagagcctggcggcatcccagaccaagaacatgcctggcaacctcctgcctcagactaagaccaagatggggccactgctacagcctcacactgaatacctcagctccagagcagctcactgccacctgagctggctctagatgaatcaccctgggcccagccacatgccccaagggccaccggaggtaggctgataatagagtgagacgacaatactaggatgagaggcacataacgaatgcattttcctagcca

SEQ ID NO: 27865 - DNA, 601 bp, Human
acatgcctggcttatttttgtagcttttgtagagatgtagtttcgccatgtttcccaggctggtctagaactcctgagatcaagcaatcctcctgcctcagcctcccaaagtgctaggattacaggtgtgagctactgtgcccagccttttttttttcttttaaagatggtgttttgctgtcacccaaactggagtatagtggtgcgatcatagctcactgcagccttgaactcctgggctcaagggatcctctcgcctcggcctcctgagcagctgggactataggcatgcaccaccatkcccggctgatcaggatcctactctttactttcccctaatacctcctcagaaaaccctggtggagaagtgaggaccaccttcatggggaaaactaaagtcagaggtggtaagcagctctgggagttcctcagcaaaggtgctaaagtagcaccccaaaaaacaggctgttcccgttacagaaaggttgagtagactctgtgactgagcgcctcttcctcccagcctggcctctctaccataagacttacaggctgcaagcctagttgggaggtagaggcagcatcccctgactctctaagt

SEQ ID NO: 27866 - DNA, 601 bp, Human
ccaagcagatgccaagggacctctgggaagcaacggtgaggggagatcccaagtgtccctgttcccaagaaaacatacatggggatcatgtcacagaaatgtctcctctccaagatgtttccccatctcttaatgaggatcctgttattatttttgtagagacagggtctcactctgtcacccaagctggagtacagtggtgagatctcagctcactgcagcctctacctcctgggctcaagtgatcctcccgcctcagcctaccaagtagctgggactacaggtgtgcaccaacatgccyggcttatttttgtagcttttgtagagatgtagtttcgccatgtttcccaggctggtctagaactcctgagatcaagcaatcctcctgcctcagcctcccaaagtgctaggattacaggtgtgagctactgtgcccagccttttttttttcttttaaagatggtgttttgctgtcacccaaactggagtatagtggtgcgatcatagctcactgcagccttgaactcctgggctcaagggatcctctcgcctcggcctcctgagcagctgggactataggcatgcaccaccattcccggct

SEQ ID NO: 27867 - DNA, 601 bp, Human
gcttggcaggggaacagaattctgactttcgctgagtcttccctcaggggctggactgcttgaaagccaacaacactgagatagagggactcccagatgggagtttaccctccccttttctcacagggtgttcacatccctccctaagtcttcctccaaagtgacaagaattgttccttaccacctgctcttcatcccagtctaggatgggaagaggactgactgtgaaagtttccatcctgatcccagatagctatcctaccaactaaaattctgcctctgatggagggggctgagtctmatctggactctcacacgcactatgaccttgggtgagccatttaacttctctacccctgcatttcctcatcaggaacacaaagatgcagactgagctgattctcccagtctcttgggggtagcaaagatgaagcttagaaaatactgtcttcaaggggtctagcacaaagaagcaatgcccattcgtctcttgtccctggatctaccctaatgctgaaaaaccttccccaaagcaggaagctgatcctcatctctgagcctgacacctttccccttgcctcaacctcctgcttgtctatgc

SEQ ID NO: 27868 - DNA, 601 bp, Human
ttcatttactgtgtcaagcccacttatagagctctatgtgcaagacactttttaggtgctcagcaaacaggactgcactggagaagctcagtccctgcccttgagctactttccttctaacaggggagacagatattcagcagtggttccacaagtcattagttcattcactaccacggtgctcagtggtacagggaggagacaggacactctgaaagcacaaaccacacgggcccggcctggggagggacagtggccagggcctacctacttcctggaagtagtatttgggctgagctcrgaagggtaaggaggaagcaattaggtgggggaaggagtgggtggagagagagaaggagactattccagacagcagatgtgaaatcctgggaagaggagcacaggcactgcaggaacacagaggaaaccagcccagttgcagcacagagggaagggatggcggcataaggtgacagaagtcagaagccaggttcaagaacacggagcaccctagttcacagccacaagtgtgtccttctcagagtctagagatgcacttgtgctggcagtccatgggggcctgatggatgctaaagtgcat

SEQ ID NO: 27869 - DNA, 601 bp, Human
tcaacctgctaaatcagcagtgcaggagcctctagtcccaggctttgggtgggcagggagggcaaacacatgaaagatgaggaatgactaaaggattctttcctgttgagcctggaccagctcagggctcaggcagccactgactgactcaggctggactatgagatagaaatgtctgccatcccagcaggactatgaagaacgtagtgagggcagaggtaaaagaccagagaccaaggtctaggcctagcacaaggacagacaggtgattcatgacacacggcatttcatgttgacagayggcatgtctgggagctgggctaggggctggggtgggcgagggacaggatggccgacaggagttgtttctgactccaagcgacccttccattcctgctcagcaccagcataccttctccttgtcgctcgcttctctggcaaccgtagaaccctgaaaggataagagccatcaggggaagtcaagctgaggcaaagtcgactgcatgagcaaacatgggagagccagcaggtgaactcaagtaggcttgttagagtcctagaggggccaggaggcagcaccttgttcatttactgtgtcaag

SEQ ID NO: 27870 - DNA, 601 bp, Human
cacccttttgtccatactcctggaaagtactgaattccattcttcttaaggtttaagaggcgcctactctaggtacagaaggagccttgcaggtgaaaatgaaggttagtaagtacctcaacgtcccgcttcagtttctccaggaagttctttttactctcctctcccacatgcagcttctgcccttcattgaggaagtcattgtctttgaatgttggcaagtccttggcctaggagagcaacagcagttaggctgggtaagcctgattaattcaccccagggacacccaactgttctgcygggagcaactatacagaaaggggaaggaggggttgtcagtgtaccgaccctcaacctgctaaatcagcagtgcaggagcctctagtcccaggctttgggtgggcagggagggcaaacacatgaaagatgaggaatgactaaaggattctttcctgttgagcctggaccagctcagggctcaggcagccactgactgactcaggctggactatgagatagaaatgtctgccatcccagcaggactatgaagaacgtagtgagggcagaggtaaaagaccagagaccaaggtctaggcctag

SEQ ID NO: 27871 - DNA, 601 bp, Human
tctcagaaccacagtagggggagagggtagaaaagggagaaggacaaagactcaggacaaataatgtcagatgatgaaaggcagaataaggaaagaacatagttgggggtgactaaggaaacgcttcctagcaaaacgaagtttatgacacccatgttcacagtagcattattcccaacagctacaaggtggaagcaacctaagtgtgatggctaattgtatatgccagctggactgggcctgagtgcccagacacttggtcaagcattattctgggtgtgtctgtgagggtttctgggtraaatgagcattgaactggtggactgagtaaagcagatggccctccccagtgtggatgggcatcatccaatcagcagaaggcctgaagagaagaaaaagggtgaccctccggtgaggaagagggaactccttctgcctggtggcctgatggcctgtagaataaaaccacaccaccagctctcctgggcctccggcttgctgactgcagatctcgttggtatccataatcccatgaaacaattccttaaaataaatctcttagggccgggcgtggtggctcacacctgtaatcccagcactt

SEQ ID NO: 27872 - DNA, 601 bp, Human
ggctagggtcccaggaaaaagaaggtccatgcaccatgccctccacccacctgagaacatttataaagcaacatgcattgaaaacaaatgcactgagtaaactgcattaaattcttctcagaaccacagtagggggagagggtagaaaagggagaaggacaaagactcaggacaaataatgtcagatgatgaaaggcagaataaggaaagaacatagttgggggtgactaaggaaacgcttcctagcaaaacgaagtttatgacacccatgttcacagtagcattattcccaacagctacraggtggaagcaacctaagtgtgatggctaattgtatatgccagctggactgggcctgagtgcccagacacttggtcaagcattattctgggtgtgtctgtgagggtttctgggtgaaatgagcattgaactggtggactgagtaaagcagatggccctccccagtgtggatgggcatcatccaatcagcagaaggcctgaagagaagaaaaagggtgaccctccggtgaggaagagggaactccttctgcctggtggcctgatggcctgtagaataaaaccacaccaccagctctcctgg

SEQ ID NO: 27873 - DNA, 601 bp, Human
gcaggatctccttggaagaggaagggagggagggatgccactctgagcacttccagacaaagccttctcaaggcccagggagaaggggctagggtcccaggaaaaagaaggtccatgcaccatgccctccacccacctgagaacatttataaagcaacatgcattgaaaacaaatgcactgagtaaactgcattaaattcttctcagaaccacagtagggggagagggtagaaaagggagaaggacaaagactcaggacaaataatgtcagatgatgaaaggcagaataaggaaagaacakagttgggggtgactaaggaaacgcttcctagcaaaacgaagtttatgacacccatgttcacagtagcattattcccaacagctacaaggtggaagcaacctaagtgtgatggctaattgtatatgccagctggactgggcctgagtgcccagacacttggtcaagcattattctgggtgtgtctgtgagggtttctgggtgaaatgagcattgaactggtggactgagtaaagcagatggccctccccagtgtggatgggcatcatccaatcagcagaaggcctgaagagaagaaaaagg

SEQ ID NO: 27874 - DNA, 601 bp, Human
ttcagtactatctgtggcttcaggcgtccactggggatcttggaacatgtcccctgctgataaggggggactactgtataataaaatagaatagaaaatatcagaatacatgacagaaaataagggtagacagtgtttcagttgtgtgtatccattgggttgcaaggtaaaatatacttctaactggcctcagagacaaagtctgaaaaaactatgtcatcgacttttcagcccaggtaaaaatagaaaaaaaaggaaaagggaacacaaaaccatacaagaatggcagccagaaccaacyaatattctcaacccattccctgaaggtcaaaagaggctgtgtggtgctgggggaaagtcctcccctagcatcatgtgactccccttgccaagccttagttttctcatctgtataatgggtgctgtgagcagggtggtggttcaagtcttttatctaggatttcaagacaaagtatggaatgatacaggatggaaatggccagctagcattccagtttagctaataatgaggcaagagtgcagtcaccatcatacagtggtcactaggagactgttagactgaccaccatgttaggtccta

SEQ ID NO: 27875 - DNA, 601 bp, Human
aggaagggcaaggatggaaagatggaaggaagaagaggttacacaggacatcccagtgacatccagaaaggggggaaaggcattcctttcaactcaattctacaaacagttttgaaattcaacagagagtaaggcatcagagcacccgccctcgcgagctctctaagtctaatggggaagacagtcattcagcaggggaaaggcaggaggtcgaggctgcagtgagctgtgatcacaccactgcactctagctgggtaacagagggagatggtctcaaaaaaaaaaaaaaaaaaaaaaaaagcaaggagctgtgggagtttacagtgaggggtgagcaagaccctccctgaagaaaggagttgaggccaaggatgaagaggagtcagtgaggcaagtactgcaggttaaagatagaacgagcactgcaggaagagggaacagcccatgacggtttgggatcaagagaggccatggtggctgggcacggtggctcatgcctgtaatcccagaactttgggaggccaattaaggaggatcacttgaggccaggagtttgagaccagcctcagcaacgtgatgagaccccatctctacaaaaaa

SEQ ID NO: 27876 - DNA, 601 bp, Human
atgatggccatgaaatacacctccttcttgggggaacctggagggacaaggagagcagggaagaaggaagagggggcaggagaagggcagacagcagctgggcactgctacaacccccagacacaaggctcagctccatccttatcatgttggggctgagaaaaggaccagtggagtcctttccagctgtcatagctcttatcttattggatcttcacagtcactctgtggggctgacaggacagtatgaataaagtttggttcatctcatgaaccagagcagaaccactcttcagtcagycaggacaagcagggaagtataggaaagcctggcagaggaggagccccaggttcaggtggtgaccctggatgggaatctggaggcagaaagaggtcaaaggcagcaatgaatgaggtggaggtccagatgcccctagaaggatctaaacaatgagctgagggggtaggatgagggcagggctgtgcagagcaggcgcaggctctgacttactttcatggcttttcatggcatagacgtcaacagaggggtcgaattccccaggaccaaagaaccgaggaaagctgaggaggttgccagggc

SEQ ID NO: 27877 - DNA, 601 bp, Human
aatgatggccatgaaatacacctccttcttgggggaacctggagggacaaggagagcagggaagaaggaagagggggcaggagaagggcagacagcagctgggcactgctacaacccccagacacaaggctcagctccatccttatcatgttggggctgagaaaaggaccagtggagtcctttccagctgtcatagctcttatcttattggatcttcacagtcactctgtggggctgacaggacagtatgaataaagtttggttcatctcatgaaccagagcagaaccactcttcagtcarccaggacaagcagggaagtataggaaagcctggcagaggaggagccccaggttcaggtggtgaccctggatgggaatctggaggcagaaagaggtcaaaggcagcaatgaatgaggtggaggtccagatgcccctagaaggatctaaacaatgagctgagggggtaggatgagggcagggctgtgcagagcaggcgcaggctctgacttactttcatggcttttcatggcatagacgtcaacagaggggtcgaattccccaggaccaaagaaccgaggaaagctgaggaggttgccaggg

SEQ ID NO: 27878 - DNA, 601 bp, Human
ggggataaacaaattgggcccagcctggcagggagcaggtgggtgaaggcagggaacatggcaaggcaggcaggctgctcttccagtctgctctcctgggaagaaggagacaggagtgtgttccttggagcaggaggcctgagactgccctccctggggtctgagggtaagcacagatgcaccgacccagctgggccctggatgaagatggagaggactcaccccgtgtttcaccgttttggcagcatgtgcagctttcttctttgtatcgtatggcgtgaggatatcaatgatggccatraaatacacctccttcttgggggaacctggagggacaaggagagcagggaagaaggaagagggggcaggagaagggcagacagcagctgggcactgctacaacccccagacacaaggctcagctccatccttatcatgttggggctgagaaaaggaccagtggagtcctttccagctgtcatagctcttatcttattggatcttcacagtcactctgtggggctgacaggacagtatgaataaagtttggttcatctcatgaaccagagcagaaccactcttcagtcagccaggacaagca

SEQ ID NO: 27879 - DNA, 601 bp, Human
acactggcaggcttggccccgagggctggagaactgggggataaacaaattgggcccagcctggcagggagcaggtgggtgaaggcagggaacatggcaaggcaggcaggctgctcttccagtctgctctcctgggaagaaggagacaggagtgtgttccttggagcaggaggcctgagactgccctccctggggtctgagggtaagcacagatgcaccgacccagctgggccctggatgaagatggagaggactcaccccgtgtttcaccgttttggcagcatgtgcagctttcttcttkgtatcgtatggcgtgaggatatcaatgatggccatgaaatacacctccttcttgggggaacctggagggacaaggagagcagggaagaaggaagagggggcaggagaagggcagacagcagctgggcactgctacaacccccagacacaaggctcagctccatccttatcatgttggggctgagaaaaggaccagtggagtcctttccagctgtcatagctcttatcttattggatcttcacagtcactctgtggggctgacaggacagtatgaataaagtttggttcatctcatgaacc

SEQ ID NO: 27880 - DNA, 601 bp, Human
ttcctacataatccctttcccaagtcaaatttgttttctccatgagccagttggtttcaagttccctaagtcatgtagtggtcttgcggcagttgttcagacctacctatggccccttcctggggccaaggcagtggtttgacccccatctgcctcttccagaaggtttcccatccaatccagcagccccagtgaagtccaagaatgccgtctccattctttcctgacctatatgctgtgagtcaggcacagagacagtgctggttcctgcttcggaagctgggcttggccaggtttggarggagccacaggaaaccaatctattcattcaaaatggtttcacaagcgatcttcacatctttggggttatctacaagtctgaccatatctcatcccaaatccccagttcctggttgagggggtgagaagatgcaggaatgtacctcccccaatgcagaacaacagagctgtttctctcctggccagagcagcctgtggctcagttctgagggcctgggtggcaggctccgaaggcaggtggaacacctgcaggaagccactccttccaaaaaagcctgtgggctgcagatctgctaaaagt

SEQ ID NO: 27881 - DNA, 601 bp, Human
ggcatgagccaccgcacctggcctataatcccagcactttgggaggctgagagcggggatcactcgaggtcaggagtttgagaccagcttggccaacatggcaaaaccctatttctacccaaaaacaacaacaacaacaacaaccacaaaattggccaggtgtggtggcatgcacctgtagtcccagttacttggaaggctgaggcacaaaaatcgcttgtacccaggaagtagaggtagcagtgagctgagattgcgccactgcacttcagcctgggtaacagggcaagactctatctcaaaaaaaaaaaaaaaggtaaaccaataatttttagtgatatataagaagcaaaaaaacacgtaaggaatagtttggttccttttttaatgcaacttgaaagaaagaaaaagaaatggatacatgcaatggattctttaaaacccaggtttcctgagaaaaagctttgatacgtattctgcatccaacataatacttactagatctagtgcggagcctccaccaagatattccattattatccataattttgtatcctataaaacaaaaaaaagaagagaatcattttcaaaatgaatccag

SEQ ID NO: 27882 - DNA, 601 bp, Human
ccctttttaatataattttataccatattaatttttcttgaaatctccctttttaataccatttttatcaattatttttatggtttataataatatttgattatgtaaattgggtacgttagccttctgcagatacatatagtttcagaagtttatcttcccaaaacaaactatcaattgctattattactgtgagaaaaaagtttcattttattctagaattaaattttttacagagataggattttgctatgtggcccaggccagtcctgaacttctgggctcaagtgatcctcccacytcagtctcccaaaagtgaacagactgtaagcgtgaaccactgtaccaggcctaagaagtttcctctcaaaggggtttcctttccttaatgagtaatacccgtgtagactatgctaaagtaacacagctaacttcagctctccctgcaaccacagccctgtcatcctgatggccgcctatcatccaggacccaacctctaacactgcaatgacagatctggcctatcttgaaaatcaccactcacctaaatgacctgcacttacagaaggggtggggaaagagtgatcacagtgacttcgc

SEQ ID NO: 27883 - DNA, 601 bp, Human
caactgtaatatctaaaatttcacagactgcaattcaaagaaatctgaaggttatcaccaaataaattattatatcattaaatatgaacacgctaaagcattcctggaattgctcttctgaaggacttaatgttggaaaaagaatccctgtaaacaacttcgtatatgctacaaatgaaattcacttagataatagtaaatctaattacataaaatgaggtaattttctacatttctgtagtatttcccaacagggtgaaaaaatgaaaagctctttatgtgtacatttatggaaaggaamcaaaataagttgtaaaagtaatcccactacattgctgtttttccctttttaatataattttataccatattaatttttcttgaaatctccctttttaataccatttttatcaattatttttatggtttataataatatttgattatgtaaattgggtacgttagccttctgcagatacatatagtttcagaagtttatcttcccaaaacaaactatcaattgctattattactgtgagaaaaaagtttcattttattctagaattaaattttttacagagataggattttgctatgtggc

SEQ ID NO: 27884 - DNA, 601 bp, Human
gatggcacatgcttgtaatcccagctacttgggaggctgaggcaggagaatcgcttgaacccaggaggcagaggttgcaatgagccaagatcgcaccattgcactccagcctgggtgacagagcaagattccgtctcaaaaaaaaaaaaaaaaagtcacattagagtcgggtcccatctcccatctcctccttcaccaagtctgtgcccaagccgacgatcaatacctgtggttagatctggacttaaccacctcccttccattaccaagtctcccaaaagcaacggcagagcggcctgcygtcattcccaaagggcgctaagaggaagaggtgaggaacactcatggaaaatcctcccctggataattaagggctggctctgtgatgactgtctgcatggttctgcccttttaaatctgccctgaacaccatccatcattgacttatatgcccatggggaacgaggaggaaggggagaaaaagagataaaactctccttacttggggggaaatcctttctgcgtcaaaattcactataaagggtattcggctgctgtctaccccccagagtgcctcatgagcagctcggaccaggccaag

SEQ ID NO: 27885 - DNA, 601 bp, Human
ctaagataataattacctctgaaagcttttattctcagaaactcaaaataattgttcctattgactcctttatatccacaactatatcagatgaaaggaagaaatgtcaggtatccacatctccatttaaaaggaaaggaaaaccaggctaacaaaggctcacttcaaaccagacgggaagcccccccccgccccctgcagagtggggcagtcagtcacaaacagtaattccacagatgacagcagcaaagccaccagtgctccccggaaccacagaaacggagccagacagagggcagaygtctaatcgatgcaggtagggttcccccaaatcatggtcccccattcttggttttcagacttgacagtgaatgtcttcacagcccacacccacacattttagccaacaggaagatacaatctggggcctttcacttagttttaaaaagataagaaatgtgctttaagccaaaggggatgaaaactagggcgctcctccacaggaagcatccgactcaggcgtgcacatctctgggacagagcccgacagtccttgcgtgcctcagctccttcacatcctgttccacatccggaagtactt

SEQ ID NO: 27886 - DNA, 601 bp, Human
atattatataataataataactattatattatccctaagataataattacctctgaaagcttttattctcagaaactcaaaataattgttcctattgactcctttatatccacaactatatcagatgaaaggaagaaatgtcaggtatccacatctccatttaaaaggaaaggaaaaccaggctaacaaaggctcacttcaaaccagacgggaagcccccccccgccccctgcagagtggggcagtcagtcacaaacagtaattccacagatgacagcagcaaagccaccagtgctccccrgaaccacagaaacggagccagacagagggcagatgtctaatcgatgcaggtagggttcccccaaatcatggtcccccattcttggttttcagacttgacagtgaatgtcttcacagcccacacccacacattttagccaacaggaagatacaatctggggcctttcacttagttttaaaaagataagaaatgtgctttaagccaaaggggatgaaaactagggcgctcctccacaggaagcatccgactcaggcgtgcacatctctgggacagagcccgacagtccttgcgtgcctcagc

SEQ ID NO: 27887 - DNA, 601 bp, Human
tataatagatattatataataataataactattatattatccctaagataataattacctctgaaagcttttattctcagaaactcaaaataattgttcctattgactcctttatatccacaactatatcagatgaaaggaagaaatgtcaggtatccacatctccatttaaaaggaaaggaaaaccaggctaacaaaggctcacttcaaaccagacgggaagcccccccccgccccctgcagagtggggcagtcagtcacaaacagtaattccacagatgacagcagcaaagccaccagygctccccggaaccacagaaacggagccagacagagggcagatgtctaatcgatgcaggtagggttcccccaaatcatggtcccccattcttggttttcagacttgacagtgaatgtcttcacagcccacacccacacattttagccaacaggaagatacaatctggggcctttcacttagttttaaaaagataagaaatgtgctttaagccaaaggggatgaaaactagggcgctcctccacaggaagcatccgactcaggcgtgcacatctctgggacagagcccgacagtccttgcgt

SEQ ID NO: 27888 - DNA, 601 bp, Human
cagttaaagctccccaacttgggggaatgcagctgaaagagcttaaatcctaatagtttgggatttgttatataatagatattatataataataataactattatattatccctaagataataattacctctgaaagcttttattctcagaaactcaaaataattgttcctattgactcctttatatccacaactatatcagatgaaaggaagaaatgtcaggtatccacatctccatttaaaaggaaaggaaaaccaggctaacaaaggctcacttcaaaccagacgggaagcccccccscgccccctgcagagtggggcagtcagtcacaaacagtaattccacagatgacagcagcaaagccaccagtgctccccggaaccacagaaacggagccagacagagggcagatgtctaatcgatgcaggtagggttcccccaaatcatggtcccccattcttggttttcagacttgacagtgaatgtcttcacagcccacacccacacattttagccaacaggaagatacaatctggggcctttcacttagttttaaaaagataagaaatgtgctttaagccaaaggggatgaaaactagg

SEQ ID NO: 27889 - DNA, 601 bp, Human
aaaacacatgattttgccctaacaattacagtccactgagggacccttaaaaaaacaaagggcccgagaaaatggctttgctcaatgaagccaagccagcagagaagcaaagaggagccaatgaggaagcccgcagccccgcctgcgcctgcagctgaccacagggcgaccccctggccatggcaggggcggggcgcaggctgagccaatgaggaagcccacgacccggcctgcgcctgcagctgacctcagggtgcccctctggccatggcaggggcggggtacaggctggggatttcaytccaggaaacgaacagccaagagacagagcagccaggatctgtcctaacatatgtggttcccttaccagaaggctcacccctggtacccaaaaacacccaggaaagaaggcctaggagccaggcgcctctgaggatatccttgtattagaattttttaaatctgcagttaaagctccccaacttgggggaatgcagctgaaagagcttaaatcctaatagtttgggatttgttatataatagatattatataataataataactattatattatccctaagataataattacctctgaaa

SEQ ID NO: 27890 - DNA, 601 bp, Human
actatccatgttaatggacaagggtaattaaaacctgaaatcttcttcacttaaaacacatgattttgccctaacaattacagtccactgagggacccttaaaaaaacaaagggcccgagaaaatggctttgctcaatgaagccaagccagcagagaagcaaagaggagccaatgaggaagcccgcagccccgcctgcgcctgcagctgaccacagggcgaccccctggccatggcaggggcggggcgcaggctgagccaatgaggaagcccacgacccggcctgcgcctgcagctgaccwcagggtgcccctctggccatggcaggggcggggtacaggctggggatttcactccaggaaacgaacagccaagagacagagcagccaggatctgtcctaacatatgtggttcccttaccagaaggctcacccctggtacccaaaaacacccaggaaagaaggcctaggagccaggcgcctctgaggatatccttgtattagaattttttaaatctgcagttaaagctccccaacttgggggaatgcagctgaaagagcttaaatcctaatagtttgggatttgttatataatagatatta

SEQ ID NO: 27891 - DNA, 601 bp, Human
ctttatgacctacctcaaggtaccagcttcgttccaacttagaaaagctaccaggctaaagaacaaaaggcgggagccctccaggcctcgtgaggcacggcgccgccctcaccctcccctcaccttcgagtcataggccgactgtttgatgacctcgggtgccatccagaatggggtgcccacgaaggtgttccttttgatctgggtgtctgtcagctggccagccacgccaaagtccgccagcttcacctcgccatgctcagacagcaggacgttggccgctgcaaaagaaagccaaggsggccctgggcggtgcggacttacaactccgtgcactgccacaagcgcgtcttctccctggctgggtggcgaacccaccgagcacaggcaccggggctacactttttgtcagaccccctcaaagccagcccagcccaggcaaggcaaacgtgcaggacaaatgggcgccagcaccttcccttgagaagtcttcagggcaaccccaccaccaccttcagtatttcaaaggaatgaaaacggatgttctcttacctttaatgtctctgtggattttcttctccgaatggagataatcgagtcc

SEQ ID NO: 27892 - DNA, 601 bp, Human
aacctttgccattattaaaaacagtgtaacagtttatggcctgatcttctataaatattaaacatttatgattccacatttaatattaaggagaatattcttcagattcaatgaagtatgagatggcagaaatctaaaagaaaataaggagatttttaatacttaaaaattaaaatgtatttgcaaaccaaagaagtcaatcatacttacttagaaaaagaaaaatgaataataccaggaagacagctgaaaagagtgattaaagcaatcccaacaggatgtatctcaaccaagtcaagcygcacatgaagaggtacgctgtgatccctgggaaacttacaaagctcggctccttattcaaacaggcctccacaaactccttgaggggtttactgtagtttccttccaacgtcggtgggttgttctttggaatgaggaataaaactttcatggggtgcagctcggaatgaggtggttcccctcttgcaagttcaatagctgttatgcccagggaccagatgtctgcctgcaacaagaaaagcatctttacaaacaccaagcaggaatctattccaatacacagtatttagggggaaaatgg

SEQ ID NO: 27893 - DNA, 601 bp, Human
aatgggaacagacagcaggaacacccaaacaccgagtcgaaccaagttcccactcactccaaattacaaaagcttgattacaagagccaagcatgttttcagattcaaactcatgagaaacgtggatcacctcaagtattctccctccctgtccatccaagggtgaaaccccaactaccccggaggtgctcatattctcgcctctcagccagctcctcggtagctgtggggtggagctctgtgtgctggggcataagcccatacaggacacatgctttgtatgggaagacatgcctgcacrcatctccactggtgctggtgcatgatggctgcaagaaacatcatcgtgtaataaaatgcagagcatcgtggcatgcaggacaagccccaccaccacccgatgctgatgtagtcatcaaacactggtgtggtggtctcagcctgcatctccttagacgtacttagaaaatgttgcattccccatttaattcctttaccagaactggcatattaggaaaccatggtgctcttgtaaaagtaaccacccatttttacataagagttaagaaaaggggggctcagcttagccttcagctaactc

SEQ ID NO: 27894 - DNA, 601 bp, Human
aaacgattctcctgcctcagcctcctgggtagctgggattacaggcctgcaccaccacaccaggctaattttttgtatttttagtagaaacgggatttcaccatgttagccaggctggtcttgaactcctgacctcaggtgatgcacctgcctcggcctcccaaagtgctgggattacagatgtgagccaccatgctgggctgctttgttaactttctgtattaacgtttggccacatccaaccatataatagaaatgtcaatttggaattatctcagagaaactggaaaggagccaggaratcccctttttcctgtctgctgaaagagcaactggatgcgcttcaccaccaactttcccggtttagaagggctatttcccaggtccctccctcccttcccttgtgattgggctgaggacttcacccatgccctgggctcagcatggccaccgcaagcagcacctggtcagctgcctgccttgaggatggcgatagtgacagggaatgtgcttcccaaggaaaccagcatggcccaaatgggaacagacagcaggaacacccaaacaccgagtcgaaccaagttcccactcactccaaatt

SEQ ID NO: 27895 - DNA, 601 bp, Human
agaacttccgggggcagtggtctcaaccttggctttaaactggaatcacctagagaccctgaaaaaccacttagggtctcatccccggaaatcctcattcaactggcctggcacatggacctgcactgtgggccaactttaacttctgccaaggcatgcacgagaacagacgagtcccacgctcggacttccagacacaagtctgcccgaccacctcccccagccctccccacacaaatggctccagccccactccgcctcttaagccaagggaattcctagatgccaaacttgacagcarttctcagtaagccactcctggtacagaagcttctaccagacacaatacagaatcacaaacacatgcatttctggcctttcagacatccatgtaaagcagtttcacctgatcagggttttacaaacaggaagtttaatggaaaacagaacagaacagaacgaaacaaaacagaatgaaacagccaggtccagttccccatgcacagctctaccacaagagttcactcgcagaaactccaccagcaacgtcaagaggctaaacaactcccaaacaggcccaggctgtgtctaacacaacaat

SEQ ID NO: 27896 - DNA, 601 bp, Human
tgggttccatgtggaaggggactctgtgtgggcacaggcggtgaactgcctcgtcttgctatctacgcagaagtgctttactggttgggcgtggtggctcatgcctgtcattccaacactttgggaagccgaagcaggaggatcacttgagcccaagagtttgagaccagcttgggcaacatagtgagaccatgtttctattaaaaaaaaaaaaagttttaaataaactgggcgtggtgtcacatgcctgcaatcccagttactcaggaggctgaggtgggaggatcacttgagcccaggmgtttgaggctacagtgagctctgatggcaccactgcactccagcctgggcaacagagaccccgtctcaaaaaaaaaaaagagagagagagagagagagagagaaaagtactttactaatgaaaccctggaaatagaaatcaggtcaagattggccattccaatggctgtctaggacagagaccgagtttctacttttgcaacctctatttggacatttaacacctgttcacttatcaaagcgcgacttgtaggatcaacaggggacagccactggcccaccctgcctgaaagaaactaca

SEQ ID NO: 27897 - DNA, 601 bp, Human
cactagacttcaaagtttcatctgcagtgacatgcaaaacccacgcaccggggaaaccagcatctgggttccatgtggaaggggactctgtgtgggcacaggcggtgaactgcctcgtcttgctatctacgcagaagtgctttactggttgggcgtggtggctcatgcctgtcattccaacactttgggaagccgaagcaggaggatcacttgagcccaagagtttgagaccagcttgggcaacatagtgagaccatgtttctattaaaaaaaaaaaaagttttaaataaactgggcgtgrtgtcacatgcctgcaatcccagttactcaggaggctgaggtgggaggatcacttgagcccaggcgtttgaggctacagtgagctctgatggcaccactgcactccagcctgggcaacagagaccccgtctcaaaaaaaaaaaagagagagagagagagagagagagaaaagtactttactaatgaaaccctggaaatagaaatcaggtcaagattggccattccaatggctgtctaggacagagaccgagtttctacttttgcaacctctatttggacatttaacacctgttcacttatc

SEQ ID NO: 27898 - DNA, 601 bp, Human
gttgcctctacacttcacgctgaggaaacaccctctgcgcaccataacatctgaaggagactatcggctgcctctcactagacttcaaagtttcatctgcagtgacatgcaaaacccacgcaccggggaaaccagcatctgggttccatgtggaaggggactctgtgtgggcacaggcggtgaactgcctcgtcttgctatctacgcagaagtgctttactggttgggcgtggtggctcatgcctgtcattccaacactttgggaagccgaagcaggaggatcacttgagcccaagagttygagaccagcttgggcaacatagtgagaccatgtttctattaaaaaaaaaaaaagttttaaataaactgggcgtggtgtcacatgcctgcaatcccagttactcaggaggctgaggtgggaggatcacttgagcccaggcgtttgaggctacagtgagctctgatggcaccactgcactccagcctgggcaacagagaccccgtctcaaaaaaaaaaaagagagagagagagagagagagagaaaagtactttactaatgaaaccctggaaatagaaatcaggtcaagattggccattcca

SEQ ID NO: 27899 - DNA, 601 bp, Human
ctgtgctccctgaaggaaagcagggacgccaacacccgtctcctcaatgtcctcatctgtaagcatggggatataatccttctactgggcttctacaagtattgtatgaaataatacacaataaacactctgaactctagggtagcaaatatcattcttaaaaatacattgggaaagatgcctgtgagtttagcaattggttacctggaaaatccaggatatgacggcgtttaggatatgtcctgaataattatgtcaaagttgcttcatgggcccagtaaaaaaataaacagcctcaggwgaatgaaaaagtccatgcactttccctaactgcctgactgaccctattccagcggccaatggcagggccgcaggagcacagcctggaaatcccacggggccaactcccatgggacaaaatgaagcgcaggatggcgctcaacccggacatcctagttaggaagaacacaggtgcccagaaccatgagccagggctgaagccagacatcatccagcagggcctccgcgtgccctgtggcttccccgacaccagcgggctcggctacttcccacttgaagctgcaggtgaggcctcgggctc

SEQ ID NO: 27900 - DNA, 601 bp, Human
gcccatgccccgcccctaagtctcaaagaaggagcaaaggcggcagaagggccgccctgggagagggcctgtccccttgccgtgtggaacgtgctggacccatcactgacttcagggagcaacctgacctgtgctccctgaaggaaagcagggacgccaacacccgtctcctcaatgtcctcatctgtaagcatggggatataatccttctactgggcttctacaagtattgtatgaaataatacacaataaacactctgaactctagggtagcaaatatcattcttaaaaatacattggsaaagatgcctgtgagtttagcaattggttacctggaaaatccaggatatgacggcgtttaggatatgtcctgaataattatgtcaaagttgcttcatgggcccagtaaaaaaataaacagcctcaggagaatgaaaaagtccatgcactttccctaactgcctgactgaccctattccagcggccaatggcagggccgcaggagcacagcctggaaatcccacggggccaactcccatgggacaaaatgaagcgcaggatggcgctcaacccggacatcctagttaggaagaacacaggt

SEQ ID NO: 27901 - DNA, 601 bp, Human
gagataggggcctgggaatgggaaacgtggatcagttcaacacatacaagccacacactctgtgccctggagctgccctggggaaatcaagtcacgtatataaacaaacagttcataacaatttcaggcaattctggacagtgtggaaagtattggttttaaaagtaatactacaaaagcagagagcaaaatgcccaacaagacagtaacaatcctacccgtttctggttttgttctatttgttttattataaagctctttctaatgggaaataaatgcctctagaatgaggtatgtgatrctaagtttgagaaatcaaaaagtttgtgttcaggcaaaagatgggtgactttttaattctattttcctttattcctatattgtttttagtatcaaaggagggagggatcgtccttcaattgcctcaaaattgaaggcagccaagtagatcatttttattttctagcaacttaaaaagttgaaatgtcttactaagaaacccgagttcagaagcataaacgtgaagtatcagaactgtggttttctcctgctgtccccacgtagaggggctcttcacaggacagtaggcagccccttcaat

SEQ ID NO: 27902 - DNA, 601 bp, Human
ttgatgattgttgttattaatgttgaaataatactttggatctggcaggttaaaaaatgtattgttgaaactaatttcacttctttttgctttttaaaaatatggctactagaaaatgtaaaattctctttttgtttggtttttagagacaggttctcactctgttgcccagcctggagtgcaaacgtgatcacagccatagccgcgaactcctcagctcgaacaattctgcagcctcagcctcccaagtagctagggccacaggtacaagccaccatgcctagctaaattttttttttttggtagagacagggtcttgctattttgcccaggctggtctcaaactcttggcctcaagcgatcctcctgcctgggcctcccaaagcattgggattacaggcatgagccaccacatccagcagaaaacataaaattctgtgtgtggcccacgctgtacttctactggccagcactggtacagatcaacttgccttaacaactaaaagaagaggaacagagagataggggcctgggaatgggaaacgtggatcagttcaacacatacaagccacacactctgtgccctggagctgccctgggg

SEQ ID NO: 27903 - DNA, 601 bp, Human
caggagcagggaaggaagaagtgggtaccacagccaagcctgcagagagatgataagcacctcaagaggcagctcatctgaggacagaggaggaaagagggcactcctcatcacagacaaaggaaagagagcaccaacttggcttcccccatgcatcactgcaaagtaaagttttaaacacaacacagacatcaggtagctacagacccgcccgagggtaaatagggtcaaccccagccacgatgcccagtgagcacgtaaaatgtgctgcgtctgaatggagatgtgctaagtgtaaaayacacaccaactccaaagacggtccctccaaaaatgtaaaataccttattgatgattgttgttattaatgttgaaataatactttggatctggcaggttaaaaaatgtattgttgaaactaatttcacttctttttgctttttaaaaatatggctactagaaaatgtaaaattctctttttgtttggtttttagagacaggttctcactctgttgcccagcctggagtgcaaacgtgatcacagccatagccgcgaactcctcagctcgaacaattctgcagcctcagcctcccaagtagc

SEQ ID NO: 27904 - DNA, 601 bp, Human
ctagagctcctcttttcaggcatttgaaatacttggcatctctcccagagaacaaatggttacataaggtcctcccaaaagcacacattagccacggagcctaagactcaactatcaagaaatacaaatgactaaatcacgggatgagttgatgtcacacaaaagaatccaaacattaattccagctgagacagaaaggctctgaaaatgcttcagaggagaggcggctctcatttttcctacagccatccactgaaacaacatgtttggagcaaaactggcaggaagtctaagccatggscaccgtggttttggcagccatcggggtgaacgctcagtgggagcttcaggagcagggaaggaagaagtgggtaccacagccaagcctgcagagagatgataagcacctcaagaggcagctcatctgaggacagaggaggaaagagggcactcctcatcacagacaaaggaaagagagcaccaacttggcttcccccatgcatcactgcaaagtaaagttttaaacacaacacagacatcaggtagctacagacccgcccgagggtaaatagggtcaaccccagccacgatgcccagtgag

SEQ ID NO: 27905 - DNA, 601 bp, Human
atcaatgtgtaagtctaattttaaaagaatgcatataaagactgagaagatcatgattcttacacaaaaactccagagcatgtcaccaaaaaccaagaatgggttcagcctccctggagagatgtgaataaaacgggaaatcatatcccttttacttacgatcaattgtcaaaaagtgaacattgatccatacatgatgacacagtaagattccagggatgcatatgcattcccgatgtgagggcaggaaacccattttggccataaaaatagtgatgcagtccaagaatctatttcctasaactgcttccgaaatatggtccaaagcaggaacaacgtgtctgcacaaagatgtctctcgggattttcgtaattacactaatttggaaacaactctgatgcccaacagtacagaatcagttaagtaaattatacaaactgaaataacagactaaaaatggtaattatctgtatttacatatatatattaaagcaatattaaaaatatgtacaagtttaaaagtacatacaaaattacagattgggcatcccttatctgaaatgcttctggctttggatctgggaatatccgcattatact

SEQ ID NO: 27906 - DNA, 601 bp, Human
ataatcccaaatatacatttcagggtttgtttttgtttttaaagacactttcctggaatatgtgcactatggttaaaattaaaaacaaaagtaataaaataaaataaaatgatcgctggaaggagctgaccctccccacccatctgagagacttcatctggctgcagcacagtgaagactgtgtgtgtccctggacgggcgcctggcactggggtggctcccagtggcgcacctcttcggtggagtcagcgaaggctctcgttgacttttaaaaaaggaggaggatgaagaaggaaaaaargaaaaacaaaaccccaaatgccaaaggaatttcagtgggatgaagttcctccaccacttagagagtatctagggaaaaagagagagagagaagtcaacacatgtcatttctcatccctgtgcaaaaattcatatagtaaccaaaatcttagttttcataagaaattccaagtcatacaaaaataagtggagcaaatatcaatgtgtaagtctaattttaaaagaatgcatataaagactgagaagatcatgattcttacacaaaaactccagagcatgtcaccaaaaaccaagaatgggt

SEQ ID NO: 27907 - DNA, 601 bp, Human
acacccatccaccagagcgattctccagctcccagagggagttatcaacttaaagcaggatacctgaggtttcatgtctttagttgccttatcataatcccaaatatacatttcagggtttgtttttgtttttaaagacactttcctggaatatgtgcactatggttaaaattaaaaacaaaagtaataaaataaaataaaatgatcgctggaaggagctgaccctccccacccatctgagagacttcatctggctgcagcacagtgaagactgtgtgtgtccctggacgggcgcctggcrctggggtggctcccagtggcgcacctcttcggtggagtcagcgaaggctctcgttgacttttaaaaaaggaggaggatgaagaaggaaaaaaagaaaaacaaaaccccaaatgccaaaggaatttcagtgggatgaagttcctccaccacttagagagtatctagggaaaaagagagagagagaagtcaacacatgtcatttctcatccctgtgcaaaaattcatatagtaaccaaaatcttagttttcataagaaattccaagtcatacaaaaataagtggagcaaatatcaatgtgta

SEQ ID NO: 27908 - DNA, 601 bp, Human
gccaccggctggcacacaccaccctctccctcgacacctaggaagggaggccagtgagggccccacagaccgaggaggccgtcgcctggccctcagccaggatggctaggtatgatgggctcactggctcacacgccctctcctagccaggggtgctgcatgaggggccgcaggggcgatcgcatgaccatcaacatccaggagcacatggccatcaacgtgtgccccgggcccatccggcccatccgccagatctctgactacttcccccggggaccaggacctgaagggggcggcgggrgcggcggggaggcccccgcccatctggtccccctggctctggccccccctgcagccctccttggggccaccacgcctgaggatggtgcggaggtggacagctatgactcggatgatgccagtgagtctgggggcttggaggccccatgtgctggtgggggtctccaggcttgccgtggtggggggagagggggatgggccctgctggctgtgcatgtaggtaggggaggagggcagtgggggggtggcaggggacggccaccacagctgcagtcagcgtggagattacagcttcagcaag

SEQ ID NO: 27909 - DNA, 601 bp, Human
ggaaaaggacgggggttcccgaggaggcgtggggtactcgtctggctgcccaaggctccaaggcccttctagctctcacggcctgtgtctatggccacatccaccgtggtgttcggctcctgcccccaggccctgaatggaggcagtgagcagcgtgctccaagatttctgagggcttcccacaatggctgagcatgtcctgatggaccagggacagccgggtggctgcagagggagggacagaggaatgggcaaatctgcttgtccttctcaagtgccagcctgtcttccagatgagacrtagtgtttagggcagagctgggctggtccaaggcccttcctacaccccggaacggggctcaggtaccccaggggccctgacactgcagttcccgaccaggatcgccgtctgtgatgaggacaagctgagtcacaatgagtttattggggagatccgcgtgcccctccgccgcctcaagccttcgcagaagaagcattttaacatctgcctcgagcgccaagtcccggtctgtgtgggggctgcaggggcgccaggggagggggccctggggaggccaggcttccagaaccttctctttgc

SEQ ID NO: 27910 - DNA, 601 bp, Human
ggtggctgcagagggagggacagaggaatgggcaaatctgcttgtccttctcaagtgccagcctgtcttccagatgagacatagtgtttagggcagagctgggctggtccaaggcccttcctacaccccggaacggggctcaggtaccccaggggccctgacactgcagttcccgaccaggatcgccgtctgtgatgaggacaagctgagtcacaatgagtttattggggagatccgcgtgcccctccgccgcctcaagccttcgcagaagaagcattttaacatctgcctcgagcgccargtcccggtctgtgtgggggctgcaggggcgccaggggagggggccctggggaggccaggcttccagaaccttctctttgccccctcagctggcgtccccctcttccatgtcagcggcgctgaggggcatctcctgttatctgaaggaggtgaggcacctcatggggatggggatgcatgtgggtgggaggctgcaggggcccaggctgaccctgagtctgtgccccgcagttggagcaggcggagcaggggcaggggctgctggaggagcgtggccgcatcctgctgagtctcagctaca

SEQ ID NO: 27911 - DNA, 601 bp, Human
gcggcgccggggactgctggtaggcatcttgcgctgcgcccatctggctgccatggacgtcaacggttactcggacccctacgtcaagacgtgagcccttgctctgaccctctcctccccagggagcctgccctggcctgagttgggcctggcctgtccctcacccctcagttcgtctccctccaccccacccccaggtacctgaggcccgatgtggacaagaaatccaagcataagacgtgtgtgaagaagaagactctcaacccagaatttaacgaggtacccaggaggggacgggacrtggagggaggccagggaggggctggggagctggctcacgaacgggtggccggccttgtccctaggagtttttctacgagatagagctctccactctggccaccaagaccctggaagtcaccgtctgggactatgacattggcaaatccaatgacttcattggtgagggaggagctggctgcgggtgttgagggcgggcaagtggcagggaggtggccctgaccctgcccacctgctccccaggtggcgtgtccctggggccaggtgcccgaggcgaggctcggaagcactggagtgactg

SEQ ID NO: 27912 - DNA, 601 bp, Human
cggacgcagccctggagcgctggcacaccctgaccagtgagctgccccctgcggccggggctctgtcctcagcctgagtggacagcagtgtcccggcacaggcccatcgagccgggtccagtacccaaccttcgcacgagtgtgttgcacgtttacacagggtgggctgcccccaccctgcactacctatttttgtgagtctccgtgacccgggtctgtctgctcatgaggggctgcggagttctatattcacatatgcaaacctcctgcctgactcgctagtccctgcaaatatgcaaascccccatcatctgcacacccgggcagtgctcagagcccggccccaggcccccgcgctcctcactcctgcctctccacgctgccccgtccctctcccccaacagggaggaggtcggattaggggaggttcagaggaggagaatgtctcaaaaaaaaaggacaaaaaacaaacccagagccactcctttaatacagaaacttcattgaaaaaacctagccctgtacagctgcccttttaaagaggtggccattgcagggtctctgcctccccagcaggtggcagatgctcccggccactcgt

SEQ ID NO: 27913 - DNA, 601 bp, Human
ttgggaggccaaggtgggtagatcgcctgagcgtcaggattttgagaccagcctggccaacatggtgaaaccccatctctactaaaagtacaaaaaattagccgggcgtggtggcaggcacctgtaatcccagctacttgggaggctgaggccggagaatcgcttgaacccgggaggcggaggttgcagtgagccgaggttgtgccactgtactccagcctgagcaacagagtgagactccatttcaaaaaaatacaaagaaaagtctagagtcagtgttttccctgcaaatgtccagttkttcagtctcttttcccctactgaattgcctttgctcctttgtcaaaaaccacgtaggagtaggaggagtgagttgtgaaatcagggtgtgttggccccccagcttcatacatttgcacaggtttctggctattcttggtcccttgtgtttccatgtgaattttagaatcggccaatttgtataagaaagtgtgctaagattttgattgacggtatatagaatctacagatcaatgtaggagaattaaattcttaacagtattgagagtctgggctcagtggctcacacctgtaatcccag

SEQ ID NO: 27914 - DNA, 601 bp, Human
ctagaaaggtttcagagaaaggctgtgttttgatttagaactggtttttttgttttttgttgcacaaaaacaaacctctcaggccctttaaaaaaaaagagagagagaggtgtggcctccctatgttgtccaggctccttgggaactcctggactcaaacagtcctcctgccttggcctcccgaagtgctgggattccaggcgtgagccattgcacccggctgacatgcaagttctgaggaaagccaggctgtctttcttgagtcacggagtagttgtcttcatgacatgttgataccagrtgataatggtcagtgaaagagagaggttagtcctttgtattaggtggcatccttccctcacacccaagctgcaggcccagcgtaggaatgggacctccacagccacacaggtctcatcctgtgtggctgtgaaggtcgctatatgactctggaggtagctatgtgactatggaggtctcgtcccgtgtggctgtggaggtcgctgtgtgactgtggaggtcacgtcccatgtggctgtggacatcttgtctgtgtggctgtggaggttgctgtgtgactatggaggtctcgtcctttgtg

SEQ ID NO: 27915 - DNA, 601 bp, Human
caagctgcaggcccagcgtaggaatgggacctccacagccacacaggtctcatcctgtgtggctgtgaaggtcgctatatgactctggaggtagctatgtgactatggaggtctcgtcccgtgtggctgtggaggtcgctgtgtgactgtggaggtcacgtcccatgtggctgtggacatcttgtctgtgtggctgtggaggttgctgtgtgactatggaggtctcgtcctttgtggctgtggacgtcttgtctatgtgactgtggaggttgctgtgtgactgtggaggtcgcgtcccgtrtggctgtggaggtcactgtgtgaccatggaagtcgcgttccgtgtggctgtggaggtcgctgtgtgactatggaggtctctctcgtccgtgtggctatggaggtctgtgtgggagtatggaggtcacatcccgtgtggctgtggaggtcgctgtgtgactgtggaggttgctgtgtgactatggaggtcgctatgtgactatggaggtcgctgtgtgactatggaggtctcatccatgtggctgtggaggtctctgtgaccatggaggtcacgtcccatgtggccgtggaggtcgctgtg

SEQ ID NO: 27916 - DNA, 601 bp, Human
cttcaaaaaatggtgtcagctgggcacggtggctcatgcctgtaatcccagcactgtgggaggccgaggcggacaaatcacctgaggtcaggcgtttgagaccggcctggccaacatggcgaaacccctcctctactgaaaatacaaaaattaacctgtgcgtggtggcaggtgcctataatcccagctactcgggaggctgaggcaggagaatcgcttgaacccgggaggtggaggttgcagtgagccaagatcctgcctttgcactccagcctgggtgacagagcaagactccaactcaaaaaaaaaagatttcttcttgtattaggggtgttcacagaataaaaaagaaagtttattaattaaacaaactgaagtgaattacacatctagcctgcagaaaaataaataggaaacaatacagtctggcctgtgtcacccagaaaaagctcagtttggattgaatcactgccctggggagtgtgaggggaaggcccagcctgttgttctccttcctgatgggaaggtggtcactgagggaaaagattttcttggttctctagccctgatttcactttgtaatcatcaaggtgaacttaaa

SEQ ID NO: 27917 - DNA, 601 bp, Human
cgtggtggcaggtgcctataatcccagctactcgggaggctgaggcaggagaatcgcttgaacccgggaggtggaggttgcagtgagccaagatcctgcctttgcactccagcctgggtgacagagcaagactccaactcaaaaaaaaaagatttcttcttgtattaggggtgttcacagaataaaaaagaaagtttattaattaaacaaactgaagtgaattacacatctagcctgcagaaaaataaataggaaacaatacagtctggcctgtgtcacccagaaaaagctcagtttggaytgaatcactgccctggggagtgtgaggggaaggcccagcctgttgttctccttcctgatgggaaggtggtcactgagggaaaagattttcttggttctctagccctgatttcactttgtaatcatcaaggtgaacttaaacacaaacacactccagtgacccccatctcagactgaggaatcggagcacccggaaacaggcctgtgaggatcaaacctgttgagaagtcccaagtgactgggcaccatagatgctcaggagtggtgcaggccagctgcctgggacccgaggtccagcagg

SEQ ID NO: 27918 - DNA, 601 bp, Human
ctgtgagggcgcacagaagcaggccccgccccagtgccacggctcagcaatgcgcttccaggaacctacgttccagatgtttccatccaaaaagcggcctgactcctaggcttgggggaagtctttagcagatgcccaagccttctcccaaagacttaggcgtttatgagagtcagtaggcggtgattgttcctactctagttgctgtcccaatttacttgaaaacgactatctgattacctgatcaaatgaatcttttgccagttactcctactctgtgggttgactaatgtgccatcarttcactcactgcacaagcacttgctttctacctactgcactggcaccgcaaaatggaaagtgacccccatgcctgatttctaccctccaagaagtcgcaggcttatgggagaggcaggggaattactgtatttccctggtgcagtggcaaaactgtgattacaaaaattatcatttggttcattaaaggcaaaagaaaaaaacactaccgtattaaatgcccttattagtcatgagacaagatcttgagttgagaactgcgcgtcaggccaggaatggtggcatgtgaagcatctggggc

SEQ ID NO: 27919 - DNA, 601 bp, Human
ccgcaaaatggaaagtgacccccatgcctgatttctaccctccaagaagtcgcaggcttatgggagaggcaggggaattactgtatttccctggtgcagtggcaaaactgtgattacaaaaattatcatttggttcattaaaggcaaaagaaaaaaacactaccgtattaaatgcccttattagtcatgagacaagatcttgagttgagaactgcgcgtcaggccaggaatggtggcatgtgaagcatctggggcagagcctcccagaggagaccctcctgaagggatggggaggatgcgccctcctgtggctgtggcaccagaagcagagcgtggagggtgctctggaaaccccgagcagcgggcacaactagaactccagagacctggtggcccttaggctgtgatgctaagttgcagactgaatttgaatctttgtggatactaccaaggagtcagacttcagtctgtgagtatcccagagtcctcacaggttttttaagcaagaaaccagaattagattgttcatggaggtcactctggcagaatgatgggataagtttacatatagaccagcacaccacagccttccattgggtcg

SEQ ID NO: 27920 - DNA, 601 bp, Human
aaggcttttaggctacattcgtacgttaacctagtaaacatggggtgtttctgtccaactcagcactgtgcgttggggaccagggacaggcatgaatggcacgggtcctgctctcaaaaagcttgtttttgctggaagagagttctgacccagcccagtctcacatggggaaatgttaatgtgatggcagatgctgagatactgtgtggcagggagtattccaaggtctgcatattcagatttcttttgcctctgggatattccagtacttcaagtaactctactttctaagatttaagtratttgttgttgttgttgttgttttgagacggagtttcgctcttaattgcccaggctagagtgcaatggcgcaatcttggctcaccgcaacaacctccactcctgggttcaagcgattctcttgtctcagcctcccgagtagctgggattacaggaatgcgccaccacgcctggctaattttgtatttttagtagaaacggggtttctccacattggtcaggctggtctcgaatttgcgatcttggattatctgcctgcttcgacctcccaaagtgttgggattacaggcgtgagccacca

SEQ ID NO: 27921 - DNA, 601 bp, Human
tggtgacgtcccttcctcaaaataaaggccatttgtacccttgcactcatacacatgctcagccacaggcagctgctgcagaacccacaccacatgctgcaggaccacgtgccacccagccaagctacgtgggcaacaggagctcttcaaaaatgtcaagcccgcagagtgcggtggcttacgcctgtaatcccagtactttgggaggccaaggtgggtggatcatgaggtcaggagatcgacaccatcctggctaacacggtgaaaccccgtctctactgaaaatacaaaaaaattagcygggcgtggtggcgggcacctgtagtcccagctactcgggaggctgaggcaggagaatggcatgaacccgggaggcagatcttgcagtgagccgagatcgcaccactgcactccagcctgggtgacagagcgagactccatctcaaaaaaaaaaaaatgtcaagccaactgtcctcagaatctaacctgtagataactatagatgaaactcacattttccttcccctggttcaccttgacagcattgcagctctggtcagccacagaatgccaggcagtggtggacaccatgatagccgtg

SEQ ID NO: 27922 - DNA, 601 bp, Human
gggcaacaggagctcttcaaaaatgtcaagcccgcagagtgcggtggcttacgcctgtaatcccagtactttgggaggccaaggtgggtggatcatgaggtcaggagatcgacaccatcctggctaacacggtgaaaccccgtctctactgaaaatacaaaaaaattagccgggcgtggtggcgggcacctgtagtcccagctactcgggaggctgaggcaggagaatggcatgaacccgggaggcagatcttgcagtgagccgagatcgcaccactgcactccagcctgggtgacagagygagactccatctcaaaaaaaaaaaaatgtcaagccaactgtcctcagaatctaacctgtagataactatagatgaaactcacattttccttcccctggttcaccttgacagcattgcagctctggtcagccacagaatgccaggcagtggtggacaccatgatagccgtgtggtcagaagggaagggcacgggagtgagctgggaaccttggctgttggggaagttgcaaagctccagtttcctctaagtgtgcctttatgatccgcactggcgacagcaggctttgtctttccttagaa

SEQ ID NO: 27923 - DNA, 601 bp, Human
ctgagccgtaggtatctttattgaccatattttccagatgaagagacgaaagcccaagagaaccctgttaatgctcggccagatcagaggagacaaaacaagcacccctgccttcatgggttgtgtggatgaatgagggtcggcctagggctgtcccctcgcggtctgtccggtctgtcggtacaggcagcagatgggccacttgttcctggaattgcagaagcagataaccaagtgtagaaaatgtatgtatccctcttctaccccaacagaagcaccgtctttttgctttttctttttytttttagttacagatatgataggtaggtttttttctatggtgtaagcatttctgctgttggattttgtttgctgtttgaagacctgcctaactcgtctcagtaggctgtataaatcgtttaatgaagattggcccttttctgaagtgagaaaaaggatggttgctgaagaacctatctcgagaatacactattgacagactcacggtgtctgtgtgtctcacatcctggaattacttgcacaccattgtggctatgtgttatatcccagaatatggaattgattttgatgtttagaaggc

SEQ ID NO: 27924 - DNA, 601 bp, Human
ccattgtggctatgtgttatatcccagaatatggaattgattttgatgtttagaaggccaaagcttacttagtaaatgccacactgattttagcttaccattttgtagtttttttctgtgggaaataacaaaaaaattattgattgaggatctatattgattttacagagctattttagaggaagtatttctcatttaatgaacactttacattggactttccatcttaacaagacactgccccaggtggaactctgtcttcacaacacctgagctgcccagtggtgtcagattgactggygtcagtttaaccccgttaagtttaaaggatctgtgcaccctcatctggaagcaaagctccgccttcggctgctgtggcccgcctgcccgcagagaggcttgctgggaggtccaggccgcagttcccgtccagctcctggagtcagagctgcaggatggctgttgggggtccttgaagcctgtccagatgcacttgggatgggtttttttgttttgtccagactgtttctgtagattcctaatataatgagccattataattttgaacaatttgtaaagagtacttccagaggaacctgtt

SEQ ID NO: 27925 - DNA, 601 bp, Human
ccattttgtagtttttttctgtgggaaataacaaaaaaattattgattgaggatctatattgattttacagagctattttagaggaagtatttctcatttaatgaacactttacattggactttccatcttaacaagacactgccccaggtggaactctgtcttcacaacacctgagctgcccagtggtgtcagattgactggtgtcagtttaaccccgttaagtttaaaggatctgtgcaccctcatctggaagcaaagctccgccttcggctgctgtggcccgcctgcccgcagagagrcttgctgggaggtccaggccgcagttcccgtccagctcctggagtcagagctgcaggatggctgttgggggtccttgaagcctgtccagatgcacttgggatgggtttttttgttttgtccagactgtttctgtagattcctaatataatgagccattataattttgaacaatttgtaaagagtacttccagaggaacctgttaaccattcaaccattaggtctttgctgtaagtgtctgtttttaattttctggcagtgcttctgagaattctgcaaagcctcaagaaaaaatagagta

SEQ ID NO: 27926 - DNA, 601 bp, Human
aaatacacattctaagagtcaaggtaagagtgttcctaatttggtgcatggatgagagttcatgttagttttcattgaggctggaagttaaacctgagccattttcctgtccagctgcactttgccacaggctgggcacactggctcatacctgtaatcctagcactttgggagactgaggaggattacttaagaccacgtgttcaagaccagcctaggagtatagtgaggtgccatctcttttaatttttaaaaaatagtcctagtgactcttaccaggccagtcaccatctccaggagyccccctgtgggagtatgttcagtgtctgccctttgtgaagtggggccttttgtcccgccacctacccccagggcacttaaggcctgggtgtgtttctgccggcagggacttgaaggtgtctggcagtgaaggaaggagaggatgaagggaggctggagagggagtggcgagcggccagaggcaggcggggccgtgggaagggaaagcagcacaggcaagctgagtgcacattggtgatgagatacagagatccatgattgaacttctagtgtatcttagcccactggggctgccatgaca

SEQ ID NO: 27927 - DNA, 601 bp, Human
gtgcacattggtgatgagatacagagatccatgattgaacttctagtgtatcttagcccactggggctgccatgacaaaacaccatagagtgtggctcatcaacagcaggagtctgttgctcacagctctggaggctggaggtccagggtcaaggcactggcagattgcatgtctggtggggccccgcttcctggtccatagccagcaccttctcactgcatccttatgtggtggaagaggcaggggagctctctggggtctcttttgtaaccccattcttgaggcttgtccactctcatsacctaatcacctcccagaggccctgcctcctaacaccattaccgtagagtgagagcttcagcctatgaattttggggggacatgaacattcaagactaatattctttcagtattccagttactgaatggtgtgtagtattcagtggagaaggtagctgaaattaaggggttaaaattgtaataatggccggttgcggtggctcacgcctgtaatcccggcactttgggaggctgaggccagtggatcacaaggtcaggagttcgagatcagcctgaccaacatggtgaaaccccgtctct

SEQ ID NO: 27928 - DNA, 601 bp, Human
tggtccatagccagcaccttctcactgcatccttatgtggtggaagaggcaggggagctctctggggtctcttttgtaaccccattcttgaggcttgtccactctcatgacctaatcacctcccagaggccctgcctcctaacaccattaccgtagagtgagagcttcagcctatgaattttggggggacatgaacattcaagactaatattctttcagtattccagttactgaatggtgtgtagtattcagtggagaaggtagctgaaattaaggggttaaaattgtaataatggccggktgcggtggctcacgcctgtaatcccggcactttgggaggctgaggccagtggatcacaaggtcaggagttcgagatcagcctgaccaacatggtgaaaccccgtctctactaaaaatacaaaaaattagctgggcgtggtggcacacgcctgtaatcccagctactcaagaggctgaggcaggagaatcgcttgaacctgggaggcagaggctgcactgctgagctaagatcgtgccactgcactccagcctgggcgacagagcgagactccatctcaaaaaaaaaaaaaaaggtaataa

SEQ ID NO: 27929 - DNA, 601 bp, Human
gcatccttatgtggtggaagaggcaggggagctctctggggtctcttttgtaaccccattcttgaggcttgtccactctcatgacctaatcacctcccagaggccctgcctcctaacaccattaccgtagagtgagagcttcagcctatgaattttggggggacatgaacattcaagactaatattctttcagtattccagttactgaatggtgtgtagtattcagtggagaaggtagctgaaattaaggggttaaaattgtaataatggccggttgcggtggctcacgcctgtaatcccrgcactttgggaggctgaggccagtggatcacaaggtcaggagttcgagatcagcctgaccaacatggtgaaaccccgtctctactaaaaatacaaaaaattagctgggcgtggtggcacacgcctgtaatcccagctactcaagaggctgaggcaggagaatcgcttgaacctgggaggcagaggctgcactgctgagctaagatcgtgccactgcactccagcctgggcgacagagcgagactccatctcaaaaaaaaaaaaaaaggtaataattaaattggccagcatttttaaagtt

SEQ ID NO: 27930 - DNA, 601 bp, Human
taaagttttccttagcagatctgtacagactcactagatagtgttttatttttaaagaagattaacacgtgctggcaggaccactgcagacaaatggtaagcttgttcactttttcatcaaaacacgacctcatccatcttccctcacccacatgattgagagctgagacatagaagttctgttgaggattctgtctgtgttcagtgctgtggttgaacagcacgatgagaaaagcagggaaggtgaactcctcagctcctgtgagagggcaccactgaccctcttggccttcaggtccasagtcacagtccgcagtggtgacagggttcttagatgcctgcatgggtctctaaatgtctctttaagcacagtttactcctcagaatctagcctgaatcccaggtctttcctgcagctgcacaaccagcgtcttaggctttgtagatgtcttggctttgacttgacgtcatgtatacatttttagtgtgacctggccgttaattacttaagtgagagaacagaccgtattaatagctttcctaagtaggttgaaatcttccgttttctaaatgatatcagtaggagacgatgggtgtattt

SEQ ID NO: 27931 - DNA, 601 bp, Human
ttgaaacaccaggtgtctagccagcagcaaggagtggagcaggaagctcggacaggcggctgactttggtcatgagggtgaagacagagggtcttggtttctctctgacgactggaggttgagcctggagcggctctttccagcgctgcagttgaaactcggagaaagactgcctgctgcccgtggggtcgcagccctgaggctgtgcgtcccctgtggaatggcttgctcagcctcccggcctcctgagcacatagcactcatcgtccgtcatctttcggggactgtatacaccaggggytctggggcctttcctcagcagcgttcgcggccacggaccccacatgtcctctgctgacccctgtgtgtcctctgtggccaccccatggcgctgaatcctgccgcctcctgcaagccgactttggacaaaagctgtgtccggtctcaccgtctgatttgtcttgttctctgttaatgtagtgtttcattcttctcacattcatacataaaagtgatgtcgtgccttctcatgagctttaaacccaagttctttaaaatgtgcctgcttttcctaccccacccactgggcacgctgacccaa

SEQ ID NO: 27932 - DNA, 601 bp, Human
gatttgtcttgttctctgttaatgtagtgtttcattcttctcacattcatacataaaagtgatgtcgtgccttctcatgagctttaaacccaagttctttaaaatgtgcctgcttttcctaccccacccactgggcacgctgacccaaggcaatgtgatttctgctttcgccatgtagagattgctcttgtctgagatgtcggtgacctgccagttaccaaatccagcaagcatttttgtccttattttatacaacatctatacaattttggacaccctgtccttgttgaagctcccattmatgccatttgcccttctaacttcctcatggaactcccaaacatctcctagtaggcatccatgtggtctacgagaaggcaaacgctgcacagaaaagacagcctgtgttccaggaaagaatggagatgataaaagtgatcatagcagattatttagcatttgctctgtgcaagggactgtttcctactaatgtatttaatccctagagcagctctgtggcgtggccattgtcactcctattttatacaaactaaggcacataagttaaaataacttgccctacctcagttgtctggcccat

SEQ ID NO: 27933 - DNA, 601 bp, Human
tcctcatggaactcccaaacatctcctagtaggcatccatgtggtctacgagaaggcaaacgctgcacagaaaagacagcctgtgttccaggaaagaatggagatgataaaagtgatcatagcagattatttagcatttgctctgtgcaagggactgtttcctactaatgtatttaatccctagagcagctctgtggcgtggccattgtcactcctattttatacaaactaaggcacataagttaaaataacttgccctacctcagttgtctggcccatagtctaaatgcttttcaaaaattattattattattattattatttttagagacagggtctcactctgttacccaggctggagtgcagtggcacaatcataactcactgcagcctcaaactcctgggctcaagtgatcttcctgcgttggcctcccctgtagctgggactataggcacgcaccaccacattcgactaacttctaaaaattttttgtagtgccaggatcttgctatgttgcccaggctggtctcgaacccctggcctcaagcgatcctcccacctcagcctcccaaagtgctggaattacaggtgtgaaccacc

SEQ ID NO: 27934 - DNA, 601 bp, Human
atctcctagtaggcatccatgtggtctacgagaaggcaaacgctgcacagaaaagacagcctgtgttccaggaaagaatggagatgataaaagtgatcatagcagattatttagcatttgctctgtgcaagggactgtttcctactaatgtatttaatccctagagcagctctgtggcgtggccattgtcactcctattttatacaaactaaggcacataagttaaaataacttgccctacctcagttgtctggcccatagtctaaatgcttttcaaaaattattattattattattattttttttagagacagggtctcactctgttacccaggctggagtgcagtggcacaatcataactcactgcagcctcaaactcctgggctcaagtgatcttcctgcgttggcctcccctgtagctgggactataggcacgcaccaccacattcgactaacttctaaaaattttttgtagtgccaggatcttgctatgttgcccaggctggtctcgaacccctggcctcaagcgatcctcccacctcagcctcccaaagtgctggaattacaggtgtgaaccaccatgcccaacactaaactctt

SEQ ID NO: 27935 - DNA, 601 bp, Human
agtgatcatagcagattatttagcatttgctctgtgcaagggactgtttcctactaatgtatttaatccctagagcagctctgtggcgtggccattgtcactcctattttatacaaactaaggcacataagttaaaataacttgccctacctcagttgtctggcccatagtctaaatgcttttcaaaaattattattattattattattatttttagagacagggtctcactctgttacccaggctggagtgcagtggcacaatcataactcactgcagcctcaaactcctgggctcaagygatcttcctgcgttggcctcccctgtagctgggactataggcacgcaccaccacattcgactaacttctaaaaattttttgtagtgccaggatcttgctatgttgcccaggctggtctcgaacccctggcctcaagcgatcctcccacctcagcctcccaaagtgctggaattacaggtgtgaaccaccatgcccaacactaaactcttaatttataaacatagtttataccataactgtcatacaaactataaacattgtttataaaatagaataaatgataccacctccagtctacca

SEQ ID NO: 27936 - DNA, 601 bp, Human
cagagcccacaagatgggttttgtggacagccactggcagctgaaccatcttcctaacattcctcaggccatgagctgaggactgcgatgaactctgaaagctgtgcatcaccttctcttctcaggggaaagcagcaaacatttggtaggagagctcccagggcttggagaagggaagctgctgggacgtgctcagcagaggacactgggaagagagtgtaccctgagggctgttggagacggtggcgggaggggcaggtggggcaggcagggtcgtggtgcccaactgcctgagtgtctsccgtcgctcagcaggaaggtggcgaggaccccgggcttctgccagcagcttgtgtgataccagttttactgtcagtggcatgcatgacctagcagcgtctccaggaacgtggagcagctctgtttaaggaaggaaatacaaggcgcgctagactggctgagaaacagaagtttttaaaaggaattcttggcacctagatgtagagaattagcaacttcacatttttgggatgatattgaatagcatagctggagattcacccataacttctaaaaagcgaaactaaaatgtagtcctgtt

SEQ ID NO: 27937 - DNA, 601 bp, Human
cacacatgcaaatgtttcattgaaaatcttctgaaagctgcaatcttgccagaatccccagtaatgagcttcgttcttagtatactaagaatttagtttatgtgaacttagaaactattgcactccccccacaagtaaaaagctgtaagatcatttctgaaataattaaaataactcaaatttaagcaagatgataaaaacatacatgaaaacttaaaaatataaatgtaaatgataaaatttttcatttgtgtgaagcactgcaaaaaattttcccaaaaaaagctgtgcgaaaaaacaygtagtagtaataggaacccaaaaaacttaatcacctttccagataccagagcaaaatcataaaggaacctgccccatagactgtcacccaaatggtgcgtgctactgccagaatggaccttagccattggttccttcattctggctttgcagaggaagtttcatgtcagatactgagcccagctgcagctaccccagcagagcctcaggcctttcccgcactgtcttgggaaacatgggcgtactttgaggtctcctgcaaccgtgttgtttggtgtcccccaaatgaacaaccaccttg

SEQ ID NO: 27938 - DNA, 601 bp, Human
tctggctttgcagaggaagtttcatgtcagatactgagcccagctgcagctaccccagcagagcctcaggcctttcccgcactgtcttgggaaacatgggcgtactttgaggtctcctgcaaccgtgttgtttggtgtcccccaaatgaacaaccaccttgttgacttgcttttgctgacccagctgtgcggggcagggttgccatttagcacctcatcctcctaccaagtgaggctcagctccctgtgggccctggggatgggaggagggtgtgcacagaccccgaaacttggtggtgcrcagggacgaaagagaagtgcagcctgggccctgttgtaggatggatgttaatatcagcgtcctttctccatgtcccccacacacatttccgtcctacctctccctccctgttaatctgtgttaatatttggcttgaatatgtattctgctttttaaaaaaattacatgtaaggaaaacaaaatctcaatttcttggatagtgtcgacattctttttgttactgatacatttaattgttttgtttgtaaggttccagaatatcttaaccatgtaagtaaacgcttagaggaagagggagac

SEQ ID NO: 27939 - DNA, 601 bp, Human
gttaatatcagcgtcctttctccatgtcccccacacacatttccgtcctacctctccctccctgttaatctgtgttaatatttggcttgaatatgtattctgctttttaaaaaaattacatgtaaggaaaacaaaatctcaatttcttggatagtgtcgacattctttttgttactgatacatttaattgttttgtttgtaaggttccagaatatcttaaccatgtaagtaaacgcttagaggaagagggagacagagtaatcacttacttggaccacagcacacagtaagtaccgtttgytcgctgagcgttcgtatcttcaccatggctggaaggttctcctggctggttattgaaataaagggtgtctttgtcaattcattcagtactaagagtgtttttgcacctagcatattttactttgttatttgtcattatttggcattcacaaattacagtttttacccagtgccttgtcatgagttacgtctaaagagagtaaatcttgctgagatacttggcatctttgagttttgagacggtctatttatgttaatggagtatcactgaatattaggttattttgattgtgcattctct

SEQ ID NO: 27940 - DNA, 601 bp, Human
ttatgttaatggagtatcactgaatattaggttattttgattgtgcattctctgttacacattttatatcgctttaattttatttatggtgctgtcacacaattttctcttttcatcttatgtttttttcctgcaaacctgaggttgatgagtagctagggaaacaaaaagggagagattatgtgagcgtgtgtgtcaggcacagtgtgtccatatgatgggaggcaaggacagaggcagaggggacagcaagggagagaaatgaaaatgatacagtgtgcagctgggcgcggtggctcasgcctgtaatcccagcactttgggaggctgaggtgggcagatcacaaagtcaggagatcgagaccatcctgaccaacatggtgaaaccccgtctctactaacaatacaaaaaaattagccgggcgtggtggcgggaacctatagtcccagctacttgggaggctgaggcaggagaatggcatgagcccgggaggcagagcttgcagtgagccgagatcacgccactgcactccagcctgggcgacagagcgagactccgtctcaaaaaaaaaaaaaaaagaaaatgatacagtgtgcagaa

SEQ ID NO: 27941 - DNA, 601 bp, Human
ggtgctgtcacacaattttctcttttcatcttatgtttttttcctgcaaacctgaggttgatgagtagctagggaaacaaaaagggagagattatgtgagcgtgtgtgtcaggcacagtgtgtccatatgatgggaggcaaggacagaggcagaggggacagcaagggagagaaatgaaaatgatacagtgtgcagctgggcgcggtggctcaggcctgtaatcccagcactttgggaggctgaggtgggcagatcacaaagtcaggagatcgagaccatcctgaccaacatggtgaaacsccgtctctactaacaatacaaaaaaattagccgggcgtggtggcgggaacctatagtcccagctacttgggaggctgaggcaggagaatggcatgagcccgggaggcagagcttgcagtgagccgagatcacgccactgcactccagcctgggcgacagagcgagactccgtctcaaaaaaaaaaaaaaaagaaaatgatacagtgtgcagaactggacccagtagggaatgataaaatgtacagatgtgcagaacaggacttggtaggactcagcagagaaaacaggaggagagatgaa

SEQ ID NO: 27942 - DNA, 601 bp, Human
atgtcggctctgcccttctccgtaagatggtgcattaaaacgttccttataaactggaaatgaaggcttgggaagatggctaaaatcagcaatccttggaataacgcagaagcatccctgcttccctgggcccgcccgtgggcctgcttgtgctgttcagtaggtggtttttagaaagggcttccttcagcgtcattagcaacaggagtcgtcgtccgtttgcatgaggaaatgttcttaaccttccgtttctgattgcctctagactgcatctgtcatagacaaatgcccccatcttttrcagagaaccagtctcttctttaaactttacttctaacgcttattctttttaccttatataggaaaccactgattgcttgtgtggagaaacagctattaggagaacatttaacagcaattctgcagaaaggtagatttcctaactcttgtgcaaattaaactgaacaattatccttagttcattaggaaagtaaagggggcattacaaatagcagtgttaggacgtttgttattttcataagacagtcattaaaaatcttttctaatgaacatgttagccatccacgggagaaaaaaaaat

SEQ ID NO: 27943 - DNA, 601 bp, Human
aatgcccccatcttttgcagagaaccagtctcttctttaaactttacttctaacgcttattctttttaccttatataggaaaccactgattgcttgtgtggagaaacagctattaggagaacatttaacagcaattctgcagaaaggtagatttcctaactcttgtgcaaattaaactgaacaattatccttagttcattaggaaagtaaagggggcattacaaatagcagtgttaggacgtttgttattttcataagacagtcattaaaaatcttttctaatgaacatgttagccatccrcgggagaaaaaaaaatcagtaagagaaataatggaaggcacctagtggaactacattcactgctaaaaccccagtggcaggaaggcccggcagaccttctgtaccacactcatgctgaaacatgggtgcagtgagcctgttgcagctctctgagcagactcatttcctgtgtccggccgttcttcatgcacactcggatgtaggggactcggggagctgttcgggctgttagattttcgtgaggcttccctcacctgcggacttcgtgcatcttagtgtcagatgaactaccgactaggt

SEQ ID NO: 27944 - DNA, 601 bp, Human
tttaccttatataggaaaccactgattgcttgtgtggagaaacagctattaggagaacatttaacagcaattctgcagaaaggtagatttcctaactcttgtgcaaattaaactgaacaattatccttagttcattaggaaagtaaagggggcattacaaatagcagtgttaggacgtttgttattttcataagacagtcattaaaaatcttttctaatgaacatgttagccatccacgggagaaaaaaaaatcagtaagagaaataatggaaggcacctagtggaactacattcactgcyaaaaccccagtggcaggaaggcccggcagaccttctgtaccacactcatgctgaaacatgggtgcagtgagcctgttgcagctctctgagcagactcatttcctgtgtccggccgttcttcatgcacactcggatgtaggggactcggggagctgttcgggctgttagattttcgtgaggcttccctcacctgcggacttcgtgcatcttagtgtcagatgaactaccgactaggtggtctgcttaagcagagtatacttttctcctggttttctggaagagaagagcatgtgttctagt

SEQ ID NO: 27945 - DNA, 601 bp, Human
ttgtgcaaattaaactgaacaattatccttagttcattaggaaagtaaagggggcattacaaatagcagtgttaggacgtttgttattttcataagacagtcattaaaaatcttttctaatgaacatgttagccatccacgggagaaaaaaaaatcagtaagagaaataatggaaggcacctagtggaactacattcactgctaaaaccccagtggcaggaaggcccggcagaccttctgtaccacactcatgctgaaacatgggtgcagtgagcctgttgcagctctctgagcagactcrtttcctgtgtccggccgttcttcatgcacactcggatgtaggggactcggggagctgttcgggctgttagattttcgtgaggcttccctcacctgcggacttcgtgcatcttagtgtcagatgaactaccgactaggtggtctgcttaagcagagtatacttttctcctggttttctggaagagaagagcatgtgttctagtgctgacggcgcggccttcacgtccgcttctccccaagtggtggcagtacctggccataggaaggtggcttctagcagcctgcacctttaaaattgatg

SEQ ID NO: 27946 - DNA, 601 bp, Human
gttagattttcgtgaggcttccctcacctgcggacttcgtgcatcttagtgtcagatgaactaccgactaggtggtctgcttaagcagagtatacttttctcctggttttctggaagagaagagcatgtgttctagtgctgacggcgcggccttcacgtccgcttctccccaagtggtggcagtacctggccataggaaggtggcttctagcagcctgcacctttaaaattgatgctgatgtcttacctcgatctttgtttattgctgttttttctaggcttcaaagtgtgctgaattctrtgaaaattacaatgagcagtctaacctttgtaacactttagtacttactggcacatttcactgttaccatttgaaacaatgttaccttctgaaagtcattttaaatgtatttggaaaatacgagacttttttcaagccattggaaaccttaaagtttaattttgagaaggccctaaatggtattcaaatatattctgctttgggttctacattgtcagataatagtattatggctaatgagatacttaagtgaaaccagaataaaaccaaaagggaggagaattaacatgattgagcatc

SEQ ID NO: 27947 - DNA, 601 bp, Human
gcaagagacctgtctcaaaaaaaaaagagaaaaaagatttcaagtaaatagtagaaatttgcataaattgttccagtgcatactttgttaagcaaaattatttaaagaaaatggtaaattatatatgtaaaagcttaccctaaattttattagaaatattttaaaaattaaaaagatacttttgaattcttaagacatgggttttagtaaaataaagtataaaaagtttgtgtcagtagatcagaatgtaattgagagaaataaacatttggagctctaggtgaggattgtaattatagcsccaccatgtgtttgcgcacagctttaaacctcctcgtttgtgtgaacatcgtgcccagtgtaggcagaatctgagactttgtgaattgtatgactgttcaccattttatgctttaacctggctgcctctcagtagttatcataaagcaagtatttagaaaatctatgagagtttttctcattgaggtatggtttcagaaaaccgttataaatattaaaaatctaaaacactgaaagcttttttaaatgctgtgttaaacacttcaaaatatccgatgatgtttttctcttatagtttact

SEQ ID NO: 27948 - DNA, 601 bp, Human
ctagtgtgccctggcaaagggaactgggctgctggagggcccgtctgcattttcatcacagatgatagggtggacagtaggcttccatctgcttcccaatcaccagtgtgaatttgctttttaggataacaccagcagtgattagcaccatcaaggtagaaagtataacttaaagaacaactgttttgctcttcttcatcagcataaatattggtttaattctaaatcatgatttttcctaaagtaatcatttttgtaaatctgcttgtcagacatgatctcctcatgccctttcctcagkgagaactattatatatttggcatatcagtttgctttataaactttatttcttaacggtccaaatttaggatttattacttaaactttcactttcatgtttcgaaagcatttctttggcatccctaacaagcccagtccaacccgtcgtagagtggcttcttgggcagtaccctgagttttcacatgtcctgtgcaggagaacggccctttggtgctgacataggacctccctgaagactaggggctctcggcccagggcaccaccccaccaaggggacatttgttgatgtctggagacat

SEQ ID NO: 27949 - DNA, 601 bp, Human
gtttgctttataaactttatttcttaacggtccaaatttaggatttattacttaaactttcactttcatgtttcgaaagcatttctttggcatccctaacaagcccagtccaacccgtcgtagagtggcttcttgggcagtaccctgagttttcacatgtcctgtgcaggagaacggccctttggtgctgacataggacctccctgaagactaggggctctcggcccagggcaccaccccaccaaggggacatttgttgatgtctggagacatttgtggctgtctgaacagagagggtgckgcttgctttgctgggcagcaccaggggtgctgctgaatgcacaaggcagccctcaccacaaagaatcacctgcccagagggccagagttgcccagcccaagaaacctgctgaagaccctctaatgagaagccattctccagatgcccctcacagaaacaggagaactgaggcagacatcagggccccttcacagatagctcgtgttttcaggatgtgccagttgcctagcatgaattttccagcttaaatggtgaacatttagcaaaagtctgtgtttttgcttgctggtgactattctt

SEQ ID NO: 27950 - DNA, 601 bp, Human
cctgaagactaggggctctcggcccagggcaccaccccaccaaggggacatttgttgatgtctggagacatttgtggctgtctgaacagagagggtgcggcttgctttgctgggcagcaccaggggtgctgctgaatgcacaaggcagccctcaccacaaagaatcacctgcccagagggccagagttgcccagcccaagaaacctgctgaagaccctctaatgagaagccattctccagatgcccctcacagaaacaggagaactgaggcagacatcagggccccttcacagatagctcrtgttttcaggatgtgccagttgcctagcatgaattttccagcttaaatggtgaacatttagcaaaagtctgtgtttttgcttgctggtgactattcttaaatcccataatgaaaagataaacaaaatttccagagaattacactaagaggaaaaaaagaaaagccaatcacagatacttaacgtgttattgcataacattttggaaatgacaaaatttagaaatggaggatagatgaaaagttaccagggtgtagggatggggcagggtgtgtggttataaaaggccccaggaggtagcc

SEQ ID NO: 27951 - DNA, 601 bp, Human
gtgaaaaagacgggtgcgctgccatgtcagtaccccagctgagacactgttgtgtagtttcgcaaaccgttgccattggaggaaactgtggaaataaagacactgggattgctttgctatttttactattatgcaaatctgtcattatctgaataaagatttccgttaaataaaaaagataaagcttacatgctgctttatggaataatcagacctgaagtcatgtatcagtccagctgtggaaagccagcactcacagcacccctccccacaaggtctcgtacaatgatagaattggaasttataactgagtcacactaaattggccataaagctactgaagatttaggttttttgccagtgagacagtcttcaggggatgggaatgtgtgctaaaaactaggaaaagttcacctttgcagtttccagtctgggtaataaaaatcagtgagtgaccatcacccctgagtgtcagcaataagtagttatactgtaacaaaatagtagtttatattcaactccacatgccgttatcaaaataaagctgggccttgtagtgtatgtgcattatttcaaaatgcagttagcaccaaagggtgta

SEQ ID NO: 27952 - DNA, 601 bp, Human
ctggccaacatggtgaaaccccgtctctagctgggcgtggtggtgtgcacctgtagtcccagctacatgggaggcggaggttgcagtgagccgagatcacgccactgcactccagcctggtgacaaagcgagagtccatctcaaaacaaaaaaaaaaaagtacaaactaaaaaagtgagcttttcatggttagaagtgatggagaaggaaaactagccaagaagtcccaagaggtatattgaattaataggaattaacttgtcttggaggaacttacacataaacattctttaaaaagcarcggacattttccagtcgtttgtaagttctctcagaaacagaatcgtaagaccaatgcattaattgtgtatttaattgtatattcacaccaagcacaggggctcatgcctgtaaacccagcactttgggaaatcacagtgggaggattgcttgaggccaggagttcgagaccagcctgggcaacatgaccccgtctctacaaaactttaaaaagatgggccagatgtggtggcctgagcctgtagcaccagctactcaggaggctgaggtgggaggattgcttgagcttgggaggttgagg

SEQ ID NO: 27953 - DNA, 601 bp, Human
tgagttggtattgatttgcttttgtagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcggtagaaaaatatttgttttttttgtttgtttgtttttgagacagtctcacccatttctagacaattttttaatatgggaarataaggcaaaatcaaccaaaatgttcaagctgctcaaggggtgtgtggaaagcgtttttatcaagtcttattaggacacaaatttaaaaaccgacacacctgcatgcatgggtggaggagggcatttccataagggaagatgaggtaagaatttagaaaagaaatgatgcttgacttcgccaaagaagggaggggtgatcaccatctttgtatcctctaatccatattaaaataggataaaaccagatgagatctcaaatgataatactatttttaagctgtacaattttttcacaataa

SEQ ID NO: 27954 - DNA, 601 bp, Human
ttcaaggacaaggtggaccacgtgatcgaggtctgcttccagaagaatgagcggttcgtcaacctgatgaaggagtcctttgagacgttcatcaacaagagacccaacaagcctgcagaactgatcggtagaaaaatatttgttttttttgtttgtttgtttttgagacagtctcacccatttctagacaattttttaatatgggaaaataaggcaaaatcaaccaaaatgttcaagctgctcaaggggtgtgtggaaagcgtttttatcaagtcttattaggacacaaatttaaaaaccracacacctgcatgcatgggtggaggagggcatttccataagggaagatgaggtaagaatttagaaaagaaatgatgcttgacttcgccaaagaagggaggggtgatcaccatctttgtatcctctaatccatattaaaataggataaaaccagatgagatctcaaatgataatactatttttaagctgtacaattttttcacaataatatcaaaatatatttcagaattcataggctttctctagtcagtaaaattttttttttaattcgaaggagaaagggggcaaagagagctgaaat

SEQ ID NO: 27955 - DNA, 601 bp, Human
tgtatcctctaatccatattaaaataggataaaaccagatgagatctcaaatgataatactatttttaagctgtacaattttttcacaataatatcaaaatatatttcagaattcataggctttctctagtcagtaaaattttttttttaattcgaaggagaaagggggcaaagagagctgaaatacgacgatactagattgactgttgattactgctgaagatgtaagatggaacatggagctcattgtgcaattgtctgcttttctgtgtgttcagaatattccattacaaaatgtttmaaagaaaaaaactaacaaaaacagcaacagaaggaattcaggaggcagtttactttggcttttgttcctctgtatcatttgtggtttctctaaagcaaagggatgttgagctcttgggagtttgggcttctggaagtcttgggttctcccatcacatggggactttggtcctccctcccaagccacctgacgatggcttgtgcagcctcagaaacaggaagcccgagtagaaatgctttcaccctgcgttgccaccttggatgctctgagaaagtctttctctttgagaatgtctcctct

SEQ ID NO: 27956 - DNA, 601 bp, Human
tctgtgtgttcagaatattccattacaaaatgtttaaaagaaaaaaactaacaaaaacagcaacagaaggaattcaggaggcagtttactttggcttttgttcctctgtatcatttgtggtttctctaaagcaaagggatgttgagctcttgggagtttgggcttctggaagtcttgggttctcccatcacatggggactttggtcctccctcccaagccacctgacgatggcttgtgcagcctcagaaacaggaagcccgagtagaaatgctttcaccctgcgttgccaccttggatgcyctgagaaagtctttctctttgagaatgtctcctctgcattcatgacaccagatcctagaaataggcactccagcgtccggggcagtcacgtcctgaaacctgagcatgtatttgctgaagtcattttattttgaaattcagagattgcatttaaagataagaaagatatttaaacctgctttaaacattcagtcctggcttcattaaaattttggcaagtatttactctcacttgacttgagaagtacttaccttagaaaatcagatatttgtttttttgtcatatagtcattttgggaa

SEQ ID NO: 27957 - DNA, 601 bp, Human
tattccattacaaaatgtttaaaagaaaaaaactaacaaaaacagcaacagaaggaattcaggaggcagtttactttggcttttgttcctctgtatcatttgtggtttctctaaagcaaagggatgttgagctcttgggagtttgggcttctggaagtcttgggttctcccatcacatggggactttggtcctccctcccaagccacctgacgatggcttgtgcagcctcagaaacaggaagcccgagtagaaatgctttcaccctgcgttgccaccttggatgctctgagaaagtctttctctttgagaatgtctcctctgcattcatgacaccagatcctagaaataggcactccagcgtccggggcagtcacgtcctgaaacctgagcatgtatttgctgaagtcattttattttgaaattcagagattgcatttaaagataagaaagatatttaaacctgctttaaacattcagtcctggcttcattaaaattttggcaagtatttactctcacttgacttgagaagtacttaccttagaaaatcagatatttgtttttttgtcatatagtcattttgggaaggttccagaatgttc

SEQ ID NO: 27958 - DNA, 601 bp, Human
acagcaacagaaggaattcaggaggcagtttactttggcttttgttcctctgtatcatttgtggtttctctaaagcaaagggatgttgagctcttgggagtttgggcttctggaagtcttgggttctcccatcacatggggactttggtcctccctcccaagccacctgacgatggcttgtgcagcctcagaaacaggaagcccgagtagaaatgctttcaccctgcgttgccaccttggatgctctgagaaagtctttctctttgagaatgtctcctctgcattcatgacaccagatccyagaaataggcactccagcgtccggggcagtcacgtcctgaaacctgagcatgtatttgctgaagtcattttattttgaaattcagagattgcatttaaagataagaaagatatttaaacctgctttaaacattcagtcctggcttcattaaaattttggcaagtatttactctcacttgacttgagaagtacttaccttagaaaatcagatatttgtttttttgtcatatagtcattttgggaaggttccagaatgttcctgtacaatgttgctaatagaaattgaagatgctctctttt

SEQ ID NO: 27959 - DNA, 601 bp, Human
tttggcttttgttcctctgtatcatttgtggtttctctaaagcaaagggatgttgagctcttgggagtttgggcttctggaagtcttgggttctcccatcacatggggactttggtcctccctcccaagccacctgacgatggcttgtgcagcctcagaaacaggaagcccgagtagaaatgctttcaccctgcgttgccaccttggatgctctgagaaagtctttctctttgagaatgtctcctctgcattcatgacaccagatcctagaaataggcactccagcgtccggggcagtcaygtcctgaaacctgagcatgtatttgctgaagtcattttattttgaaattcagagattgcatttaaagataagaaagatatttaaacctgctttaaacattcagtcctggcttcattaaaattttggcaagtatttactctcacttgacttgagaagtacttaccttagaaaatcagatatttgtttttttgtcatatagtcattttgggaaggttccagaatgttcctgtacaatgttgctaatagaaattgaagatgctctctttttctagtttagagtatttactatatgtttatgct

SEQ ID NO: 27960 - DNA, 601 bp, Human
agaattttatttcagtgagtctggtggtgacacctgaagaagggaaaaaggcagtcctagtgaggcattgggtttcatggaatacattctggggactgagataaattctaacacagatgaaactttatattgaaaattacacggtttattttgttttaggttaattatgttttattactttctcaaaatgattgtcttggatttctctgttttagcatatgcagaatcagagtgactcaggccctatagacctcacagtgaacatactcacaatgggctactggccaacatacacgcccakggaagtgcacttaaccccagaagtaagtgtgcagaaagcatgctgtccgctcccgctgtcatgcccttaccaggcacagatatgttgccttcaagaattgttgaatggggagtttttaaaaatagcccactcagtccaaaatcaaagtgctcttatggtctttggaaatgtgcttgagaaagtgaccacttttgtcaccttctgtggctcctcccagtgcagcctgtgtccacctgctgacctgcagggggcccatgagcacaggcacttgttttggaagttatggcttattaagctgcg

SEQ ID NO: 27961 - DNA, 601 bp, Human
ttctctgttttagcatatgcagaatcagagtgactcaggccctatagacctcacagtgaacatactcacaatgggctactggccaacatacacgcccatggaagtgcacttaaccccagaagtaagtgtgcagaaagcatgctgtccgctcccgctgtcatgcccttaccaggcacagatatgttgccttcaagaattgttgaatggggagtttttaaaaatagcccactcagtccaaaatcaaagtgctcttatggtctttggaaatgtgcttgagaaagtgaccacttttgtcaccttytgtggctcctcccagtgcagcctgtgtccacctgctgacctgcagggggcccatgagcacaggcacttgttttggaagttatggcttattaagctgcggttcttgtctggttgttctttctttccattgtagacagtgctgaagtcttgggaatggcattatttagggccttctttgtcagccactactttagctacactaaacccttcagtggagggtttgcatgccggaggtagaattctgtgctcaatgaagttaacatcagcaggagatacaatacatgcaccattcatttaatac

SEQ ID NO: 27962 - DNA, 601 bp, Human
ccactcagtccaaaatcaaagtgctcttatggtctttggaaatgtgcttgagaaagtgaccacttttgtcaccttctgtggctcctcccagtgcagcctgtgtccacctgctgacctgcagggggcccatgagcacaggcacttgttttggaagttatggcttattaagctgcggttcttgtctggttgttctttctttccattgtagacagtgctgaagtcttgggaatggcattatttagggccttctttgtcagccactactttagctacactaaacccttcagtggagggtttgcaygccggaggtagaattctgtgctcaatgaagttaacatcagcaggagatacaatacatgcaccattcatttaataccaggcgaagggaaagggctgagaccagcctgcaatcatggaagacttcctggaaaaggcgtcccttaagcctgatctcaagtaaagatgaatgatgatttcgtcagctgagaagggaagaaagacacacagctacagtggtaggacagtgtgattccttttcttatccatcatgagggtcatggccaatgctcctttaacaaaagacaaattaggaggagaaaac

SEQ ID NO: 27963 - DNA, 601 bp, Human
gttttatttaacacatcaggcttcagaaacgaagaccaaagacccagggaagactgtccattgttatgcttaggtttgataaagaatgggcagccatgtagaaataggtgtgttagtctgttttgcattgctgtaaaggaatacctggggctgggtaatttgtaaagaaaagagttttcattggctcatggttctgcaggctatacaagcatggcacctgtgtctgtgcaacttctgatgaggtcccaggaagcttttactcaaggttgaaggcaaagggggagtaggcgagagagagggygcaacaggtggtgggggaaggtcccagactccttaacaatcagatctcgtggtaactcattaccacagggagggcgccaggccattcatgagggatccacccccatgacccaaacacctcccaccaggccccacctccagcactgcagatcacagttcaccgtgagatttagaggggacagacccccaaactcttatcaatgtgactggacagaagggtaccatctaacagtagtagagtagcggggaaaccagtaaggcctgtctgttcagattcttcttggcctcactgggcaatgtt

SEQ ID NO: 27964 - DNA, 601 bp, Human
ttcctgtctccacagatgtttgtgcttctgcaccattccctttccccttaatattctagtggctatttcccaagaacataagcacctgtcaaatgagggcattcactctgatgtaatactttcaccccatttctgttggttgtctcagatatgtcctttgtggtgtttttccggtacccagctgagcccaggacccaggcggccttcgatgctccctgtgagtaggttcaggttgggcaggtccagccagatgccccgtgtccccatcaggatcctggcgggaggtgcgcactatcacgtrccccagtgtcttggtgacattcgataggatcctcctgtgaaggtgctggctggtttctccaccgtatcgttagtgtttttccttttgtaatcactaagtaatctgtgaggagacatttcaagactacgtaaacctcttaatcctcatccagctgtcacctgtgtggcgattcctggctgaattgatttttacctggtgaatggggatttttttccagctctatcatttctctatatttagaagttggcattctaaggaagagcccttctttccaccccctttatttacttatttatttct

SEQ ID NO: 27965 - DNA, 601 bp, Human
gcagctcctccccagcctgctctgctccggaccccggcagccactatctgcttcctgtctctgtggatttgtctacattagatagttcacagaaatggaatcacaatatgtgagcttttgtgtctggcttctttcacttagcgtgctgttttcaaagtccatccgtgctgcaccatacatgagcgctttattccatccatgctgtaccatacatgagcgctttattccatccatgctgtaccatacatgagcgctttattccatccatgctgtgccatacatcagcgctttattccatccrtgctgtgccatacatcagcgctttattccatccatgctgtaccatacatgagcgctttattccatccgtgctgcaccatacatcagtgctttattccttttctggctgaataacatcacattgtatcgataggtcacatctggtttctccattcaccaaacattgggcatttgggttatttccaccttttggccgctgtgaataatgctgctatgaacatgggtgtacaagttttagtttgaacacctgcggtcacttattttggggtatatacctgggagtggaactgctgggtcatgc

SEQ ID NO: 27966 - DNA, 601 bp, Human
cacagaaatggaatcacaatatgtgagcttttgtgtctggcttctttcacttagcgtgctgttttcaaagtccatccgtgctgcaccatacatgagcgctttattccatccatgctgtaccatacatgagcgctttattccatccatgctgtaccatacatgagcgctttattccatccatgctgtgccatacatcagcgctttattccatccgtgctgtgccatacatcagcgctttattccatccatgctgtaccatacatgagcgctttattccatccgtgctgcaccatacatcagygctttattccttttctggctgaataacatcacattgtatcgataggtcacatctggtttctccattcaccaaacattgggcatttgggttatttccaccttttggccgctgtgaataatgctgctatgaacatgggtgtacaagttttagtttgaacacctgcggtcacttattttggggtatatacctgggagtggaactgctgggtcatgcagtaacttgaagtttaagttactgaggaattgccggactgtttcccacagtggctgcagcagcttttattccagttagcaatcacga

SEQ ID NO: 27967 - DNA, 601 bp, Human
tttctcccattctgtgggctatctttttactttcttgatagtgtgcttctacaaaagtttttaattatggtaaaatcacatttattttctcttttgtaacttttggtgtcatgtctgagaaaccattgccaaatcaagatcacaaaaaattgacgaggccaggtgcagtgcctcacacctgtaatctcagaactttgggaagccaaagatcacttgagcccaggagttaggaacagcctagacgacatggtaaagccccgtctctacaaaaaatagacagattagccgcatgtcgtggtgyctgcctacagacccagccactcaggaggttgaggtggcaggattgcctgagtctgggaggttaaggctgcagtgagctgtgatggagccgctgtactccatcctgggcaacagagtgagatccgagaccgtgtctcaaaaaaagaaaataaaatagcactatgtattctcccaaaagttttatagttttagctcatatgtttcagtctttgacccattttgggcctggactggtagctagcacatagtacccaaacgatagcattatgatgataattatcctcattaataccaatccagt

SEQ ID NO: 27968 - DNA, 601 bp, Human
acttctcaaggcaaaaagaaagaagaggcttatcacattattgacttttatttaggtatggtaatggcatagtagatacatttcctaaaagagttcctgtcctttagagatacagaaatacctacaaatgaaatgaaatcgatgatatcgcgcctgggatttggtgtcattgaagatggggagtaggtgcagcaggtgatttatacatgtggtttcatagaaaggtgactcttgggctgagttttgaagcatgaagaggagattgccaagcagatgtgaggtcagcaggaatttctgacakggcacagcttagacagaaacacagagaaactaaaagggcacgtcaagtctagagagcagcaggcatttatgcagcacctgctggtgccatgtacagtgctgcaatggggagtcagagagccagaggccctgccctgtgagcccctgtccggagtccacattcacactgtgctatagatgctggtagagctaagagggtgtcagagaagacctctctgaggaggcggttctggaaatgagtaggtttcatgagggagatgggatatgggatccagcagaagaaaccacgtgtgtgaaagtc

SEQ ID NO: 27969 - DNA, 601 bp, Human
agaagacctctctgaggaggcggttctggaaatgagtaggtttcatgagggagatgggatatgggatccagcagaagaaaccacgtgtgtgaaagtctgaggggatgagaatgtatgaaagacagtggaatgatcgactgaactgggcctggaggatgggaggggcacaggccaggtctgtgagatcagaggttagaatttcacgctttctttgtcccaagatctttagaagccatccagagacacagggaatggtgagctcgtgggagaggagggattggtttggatttgtgttcctgcscaaatctcatattgaattgtaatcaccactgctgggggagggcccgggtgggaagcgaccggatcatgggggcagatttcccccttgctgtgctcatggtagtgagtgagttctcatgagatctggttgtttaaaagtatgtagcacctcccccttctctctcttccctgctcccgtcatgtgaagacgtgcctgcttttttccccttaccttctgccatgattaaaagtttcctgaggcctccacagccaagctacttgtacagcctgcagaactgtgagccaattaaactttccttct

SEQ ID NO: 27970 - DNA, 601 bp, Human
gatttgtgttcctgcccaaatctcatattgaattgtaatcaccactgctgggggagggcccgggtgggaagcgaccggatcatgggggcagatttcccccttgctgtgctcatggtagtgagtgagttctcatgagatctggttgtttaaaagtatgtagcacctcccccttctctctcttccctgctcccgtcatgtgaagacgtgcctgcttttttccccttaccttctgccatgattaaaagtttcctgaggcctccacagccaagctacttgtacagcctgcagaactgtgagccarttaaactttccttctttataaattacccagtgtcaggtatttctttatagcagtgaaagaatggacccatacaagacgtataggtggatgctgagtcccggagcattggcatttgtggagtggacgagagcagggggaggccacgccctgggctgtgcagagatggtctcctgaggcgaaactggtgagcccttgcgtgcgcagcacagacgtgtcggagatcccgggtgcagtggacaccagacaggatcaagctgaagagtggagggtatgacggaccaggaagggcatgcagaagtc

SEQ ID NO: 27971 - DNA, 601 bp, Human
cttttttccccttaccttctgccatgattaaaagtttcctgaggcctccacagccaagctacttgtacagcctgcagaactgtgagccaattaaactttccttctttataaattacccagtgtcaggtatttctttatagcagtgaaagaatggacccatacaagacgtataggtggatgctgagtcccggagcattggcatttgtggagtggacgagagcagggggaggccacgccctgggctgtgcagagatggtctcctgaggcgaaactggtgagcccttgcgtgcgcagcacagaygtgtcggagatcccgggtgcagtggacaccagacaggatcaagctgaagagtggagggtatgacggaccaggaagggcatgcagaagtcagggaaagcaccgcgcatgggagagtcacacacagcctgcccctgagaggcatccggaaaacacgagcaggatccgggcgatgggaaaggctggtgcactgaacgctgggaacttgaaaatgcagcaaccacaattttaaggatcagtagaaagtttggaaaatgtaagaaattcactcaaggccaggcacagtctaattccagcgttttg

SEQ ID NO: 27972 - DNA, 601 bp, Human
ggagcattggcatttgtggagtggacgagagcagggggaggccacgccctgggctgtgcagagatggtctcctgaggcgaaactggtgagcccttgcgtgcgcagcacagacgtgtcggagatcccgggtgcagtggacaccagacaggatcaagctgaagagtggagggtatgacggaccaggaagggcatgcagaagtcagggaaagcaccgcgcatgggagagtcacacacagcctgcccctgagaggcatccggaaaacacgagcaggatccgggcgatgggaaaggctggtgcacygaacgctgggaacttgaaaatgcagcaaccacaattttaaggatcagtagaaagtttggaaaatgtaagaaattcactcaaggccaggcacagtctaattccagcgttttgggaggccgaggcaggaggagcgcttgggcccaggatttcaagaccagcctgggcagcatgagaagacccatctctacaacaacaacaacaacaaaaatcaacgggcttggtgtcatgtacctgtagtcccagctgctcaggacactgaggcaggtggatcacttgcacctgggagatccagcctgcagt

SEQ ID NO: 27973 - DNA, 601 bp, Human
ctcctgaggcgaaactggtgagcccttgcgtgcgcagcacagacgtgtcggagatcccgggtgcagtggacaccagacaggatcaagctgaagagtggagggtatgacggaccaggaagggcatgcagaagtcagggaaagcaccgcgcatgggagagtcacacacagcctgcccctgagaggcatccggaaaacacgagcaggatccgggcgatgggaaaggctggtgcactgaacgctgggaacttgaaaatgcagcaaccacaattttaaggatcagtagaaagtttggaaaatgtamgaaattcactcaaggccaggcacagtctaattccagcgttttgggaggccgaggcaggaggagcgcttgggcccaggatttcaagaccagcctgggcagcatgagaagacccatctctacaacaacaacaacaacaaaaatcaacgggcttggtgtcatgtacctgtagtcccagctgctcaggacactgaggcaggtggatcacttgcacctgggagatccagcctgcagtaagctaggatcacaccacaacctggctgacagagcaagcctgtgttccaaaaaagaaaagaaattcac

SEQ ID NO: 27974 - DNA, 601 bp, Human
taactcgtgctgcactttctgtgcaggcccagatggaggtgtttgccatcagcccctgcacagtgcaacgcaaggggttgtggtgtcacccttcacagatgaggaagcaggagccccgctcattgccgggaacaccagccgaggccagggctgggcatggccgggctgagacacaggatctggcctcagacacctttttcttgacgggctccagtcttcactctgtgccactggccccagcaagccctggtatgtacagagaccacggaatacagctggtctgtaccatgaaacaccagtkcaggcattatctcgttgacactgagaagccccaaagttcaaggattgaggacgtttttacaaataatggaatccagaaagtgtgagaatatagagctgaccttttaattcagccgtgagaaattgtaaaactctgtgcattgaatggggagctattgagatggatggtgtgtggcataattttgttgttctcctatgcttaacagatgattaaacttcaggaagtatttaaggcattttatcttggaaagcacagtggtcgaaaacttcagtggcaaactactttgggacatgctgtttt

SEQ ID NO: 27975 - DNA, 601 bp, Human
tgacgggctccagtcttcactctgtgccactggccccagcaagccctggtatgtacagagaccacggaatacagctggtctgtaccatgaaacaccagtgcaggcattatctcgttgacactgagaagccccaaagttcaaggattgaggacgtttttacaaataatggaatccagaaagtgtgagaatatagagctgaccttttaattcagccgtgagaaattgtaaaactctgtgcattgaatggggagctattgagatggatggtgtgtggcataattttgttgttctcctatgcttracagatgattaaacttcaggaagtatttaaggcattttatcttggaaagcacagtggtcgaaaacttcagtggcaaactactttgggacatgctgttttaaaagcggagtttaaagaagtaagttgtctgtttcatttattttttattatttgtaaatatgttaatataatttttttattgttactggactttagtagcaaaaaaggagtgtttcactttaattcactagcttttataagtcaataaaatttataacagttaaagggttattattccaatcaataaaaattcttaagaaa

SEQ ID NO: 27976 - DNA, 601 bp, Human
attgagatggatggtgtgtggcataattttgttgttctcctatgcttaacagatgattaaacttcaggaagtatttaaggcattttatcttggaaagcacagtggtcgaaaacttcagtggcaaactactttgggacatgctgttttaaaagcggagtttaaagaagtaagttgtctgtttcatttattttttattatttgtaaatatgttaatataatttttttattgttactggactttagtagcaaaaaaggagtgtttcactttaattcactagcttttataagtcaataaaatttrtaacagttaaagggttattattccaatcaataaaaattcttaagaaatcaatccatagaaaaccatttacctattgaaaaaaagagcagagaatgtgaagaggcaactcataaaagcaaaattgaaaaaaatatctgtgaagatgcattacacttctctgctaaacagagggcttcaaagtaaaatacagtaagatgccactttttgactaagagatttgatgaagcctaaaaaataaaaaaaaattaaaaaaaacagactcttgcccactactggaagaagcataaactgtagtgagct

SEQ ID NO: 27977 - DNA, 601 bp, Human
gagcttttggaagggcagtttggcattgtgaactttggcaaccctgctgccgagttgttgccttagtttcaactctaggaactcatcttaataagacattttcacggattaatgaatgagaatagtggttgcagtgctgttattatgagcgattatttaagaggggagaatgcatacaatgcactgatcaatgaaaggcgcttatgaaacggcaattatatacactaagcaaaaacataaaattcctattttgtatagctgttatattaataataaacttatctgtacattatcaaataasttatacatacctactttattattgtagagagtcatatacatgaaaccatatattctcttccttaaggtattaggaaagttaatttctattatccccagttttttacctacttgctgactttagttgaacttgacctccacagggtctgtaccagcaccaccaactgcagctctctccaggtgtgcaggaagggcttgttatgggcttgtgatgagtctgggctgggtccgcagagggggccaccaactgtcacccaaactctcatgtgcctctcgtgggtctgacctggaggcatgtggc

SEQ ID NO: 27978 - DNA, 601 bp, Human
aaaattcctattttgtatagctgttatattaataataaacttatctgtacattatcaaataagttatacatacctactttattattgtagagagtcatatacatgaaaccatatattctcttccttaaggtattaggaaagttaatttctattatccccagttttttacctacttgctgactttagttgaacttgacctccacagggtctgtaccagcaccaccaactgcagctctctccaggtgtgcaggaagggcttgttatgggcttgtgatgagtctgggctgggtccgcagagggrgccaccaactgtcacccaaactctcatgtgcctctcgtgggtctgacctggaggcatgtggcaagttgctgcagcactaactcctgaatagaaaaggagatcatcctgggatatataaggccaaattgcattcacccctacgttacagtcagtcccgtataaaagaaagctggactgtaatcccagtacctggggaggccgaggtgggtggatcacaaggtcaggagatcgagaccatcctggctaacacagtggaactccatctctactaaaaatacaaaaaattagccgggcttggta

SEQ ID NO: 27979 - DNA, 601 bp, Human
ctggaggcatgtggcaagttgctgcagcactaactcctgaatagaaaaggagatcatcctgggatatataaggccaaattgcattcacccctacgttacagtcagtcccgtataaaagaaagctggactgtaatcccagtacctggggaggccgaggtgggtggatcacaaggtcaggagatcgagaccatcctggctaacacagtggaactccatctctactaaaaatacaaaaaattagccgggcttggtaggcaccagtagtcccagctactcgggaggctgaggcaggagaatggcrtgattccgggaggtggggcttgcagtgagctgagattgtgccactgcactccagcctgggtgacagagcgagactccttctcaaaaaaaaaaaagtttgagagcaaaaagaagcttcttttaatttttcaaagattgtacatgcacagcttcagaggtgtgatgaggccttctcttccaggggaagaaggaattccaggtgtccctcttccagacactggtgctcctcatgttcaacgagggagatggcttcagctttgaggagataaaaatggccacggggataggtacgaaaactgca

SEQ ID NO: 27980 - DNA, 601 bp, Human
ttcacccctacgttacagtcagtcccgtataaaagaaagctggactgtaatcccagtacctggggaggccgaggtgggtggatcacaaggtcaggagatcgagaccatcctggctaacacagtggaactccatctctactaaaaatacaaaaaattagccgggcttggtaggcaccagtagtcccagctactcgggaggctgaggcaggagaatggcgtgattccgggaggtggggcttgcagtgagctgagattgtgccactgcactccagcctgggtgacagagcgagactccttctcaaaaaaaaaaaagtttgagagcaaaaagaagcttcttttaatttttcaaagattgtacatgcacagcttcagaggtgtgatgaggccttctcttccaggggaagaaggaattccaggtgtccctcttccagacactggtgctcctcatgttcaacgagggagatggcttcagctttgaggagataaaaatggccacggggataggtacgaaaactgcagagtgcatagctccatgagttgttcttaaagcatgtatttgttttaagataagacatagacttggtagcatgattggtttact

SEQ ID NO: 27981 - DNA, 601 bp, Human
gacactggtgctcctcatgttcaacgagggagatggcttcagctttgaggagataaaaatggccacggggataggtacgaaaactgcagagtgcatagctccatgagttgttcttaaagcatgtatttgttttaagataagacatagacttggtagcatgattggtttactgttgttgagtctcattcgtttaacgccagcctttgcctgcatttgcttcccattcagaggatagtgaattgcgcagaacgctgcagtccctggcctgtggcaaagcacgtgtgctgattaaaagtcccaraggaaaggaagtggaagatggagacaagttcatttttaatggagagttcaagcacaagttgtttagaataaagatcaatcaaattcagatgaaggaaactgtatgtataaactttctctttttacttatagggggtttagcagggaatcatttgtttttgtagtaatgtttttggctgttagaggcctgaagcacatttctacaataatccaatttcactatgtaatgtttataagagtactcattttcctgtcgctttcattaacttcacattctcagtaggaaagaaaatcagaaaaa

SEQ ID NO: 27982 - DNA, 601 bp, Human
aggcctgaagcacatttctacaataatccaatttcactatgtaatgtttataagagtactcattttcctgtcgctttcattaacttcacattctcagtaggaaagaaaatcagaaaaaaagccacttaatgttattcctattcacaaaaaagttgtgtgctaagccagaactccccatggtcatagggtttcgaaaattatccacactttctatggtaatagaatctgatatggttcactcttggtgttgtacattctgtgggtctgggtaaatgtataatgttatgtatccaccattatrggatcatacaggacagtttcattgccctaaaaattctcttatgttctgtcgctgtatccctgtctccctccgagcccctggcaacccctgaccctgttactgtcaccatagttttgccctttcctgaatgccgtacagttggagtcatagtgtatatagccttttcagattggcttctttatttattagaacgtatttgaggttcaccgtgtcttttcatgactgggtaactctgctttttgcactgaaggattctccgttgtctggatgcatcacaacttatcccttcacctactgaag

SEQ ID NO: 27983 - DNA, 601 bp, Human
acagcctttttctgtggtgtgagtgtatgtaaactttttttttagtgggatcactaagccaggcacagtgacatgcacccatagtctcagctactcgggagggtcgcttgatcccgggagtttgaggccagcctgagcaatgcagtgagaccccaaactctacaaaagaaaaaacacctgggatcactgtacatatggcacctgtcagggccttcctgtagccagttttcgttgctgatcgcagtcttctcctggccaggacttgttgcaggagcacagtgccggttgtgtagacccaccrgggctggcagtgccctcggccacaggcactaacattcctccactgcccctcctgaaaataagattacgttcaacaccctggcacagacatttctgtgcacttgttagattgtttctttagtgtgattcttgctctggagctgctgggtaaaataatgtgtacttgtcttagtttgctcttttccaagttgaagtctggcagatttcaccagagcacagtgtctgcccccacctccacctgtcctttgctcaccctgttctgagcagcccaaagatagtttgttgcagttttcattttgat

SEQ ID NO: 27984 - DNA, 601 bp, Human
ctcggccacaggcactaacattcctccactgcccctcctgaaaataagattacgttcaacaccctggcacagacatttctgtgcacttgttagattgtttctttagtgtgattcttgctctggagctgctgggtaaaataatgtgtacttgtcttagtttgctcttttccaagttgaagtctggcagatttcaccagagcacagtgtctgcccccacctccacctgtcctttgctcaccctgttctgagcagcccaaagatagtttgttgcagttttcattttgatttctgattctttacrgcatctttctaccactcagtagtttatacaaattatataatctttctaatgctcagtttctcatatttaaaatagacatactactacctcaagttgtgagaattaaatgaatcgtttagaaagctctttgccacacacctgtaagcacttcatacatgttgatgctgctctttttatgcttagccatttgtatttttctttttctaattgcttttcaagtcatatgcattcattataatgttttttctcttactgattagtaggttttctttatatattaaggatattaatgctttgtcc

SEQ ID NO: 27985 - DNA, 601 bp, Human
gtctcagcctctcgagtagctgggactacaggcatgtgccaccacactcaactaagttttctatttttagtagagacggggtttcaccatgttggccaggctggtctcaaactcctgacctcaggtgagtcacccatctcggcctcccaaaatgctgagattacaggcgtgagccaccatgcccagcctgctttgtcatttttgacagataattttgttgtttttattgggttttttttcacataacagtttttaagttctcaaatatagtctccttttcttttatggtttctgacttaaygtgtaatgctgtattaggccattcttgtattactataaggaaatacctgaaactgggtaatttataaagaagagaagtttaattggctcacggttctgcaggctgtacaggaagcatggtgccagcatcacctcagcttctgacgaggcctcaggaagtttccagtcatggtggaaggtgcaaggggagcaggtgtctcacgtggcaaaagcatgagcaagaacagggagggaggtgccccacatgtttaaacgaccagatctcatcaccaaggggagggcccaagccattcatgaggga

SEQ ID NO: 27986 - DNA, 601 bp, Human
ttaactttttttttcttttttatacaggttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaaggtaaatgtaacattagcataattaaatttgtagtatttgctaaacaattgacaaagcatgtttaattctatgttcagtcatatcatttgacctgcattattcatggtgctttgtgtatacrctgaatgtagaaaaactggcaaatgtgaagctctttattccaggtgttgctcatcgccactgcagaaatgatagagccctaaaactctccttcccagggatggtgcgcgcttgttcatattttcaggaagggaagaggtagatgggacatggaaagctgaacacttttctcatagtagtagcggtcaaggttacatcacaagattttaaggaaatgataacaataactaacttactcagcgtttacagcctacaccgcgttttccaccacggtaatagtctactgttgctgttgcttatg

SEQ ID NO: 27987 - DNA, 601 bp, Human
agatgagaaagactcttggtcataatcttctagtttctgaattatataatcagctgaaatttccagtaaaggtaaatgtaacattagcataattaaatttgtagtatttgctaaacaattgacaaagcatgtttaattctatgttcagtcatatcatttgacctgcattattcatggtgctttgtgtatacactgaatgtagaaaaactggcaaatgtgaagctctttattccaggtgttgctcatcgccactgcagaaatgatagagccctaaaactctccttcccagggatggtgcgcrcttgttcatattttcaggaagggaagaggtagatgggacatggaaagctgaacacttttctcatagtagtagcggtcaaggttacatcacaagattttaaggaaatgataacaataactaacttactcagcgtttacagcctacaccgcgttttccaccacggtaatagtctactgttgctgttgcttatgaaagtcagcccaggcctgtcaacccgcgttgttttcagaactgagatttactgtcctgccacgtgtgggatgcaggataagccgggaaagtattatgaaacgtttttta

SEQ ID NO: 27988 - DNA, 601 bp, Human
tgtgtatacactgaatgtagaaaaactggcaaatgtgaagctctttattccaggtgttgctcatcgccactgcagaaatgatagagccctaaaactctccttcccagggatggtgcgcgcttgttcatattttcaggaagggaagaggtagatgggacatggaaagctgaacacttttctcatagtagtagcggtcaaggttacatcacaagattttaaggaaatgataacaataactaacttactcagcgtttacagcctacaccgcgttttccaccacggtaatagtctactgttgctrttgcttatgaaagtcagcccaggcctgtcaacccgcgttgttttcagaactgagatttactgtcctgccacgtgtgggatgcaggataagccgggaaagtattatgaaacgttttttacatgtatttatcaacccaggaaatactgaactctgatgacgcctggcctctcagggacaggaccggccacacgtgctttggagggaaagtccccagattccatgttgtgcagtttgagcctcccattccatcaagggaataaagttgagatgcactaaatagtcgaacacttaagagtctgg

SEQ ID NO: 27989 - DNA, 601 bp, Human
agatcgcaccactgcactccagcctgggcgacaaaatgagaccccatctcaaaataaataaacaaaataaaatacagtacttaggcagaagcatcctttcaaaggataaaagttgccccagtaagacatgttgagattttcctttcaaataaaaatgtgtcacgtgatcgggtctgcctcacttatacgtgcccttgctgatggcagatgtcggatctgcctcgcttatacgtgcccttgctgatggcagatgtcggatctgcctcgcttatacgtgcccttgctgatggcagatgtcggrtctgcctcgcttatacgtgcccttgctgatggcagatgtcggtctgcctcgcttatacgtgcccttgctgatggcagatgtcgggtctgcctcgcttatacgtgcccttgctgatggcagatgtcggatctgcctcgcttatacgtgcccttactgatggcagatgatgtatgtacatttcacaagtttcacgtttccctcaggaaaccacactctgaccataaactcacatggacgctttttttatcaagagataacgttaactttgtctttaaaatagaaagttttgttcatttcata

SEQ ID NO: 27990 - DNA, 601 bp, Human
tgacccttgaacaacacaaggttgaactgcacaggtccatgaagtggattttcttcctcccctaccaccttagacagcaagatcaagccctccttcttcttactcctcctcagcctactcaatatgaaggcgaggatgaagaccctgatgatccacttccacttagtgaacagtaaattacagtttatcttccgtgtaatggtgttaataacactttcttttctctagcttactttattgtaagagtacaatatgcaatacatatacaaaatatatgctaatcaactgtttatgttatctstaaggttttcagtcaatagcacactattagttaagtttttggggagtcaaaagttttatgtggacttttgactacacaggggcgtcagcatccctatgccccacactgttcaagggtcatctctgttattttaaaaaccatgtgtgtaagttcaacctcttcaatttgttatcgatgagttgcttaactggaatggtcagaatgtgaggtagtgtgctgatgggcattttttgcatactcccctcccttaatgggtctcagttaaaaaaggtcaaaatagttaaattagtaactatatta

SEQ ID NO: 27991 - DNA, 601 bp, Human
cttttagcaatttagttggtttggaccactgttgccaatttctatcaatagtaccattggcctgtaatattttaatcaacaacctttaggcaaatatgcactacagaatcatccatatccttatgtgtgttttactagtaatttaagtgactaaaagcctgcagatgagacttcgttggtgatgtactgctgtgaatttatagtacttaaataatttataatattagatatagtaaaaagttaaggatatttctaagtttacagtttcataacatacagttgacccttgaacaacacaagkttgaactgcacaggtccatgaagtggattttcttcctcccctaccaccttagacagcaagatcaagccctccttcttcttactcctcctcagcctactcaatatgaaggcgaggatgaagaccctgatgatccacttccacttagtgaacagtaaattacagtttatcttccgtgtaatggtgttaataacactttcttttctctagcttactttattgtaagagtacaatatgcaatacatatacaaaatatatgctaatcaactgtttatgttatctgtaaggttttcagtcaatagc

SEQ ID NO: 27992 - DNA, 601 bp, Human
aaaaaatagcagaacaagtatatacacgccagtgagggtcaaaagcttagaagcatctgactccaagatacagtgggacattcttttttgatttgttttaaagtaaaattataaccagaaagattcatcatgtttatcataagctttgctggcatactgctggttaattaagtcttccagtgccatcccactcccagtctcaaagagtaaacatgtacactaaagtttgaaaataagagcttttaaataactattcatcttttttttctttttttttttgagacagagtctcgctctgtcrcccaggctagagtgcagtggcgcgatctcagctcactgcaagctccacctcccgggtccacaccattctcctgcctcagcctcccgagtagctgggactacaggcgcccgccaccacgcccggctaatttttttgtatttttagtagaaatggggtttcaccgtgttagccaggatggtctcaatctcctgatatagtgatccactcgtctcagcctcccaaagtgctgggattacaggcgtgagccactgtgcccggccaacactttagcttcctacgaatacatctgttttggcaaca

SEQ ID NO: 27993 - DNA, 601 bp, Human
gcaatgtttttcaaactgtgccaatgtactccaaaaaatagcagaacaagtatatacacgccagtgagggtcaaaagcttagaagcatctgactccaagatacagtgggacattcttttttgatttgttttaaagtaaaattataaccagaaagattcatcatgtttatcataagctttgctggcatactgctggttaattaagtcttccagtgccatcccactcccagtctcaaagagtaaacatgtacactaaagtttgaaaataagagcttttaaataactattcatcttttttttctttttttttttgagacagagtctcgctctgtcacccaggctagagtgcagtggcgcgatctcagctcactgcaagctccacctcccgggtccacaccattctcctgcctcagcctcccgagtagctgggactacaggcgcccgccaccacgcccggctaatttttttgtatttttagtagaaatggggtttcaccgtgttagccaggatggtctcaatctcctgatatagtgatccactcgtctcagcctcccaaagtgctgggattacaggcgtgagccactgtgcccggccaacacttt

SEQ ID NO: 27994 - DNA, 601 bp, Human
gcttttagctgggtttctacagtgtttataataaatcagcctaaataaaataagtactattagcattttgtgtaatttctcattacacgaaagactgatatagtctgaattatatcctttaaagcctttggtatttacataatactaaattaaaacattatctgtaagcaatgtttttcaaactgtgccaatgtactccaaaaaatagcagaacaagtatatacacgccagtgagggtcaaaagcttagaagcatctgactccaagatacagtgggacattcttttttgatttgttttaawgtaaaattataaccagaaagattcatcatgtttatcataagctttgctggcatactgctggttaattaagtcttccagtgccatcccactcccagtctcaaagagtaaacatgtacactaaagtttgaaaataagagcttttaaataactattcatcttttttttctttttttttttgagacagagtctcgctctgtcacccaggctagagtgcagtggcgcgatctcagctcactgcaagctccacctcccgggtccacaccattctcctgcctcagcctcccgagtagctgggactac

SEQ ID NO: 27995 - DNA, 601 bp, Human
taaagagagcccacaccctttggtatacaggaagtacaggaatgaatgaggagctcactgggctcaccaatactattacaccttttatcttctggattaaatgtaaaatgagacttaaagacaggaaatgctcaattcattagaaatatctaaaatcttcgttagtaagacagaatcaagcttggaaatcccattaaagttaacaatggagacaaattaacaatacacaccaaaacttcttgaaagctgatattatctgctttaattgtaggaaaattttaaaaatatcgataaggcagartaaggatttaattatttttcaatcggtaacacttaccttctgtctttccatttttcaacatatgtactagcccagaattctccatttctactatagtcttcatgtgcttggaaatgagttccctttcaaccacctttacaattggttcttccgttgatttgtcaaggcagtgcatcactcgttctatttcttcattaattctagcttctactttctttatatatactgaagcactattttctgctaaaaatttctggctttccatctgccatttaaaaatatatatattttttaaacata

SEQ ID NO: 27996 - DNA, 601 bp, Human
actaaagagagcccacaccctttggtatacaggaagtacaggaatgaatgaggagctcactgggctcaccaatactattacaccttttatcttctggattaaatgtaaaatgagacttaaagacaggaaatgctcaattcattagaaatatctaaaatcttcgttagtaagacagaatcaagcttggaaatcccattaaagttaacaatggagacaaattaacaatacacaccaaaacttcttgaaagctgatattatctgctttaattgtaggaaaattttaaaaatatcgataaggcasagtaaggatttaattatttttcaatcggtaacacttaccttctgtctttccatttttcaacatatgtactagcccagaattctccatttctactatagtcttcatgtgcttggaaatgagttccctttcaaccacctttacaattggttcttccgttgatttgtcaaggcagtgcatcactcgttctatttcttcattaattctagcttctactttctttatatatactgaagcactattttctgctaaaaatttctggctttccatctgccatttaaaaatatatatattttttaaaca

SEQ ID NO: 27997 - DNA, 601 bp, Human
tcttttaacttgtaatttcttctaggatacttgtcacaatttttcttttaccccaggaaaataaatagctataaaaaacaaatgttagttatctcaaaaatgttctttacttttatgcactcctccttcctccttttccattctgtaacttcagtgttccccaaaccaatctaatttatctaagtatgtcaatatggaagacacaaatatttttgcattttcagcaccctgtcacaactaaatcccaaaggaaagtctacaaaaatcttaaggtggaaacttaaggttttaagagaatcayaaaaccccaagagagtatgtaggactaaagagagcccacaccctttggtatacaggaagtacaggaatgaatgaggagctcactgggctcaccaatactattacaccttttatcttctggattaaatgtaaaatgagacttaaagacaggaaatgctcaattcattagaaatatctaaaatcttcgttagtaagacagaatcaagcttggaaatcccattaaagttaacaatggagacaaattaacaatacacaccaaaacttcttgaaagctgatattatctgctttaattgtaggaaa

SEQ ID NO: 27998 - DNA, 601 bp, Human
tgccatctatttatgtacagctcatgaactaaggatggttttcacatttttaatggctgaggaaaaactgtaaagaatgctatttagtgacacataaaaattatatgaaattcaagtttcagggcccataaataaagtcttatagaaacacaggattattcatttgttattgtctaggactattttctcactatgactgcgtggctcacaagccattttattcaacaacaaaaaagcttgccaacccctgacttggacctcaattttagaaaacacagcaaatatactagatgacttctgytttttttttttttttggcttttacaaaaaaggtttaactgaagagtcttttaaaaaggaagcctctctagttttttttgttttttttttgtttttttaaattacatataacttttcagggatttctcatatatacaaacatttaacaattttaaaacacaaggtaaggattccactagagataaacatggctcaacttcccaccagctttcgttttcctttctcttgtatcctccttctctttataattctcctttaaaaaattttttcattccctacatagctcatgaccccaacaggc

SEQ ID NO: 27999 - DNA, 601 bp, Human
taaacatgtatattcatttttaaacttacagttttgatattattttcaagcctatatctaagcctctattaaaaatgtcaatgagagaagtattataacttccatatatgtattaatacaatgcaaacgaaccaaagaacctcctcactgtttctcattctcctgtcttgatggaatgggttagccagtgaaaaaaattagcttaaaaaatgtaccaaaaaaagctgattatgttaaaacacaaaacatggcacataatttattcatagtactccttgaaaacaaaacattttcaaacaamaaatacttaaaccagttgttttttccaatatactacagtatacaaacactaaggcataccaaagaacctcacattcactattgaggctatttaaacaaggtcttcatcaaagaagttaaatgaaaagtagcagctgaattttagctccctgatataaatacgcacaccttgcaaaatcctaaaatatgtaggataattacaaatattaatttactactgggacaattaagttgaaagtacacaatacacagcatggtaaaagtggcctttttagcacttgtcaaaatgcctttatcataa

SEQ ID NO: 28000 - DNA, 601 bp, Human
atccaattattgtttgacatataaccttcagaaccagatgagagcaaacaacactctctactagaaagttttctagttctttatcttcagcatgcctaactctcagtcataaaaatgactgtttaccaactacagctgtgtagttgttcagttttttttttttttttgagacggagtttcgctattgttgccccagctggagtgcagtggcgtcatcttggctcactgcaacctccgcctcctgggttcaagtgattctcctgcctcagcctcctgagtagctgggattacaggcatccaycaccatgcccagctaattttgtatttttagtagagatggggtttcaccaagttggtcaggctggtctcaaactcccaacctcaggtggtctgcccacctcggcctcccaaagtgctgagattacaggcatgagccaccatacctggacagttgttcagtttttttgagacaaggtcttgctctgtcgcccagcatagagtgcagtcacgcgatcacagctcactgcagccttgaactcctgagctcaagtgatcctctgcctcagcttctgggacaacaggtgtataccactgtgtgcca

SEQ ID NO: 28001 - DNA, 601 bp, Human
gagcatgttttatgcttcagttgattttctatgctgtcgtgagctcctcaggttccagagatatcatatatcacaaaggcttgaaattgagctacaccaaccattttctgagatgagatctactctatctatgccttaatattcttggcatccaattattgtttgacatataaccttcagaaccagatgagagcaaacaacactctctactagaaagttttctagttctttatcttcagcatgcctaactctcagtcataaaaatgactgtttaccaactacagctgtgtagttgttcagttttttttttttttttgagacggagtttcgctattgttgccccagctggagtgcagtggcgtcatcttggctcactgcaacctccgcctcctgggttcaagtgattctcctgcctcagcctcctgagtagctgggattacaggcatccaccaccatgcccagctaattttgtatttttagtagagatggggtttcaccaagttggtcaggctggtctcaaactcccaacctcaggtggtctgcccacctcggcctcccaaagtgctgagattacaggcatgagccaccatacctggacagt

SEQ ID NO: 28002 - DNA, 601 bp, Human
tttttaactagcatctcaggtgattcacgtgcaagtattctatggaccacactttgtgaaaaagaactacacagcatagcctctttattgtttcccttttactaatcctcccttccaggcctccatgaatgtatcctgacacaccaacagaaattccagcaaactctgaatgtccctgaacttgaacaaatgttagtgtagtctgtgttcttctccaaaacaatctacctttatttctagaaataaacacttaataatctaccaaattaatttccaatcacgttgtcagtacacaatcatrataaacctcagttaggtgcactctatttcatctaaaacacaccttacctttaacttagatatcatgtttttttcagagtcatcagaaacacttttatttgtgagaagtctccttgccaagtgttgtttataataacgttcaaatacatctttttcttgcataaacctaaaaaggaccattgctttatccaatattgtttctacttcttgttctgttagctgcaaaattaagatgatgtaacaattatacaattttagttctacaaaagcagtactacggttcatttacagcttaaaaaca

SEQ ID NO: 28003 - DNA, 601 bp, Human
atatatcaatatattagatttaactataaattcctaaacaatctaaaaataaaaatccaggataattacaccactatttcctgtccacccgaaatttctgtcatggacttgcatctttcctcctctcagctcttctccactgtaaacactgatatttataaagcaaatcatacaactatttacattagagtcagaatgttttcatagaaatgaatggttattctacagaattacgtattttcacgtatctggtttgcgagactataaggccagtagaagtgatgatctcatatttagataycaaaggaaaagactcacaaatctgttaaatggttgtgacacattttaaccatagagtggtacacggtgattttaaaaatttaaaaactgtacaattctctaaacttaaggttaagttgaaaatcagagtaaaaaatgaaactaaattctgaatttcattaaatgctcataaaactcccatcagactccaaagctaaagaagttccagctcaccacctttggggagttataccaaacacatttataatacattaatttctgtgtttttatagtctcacttcacctgctacgcacccttagg

SEQ ID NO: 28004 - DNA, 601 bp, Human
gatctagcccaatcttccctatagctttcaatgtgtaagattagtggaagaaaaaaatttaaaaacttactagagcaaacaaaaaaatacaagaaaatatatcaatatattagatttaactataaattcctaaacaatctaaaaataaaaatccaggataattacaccactatttcctgtccacccgaaatttctgtcatggacttgcatctttcctcctctcagctcttctccactgtaaacactgatatttataaagcaaatcatacaactatttacattagagtcagaatgttttcayagaaatgaatggttattctacagaattacgtattttcacgtatctggtttgcgagactataaggccagtagaagtgatgatctcatatttagataccaaaggaaaagactcacaaatctgttaaatggttgtgacacattttaaccatagagtggtacacggtgattttaaaaatttaaaaactgtacaattctctaaacttaaggttaagttgaaaatcagagtaaaaaatgaaactaaattctgaatttcattaaatgctcataaaactcccatcagactccaaagctaaagaagttc

SEQ ID NO: 28005 - DNA, 601 bp, Human
tcaactgtcacaattattttcttcctttaaacaaattaaatttttaagtaaacaacaataaggcacaacaaaaactcttaaagattaaatattatttctattattgatattcaggatgtgttataaaccatcattccatttttatcttacctcaatgatttagtaatgtaaatttttaaggggaggaatcagtttatgaatatcaagaagcattctacactccgatttcttcacaagtatccactaaatgattacttaactttaaggaaactgaaaataaacttggatgatgcacagaagrgaggatcatagaggagactcttagatggtgtactgggggaggtggagaactgtttatacattcgcaagttggttaggggaagggagggtcacaaagtggacagtccatccatcccatatcaatatgcatgggatctagcccaatcttccctatagctttcaatgtgtaagattagtggaagaaaaaaatttaaaaacttactagagcaaacaaaaaaatacaagaaaatatatcaatatattagatttaactataaattcctaaacaatctaaaaataaaaatccaggataattacacca

SEQ ID NO: 28006 - DNA, 601 bp, Human
aataaggatcatgcagttgaccagggtgaagcaggactgtctacaggattatgtgaattgtggtggtggagacagtatacaagattaatggattaaaacctagctgctttcctggaaaatggcctatgttctaaaagacaaaatctagtttttatttttttaatttatgaagctacaagtcaataatatgctagtgcttctggttcaaaatgaaagcaactggctatggtaatgtagagaagacagcaggaatagcaccagaatgttcgaggctttttaagttaaattcttagttacttcrccttacaaagatacatgtcaatatgctgaatactcaacaaagatccaggatatgggctatttaaaaatacgtatctcctggatcagcaccaaaaatatctttagtttctgtacaacccacgtcaagtttttaagtgtaggcaagtcgaaattatttctgatacaaatcacaaactccacagaaatcattcaagatatattcaaacaactttcaaatacattttgacatcaaggtcaggcaattcacctggaagaacatcttaataagtaccaatgaattttttgtagtaagatgtttgat

SEQ ID NO: 28007 - DNA, 601 bp, Human
tttcttgaatttttatatttatgttttttgtcactatccacaccatattttttccaaagcctgagccactctgtggttcttgccccaatataacaatcatcccttcactcttagaattccttttcccttgtcattttgcctttctacagtttataaaaaatgaggactttggggagggaaaaaacccaacatttctgtgaactcgagactataggcagtgcctaaaccagtaggatcaggcaaataaaactagttggacagcagacatatcatgaactcttgcaacagcgtgttatctgtrtgcatgtctaaagtgttatactgattcactattacaataaggatcatgcagttgaccagggtgaagcaggactgtctacaggattatgtgaattgtggtggtggagacagtatacaagattaatggattaaaacctagctgctttcctggaaaatggcctatgttctaaaagacaaaatctagtttttatttttttaatttatgaagctacaagtcaataatatgctagtgcttctggttcaaaatgaaagcaactggctatggtaatgtagagaagacagcaggaatagcaccagaatg

SEQ ID NO: 28008 - DNA, 601 bp, Human
ctgccccaacctactgctgctcagcccttgctgttcttaagaccacctttctccatagtaacccaataatcaatttgttctaagtcagtagcagacatcaacagtacaaaatatactcctataccacagtacgaaaaatactcaatgcacatttataaaatattcctctgggaaaagtttatgtaattttttcttacatattaaaattataaaggataaactctccctttgtttttgttgttcaaaactggtagtttttcttgaatttttatatttatgttttttgtcactatccacaccrtattttttccaaagcctgagccactctgtggttcttgccccaatataacaatcatcccttcactcttagaattccttttcccttgtcattttgcctttctacagtttataaaaaatgaggactttggggagggaaaaaacccaacatttctgtgaactcgagactataggcagtgcctaaaccagtaggatcaggcaaataaaactagttggacagcagacatatcatgaactcttgcaacagcgtgttatctgtgtgcatgtctaaagtgttatactgattcactattacaataaggat

SEQ ID NO: 28009 - DNA, 601 bp, Human
ttgagatctgcagaacccatatgatgctggagtgtgagctgtcgaccactgtgtttggctaagtagaaccttcagtaaatcaaaccaggttttagaaaatcaaacaaacttacacatttgaaattacaaactacaggataacatcccttaaacatttgtgtgtgtgtgtgtgtgtgtatggactttaaaacttaaaggaaactttaggaatcaagttcagtttcaactttctataggcaagaccttgagagagtcctaagtaactcagctagatattaaatgacaaaggccccacactaartaatttctactgtacactctgccccaacctactgctgctcagcccttgctgttcttaagaccacctttctccatagtaacccaataatcaatttgttctaagtcagtagcagacatcaacagtacaaaatatactcctataccacagtacgaaaaatactcaatgcacatttataaaatattcctctgggaaaagtttatgtaattttttcttacatattaaaattataaaggataaactctccctttgtttttgttgttcaaaactggtagtttttcttgaatttttatatttatgttt

SEQ ID NO: 28010 - DNA, 601 bp, Human
ctattttatgcaatattttctcaaacctaattttatgaataaaatatgtaattatcctaatgtttagtccttagggaagactatactggtatagtcttcatattttcaaaggtgcagttagcaactgagagaacagaagtaataaatcaaagctaggatttttaacctttctaacatgtgagacaggcagagaaacagaagtaagtaatttacccaggtcaacataaatcacacatcagctctaatagactaactttaagttacttaatacgttcaaactatcaatatttacctttttaaytggtccataaaatgtggcattgagatctgcagaacccatatgatgctggagtgtgagctgtcgaccactgtgtttggctaagtagaaccttcagtaaatcaaaccaggttttagaaaatcaaacaaacttacacatttgaaattacaaactacaggataacatcccttaaacatttgtgtgtgtgtgtgtgtgtgtatggactttaaaacttaaaggaaactttaggaatcaagttcagtttcaactttctataggcaagaccttgagagagtcctaagtaactcagctagatattaaat

SEQ ID NO: 28011 - DNA, 601 bp, Human
tgtttcatttttaaaaaaatataaacaaagacacaatcatttcctggtaacattaatgtatgtatgtacgtacatatgtatgttacagggtctcactttgtcatccaggctacagtgcagtggcgcaaacacagctcactgcagcctcaacctcctgggctcaagcaatcctcctaccttagcctcccaagtaactaggaccatgtgtgtgcaccatcatgcccagctaacttttgtattttttgtagaaacggggttttgccatgttgcccatgctggtctcaaactaacgggccccagygatttgcccgcataggctcacaaaatgctgagattatgggcgtgagccaccacgcctgaccaattttctggtaactttaatggtatgtttcagaaataggtcccataatctccatcctcccccaacaaaactacataacttatttatataaaggaaatctattttttaaaatgtgtgcacacacacacaaacagtatttaggactgtcccttgtccccccattgtgaacattttaatgttatctgaacaagtaactaatcaattccctgtatttaatgctaaaattattttaacagtaca

SEQ ID NO: 28012 - DNA, 601 bp, Human
cttcctgtttcatttttaaaaaaatataaacaaagacacaatcatttcctggtaacattaatgtatgtatgtacgtacatatgtatgttacagggtctcactttgtcatccaggctacagtgcagtggcgcaaacacagctcactgcagcctcaacctcctgggctcaagcaatcctcctaccttagcctcccaagtaactaggaccatgtgtgtgcaccatcatgcccagctaacttttgtattttttgtagaaacggggttttgccatgttgcccatgctggtctcaaactaacgggcyccagcgatttgcccgcataggctcacaaaatgctgagattatgggcgtgagccaccacgcctgaccaattttctggtaactttaatggtatgtttcagaaataggtcccataatctccatcctcccccaacaaaactacataacttatttatataaaggaaatctattttttaaaatgtgtgcacacacacacaaacagtatttaggactgtcccttgtccccccattgtgaacattttaatgttatctgaacaagtaactaatcaattccctgtatttaatgctaaaattattttaaca

SEQ ID NO: 28013 - DNA, 601 bp, Human
tccatcttcctgtttcatttttaaaaaaatataaacaaagacacaatcatttcctggtaacattaatgtatgtatgtacgtacatatgtatgttacagggtctcactttgtcatccaggctacagtgcagtggcgcaaacacagctcactgcagcctcaacctcctgggctcaagcaatcctcctaccttagcctcccaagtaactaggaccatgtgtgtgcaccatcatgcccagctaacttttgtattttttgtagaaacggggttttgccatgttgcccatgctggtctcaaactaaygggccccagcgatttgcccgcataggctcacaaaatgctgagattatgggcgtgagccaccacgcctgaccaattttctggtaactttaatggtatgtttcagaaataggtcccataatctccatcctcccccaacaaaactacataacttatttatataaaggaaatctattttttaaaatgtgtgcacacacacacaaacagtatttaggactgtcccttgtccccccattgtgaacattttaatgttatctgaacaagtaactaatcaattccctgtatttaatgctaaaattattt

SEQ ID NO: 28014 - DNA, 601 bp, Human
ataaactgtattctatttattgaaaaacatgaaaagaaatactttgttcacactataaattactttttaaaatgcttactgtacttggattcaaatgcattttgatacaaatacttatcaataaaagctgctttctttcttaagcctaagtatcatgcagcaccagaaaaggagtatttttaaaagaaatccaatagatgagattttttttctaaagagaaaaatatataattttttgagaggaaaaatataattccagatacctgtttgaatcttgactctgtgtagtttggatgtgaaytgatcattaactgtaaatatatgaccattttctatttcctttgatttgggttcttttgtaagaacccgctgtgttggtttaccacaggcgagggactgtagggctctaacaagctctctttcagggatatctgtctcttgctgaatttcctgaaatttcatcagattaacataattagactttttgaaagattaaagttagttaattagcaagtaaactgaccaagcagtagttaaaaagaggtaattccattaaataaataatgcacaaaaaagaattctcttgagtactatgacacat

SEQ ID NO: 28015 - DNA, 601 bp, Human
gtttaatgaatagaattttcattatcgacttatatggctattaaaaatcattcacatcagtatcatttctatgtttttaaattaaagaggatatgggttttaagattttgaaacaaaaaatatttatcaaaatataaatagcaacatccaaacatcaaacttttatataggtctcccaattctgaaaaacttctaaatcagctttaaaattagacttccactgactattagttaacaacttaaaaacaattttaagtaccaatatgttcataaactgtattctatttattgaaaaacatgraaagaaatactttgttcacactataaattactttttaaaatgcttactgtacttggattcaaatgcattttgatacaaatacttatcaataaaagctgctttctttcttaagcctaagtatcatgcagcaccagaaaaggagtatttttaaaagaaatccaatagatgagattttttttctaaagagaaaaatatataattttttgagaggaaaaatataattccagatacctgtttgaatcttgactctgtgtagtttggatgtgaattgatcattaactgtaaatatatgaccatttt

SEQ ID NO: 28016 - DNA, 601 bp, Human
ctatcataatatacaatataaataacatttttttaaaatcaacaaatgacagtcatttaaaagatcatcttatttatcttaggacactgttttattgcacacatatttggctgtaatgaatatattagtactaggaagcctatctaatactagtttttaagccaagtagtaaacaattagttttaaacatcaatcagcaagggtggagtgccttttttcccctttaaatacacagaaaacaagcatcttacattatgttaaatgtttaatgaatagaattttcattatcgacttatatggctattaaaaatcattcacatcagtatcatttctatgtttttaaattaaagaggatatgggttttaagattttgaaacaaaaaatatttatcaaaatataaatagcaacatccaaacatcaaacttttatataggtctcccaattctgaaaaacttctaaatcagctttaaaattagacttccactgactattagttaacaacttaaaaacaattttaagtaccaatatgttcataaactgtattctatttattgaaaaacatgaaaagaaatactttgttcacactataaattacttttta

SEQ ID NO: 28017 - DNA, 601 bp, Human
ttaaatgggaggggaggggctcactctggagcctaacacaatactcctcacttgagtgcagcagaaggggttgttgttgtgcaagtgcctatatatgacctatatgcacgctgggggatggaatttgagaaaggcaggtggtggtggtggtggtggtgaagactgtcaactctggaaactgcccccccagattacaattaatctaattcttttcaaaggctgtgttattttagtaattcctttaacttctttgcatgaacttttactactggctacagtaaaagcagcataaataggtagrgtctgagtcttcgaatatttgattatgttactgagcctttgacagtaaaaccaatgtggtcacaatatttaccaccaaagagaaaattttgacttaaactatgagtaagagccaagatcatttaaaaaccattcccaagaaaaaaacattgctttgtagaattttattgctgaaaagaacttttaagctctagtgaaattcatcatatatatatttctgttttgaacatacctaaaacactacatacacatactccagatacacacgtaagtgtgcacacttaacacgaaaatctaaaaa

SEQ ID NO: 28018 - DNA, 601 bp, Human
aattctaatgactggtaaacgtaggtcacagccatattgatattcattatagtgcttttcactttctttgtggatttgaaaacaaaaaatacaaagttgcagggaaaaaagtagttgtttaaacaatccctttggctcatctggatgtggtcacctaaataagtgtcttcttaaatacctgcagaaaaacatggatgtgcagatcgtgctgatgagtcaaaatgagtattctttttaaatgggaggggaggggctcactctggagcctaacacaatactcctcacttgagtgcagcagaaggggttgttgttgtgcaagtgcctatatatgacctatatgcacgctgggggatggaatttgagaaaggcaggtggtggtggtggtggtggtgaagactgtcaactctggaaactgcccccccagattacaattaatctaattcttttcaaaggctgtgttattttagtaattcctttaacttctttgcatgaacttttactactggctacagtaaaagcagcataaataggtagagtctgagtcttcgaatatttgattatgttactgagcctttgacagtaaaaccaatgtggtcacaat

SEQ ID NO: 28019 - DNA, 601 bp, Human
gatgtcagttcctaaaatctccttgccaaaaatctccctagagttctgttatctaaccatttcttgtcatatattttattatgctttttatgtcacaacctcatcacaaattcataccagattccaatctttaggagtcttactctattcttccctatagtcttcaaagcaactgttaagggaaatacagaagtcgtcttctcctgcaactctgctctgaatgaaatagcagaaaaagaaaactggtgttttattcgttcaccaaaaggagatagatgtgaagtttctggaggtagaaacygtaaaattgcaaagcagcacatggggcattgctgactgaggcatgggcatagatagccacgagacagcagattgtacaatttagaagatcattctggtgtgcgtatccattcaactgtttctaattagaatcctttggataaaaatactgctttcggtgtcatttcccaagtgtaagataatcaatatcttagtaaaaaaaaaaaaaattcgatgaaaataatctactaagaatgatgcttatgatgcttttcctcagaagttgatgtcatgaaaaaataaaaagatagaggtactggtt

SEQ ID NO: 28020 - DNA, 601 bp, Human
caaatcttgcttagcacatacccctgcaccctgccctaggttctcaggaagaggcatgttcagtaacatctgtgtcagtacactaccatcatcatactctctatacaatcctcacctttccttttctagaatgtggtatttatcccttcatctcatttttttcaatttaaggatccattctttattcataggatataaacatgctcagtatcctcccattttgggggggaaaaagcccaaacccttcaactctacactgaatcctctaatactactctctctgccctttcccttgagccartacctcaaagaataagccactcttggtggtttccacctccatttccttctcaaggcactaccactggatatccactttcacgagtccaatgaaaatgtctgagaaagttaacctgtcacgtaattgccaaagtgtttattcaacttggtttttccatgattttttatattactgaccactcactccttgtaattctcttcccttgtcataggacactgtcattttgttttcttttccttctaaagcagtgttctcaaatttgaaaaaacatcagaatcacctacagctcgtgttaaaaaa

SEQ ID NO: 28021 - DNA, 601 bp, Human
tatatgtactacatcattatcaacctaccacagaggtctttgctgagtaaagatgtagttgttaacaccgtatgtgtacaccaggagtcagcaaactgcagtcacaggccaaatacaccccactacctgtttctgtaaaattttactgaaacacagtcacatgtatttatttattttttattagttttttttttgagatggagtctcgctctgtcgcccagggtggagtacaatggcacgatctcggctcactgcaaccttcgcctcccagcttcaagcaattctcctgcctcagcctccygagtagttgggattacaggcacccaccaccagctaatttttgtattttcagtaggacggggtttcgctgtgtttgtcaggctggtcttgaactcctgaccgcaggtgatccgcccaccttggcctcccaaggtgctgggattacaggcgtgagccaccgcgagtcacacgcatttatgtattatctatagctgctttcatgctacaattggccatttacaaaaacatctgccaatctctggtgtagactaacacaaatttatagtattcaaaagttcagcaagttcctgagcaccattct

SEQ ID NO: 28022 - DNA, 601 bp, Human
cgagcctaaactgcattcaagatcacttctcttgaaagctgcactctcaacaggaccttctactcctgattcttttggtcctatcccataaacactatttgattaaacctatattctatatgtactacatcattatcaacctaccacagaggtctttgctgagtaaagatgtagttgttaacaccgtatgtgtacaccaggagtcagcaaactgcagtcacaggccaaatacaccccactacctgtttctgtaaaattttactgaaacacagtcacatgtatttatttattttttattagttttttttttgagatggagtctcgctctgtcgcccagggtggagtacaatggcacgatctcggctcactgcaaccttcgcctcccagcttcaagcaattctcctgcctcagcctcccgagtagttgggattacaggcacccaccaccagctaatttttgtattttcagtaggacggggtttcgctgtgtttgtcaggctggtcttgaactcctgaccgcaggtgatccgcccaccttggcctcccaaggtgctgggattacaggcgtgagccaccgcgagtcacacgcatttatgtattat

SEQ ID NO: 28023 - DNA, 601 bp, Human
cccaatcatagtaagtgcttctgttggttttttccaagtactatcaggattctaagtactgtgctatatataataataaaataataactaaagcagcagtcatagtctgtctatgcactattcatctgtcattttgcatgtatgagtttatttaatttattttttcttttttgagatcgagtcttgctctgttgcccaggctggagtgcagcagcgcaatctccgctcactgcaagctccgcctcccgggttcccaccattctcctgcctcagcctcctgagtagctgggactacaggcgyccaccaccacacccggctaattttttgtacttttagtagagacggggtttcatcatgttagccaggatggtctcgatctcctgaccttgtgatctgcctgcctcggcctcccaaagtgctgggattacaggcgtgagccaccgtgcccggcctatttaatgttcttaaccctgcaaaataagttgtctcattttacaaacgaggaaaataaagccggagaagaaaactgacatcaacaagtagtaaataacagagccaacagagatgaatctaaacctttctgacctcaaagtccatgtt

SEQ ID NO: 28024 - DNA, 601 bp, Human
tgaagataaaaatactctggaagcacaggatatctgacaagaatcttcagcacaaagcacatgtttgaaaacgtgaaacgatgactctttggaggacaatagctaaatatccaagaatcatcaggtttgagaaatattgcttaatcactttccaaaacacagctgcaagaattgaagatttcattaaaactatcaaggtcatcatatttattgcatctttagattgcattttgaaacagaaaattaatagtgcaccacagcttcaccaaaatatatatttaggggcagggaggacctaggrtatttataaacaaagtatagactgtatgtgcttttcagaggggctgaattaaatataaccagctgccaactttgtgctctgacatacttgaattagtgggtatgtgtatactaaattcattatttttgtctacaataaatgaaataaaaacaccaccctatacaatccactattagcagtgagtacaacagcaaaaaaattattgtacaatttacacatactaaaatactttctttctctagaaataactcagaacaaaacctaatcattataagacttaatttgggaaatctcaaatta

SEQ ID NO: 28025 - DNA, 601 bp, Human
atcaaacctgtgctccaaagttaacaagtatgtctctaaactctagatctgatttttacagccacacttgagacaatgacgtaaacttaaactttacttttaatggcttaaactagcactaaaatgtttaatgtctcacttaggagatttcaaataaagtttttacatcgctcatgtttactaactcgacaatctgagctgtcctgttttcccaggtgttaaatatcatttaactgggaaatgaaagcaataaaaaaattctcaaacatgaactaccattactttcctataaacatcttamcattatagaaaatttccaattatgtcaaaatcagaaggtgaaacccttagctttccatgttacacctgacttagtactactcaagtatggtaaaagtgtcctgagaataatgttcacaatacttttcattggcatcttaattgcatcatgtagaagtggaaaatgtagagataaagagcacaaggcttgtaattctacagtacagatggagacaaaattgcaataaaagcatatttgcaagtctaaaaggaaaattataacccaagacgcatggggaaaaatatttatgtggagttttta

SEQ ID NO: 28026 - DNA, 601 bp, Human
tcactatgagaaggattcttacagagaaggcctatcatcagcatcttgggggtttgatagtacataattacaatgctacacaggtgactctagcatacctttagaaaggcatgcatctcttcccccattccctttttaagttcactgacataaagaatccttgcaatcacaaccactttttgtgaggctgtgcgttccctaattgcaatgaattttcagtctttaaataatgttaacgattcaaaataaacactgtcctggacttgataatgaaggcagagaattacactttaacagttamtgaagagatgacatgatttttgcagttgaaaaactatgtatccaccctccttaaaagtcttctaataaatcaccaaaatttctctgcaccaacaggatggaatggttaggatgcatttttctttcaaattaaagcattaaaaactgagaaaaaatagcatctgtgacctcttgctaaaaagaaagcaatgttaaatgtattttgttataacctttatgacctaaaataatacttatgcagtcaaacatataaacattttgtgtgaccagttttttcagtgcagcatcacatcgccagcaa

SEQ ID NO: 28027 - DNA, 601 bp, Human
tagacaggcaaagataaaaatctttaacactagttactgaaaatgagtatcttaaactgtaaacattaaaactgctttccaaattaaggaattaaataatatttagaaacctaagatgatgccagtgtactagtcttctagagatgtaggcataatcttaaaactggttctaggccttttctgctacccaacatatccggtgaacaaaacatcaacagtgcttcactatgagaaggattcttacagagaaggcctatcatcagcatcttgggggtttgatagtacataattacaatgctayacaggtgactctagcatacctttagaaaggcatgcatctcttcccccattccctttttaagttcactgacataaagaatccttgcaatcacaaccactttttgtgaggctgtgcgttccctaattgcaatgaattttcagtctttaaataatgttaacgattcaaaataaacactgtcctggacttgataatgaaggcagagaattacactttaacagttactgaagagatgacatgatttttgcagttgaaaaactatgtatccaccctccttaaaagtcttctaataaatcaccaaaa

SEQ ID NO: 28028 - DNA, 601 bp, Human
atgtattaactttagtttgtcacattactattcatgtgaatgaggtacaaaataaatgaaaattttttaatatggaaaatcgtgtcaatttgtaacatggaatatggataggattaaacctaggtccaactcctggctctgccatttcctgctagcaaccttggacaacactggtataatgacagttatgtcacataaagccaatatgacaactaaatgaatgaatatacataaaatattcagaatagtatctggcatatgataagcacttaaatgttaacatttctaattatttctgctytgaggactagaaatgacttctaattttgctgacctgaaatgttttaacattcgtatttacagaatgcaaaatactatgcaacatatagtaaaatacatgacctacaattgatatgcaacagctttccttccaagattgacacaatataccatatactctataaaaaattattctatgaaagtcttaagttacagtagacaggcaaagataaaaatctttaacactagttactgaaaatgagtatcttaaactgtaaacattaaaactgctttccaaattaaggaattaaataatatttag

SEQ ID NO: 28029 - DNA, 601 bp, Human
gtagatttgaatttaaggtacatgcctatctgtggtacccacttaagtatgtaaaactttctctaagattgtaggagacaaagcgcctattttcttttcaatggacacattccagaatagcagcaatcaccttccctgttttccttcctaccaaaagttggtatcagcaaataatgtaaagctaacaaaaatgtgcaaaattccatattgcaatgcttcatgtattaactttagtttgtcacattactattcatgtgaatgaggtacaaaataaatgaaaattttttaatatggaaaatcrtgtcaatttgtaacatggaatatggataggattaaacctaggtccaactcctggctctgccatttcctgctagcaaccttggacaacactggtataatgacagttatgtcacataaagccaatatgacaactaaatgaatgaatatacataaaatattcagaatagtatctggcatatgataagcacttaaatgttaacatttctaattatttctgctttgaggactagaaatgacttctaattttgctgacctgaaatgttttaacattcgtatttacagaatgcaaaatactatgcaa

SEQ ID NO: 28030 - DNA, 601 bp, Human
aatatccttatactgtcatagccccaatagtgcagtacaaattttaatgtgaagttcaattcttttaaagattttctttcaagacactgagtgatcatttagcacattcatctgaagatttactgagtgcctacatccactacataccagacatcgtgctgaggcatttattcaagaatcacaactgcagaaagaattctgagactgagaattttaattttcccacattgcaataaatcttgtatgcaataaagtttattagttgaactgtcctgttattaaaatcttgaaatttgacaayttcattgttactaaaaaatacacgtttactttgagctgctcatgtataattttaaagctatttttgcatggctcactcgaggtcaacttagaccctaaaactgagcatcaaattacttaaatgacacgcttacaaatttgccatttctaaaattaaatgcacgggtttcaagacatcctagttgtttttctcctgagagctggcgtaatggccaatctctgtatcattacctgttaaatttatctgccattcttaacgtctcttcttccttctggctaatttgacataggaaaggcacac

SEQ ID NO: 28031 - DNA, 601 bp, Human
aaaaaaggaataataatacccttttctcaaggaagctattcagaaggccaaggaactcctgtggggtgctgagaaagcatacctaaaacactaacattaggagaacgggacacaacagcgtttgggttctggcttgaatctgctccgtgacactgggcaagtcccccgcccactttgggactcagccttctctctcctatcacctggagaatcgtcttcctaatagacaaggaagatgctcatctctctatgatgcttgctgggatgcagctttttctagtaccagatttccaacctgctrgctgaacagaaaggtgaaaaccagccaggggagtttgcccaggcacccaatcatggaggctgggggcatggaggggacttttggagggcggtctcaggaggggccaggactccaggggaagttccttctaggtgcacttacctcccttgggcactctcatctctgggctccagcccttgtgcctgtgtgccaaggctgtctgctggcagagccctggagaggcaaaggagatattgcatcagggatgggcactgtggagaggggccaagccttcaaagaggcagagtgagggtttaggct

SEQ ID NO: 28032 - DNA, 601 bp, Human
ggccagggcaggaatcctggatcagaccaggccaaggctgaagaaaacagctcaaagcaggcaagtcagaagtgagcagaagacagcaacgacctgcacgatggcttaagaagaaaaagcagggtgacttgggacacagaaagcagcctggaacccacaaagcagaaagtagcttcctggttacccagagctagggaccccactgtggaaggagctagagggcccagcccagggaactaggcctgcccaacaccctcatcaccctgctggaccctggcaagggaggtatcctggcatcctygcagtgaggatgataggtgagggcttctaacttggagtactacactccaaggttcaaatctcacttctgctgccacttgccagctggtgatctggacaaaaggtatcacttctctgagcttctactttcttctccaaaaaaggaataataatacccttttctcaaggaagctattcagaaggccaaggaactcctgtggggtgctgagaaagcatacctaaaacactaacattaggagaacgggacacaacagcgtttgggttctggcttgaatctgctccgtgacactgggcaagtccc

SEQ ID NO: 28033 - DNA, 601 bp, Human
aggctgcagttagctgggatcgtgccactgcactccagcctgggcaacagagtgaaaccctgtctcaaaaaaacaaaaacaaaaacaagaaaaaccccaaaaaacagacctgggttccaatcccagcaccatgctttgttagctgtgtagcctgaggccagtaacttctcctctgtgagattcagttttttggtctataaaatgtggataagaggtgttcctatgtcctcaggttgctgtgaggattaaaggagataaacttgttgggggcttaacccaatacttgccatacagtaggcaytcattaaatgacaatggtgaggatgggtactccatcaataaaagcagtatcaacactaaaatagtaataatagcacctaacatttattaacctatttgatgcccacaggtatctataaggtaggcaaattatatttccatgttacagatgaagcaatggaagcacaggggttgagtcgctttgcccagggtcacacagctaagaagtggcagagctgaggtttgaacccagacatccttgttctggaatctgtgctcttaacctttacccactattgccttactacaaagcatattcaaa

SEQ ID NO: 28034 - DNA, 601 bp, Human
gttcaaagtgctctgggtctcaggatagggacagcagcttttccaatggaagaaggcagggagcaagggacagagggaggaaggaaaggaaaggatgagggggagtgaaggggaggatgggaggagttctggacatggggagtttaagaacacaataggccaggggcctgtaatcccagcactttgggaggccaaggcaggaggaaggcttgagctcaggggttggagaccagcctggaagacatactgagatctcatctctactaggaaaaaaaaaaaaaaaatgagctgggtgtggagmtgctcgcctgtagtcccaactactcgggagactgaggtgggagaattgcttgagcccaagaggtcgaggctgcagttagctgggatcgtgccactgcactccagcctgggcaacagagtgaaaccctgtctcaaaaaaacaaaaacaaaaacaagaaaaaccccaaaaaacagacctgggttccaatcccagcaccatgctttgttagctgtgtagcctgaggccagtaacttctcctctgtgagattcagttttttggtctataaaatgtggataagaggtgttcctatgtcctcaggt

SEQ ID NO: 28035 - DNA, 601 bp, Human
tgagtatttccataaatagatgtctgcaaaatcaactaatgtcaagaggaagaggaactcacgagacccacagacaaagcttacacttcaattacaagggcacagcccccaaagctcagcgttagtaaattctctttgttaaagagagatcagtgagtgctagagaggtggtaatgactttttagcaccaaatggaaactttcttcttgagccaactgaagagttacggaactaagagacgattaacttttttccgttgtgattcaatacgataactgtttatttcctaaaatcagcacaygctcagaaatgctgagcttagcttaaattaaagactctgggtcttaatgaagtaagggctgtgaaagctcttcctcaggcctgggtcccattttcaaatatttgcctataaggaagttagaacacagcacttaaagtaaactagaagctgtaatggaaacgtataaataaggccatcaacttgttaactgttcttttacccagtgggtgttagcctactttaacacttcaaaagcattttgtcagtcactggaggctcacacctgtaatctcagcactttgggaagagtgaagcaggggc

SEQ ID NO: 28036 - DNA, 601 bp, Human
ggtctcaaactcctaggctaagcagtctgcctgccttggcctccaaaagtgctaggattatagacatgagccatcatgtccagcctatgtaaaatattaacatttcaatatgtaatttatataaaagtgactaataagaaacgttacatacttttttgtcctaagccttcaaaatctagtgtgtattttacacctaacaggacctctcactttggactagcctcctgttacagaatcaggggccacacatggctagtggctaccgtatgggacactgcaggcagagacgatttcatcagcrtagatgtccttttagccactgtgtttactgagccccaggatccattattggaacacacagggtccacagcactcacagaagcacacaggcatgcatgcaaactcacagggcttagtgagaggacttttctttgcagtaacagccaagctatggcaaaaactaaaccagggatctagcacttgccaagacttgttgaccgccccagggaagaaatctctttggatgaaaatgagagacagcttccattttaaataaacaaacacaaaaagctccaaagagttgatgttaaccaccagtgct

SEQ ID NO: 28037 - DNA, 601 bp, Human
tgagtagctgggactataggcacgtgccaccatgcctggctaatattcaatatttttagtagagatgaggtttcaccatgttacccaggctggtctcaaactcctaggctaagcagtctgcctgccttggcctccaaaagtgctaggattatagacatgagccatcatgtccagcctatgtaaaatattaacatttcaatatgtaatttatataaaagtgactaataagaaacgttacatacttttttgtcctaagccttcaaaatctagtgtgtattttacacctaacaggacctctcaytttggactagcctcctgttacagaatcaggggccacacatggctagtggctaccgtatgggacactgcaggcagagacgatttcatcagcatagatgtccttttagccactgtgtttactgagccccaggatccattattggaacacacagggtccacagcactcacagaagcacacaggcatgcatgcaaactcacagggcttagtgagaggacttttctttgcagtaacagccaagctatggcaaaaactaaaccagggatctagcacttgccaagacttgttgaccgccccagggaa

SEQ ID NO: 28038 - DNA, 601 bp, Human
tgagaggctgcttcctggcagaagggccactgagatgtggccccagctggatcagtgcttagagaccctctggtccagcacgcatccccacagccctttattttttatttttattttttgagatggagtctcgctctgtcgctcgggctacagtgcaacggcgtgatctcagctcactgcgacctctgcctcccagggtcaagcgattctcctgcctcagcctcccaagtagctgggattacaggtgtgtgccactacgcccggataatttttgtatttttagtagagacggggtttcacygttttggtcaggctggtcttgaactcctgacctcgtgatctgcctgccttggcctcccaaagtgctgggattacaggcagccagctcacatccccctttttataatgggaaaaccatcaaccagagtggagaagtgacacatctaagggcatacagccagatggtggtatagctgagaaagacagaattcggaattccccttggggtttctaacctgaaaatatcctttcagattggctggtgttttatagtcccctttcaagacctaaggaagagaaaaagaaatatcactattatgaa

SEQ ID NO: 28039 - DNA, 601 bp, Human
gcgatctgagagctagggaccatggcttttgagcatttcctggttgtttggggagaggtcccactccctttgtgggaatcagagatctatcttttgctgacgtcaagaaagtagccagaattagtgagcactaatttagtatttgttttaaccaaaaagatgatgtaggcagaacaacacagtggggatgaggagaattatccacaaactgaaacttctcatttttgcacgttgccttcgtttttgttgttgttgttgctgctgttgtttttaagagacaggggctccagcgatcctcccrcctcagcctcctgagaacctgggactgcaggcatgccactgcacccaactcctgcgtgttgcctttttttgtccacctgaatatgcatttttacattagttgcaattgtatagtatgagctgctttgttttgctttcttactattttttcatcatttgggtttcactagcaccattttggatggctacagatattctgtggagtgcatgtaccaccgtttactgactgcttacctaagaatggttccaatttttgcagtattttaaatgacatcacatcctgattctgcctctcttctgt

SEQ ID NO: 28040 - DNA, 601 bp, Human
cacgaacatgtgccacatgtgccatacccagctaaggctttctcttttttgtagggagatggggtctcactgtgttggccttgaatttaaaaaaaaaaaattaatgcgatctgagagctagggaccatggcttttgagcatttcctggttgtttggggagaggtcccactccctttgtgggaatcagagatctatcttttgctgacgtcaagaaagtagccagaattagtgagcactaatttagtatttgttttaaccaaaaagatgatgtaggcagaacaacacagtggggatgaggagrattatccacaaactgaaacttctcatttttgcacgttgccttcgtttttgttgttgttgttgctgctgttgtttttaagagacaggggctccagcgatcctcccacctcagcctcctgagaacctgggactgcaggcatgccactgcacccaactcctgcgtgttgcctttttttgtccacctgaatatgcatttttacattagttgcaattgtatagtatgagctgctttgttttgctttcttactattttttcatcatttgggtttcactagcaccattttggatggctacagatatt

SEQ ID NO: 28041 - DNA, 601 bp, Human
atgatgaaatctctaaatgacagaatttggaaagcttcctggttggtaaacacattgagaggctgggagggtgtcatgccgggaaagggcatggatgttctgtgacccatcccccatacctcaccctacgcttcttgcatttgactgtacctgagttgtattcttttttatgagacagggtctcactctgccacccaggccagagtgcagtggcacgaacatgtgccacatgtgccatacccagctaaggctttctcttttttgtagggagatggggtctcactgtgttggccttgaattwaaaaaaaaaaaattaatgcgatctgagagctagggaccatggcttttgagcatttcctggttgtttggggagaggtcccactccctttgtgggaatcagagatctatcttttgctgacgtcaagaaagtagccagaattagtgagcactaatttagtatttgttttaaccaaaaagatgatgtaggcagaacaacacagtggggatgaggagaattatccacaaactgaaacttctcatttttgcacgttgccttcgtttttgttgttgttgttgctgctgttgtttttaagagacaggg

SEQ ID NO: 28042 - DNA, 601 bp, Human
ccccagtgaagtccacaggcttacctggaaatcacgagcttcctaagtgggaggaggtgctgttctggttcacctggagaaagacaatacacagaagaaggggtcacggccaggtgagggatgccttgctgtattgagggtcacccctcagcatcactgagtcatgcacatgcttattcacgtagtatttactgtacatctactatgtgccaggtgctgggatagcgtggtgagcgggacagacccaaacctaggatcacggaacttacgttcgagttgaagaaaaagcctactgaacacrcacagatgcaagaaaatgtcaaacttgggcaatatgacaggctgctatgagtgatcagtatctgtgctacttcaaaaacggtggccaggaaaggactctacaagatggcatttcagctgtggtataataataaatatttgttcattgtccccagttcctggcacatagctccccaaactcttggaatctctgaaggaataagggtatcttggccgggcgccatggctcatggctgtaatcccagcgctttgggaggccgaggagggtggatcacctgaggtcaggagtttgagaccagcc

SEQ ID NO: 28043 - DNA, 601 bp, Human
ctctgatggggctgggtcagcccaccctagtggacatgtctaccccagggaggctctggaaggacagaaaagtggcttttcagaaaagtggctccggggccacccagaagcagcgggaacccccagtgaagtccacaggcttacctggaaatcacgagcttcctaagtgggaggaggtgctgttctggttcacctggagaaagacaatacacagaagaaggggtcacggccaggtgagggatgccttgctgtattgagggtcacccctcagcatcactgagtcatgcacatgcttattcaygtagtatttactgtacatctactatgtgccaggtgctgggatagcgtggtgagcgggacagacccaaacctaggatcacggaacttacgttcgagttgaagaaaaagcctactgaacacacacagatgcaagaaaatgtcaaacttgggcaatatgacaggctgctatgagtgatcagtatctgtgctacttcaaaaacggtggccaggaaaggactctacaagatggcatttcagctgtggtataataataaatatttgttcattgtccccagttcctggcacatagctccccaaactc

SEQ ID NO: 28044 - DNA, 601 bp, Human
cccccagtctgtcaccatggaaacctctgatggggctgggtcagcccaccctagtggacatgtctaccccagggaggctctggaaggacagaaaagtggcttttcagaaaagtggctccggggccacccagaagcagcgggaacccccagtgaagtccacaggcttacctggaaatcacgagcttcctaagtgggaggaggtgctgttctggttcacctggagaaagacaatacacagaagaaggggtcacggccaggtgagggatgccttgctgtattgagggtcacccctcagcatcaytgagtcatgcacatgcttattcacgtagtatttactgtacatctactatgtgccaggtgctgggatagcgtggtgagcgggacagacccaaacctaggatcacggaacttacgttcgagttgaagaaaaagcctactgaacacacacagatgcaagaaaatgtcaaacttgggcaatatgacaggctgctatgagtgatcagtatctgtgctacttcaaaaacggtggccaggaaaggactctacaagatggcatttcagctgtggtataataataaatatttgttcattgtccccagtt

SEQ ID NO: 28045 - DNA, 601 bp, Human
ctgtgcaaaaatggttccagaatctccccctcccccatcatagtggtgcttcctgccctgtccccagtgtcagacaaacctttttctggttggttcagcgttaatccctctccctgtccttgatccagagctagaaaactaagccttgattctataaatagcacccccagtctgtcaccatggaaacctctgatggggctgggtcagcccaccctagtggacatgtctaccccagggaggctctggaaggacagaaaagtggcttttcagaaaagtggctccggggccacccagaagcagygggaacccccagtgaagtccacaggcttacctggaaatcacgagcttcctaagtgggaggaggtgctgttctggttcacctggagaaagacaatacacagaagaaggggtcacggccaggtgagggatgccttgctgtattgagggtcacccctcagcatcactgagtcatgcacatgcttattcacgtagtatttactgtacatctactatgtgccaggtgctgggatagcgtggtgagcgggacagacccaaacctaggatcacggaacttacgttcgagttgaagaaaaagcctact

SEQ ID NO: 28046 - DNA, 601 bp, Human
cttgggcaagtcaaagcccttccttctctgtgctttggttttctcttctgtaaaatggaatgatcatgtcatccgcctcccaaggatgctgagggttaaatgagtaacacaggaccagtacctggcccaacggccatgggggttattcttagaacagaacgacttgtgactgttattagaacattaattgctctggcccaacgctgatgctgtttttagaagccagactggcagacagcattctgtgcaaaaatggttccagaatctccccctcccccatcatagtggtgcttcctgcccygtccccagtgtcagacaaacctttttctggttggttcagcgttaatccctctccctgtccttgatccagagctagaaaactaagccttgattctataaatagcacccccagtctgtcaccatggaaacctctgatggggctgggtcagcccaccctagtggacatgtctaccccagggaggctctggaaggacagaaaagtggcttttcagaaaagtggctccggggccacccagaagcagcgggaacccccagtgaagtccacaggcttacctggaaatcacgagcttcctaagtggga

SEQ ID NO: 28047 - DNA, 601 bp, Human
tggagcaaagtaaattgaaagaaaaactaaaacatatgctgattgtttaaaaatagatacagagactaaaaataagagtccaagctggaaggtgtttccatgtaaaataacctctcttgaggtttcctttaacctgatcatagaggctgggggacagaaggaagtgagctcactcatgcagccttaactccagtgcccaagtccacagcgagggcccagcacttcacggtttccaagcactcccacctgggccagctcacgccatctcatggccaacctcagaggtgggcaatgatgaatscccattctccagatgaagaaaacaggggctgaagggagttaaacctggagatcttaaatctttgaattaccaagttcaaaaaatccctttcccgaccccttagtagaatatggatggataaatgtgcacttaaaatcattcactaaaagcaaacctgggaggaattctgtcccttggtggctgtgtagccttgggcaagtcaaagcccttccttctctgtgctttggttttctcttctgtaaaatggaatgatcatgtcatccgcctcccaaggatgctgagggttaaatgagtaacaca

SEQ ID NO: 28048 - DNA, 601 bp, Human
aaaacgtttcctgggttcttccccacatctcatcttgcatccacttgacctcaaatatacacttttcttatggacacagagcaaatgacagtgattatgtgataaatactgatgaattcttggaggcaagagaaggactcatgtttgttcaaggccaactctgtacccaggattcagctaaagcacctctatatggtatctcatttaaacagtaaaacaagtaacaaatctgcttttgtcaatgagaaggtccaggattctactaatgatctgcagaaaggcagcgagggaacagttagtraggaacagggaggaaagctgtttttcatgagagggttcttttctttggaatagaactatgggatcttgggtaggtgtggtggctcatgcctgtaatcccagcactttgggaggctgaggtgggcagatcacttgaggccaggagtttgagaccagcctggccaacatggtgaaaccccgtctctactaaaaatacaaaaattagctgggtgtggtagcgcacacttgtaaccccagctacttggaaggctgaggcacgagagtcacttgaaccccagaaggtggagattgctgtgagctg

SEQ ID NO: 28049 - DNA, 601 bp, Human
gaagactgtgttaggctcagagtaacaattctgaaatagatcatttatatttatacatgtgattgcagaacatactgtcttcatccattcgcataagcatgtaatgttttaagaatgcatcccagatggccagagagagtttaaatttaaaaacgtttcctgggttcttccccacatctcatcttgcatccacttgacctcaaatatacacttttcttatggacacagagcaaatgacagtgattatgtgataaatactgatgaattcttggaggcaagagaaggactcatgtttgttcamggccaactctgtacccaggattcagctaaagcacctctatatggtatctcatttaaacagtaaaacaagtaacaaatctgcttttgtcaatgagaaggtccaggattctactaatgatctgcagaaaggcagcgagggaacagttagtgaggaacagggaggaaagctgtttttcatgagagggttcttttctttggaatagaactatgggatcttgggtaggtgtggtggctcatgcctgtaatcccagcactttgggaggctgaggtgggcagatcacttgaggccaggagtttgaga

SEQ ID NO: 28050 - DNA, 601 bp, Human
tgcaaattaaggaggatggcaaatctgtctcttaaaaaaaagttcttgaggggaaaaatataaaatacctaagtttcaaaagccggactacttccatacccttcattctctaccctggagtgtccagagatagagagtttcaaggtacgttttcaatgattcagcttttgcaaacatatgcaaatacattcctcatcagcagtcctgttttggcgattaatagcaagcaatatgcttggattagaggtccgatttccacttaaatgcattttcttctcttcttggcaatgaagtcatttgyggagatctgaaagtggggaagactgtgttaggctcagagtaacaattctgaaatagatcatttatatttatacatgtgattgcagaacatactgtcttcatccattcgcataagcatgtaatgttttaagaatgcatcccagatggccagagagagtttaaatttaaaaacgtttcctgggttcttccccacatctcatcttgcatccacttgacctcaaatatacacttttcttatggacacagagcaaatgacagtgattatgtgataaatactgatgaattcttggaggcaagagaa

SEQ ID NO: 28051 - DNA, 601 bp, Human
aggctggagtgcagtggtacaatctcagctcactgcaacctccgcctcctgggttcaagcagttctctgcctcagcctcccaagtagctgggattacaggcacccaccaccacgcctggctaatttttgtatttttagtagagacagggtttcaccatcttggccaggctggtcttaaactcctgacctcgtgatccactcatgtcggcctcccaaagtgctgggattacaggcgtgagccaccgtacccggccatatctttttttttttttttttttttttaagagaggaagtcttgctrtgtttctcaagctgaagtgtagtggctatttacaggcatgattacctgtgaataacatgcatagtgcagccttgaaatgctgtgctcaagcaatcttcacacctcaagtacctgcgattacaggcacacgccactgcacttagctcgttcgcatgtgtttaccttcccaattctttgctaagcttccagttcctatctctaatttccaaccagatatctgtccagaaatgtcctatgggcacaccagtataatcatttaatgcattgagctcattatctttcctcagaatttactctgat

SEQ ID NO: 28052 - DNA, 601 bp, Human
atttttagtagagacagggtttcaccatcttggccaggctggtcttaaactcctgacctcgtgatccactcatgtcggcctcccaaagtgctgggattacaggcgtgagccaccgtacccggccatatctttttttttttttttttttttttaagagaggaagtcttgctatgtttctcaagctgaagtgtagtggctatttacaggcatgattacctgtgaataacatgcatagtgcagccttgaaatgctgtgctcaagcaatcttcacacctcaagtacctgcgattacaggcacacsccactgcacttagctcgttcgcatgtgtttaccttcccaattctttgctaagcttccagttcctatctctaatttccaaccagatatctgtccagaaatgtcctatgggcacaccagtataatcatttaatgcattgagctcattatctttcctcagaatttactctgatagtcttcatctgggttcatttcataacccttcatccacagtttttctaagccagaaatcatttggtccaatattggtccggaatggaccaggtctaatatttgtattttctgatctgccactttcttatc

SEQ ID NO: 28053 - DNA, 601 bp, Human
cttagctcgttcgcatgtgtttaccttcccaattctttgctaagcttccagttcctatctctaatttccaaccagatatctgtccagaaatgtcctatgggcacaccagtataatcatttaatgcattgagctcattatctttcctcagaatttactctgatagtcttcatctgggttcatttcataacccttcatccacagtttttctaagccagaaatcatttggtccaatattggtccggaatggaccaggtctaatatttgtattttctgatctgccactttcttatccatcatctycatgaggccagcacacctcacaccaaagcccaccaggctctttttctttctataccccatgattggcctcctagttacgaactggaccatggatatttaccactaactacatggttttaatttttgcaccatgtaactctgacttggagagatttatgtgattgaattctcttttttctgtttcttttgattgttccttactgtgactagactggtttaccgccttcggctttggtatttttatctaacataaatcccattgctctctctgtgattttgtttaacttaggttctaaggct

SEQ ID NO: 28054 - DNA, 601 bp, Human
tccaaccagatatctgtccagaaatgtcctatgggcacaccagtataatcatttaatgcattgagctcattatctttcctcagaatttactctgatagtcttcatctgggttcatttcataacccttcatccacagtttttctaagccagaaatcatttggtccaatattggtccggaatggaccaggtctaatatttgtattttctgatctgccactttcttatccatcatcttcatgaggccagcacacctcacaccaaagcccaccaggctctttttctttctataccccatgattgrcctcctagttacgaactggaccatggatatttaccactaactacatggttttaatttttgcaccatgtaactctgacttggagagatttatgtgattgaattctcttttttctgtttcttttgattgttccttactgtgactagactggtttaccgccttcggctttggtatttttatctaacataaatcccattgctctctctgtgattttgtttaacttaggttctaaggctctggaatattccaatgggatttttgattgccaatctcccacctctccattcatgggaagtttgcga

SEQ ID NO: 28055 - DNA, 601 bp, Human
tccagaaatgtcctatgggcacaccagtataatcatttaatgcattgagctcattatctttcctcagaatttactctgatagtcttcatctgggttcatttcataacccttcatccacagtttttctaagccagaaatcatttggtccaatattggtccggaatggaccaggtctaatatttgtattttctgatctgccactttcttatccatcatcttcatgaggccagcacacctcacaccaaagcccaccaggctctttttctttctataccccatgattggcctcctagttacgaaytggaccatggatatttaccactaactacatggttttaatttttgcaccatgtaactctgacttggagagatttatgtgattgaattctcttttttctgtttcttttgattgttccttactgtgactagactggtttaccgccttcggctttggtatttttatctaacataaatcccattgctctctctgtgattttgtttaacttaggttctaaggctctggaatattccaatgggatttttgattgccaatctcccacctctccattcatgggaagtttgcgagctctgcaccttgtgg

SEQ ID NO: 28056 - DNA, 601 bp, Human
tctcttttttctgtttcttttgattgttccttactgtgactagactggtttaccgccttcggctttggtatttttatctaacataaatcccattgctctctctgtgattttgtttaacttaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacrcttgttgaatggcttcagagtcaaatggtagggtctgcctgttccaaattctgttataaatcctttgttgcttattccaaaatttagaacatagaatagctgattagaacaagaaaagtttagggcaacacatgtgctccgattttattacttaagatatcttaattttcttttgactctaaggataactttttaaaaagtgctattagtgtacattttgtaaataccaacaacaggtcacctgattctgcccataaaaacagactggcttttagattgtgcctgaatgacctactgtgg

SEQ ID NO: 28057 - DNA, 601 bp, Human
tctcgtattttctgtttgacagtgacagctgtgcagattcaattcaggccccttggactaagaacacttgtgattttcatttatctacgatatatcattcttagagaagatcagccttacccatattacttcctttttcagacaaatggacacctaccagggaacggagatgtgtatcaagaaaggctggcacgtttagaaaatgataaagaatccctcgttcttcaggcaagtgatttttaaatactgttctttccttgcagcatacttacaaagccttttaaattggggtggcaaattyagattgcttgcagcaatcagactgctaatagaaataagcctgataagccatctgtacacaatagggagtggtgaggattggggcagaatgatggtgtttacacccagtttaaaaggagctaccattaatcatcctcagctcttgcaggaccagtctgaatacgggcacaatgttgtctgatctgttcttttttttttttttttttggaggcagggtcttgttacattgcccaggctagtcttgaactcctaggctcaagcaaccctcttacctcagcctcccaagtagctgggattacag

SEQ ID NO: 28058 - DNA, 601 bp, Human
ggcacgtttagaaaatgataaagaatccctcgttcttcaggcaagtgatttttaaatactgttctttccttgcagcatacttacaaagccttttaaattggggtggcaaattcagattgcttgcagcaatcagactgctaatagaaataagcctgataagccatctgtacacaatagggagtggtgaggattggggcagaatgatggtgtttacacccagtttaaaaggagctaccattaatcatcctcagctcttgcaggaccagtctgaatacgggcacaatgttgtctgatctgttcttttttttttttttttttggaggcagggtcttgttacattgcccaggctagtcttgaactcctaggctcaagcaaccctcttacctcagcctcccaagtagctgggattacaggtgtgcagcaccatgcttcactggatctgatttttaagtatattttaatatatagcagaaattcagatatatgaatatagcataacatctgaatatatgtaagtttatatttctgaatctgaaatcagaatatatatatttaatttttcaattttaaaaatgttaccctgtgtgagacaaaacaaaac

SEQ ID NO: 28059 - DNA, 601 bp, Human
ttacaaagccttttaaattggggtggcaaattcagattgcttgcagcaatcagactgctaatagaaataagcctgataagccatctgtacacaatagggagtggtgaggattggggcagaatgatggtgtttacacccagtttaaaaggagctaccattaatcatcctcagctcttgcaggaccagtctgaatacgggcacaatgttgtctgatctgttcttttttttttttttttttggaggcagggtcttgttacattgcccaggctagtcttgaactcctaggctcaagcaaccctcytacctcagcctcccaagtagctgggattacaggtgtgcagcaccatgcttcactggatctgatttttaagtatattttaatatatagcagaaattcagatatatgaatatagcataacatctgaatatatgtaagtttatatttctgaatctgaaatcagaatatatatatttaatttttcaattttaaaaatgttaccctgtgtgagacaaaacaaaacagtgactagaaccctccttgtgggctaaatttgagtttgcttcttcataatgttttaaatgcttcacaaacatttttctt

SEQ ID NO: 28060 - DNA, 601 bp, Human
atatatttaatttttcaattttaaaaatgttaccctgtgtgagacaaaacaaaacagtgactagaaccctccttgtgggctaaatttgagtttgcttcttcataatgttttaaatgcttcacaaacatttttctttggtatattgagcaaaatgaattgaagtatatttactgagtgatgattattgaggaaaaactcaaagatctgctgtaagcactagagttgaaggactagcccaacagctcctcaggcacctttgggtatattgagttgccccccctgactttgaacacatctatgrtctgtgtcatcttcaaagagctcatggaatttgaattccctgggttttgtttttgtttttgttttggacggagtctcgctctgttgccgagacgggagtgcagtggcacaatcttggctcactgcaacctccacctcccggatccaagcgattctcctgcctcagcctcccgagtaactgggattacaggcacatgcccccacagccagctaattttgtatttttagtagagatggggtttcaccgtgttggccaggctggtcttgaactcctgacttcaagtgatctgcccgcctcagc

SEQ ID NO: 28061 - DNA, 601 bp, Human
catctatgatctgtgtcatcttcaaagagctcatggaatttgaattccctgggttttgtttttgtttttgttttggacggagtctcgctctgttgccgagacgggagtgcagtggcacaatcttggctcactgcaacctccacctcccggatccaagcgattctcctgcctcagcctcccgagtaactgggattacaggcacatgcccccacagccagctaattttgtatttttagtagagatggggtttcaccgtgttggccaggctggtcttgaactcctgacttcaagtgatctgccygcctcagcctcccaaagtgctgggattacaggcgtgagccaccgtgcatgctacctctcccccctacccctggccaggttctttttcttattctccttgaagtatcaaatttttgataatttctatttcaaacattaactttgtttcctctcttatactatctccaccctgctccctaaaaagataacttctgcacatgctgtctctcataaatggttgaagtagctttaaccaaaaagtattgtacattcctaatctacacgaactttctccaaattgtataggcctccttaaatcaaa

SEQ ID NO: 28062 - DNA, 601 bp, Human
gcctcccgagtaactgggattacaggcacatgcccccacagccagctaattttgtatttttagtagagatggggtttcaccgtgttggccaggctggtcttgaactcctgacttcaagtgatctgcccgcctcagcctcccaaagtgctgggattacaggcgtgagccaccgtgcatgctacctctcccccctacccctggccaggttctttttcttattctccttgaagtatcaaatttttgataatttctatttcaaacattaactttgtttcctctcttatactatctccaccctgcyccctaaaaagataacttctgcacatgctgtctctcataaatggttgaagtagctttaaccaaaaagtattgtacattcctaatctacacgaactttctccaaattgtataggcctccttaaatcaaatagcaacatataaataggaatgcgagggaccactgtcttcttggtacttctcagatttttttttctttataaccgtatgaatggtaggatcattcctttttttgttccatttagagaaataacgtatgcagtgggacccaaattctttttcactcattgcattattttgctct

SEQ ID NO: 28063 - DNA, 601 bp, Human
atgacattaggccagttcctaacctctctgttactatgtttcctcatcttttgattaaggataataagaatttctacctgataagttttttgtgaggattgaaatagtatttgttacaaccggtgcctggcacatagcaaacatagtatcaccatcatcaatgttatcatcagactgaagtatatatatggtttatgcatgtgtatctacacaacatatgtctccctcagtaaactgacatgtgcttatttctgttcaaaggagggtaactaaagtgaatagttcttttttattttatttyattttatttttgagatggaatctctgtctgttgcccaggctggagtgcaatggtgcgatctccgctccctgtaacctccgcctcctgggttcaagtaattctcctgcctcagcctctcaagtagctggggttacaggcacccgccactatgcccggcaaatttttgtatttttagtagagacagggtttcaccatactgtccaggctggttctcaaattcctgacctcaagcgatctgcctgcctcggcctcccaaagtgctgggattacaggcatgagccactgtgcccagcctcaagt

SEQ ID NO: 28064 - DNA, 601 bp, Human
cgccactatgcccggcaaatttttgtatttttagtagagacagggtttcaccatactgtccaggctggttctcaaattcctgacctcaagcgatctgcctgcctcggcctcccaaagtgctgggattacaggcatgagccactgtgcccagcctcaagtgaataattttttaaaagtgtgtagattcagtaattatacttcactatatcctctacttgataggtgctgctttgtgcgatcataaatgaggtaaattcacgtgcctgtttataataaaagacttcttgaatgtatctgttamattataataggagcttctaagtaggacatccttagaaactcagaagttggatctgatggctgaaatatctaacttgaagttgaaactgacagctgtagagaaggacagattggattatgaagataagttcagagacacagaggtgagtgatacagtctctcctccctctctctctctctctgtcactctgtctttgtctctgacacacatacattcctagggcaaagttgaaattccctggaggtgtgcaaggaaggcagttaattactacgtaccatcatcctacttcattttaagaat

SEQ ID NO: 28065 - DNA, 601 bp, Human
gataggtgctgctttgtgcgatcataaatgaggtaaattcacgtgcctgtttataataaaagacttcttgaatgtatctgttaaattataataggagcttctaagtaggacatccttagaaactcagaagttggatctgatggctgaaatatctaacttgaagttgaaactgacagctgtagagaaggacagattggattatgaagataagttcagagacacagaggtgagtgatacagtctctcctccctctctctctctctctgtcactctgtctttgtctctgacacacatacattcytagggcaaagttgaaattccctggaggtgtgcaaggaaggcagttaattactacgtaccatcatcctacttcattttaagaataatctttcattgcattgactttttatcactaaatgctaatggcaatttttatttttagacttttgatatgaagtattaatctttttattaacctttagaaatacttttgactttacgatatttggagcatccgtccatccatactgtttttcttaattttgtaaataatgggcttaaatacatggtttcactagtagttattatttaggcacactga

SEQ ID NO: 28066 - DNA, 601 bp, Human
gttatcgtccccttaataaaaatatttttctgggtgtttcatgaatccataatatttaactttctcttagaattttagatttatatttggatattaatttccaagaaaatattggcatggggaagaagtataggcatttccaaaggactgagggtacaagtctttaaactttggaagattcaggacttgtccctggaattgctaatgggagatgattagcatcattcaacagtgcccccttgtggtaagagcatacatgtcagagactgagttcctgcaggagccctgaattctctgaaarggaaaagagaaagggaacaggaattttcttttttaaaaggactgaacttctgataagaaattgattgaaatagtttgtattctgttttttaaagttttacattagggagccatttccagattttccagcttgtgttgtcaggggaagatgtgatttatttcaggttggaaatttagaccatatttaaagtattgccatgaaatatagttgagtagttttttgttaaaacagataaattatcccagtttacaattccatttttttcagtggtttcttctttgcacgagcaaagaagaaagg

SEQ ID NO: 28067 - DNA, 601 bp, Human
tgtagcatcccttctcttagcctttgtgaacttgaatcattacacttggaagcttaaaataatttctatttacaaagttttatttcatatagcattgttctacttgtaatttttggcattcgtggataattttgtcctgtagtctatgaatttgtgatgcaggaatacatgcatgtctttgtaaaaagagagaagctggccgggcacagtggctcacatctgtaatcccaacacttagggagtccgaggagggcgggtcacttgaggtcaggagttcaagaccagccaggtcaacatggtaaaacccccgtctctactaaaaatacaaaaattatctgggcatggtggtgggtgcctgtaatcccatctactggggaggctgatgcaagagaatcacttgaaccctggaggcgaaggtcgcggtgagctgagatggcggcactgcactccagcctgggtgacagagtgagactccatcttaaaaaaaaaaaaaaaaaaaaaggagagggagagagaagcaaaaatatagtaaccattgtagggatctttgtggcttgtagtaaaataagtcatctcccatgcagggtatttgagtgtctct

SEQ ID NO: 28068 - DNA, 601 bp, Human
gtaaaaagagagaagctggccgggcacagtggctcacatctgtaatcccaacacttagggagtccgaggagggcgggtcacttgaggtcaggagttcaagaccagccaggtcaacatggtaaaacccccgtctctactaaaaatacaaaaattatctgggcatggtggtgggtgcctgtaatcccatctactggggaggctgatgcaagagaatcacttgaaccctggaggcgaaggtcgcggtgagctgagatggcggcactgcactccagcctgggtgacagagtgagactccatcttaaaaaaaaaaaaaaaaaaaaaggagagggagagagaagcaaaaatatagtaaccattgtagggatctttgtggcttgtagtaaaataagtcatctcccatgcagggtatttgagtgtctcttttggaggagttaatattgcttaacactctaatttcctttcctactctctgggctcttggacaagttttgtgagcaaattggtcctttaaaaagtagcactaaaataaagtggcagtagaaaaggtgcagaattgtgttgtgtcatataaacactaggattggtttctctttcattttct

SEQ ID NO: 28069 - DNA, 601 bp, Human
catagtactaaatgtaataaatatatctttagagattctgaaagcaaaatgtgatgttgaatataaagctgtacttcttagcattgcatagctgtattttctgtgttaagtacagccagcaaaatttgtttgctaaaactaattctttactgaaaggaaactgaaaatttaaacatgagtacatagaaggatggacttgaaatcttatacacagttgtatagttaaaaattaaaagagggctccactatctgttttcgaaatttattttttcccattgttgtaggagattctgtccttttrtcttagtgatgagggtgaattatttagttccctgatttggctaaaattgttcatgacttgctaccttacccatgaatgaaactctgtgcttgtcaaggaagcatgagtgccaacttgaaatgctgaataaatgtcaagctagtcttttccaatttgcattttattttgcttttatgacactaagtatctaatttgattatcttccttgattaacttggttatatttttaatttaatgtaaagatttaaaccttagggctatcccatccctaattactctttaaaagatctctttttaatt

SEQ ID NO: 28070 - DNA, 601 bp, Human
ttatccattttatgaacattagtaacattgtctgtccaatgagggacttgagttagattatctctaaagtccttcttggctctagaataccatggccttatacccctgcaggtatcacaattccctgtccgtcagaaaattcatcaagcctgaggaaaatggattctcaccaccaaccgcttcaccgccccaccccatcacctactgtttggcatatatataattgtgtattgataagggacattcagaaacaggtcatactgatcatgctttcagggttttaagaataaaatgggctggkttcagtggctcacacctgtaattccagtactttggaaggctgaggaaggaggatcgcttgaggccaggagttcaagaccagcctgggcaacacaatgagaccctgtctctacaaaaaatttctttttaagatttgaaatttttaaatttcaaatttcaccaggcatggtggctcactcctgtaatcccacctacttgggaggctgaggagggaggatcacttaaggcccaggagttcgaggctgtagtgagctatgactgtgtcactgcacttcagcctgggcaatggagcaagatcctg

SEQ ID NO: 28071 - DNA, 601 bp, Human
atccattttatgaacattagtaacattgtctgtccaatgagggacttgagttagattatctctaaagtccttcttggctctagaataccatggccttatacccctgcaggtatcacaattccctgtccgtcagaaaattcatcaagcctgaggaaaatggattctcaccaccaaccgcttcaccgccccaccccatcacctactgtttggcatatatataattgtgtattgataagggacattcagaaacaggtcatactgatcatgctttcagggttttaagaataaaatgggctggttwcagtggctcacacctgtaattccagtactttggaaggctgaggaaggaggatcgcttgaggccaggagttcaagaccagcctgggcaacacaatgagaccctgtctctacaaaaaatttctttttaagatttgaaatttttaaatttcaaatttcaccaggcatggtggctcactcctgtaatcccacctacttgggaggctgaggagggaggatcacttaaggcccaggagttcgaggctgtagtgagctatgactgtgtcactgcacttcagcctgggcaatggagcaagatcctgtc

SEQ ID NO: 28072 - DNA, 601 bp, Human
catgtgacacaagcagtgttctagtcacattcaggaggaccaggtatcaaaccgtgatggaaatataaaaacaaagtgacactaactaggttttcatcatttatggtataagaagtgcttgtagtccataaacctaattttaatgtgagaaaatcaaggtccagaaaaatgaagtgacagaggtagtaactcaaatttaggtcttctgttctctttctaacctcacatagagcattattgtactaccaatcctgcagtcacaaaatagtgctgaaaaagtttttatgaggttagatttcckttattttaggtaaaaagagactaaatagtagtgatttaaaaatattacttattgttgtaatgtatgctaacttccaatccaatgggttttcctgcacagatgaaaattttaaaaagaagctcaaagaaaaaagtaaggtttggtgcatttccatcagcctttacattcaccaaaaatactaccttggactgttctttgcatgtgttttaaaacatttctctcaccaaagatgtaaagttgcttcatcaataagccctccatttcttcagagtgtacacaatagagggtggataataaaac

SEQ ID NO: 28073 - DNA, 601 bp, Human
gagatgctcaaactgttagaggggcacccagcataacataacttcctcgtggggtcggggattcagaagacttcaaagaggacataatttgagcaaattctggggaagagcaagagttgttcatcaggaaaataaaggcttcttaggcaaagggtccatgaatcaaaacttgtctcgagaccaggtttgaaacagcgcagtgcatgctgggattgtgctggaacatgaagtgcaggtggagtaggggcgtggggctgaccacagagctaagtcagtgggcaggctacttcatacaccatgstcttgatttagggtcttagcttgtaaaccttaggcagtgacatgattacattgccattttagaaagctaactctggtagcagaatgggagagtgaagacagacaaacagttaagagtcagttaaaataggtgagaaatgaagagggcttgaagtaaggcaatagcagtgaagtgataaggtgggaagagcttttagagaaatttacgggttgacaagatttaagatctctggatttgaaaaacgagagaaaatttctggtttgggcaattgggtgaatggatgaatggatggttctctta

SEQ ID NO: 28074 - DNA, 601 bp, Human
taggatagtgtcactcacatgtccagtgattgacagcctagtttaggttggccccagctgggaggactagcctcttctccagatggtctcccatcctccagtagactaggctggacttcttcacgtagttcctcagggttccttagagccacaccacagggcagccacaaagggcaaatgttattcaagcctttgcttgaataacatttgctgatatctctttggccaaagccagccacatggccaggcccagaatgagaatgggaggcgctagggaggccattttcataacacagttgarcacatgggaaaagcaaagagggtcatggacagaacctggaagctctagcattttatagtccaagaagataatgggggttatggaagttcaacagctatctggtcaaaggattgagaaataaaaatcgaagaaaagaaagagtggatggataagtgaaaggagaaggaaagagtggggtcagtcaagtgccatatggaggtcaaattagaaaaaggttggggccgggcatggtggctcacgcctgtaatcccagcacttcaggaggccaaggtggacagattacttgagcccaggatttca

SEQ ID NO: 28075 - DNA, 601 bp, Human
cctggatcatacccattgtcccaaattaggtagctaattcgttaattgaacaattaggcaactgtactctgccagaaagtgtccagcctgaggagtgagtgtactgtagagtcattggtcggggagtgcctctctaaggagttgatgagatagcattccagagagagaaaaacgacagtatatgcagagagcctagggggaaaagaatatggcatgcttaagaagaagaacaccagtgcaactgcaaggtggtgggcagtggggagaggggatgagatgagaccataatgatgagcaaccwctggtagcgcaaggggtggagttaagctcttgctcaagtgcagagggactcactgaagggttttaaaagtcagcagtggtcaggcgtggtggcctacggctgtaatcccagcactttgggaggccaaggtgggtggatcacccaaggtcaggagttagagaccagcctgaccaacatggtgataccacgtctctactaaatacaaaaaaattagctgggcatgggggcaggcacctgtagtcccagctactcaggaggctgaggcaggagaatcgcctgaacccgggaagcggaggttgc

SEQ ID NO: 28076 - DNA, 601 bp, Human
ggaggaaatcaagaaagacgtttccaactaaagcaactgggtagatgatggttccattgactgatatggggaagcctagagaaggaacattgggctgggtaagggggattgagttcagctttgaacatggtgagttcagaaaaaccctgtaagacaggtacataaagagagttgtgcattttgttgtgtttattattattttatctgcagatgggccaattggccatcctcaaatgtggaggaaatttgaaagtgctcttgttttttagcaatgcataaatagagttatttgctcgcaacrtaagcactggatataaacaattcttttggaaggtccccatgaaacactcagattttgaagttttaattttgatgagttcacagagaaggaaaatcctgctttggatcaggatttttgaaaaaaaaaattttgtacacaaggtctggcataatcgattttataaatatctgagtgagcaaatgaacctctaataatcagtgttgactagcaattctcatcactcagcattttccatgccttcagaagaagagtctctatcctatggaatattgcaaatttgtaagtgattaatttttacat

SEQ ID NO: 28077 - DNA, 601 bp, Human
ttttatattcgttataattgggattcttatcttcttgtaaaagtgaaatataaatcaaaagctgctgttgtcttctctttgttttatcttttcctaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagaggtattaatagactttcagtatttcctttatgttgaagagactgtgttaytgaaaagttaaaacactgctcataacatgaaaaacatgggttcctttctcagttccatcaccaactcaagtgaggttatataaataaattgactttggccacttctgatggtgactctgaaagataattgaataaaattttcttctgacttctttagacttggaagaagcaactggagaggagtaaacagttatacactccttactttgcatcaaactggcaggaaaatctgtttgctgtctattgtacaccacaccgaaactttgtggcttcaatgacagcatttcttttgctgatgac

SEQ ID NO: 28078 - DNA, 601 bp, Human
cctttatgttgaagagactgtgttattgaaaagttaaaacactgctcataacatgaaaaacatgggttcctttctcagttccatcaccaactcaagtgaggttatataaataaattgactttggccacttctgatggtgactctgaaagataattgaataaaattttcttctgacttctttagacttggaagaagcaactggagaggagtaaacagttatacactccttactttgcatcaaactggcaggaaaatctgtttgctgtctattgtacaccacaccgaaactttgtggcttcartgacagcatttcttttgctgatgactctgcactttagcagggttcagcatgagcatctcgtctctgctctacttggcatcagctggagtggcgtgaaggcctgggcctgagtcatctgaaggctaactcactcatatgtctggtggttgaggctggcctttggctgggacctcagctgaggccccatttagaacaactacatgtgaccgcttggcttcctcacaatcctaagggtgagcattccaagaggcccgggcaactttgcatcgcctgttatgatttatctcagaaatcacatgg

SEQ ID NO: 28079 - DNA, 601 bp, Human
tgtaatactttaaacatttagaatttcatacgaatcatgttataattcactgcattacagaagaacacatccacagctatcttcaccataagcctatctctagctaagtttccctgtaaggctgcagtgggacatcccattatttttagagcctttcatcatttttcagaggttcaatgagaccgcactactgtaatcttcctaaggtatttttttttctatttttatttgattctagtctagtccatcctgaggtcttagcaaagggttttacagccacatccttggctcacctgaagaycatgttttcctgatagcccttgtgcttgatctttgccctgaaaccatttcttaattttagtgtaatttttttttgtctagaaagaccgggaatgggaaatagtttcattgtttaaacaatcttggcttccttattttagcagttccttttttggtcatttctcttctcacattttactataggtagtgagaagaaaccaagtggcatttttacttttatatctgttgctgataattacacaataagaagatgaaatttgaatggaatgaaaatgaattcaagaagaaaacattgaaaatt

SEQ ID NO: 28080 - DNA, 601 bp, Human
gattgatagttaaataatctgctactttataataattcgacttcacattttataaccttttattgtgttaaaggatgagaccaccactgaataacataaacaaaaatcacaaagctgaatgtattgcttacttaagtaagtgagtgttcccggtccagtacattctcttctagctgatcatatgtagggtttttgagatggttggagctcaagggttggtggactttctgaggcaagtgagagtcgacatccactgtagatgtgtggttactaaggtgagactgttgctgactggttggcrtgtagaagggtgttcactggtgtgagtctttatcaggcagctttcagaggtgaagaactgtcactggttgactggcaggagttcattgtggcaaactttgttcatttttttttttactgaaatatttttcatttattcatttatgatgtggcctgcaatctaactgctctacagttgtaaaaaattattgaaaaccgaagtattaaaattatttcacagactccttccttaggatgcacaaagcatttgtttgagaaaatgtgttatgcattttatatgttgctgtaatattattattat

SEQ ID NO: 28081 - DNA, 601 bp, Human
gttggcgtgtagaagggtgttcactggtgtgagtctttatcaggcagctttcagaggtgaagaactgtcactggttgactggcaggagttcattgtggcaaactttgttcatttttttttttactgaaatatttttcatttattcatttatgatgtggcctgcaatctaactgctctacagttgtaaaaaattattgaaaaccgaagtattaaaattatttcacagactccttccttaggatgcacaaagcatttgtttgagaaaatgtgttatgcattttatatgttgctgtaatattaktattatcattaagcaaagtgttttaagtggtagccacaaagtccattgtaattggttttaattacacttttcatcaattatgttaattgaaattagtcaactagtacacacatagaataataattaactggcttgaccaatgttccatataagattagtagtagaaattaaagtaaaaatggagcttttcgctgggcacagtggctcatgcctgtaatcccactttgggaggctgaggcaggaggactgctcgagcacagagttccagattagcctgggcaacatagggaaaccgtgttt

SEQ ID NO: 28082 - DNA, 601 bp, Human
catcccttcattattgccagcaactgtaagcatggaaacttctgaaaaatcaaagttgactcctaagccagagacttcatttgaagaaaagtatgtcatttattaacagtgcaatataaatgttcaaaaaagtagatcagccaaagacaaggatgtattgcatttatttacagacacaatttttacctagagaagcaagaaactgcaagatgtccactgggggatctgtaatcagttctgtattatggaaataaaaggtgtgaagcaggaaataataagagatcaggctggggaggtaggkttgtcaggttagaaagagattttaaggaacttggccaagtgtggtggctcacgcctgtaatctcagcactttggaaggccaaggtgggcagatcacttgaggccaggagtttgagaccagcctggccaacatggcgaaatcccgtctttactgaaaatacaaaaattagctgagtatggtggcacacgcctgtaatcccagctactcagaggctgaggcacaggaatcacataagcccaggaagcggaggctgaagtgagccgagatcacatcactctactccagcctgggtgacagagc

SEQ ID NO: 28083 - DNA, 601 bp, Human
agaccagaaactataaaactgctagatgaaaacataggggaaacacttcatgacattgatctaggcaaagcatctttgtataaatactaaaataatatactgtgttacagctggctctaattgcccattcaaagaaccaaaaagctcaaaataaagttgctcactgtgccttcattttcttattctttgaggagaatatttaaaataactggaatagaatctccttatactgctggtatagaagtttgaactaatgcctgctttgtagaataattaatattatattaggcttctattgacraagttataatataagaatatgaactgtattatagctaaatccgtgacataattgttagaaaagtcagaaatctgctgctattattctggttatgtaatgtctccatgtcttttgaggaatgaggcaaacaaaatttaagaatttttgtatcctaaatatttaaagccctagacatatcgattctagattagtgatgaacatgttttccttgttgcttttgttgttgtttcttaagtagctttcagaattgattttttttcaacttctgataaggcatttgacattggtgatcaatgtatt

SEQ ID NO: 28084 - DNA, 601 bp, Human
aacaggcacttactttatgtcaaaagaaaaattaggcatatccagttcattcttctctcagtgcctaggatttaatagattggaatacatttcaaaaataaagaattgcttgaactgggtaactgatttgatgtaaatgccaaaggagaaggagtaaaaggaaaatgacatagagtctgagctagagtaacagggacagtattaattaatattaaccaaatatcaaataagaacatttaagagacgaggccaggcgtggtggctcacgcctgtaatctcagcactttgggaggccgaggtrggtggatcacgaggtcaggagttcaagaccagcctggccaagatggtgaaaccctgtctctactaaaaatacaaaaattagccaggtgtggtggcgggtgcctgtaatcccagctacctgggacactgaggcagagaattgcttgaacccagtaggcggaggttgcagtaagccgagatcatgtcactgcactccagcctgggaaacagagtgagactctgtctcaaaaaaaaaaaaaaaacatttaagagagaaaaagactctcggggaaattggatgagtttgtgaagtcccagatgt

SEQ ID NO: 28085 - DNA, 601 bp, Human
gctctgacactcttaaccaaagtttagggctggcttagaactactacattgactcactgtgcataagagggtggggttggcaaacataaagtacaagacattgataccaaatcttttaacagtataatagactgactagaaaccctttacatatagcccctcccatacaggtggaacactggacataggttacatcaaggaggaaactctctttggccttcttcaaataccaaacagtttcatttgccatatgttgtctttgaacacagtagagctccttgtactatttaaaaaaaaccattcatcttcccctccgcaccctgcccccaccccggaacaagaacactatttgtgtatctaagtaaaagaaaacaggaattttgctttgattgtttcctacactcagtgacaacatattgccctcttctcattggttaccatatggaaagaaaccataattctgctaaagttagttcaaattagacttaagtttctttcagtccaactgagtttcctgtttgggaatccaatcttcaaacaacattggttaaaactgatacagtgacttgtgtttgtccaatttggtctttttctgtagcac

SEQ ID NO: 28086 - DNA, 601 bp, Human
aaggatgcagattgtatttctgcatgttaatgttgcttaaggaggtggctcccacagacagcaccctagagaggcagagcactgatattgggatgcctgaagcctggatttcaggaccagctctatcactcactaacttgggagaaatggagaaaagatatgtaaattaaagatcaaagtccatattgtgtctacctcaccgggctgttgagaggatcattggagataacctaagagaaagctttgcaaattataaagcacaatacaaacatgtatgatttgtggtgacttttgacaagcttttttttttttctttaaacaggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaaggttggttcaggctcatacggtttaataattgcttggcgcaaaggcaacgttttgtcggttacctggttattctgttttctggggtttact

SEQ ID NO: 28087 - DNA, 601 bp, Human
gcattgggtttttatgatgtccagttttttcttgaagctctcaccactgtgttaagtctctgccttttttatctcgttttcccgctcctgccttgagtccttgccttctccctgcctagttcccaacccaggcttgtgggaccctcccttaactatagttggtgcgcatgcgtgggccgggtgttggctgcacttccacctaaaggctgcattgctcattcccgccgccccaggaaggttgtataccagtcaaatctatacgtactgtacctgcgtttctcttaggaattctcctttaccytcttcccctctttatcagcatgcagctagctacattctggcaggtgatctgcagagtgagtgattactgggcgtcttaaggggcgttcctttctgcataggtatttcccctcctctctgctcaaatggagcatgcatgttttgggtggtttctggggtgcgagattttccagacctctcttttctcaggggcttcccctcatgtctagctatctgcccactctaacaagttgaaggaacagttgacccttgaagaacatgagtttgaattacacaggtccactcctactcggattttttt

SEQ ID NO: 28088 - DNA, 601 bp, Human
tctcgttttcccgctcctgccttgagtccttgccttctccctgcctagttcccaacccaggcttgtgggaccctcccttaactatagttggtgcgcatgcgtgggccgggtgttggctgcacttccacctaaaggctgcattgctcattcccgccgccccaggaaggttgtataccagtcaaatctatacgtactgtacctgcgtttctcttaggaattctcctttaccttcttcccctctttatcagcatgcagctagctacattctggcaggtgatctgcagagtgagtgattactggrcgtcttaaggggcgttcctttctgcataggtatttcccctcctctctgctcaaatggagcatgcatgttttgggtggtttctggggtgcgagattttccagacctctcttttctcaggggcttcccctcatgtctagctatctgcccactctaacaagttgaaggaacagttgacccttgaagaacatgagtttgaattacacaggtccactcctactcggatttttttttttcaagcaaatgtggagggatgcaaaccccacatatagggaggcccaactttttaggtacacgggtact

SEQ ID NO: 28089 - DNA, 601 bp, Human
ctgcgtttctcttaggaattctcctttaccttcttcccctctttatcagcatgcagctagctacattctggcaggtgatctgcagagtgagtgattactgggcgtcttaaggggcgttcctttctgcataggtatttcccctcctctctgctcaaatggagcatgcatgttttgggtggtttctggggtgcgagattttccagacctctcttttctcaggggcttcccctcatgtctagctatctgcccactctaacaagttgaaggaacagttgacccttgaagaacatgagtttgaatwacacaggtccactcctactcggatttttttttttcaagcaaatgtggagggatgcaaaccccacatatagggaggcccaactttttaggtacacgggtactgctggacttgagtatgtacggattttggtatacatgggggtcttggaactaatgctctgtgtatactgagggacaactgagtatatatcttttaaaagtataataattaagagaatgcacccagatagctcagtcagtagagcatcagacttttaatctgagggtccaaggttcatgtccctttttgggtgttccctct

SEQ ID NO: 28090 - DNA, 601 bp, Human
ataaatgtcttttataacaaccccaaaggaccacatgtctcttggagaatgtgtagctctgagctcttggctctcagtgtgactccctgtctccttgttttccagcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttcyaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaat

SEQ ID NO: 28091 - DNA, 601 bp, Human
tctgcgcccagtaccgtgggtaaggcgaggccggccggctaaccccgggctggcggccttgcagcgtgcgtggcaacagcagctgggcccgcaagactcagcacgggacgtcctcgtccaagtctgggccaagagcagcggcccagggggcggggccggccagagggagcggggagaggctgaggggcggtgccagcgccggaccctgccattggctggagattacaggaggcggggacatagcagggaggagccgctggacaagccccacccggccgccagggagggtctgaggtcaagmgccggagagaagggatttagggccctgggccaagttgcacagcagggagaaggggctgcgcagaggggcggggagaaagggatccgcttccttcctttagagctgtgaaatgtccccggttggaattaaaggcggctgctggggagaggtgaaattcagccaaaaccacccagtcaggcagcccttctcagagataaacagtccgagccagcccggccaggaaccttcccctccaacctccctaagcctttaacactcctaagcctttaacgcgtttacacactcacataaataaacaca

SEQ ID NO: 28092 - DNA, 601 bp, Human
cattgggatgatgacagagaaaggagagcggagaagtcagacccgtgggtcagcactagctgctgctcactcggccccacccggttcttgtgtcaagacaaaaagaaaacccaggtggcctcataccttgattcctgggaacgtaatggcagaagaggcgtaagagccaatcatgagggccattaacgtggagcgcaggttcccaaacatgttgggcagctgaggagggaaagcagcacccatgaggtggggacaccgtgacccttgcccagcattcccagccctgctccatacaatagcyccaggagacgcagcagaaaagccccaaggtaaaacaaacagaaaaatcaatgtgggaaactgtactctgccccctgcctacacagtcacagtgccctttagcttcaaaaaggctcccagacacccctcagagagacattttgttaattttgtttaattccaggtttcccaagtttgttacgtaacacctctgaaaaacacatggaataggtgcttaagaaacactgatcttggctgggcgcagtggctcatgcctgtaatcccagcactttgggaagccgaagctggtgggaagcttgag

SEQ ID NO: 28093 - DNA, 601 bp, Human
cctggccaacatggtgaaaccccgtctccactaaaaaatacaaaaattagctgggtgtggtggcgcgtgcctgtaatcccagctattcaggaggcagaggttgcagttcactgaaatcatgccactgcactccagcctgggcgacagaatgagactctgtctcaaaaataaataaataaataaataaatatttaccatgttttgaccacctgttatgtgccaactgtattacttaaaaacacccatgggaggctgggcacagtggctcacgcctgtaatcggacactttggaagggcaagsggggaggatcccttaaggccaggagttcaaaaccagcctaggtaacacagtaagccctgtctctacaaaaaataaaaaaattaactgggcatggtggtgtgtgcctgtaaccccagctcctcgggaggcagagggagaggttcgcttgagcccagcagttttaggttgcagtgagccaggaccaagacactacactccagcctgagtgacagagcaagacactgcctctaaacaaacaaacaaacaaaagcgacctgtgggtaggtaggaacaggctcatagtacagatgagaaagcaga

SEQ ID NO: 28094 - DNA, 601 bp, Human
ggctcacgcctgcaatcccagcactttgggaggctgagccaggcggatcacttgaggccaggagttcaagaccagcctggccaacatggtgaaaccccgtctccactaaaaaatacaaaaattagctgggtgtggtggcgcgtgcctgtaatcccagctattcaggaggcagaggttgcagttcactgaaatcatgccactgcactccagcctgggcgacagaatgagactctgtctcaaaaataaataaataaataaataaatatttaccatgttttgaccacctgttatgtgccaactrtattacttaaaaacacccatgggaggctgggcacagtggctcacgcctgtaatcggacactttggaagggcaagcggggaggatcccttaaggccaggagttcaaaaccagcctaggtaacacagtaagccctgtctctacaaaaaataaaaaaattaactgggcatggtggtgtgtgcctgtaaccccagctcctcgggaggcagagggagaggttcgcttgagcccagcagttttaggttgcagtgagccaggaccaagacactacactccagcctgagtgacagagcaagacactgc

SEQ ID NO: 28095 - DNA, 601 bp, Human
gcaacctcagcctctagggttcaagtgattctcctgcctcagcctcctgactagctgggattacaggcatgcaccaccacacccagctaattttgtatttttagtagagacggtgtttctccatgttggtcaggctggtctagaactcccgacctcaggcgatccaccctcttcggcctcccaaagtgctgggattataggcatgacccactgcgcctggcccattacttttaatggcaaaaaccacaattacttttgcacccacataaatagttaccatgagctgagcatggtggctcasgcctgcaatcccagcactttgggaggctgagccaggcggatcacttgaggccaggagttcaagaccagcctggccaacatggtgaaaccccgtctccactaaaaaatacaaaaattagctgggtgtggtggcgcgtgcctgtaatcccagctattcaggaggcagaggttgcagttcactgaaatcatgccactgcactccagcctgggcgacagaatgagactctgtctcaaaaataaataaataaataaataaatatttaccatgttttgaccacctgttatgtgccaactgtattac

SEQ ID NO: 28096 - DNA, 601 bp, Human
ggcacgatctcggctcaccgcaacctcagcctctagggttcaagtgattctcctgcctcagcctcctgactagctgggattacaggcatgcaccaccacacccagctaattttgtatttttagtagagacggtgtttctccatgttggtcaggctggtctagaactcccgacctcaggcgatccaccctcttcggcctcccaaagtgctgggattataggcatgacccactgcgcctggcccattacttttaatggcaaaaaccacaattacttttgcacccacataaatagttaccatgrgctgagcatggtggctcacgcctgcaatcccagcactttgggaggctgagccaggcggatcacttgaggccaggagttcaagaccagcctggccaacatggtgaaaccccgtctccactaaaaaatacaaaaattagctgggtgtggtggcgcgtgcctgtaatcccagctattcaggaggcagaggttgcagttcactgaaatcatgccactgcactccagcctgggcgacagaatgagactctgtctcaaaaataaataaataaataaataaatatttaccatgttttgaccacctgt

SEQ ID NO: 28097 - DNA, 601 bp, Human
cccagctcatgcagttcttggggggagtgacactaactatgtgactttggagagagactggtttcttcaaagacgggaaagttcagattcacttgcctccaggctcttgctcagctcagaacatttttggatgtatgtcctatgcttcgtgtggtaaaaataactcagttaggtgccatggctcacgcctgtaatcccaacactttgaaaggcagaggtaggaggatcacttgagcccaggagttcaagacctggtggtcaacatagcaagaccctatctctaaaaatatatatatatatwtatttatttatttatatacagaaattatatatatatttatatatataaatatacatatatataaaaatatatatatatgaaataagccaggcatggtggtgcacacctgtattcccagctactcaggaggctgaggcaggaggattgcttgagcccaggagttcaagaccagcctggtggtcaacatagcaagaccctatctctaaaaaatatatatatatataaaatataatataaatatatatataatttatatataaaaaataatataatatataatataatatataataatataat

SEQ ID NO: 28098 - DNA, 601 bp, Human
aggctcttgcgtaaggggacagaccctggggagacagcagggggcgcccctgagccccagaccttccactgccctctgattgtcccagctcatgcagttcttggggggagtgacactaactatgtgactttggagagagactggtttcttcaaagacgggaaagttcagattcacttgcctccaggctcttgctcagctcagaacatttttggatgtatgtcctatgcttcgtgtggtaaaaataactcagttaggtgccatggctcacgcctgtaatcccaacactttgaaaggcagaggtaggaggatcacttgagcccaggagttcaagacctggtggtcaacatagcaagaccctatctctaaaaatatatatatatatatatttatttatttatatacagaaattatatatatatttatatatataaatatacatatatataaaaatatatatatatgaaataagccaggcatggtggtgcacacctgtattcccagctactcaggaggctgaggcaggaggattgcttgagcccaggagttcaagaccagcctggtggtcaacatagcaagaccctatctctaaaaaatatatat

SEQ ID NO: 28099 - DNA, 601 bp, Human
acaaggcaaggtgccaagtgcacagtcagcactctgcattagctattcttattattaagcaagccaggtcccttcctagcctcagtttcctcatctgtaaaatggggaggtacccctgatctcctagggttcttgggagaaagcaacaagctgctggatgtaaacgcacagagaaaatgaaaagcactgcctgaccacttgctgtcaccatccctgtacaggcaggtcacctggcatctccgaggacagtgccctgagttggggcgtccacgcagtccttgatccgccagtccatgatgtagccaatgagggggcaggtgagaaggcacaacagctgcatggccccgaagacggaggagtagaacccaactgggcaggatgggaagggcagtggggtcaggaactggcactcagtggacactatcaccccttccagcggaggccagagagcaccaaaatagccttcctctgaacccagactcttacatcccacaaaagggttacctgggtgggcccaggcctagaggagtcccgccccctgagaagcgggttgcagtggggtgggcgtgagccagggccctgctttcatagccctacctgt

SEQ ID NO: 28100 - DNA, 601 bp, Human
cagcaggataggctgcctttaaggaagtgagctccctgccatcagagggtctcagagagaggtgcattaggggatgcctggggccctcccaacccttccctggggttctctgatcacggttgcaaagctcaggaaggcatttcagcccaacagactcacactgcagcatagagactcccacaggctgagtggaagaaacctcgaacaatggtgtgcaggacaaaggtcacaaactaaaaccaaaaagagagagtgaagaggttaggagagtgtgtggaggctggaggaaggaggggtaggrcgaagaggccaactgggcctcaattcccaccccctcgccaacccaatctactagaaacacttcctggagaacccggaaaatagatccagatcagaagaccagaactgcgcttcctggaaggcaggtgctggatggaccatccctttggaggagcctcgggaggcagggagaggggaaggatgaaggtgggtacctggaggtgtaagttgttgatgagacaggtgatgccaaaacccacaagcagcaggttggtcagggtgaaggcactgatggcattggtgagcttttggatcttgcagt

SEQ ID NO: 28101 - DNA, 601 bp, Human
ggtagccatcacctgtggttgcagctactcagaaggctggggccggaggatcgcttgagcccaggaatcagaggctgcagtgagctgtgattttaccactgcactccagactgggcaacagaacaagacaccttctctacaaaaaaaaaaaaacaatagggccgggcgcggtggctaaggcatgtaatcccagcactttgggaggctgaggagggcagatcacgaggtcgggagatcgaggccatcctggctagcatggtgaaaccccgtctctactaaaaatccaaaaaaaaaaaaaaaattagctgggcgtggtggtgggcgcctgtggtcccagctacttgagaggctgaggcaggagaatggcatgaacccgggaggcggagcttgcagtgagccgagatcgcaccactgcactccagcctgggcaacagaatgagactccgtctcaaaaaataaaaataaaaataaataaataaataaaataacaataaattaaaaacaaaaacagactcctacggtcaggctgagatatcctgattcaggggactggggaatctgtatttttaacactccgtgaggggttctaaaaggcagacaa

SEQ ID NO: 28102 - DNA, 601 bp, Human
tgtttatctgtacaaaatttttttttaaaaaattagccaggtatggtagccatcacctgtggttgcagctactcagaaggctggggccggaggatcgcttgagcccaggaatcagaggctgcagtgagctgtgattttaccactgcactccagactgggcaacagaacaagacaccttctctacaaaaaaaaaaaaacaatagggccgggcgcggtggctaaggcatgtaatcccagcactttgggaggctgaggagggcagatcacgaggtcgggagatcgaggccatcctggctagcayggtgaaaccccgtctctactaaaaatccaaaaaaaaaaaaaaaattagctgggcgtggtggtgggcgcctgtggtcccagctacttgagaggctgaggcaggagaatggcatgaacccgggaggcggagcttgcagtgagccgagatcgcaccactgcactccagcctgggcaacagaatgagactccgtctcaaaaaataaaaataaaaataaataaataaataaaataacaataaattaaaaacaaaaacagactcctacggtcaggctgagatatcctgattcaggggactggggaa

SEQ ID NO: 28103 - DNA, 601 bp, Human
gccacttcacaaagcacctggagtttactaaaaacagactcctaggaggtcaggcactgtggctcacgcctgtaaccccagcactctgggaggccaaggtgagaagatcatttgaggccaggagtttaagactagcctgtgcaacatggcaagaccctgtttatctgtacaaaatttttttttaaaaaattagccaggtatggtagccatcacctgtggttgcagctactcagaaggctggggccggaggatcgcttgagcccaggaatcagaggctgcagtgagctgtgattttaccacygcactccagactgggcaacagaacaagacaccttctctacaaaaaaaaaaaaacaatagggccgggcgcggtggctaaggcatgtaatcccagcactttgggaggctgaggagggcagatcacgaggtcgggagatcgaggccatcctggctagcatggtgaaaccccgtctctactaaaaatccaaaaaaaaaaaaaaaattagctgggcgtggtggtgggcgcctgtggtcccagctacttgagaggctgaggcaggagaatggcatgaacccgggaggcggagcttgcagtgagccg

SEQ ID NO: 28104 - DNA, 601 bp, Human
tcctctaagacttgcaagcagcagcaccagagagggaacctgccctcctggccctggaaggggccgacccccaacccctaacccaggacacagctggcacctcaggcccctttccttctgaaaggagggctgtgtctctctcacattcacacatacacagacacatgcatgtgtgcacactcatggcacatgggacctcaggggtagcctgtttgccgatccccccaagaggtaccaggaggcagaccgctagaaggagataagaggcaccctggtctcctccaacccaaggaggaagaargctcaacccctctaggatagggactgtcttcagtcaatggagcgttgacttagggggcgtttttgaaggttttttttcctcctttttgcagtctttacaaaaatagaacttctcttggtatttataaatctacggccatggctctatgtgcatgttacaggtagaaaagccatatggggcactccttttggttgctcaggccttgattgcctgtcatccaggtcccttggtctgagaagtctatgcggtcacctcagagccgctaagcaccttcagtgggcccatcccattggcggcgta

SEQ ID NO: 28105 - DNA, 601 bp, Human
tattttagtagagacagggtttcactgtgttgcccaggctggtctcaaactcctgagctcgggcaatccacccacctcagcctcccaaagtgcatggcttacaggtgtgagccactgcacccggccttaaatggtaatctttaaataacaattagtagagcattacaatgctctttttttttgagagttgggggtcttactctgttgcccaggctggagtgcaacagagtgctctctacagcctcgaactcctggtatcatgtgattcttcagcctcagcctcctgagttgctgggattayaggcatgagccaccatgcccagcttaaaatggtttactttaactactaattctcaaaaatgactttttaaaaaactgcattcaattacagtagcattctagttaccttgaaatatccccccagtaccattctgcatcctgaagagaaacagaactgtccttcattccatttggaactgctgaagtcattggcttaggtggctttggtggaagagctagaagagaaatgaatattactctgtagatgtaaattatttactgttttctaatttcctcaggagcagctcactaaccaaggtat

SEQ ID NO: 28106 - DNA, 601 bp, Human
acacatgctacaacatgaatgaaccttgaagacgtatgaagaaagtgaaataagccagtcacaaaagtacaattattatatgattacacttatgcaaagtacctacaattgaattcataagacagaaagcagaatggtggttgccatgagctgagggaggggagaatggggggttattgtttaatgggtacagaatttctgttagggaaaatgaaaaagttctggagatggatggtgatgatagctgcacaacaatgcaaatgtactcttaaaatagttgaaattgtaagggtaaaaaaaattaaataaataccattttggtagaggaagagaacagagaagagaaagggataggtaagtgttctgaggaatacagcatcaacctggaaactgatttgacagaaatggatagggctttaaaaagaaaatacatctgagacccactaaagcaagtttaacaagaaaaaaatttagtaagaaaatacaatattcaaattaaatgtatataattccctctttaggttcaaaattacctaaaactacactttacccagaaaacaaatctgtcctagagtcctgtttatcaaactggggtgtgtaa

SEQ ID NO: 28107 - DNA, 601 bp, Human
aaggaatgaaattctgacacatgctacaacatgaatgaaccttgaagacgtatgaagaaagtgaaataagccagtcacaaaagtacaattattatatgattacacttatgcaaagtacctacaattgaattcataagacagaaagcagaatggtggttgccatgagctgagggaggggagaatggggggttattgtttaatgggtacagaatttctgttagggaaaatgaaaaagttctggagatggatggtgatgatagctgcacaacaatgcaaatgtactcttaaaatagttgaaatygtaagggtaaaaaaaattaaataaataccattttggtagaggaagagaacagagaagagaaagggataggtaagtgttctgaggaatacagcatcaacctggaaactgatttgacagaaatggatagggctttaaaaagaaaatacatctgagacccactaaagcaagtttaacaagaaaaaaatttagtaagaaaatacaatattcaaattaaatgtatataattccctctttaggttcaaaattacctaaaactacactttacccagaaaacaaatctgtcctagagtcctgtttatc

SEQ ID NO: 28108 - DNA, 601 bp, Human
aaatggctgggtgcagtggctcacgcctataatcccagcactttaggaggctgaagcagagaggtcacttgaggtcacgggttcgagaccaacctggccaacatgatgaaaccctgtctctactaaaaatacaaaattagccggacgtggtggcagggcaagcgcctgtaatcccagctacttgggaggctgagacaggggaatcacttgaacctgggaggcggaggttgcagtgggctgagactgcaccactgcacgccagcctgggggactgaacgagactctatctcaaaaaaaaaawttttttaataaaacatattaagtcctcttcaaaaagttaaacacagaattacctaccatatgacctggcaattccattccactactgggtatatacccaaaataactgaaagcagggactcagatatgtgtgcaccaatattaattgcagcattatttacaacagccataaattagaaacaatctaaatgtccagatgaatggattaaaaaaatatataacatatacatatattagccttaagaaggaatgaaattctgacacatgctacaacatgaatgaaccttgaagacgtatgaag

SEQ ID NO: 28109 - DNA, 601 bp, Human
aaagcattcttattccaaaactctcttcaaatcacagataagcttcttaaagagttgtttatggctgggcaccggtggcttacgcctgtaatcccaacactttgggaggctgagtcgggtcgatcacttcaagtcaggggttcaagaccagcctgaccaacatggcgaaatcccatctctactaaaaatacaaaaattagccagatatggtggtggatgcctgtaatcccagctactcaggaggctgaggcaagagaatcacttgaatctgggagatggaggtcacagtgagccgagatcrtgccactacactccagcctgggcaatagagtgagactctgtctcaaaaaaataagtaagtaaaataaaaaataaaaataaaaaaagagctggccaggcacggtggctcacgcctgtaatcccagcactttgggaggccgagatgggcggatcacctgaggtcaggagtttgataccagcctggccaacatgatgaacccctgtctctactaaaaatacaacaatttgccgggcatggtggtgcacgcctgtaatcccagctattcgggaggctgaggcaggagaattgcttgaacccggg

SEQ ID NO: 28110 - DNA, 601 bp, Human
ttagaaaggcaataaatatgcataagggtctagaaaaactgctgtcctgaatgtttacaattctagaagttttgatgtttatgggataattcctacattatctagcacttactaggctggggtgtttggttttggttttggctttggtttcggtttcggtttcagttttggttggtgggtgggtgggtggattggtttttttaaaactgttgcctaagctggacttgaaatcctgggcttaagggatcattccacctcagcttcccaactagttgagactttaggagggcaccacacaccyagcttaagcatttgtcactttcggcaattgattactgagaatccactatacagaaattaccatctggtgatagagatttgtgaaacgtgaagtctgccctccaggactcagaatatacaggtggaacagatttctgaactctaataaggtttggtttcatgtcatggaagaggcaaccagttatttattaactagttatttattgctttacagagacttcacagaggaggtgacacttaagctaggtcttaaagaactgagatagaggaagaaaatacagcactgcacaaaggaggcatg

SEQ ID NO: 28111 - DNA, 601 bp, Human
attttgttcagtttgctttttagaaaggcaataaatatgcataagggtctagaaaaactgctgtcctgaatgtttacaattctagaagttttgatgtttatgggataattcctacattatctagcacttactaggctggggtgtttggttttggttttggctttggtttcggtttcggtttcagttttggttggtgggtgggtgggtggattggtttttttaaaactgttgcctaagctggacttgaaatcctgggcttaagggatcattccacctcagcttcccaactagttgagacttyaggagggcaccacacacccagcttaagcatttgtcactttcggcaattgattactgagaatccactatacagaaattaccatctggtgatagagatttgtgaaacgtgaagtctgccctccaggactcagaatatacaggtggaacagatttctgaactctaataaggtttggtttcatgtcatggaagaggcaaccagttatttattaactagttatttattgctttacagagacttcacagaggaggtgacacttaagctaggtcttaaagaactgagatagaggaagaaaatacagc

SEQ ID NO: 28112 - DNA, 601 bp, Human
ctatttctctagtccaggccctcattatcgtttaacctgatgaccacaactgttgcagtcatgtgcaagtcaggctggtgttcctgcctacagtcttgttctactacaatttattctcagactgctgccaaagttgatattcaattcaaaaaaatattcgatgagcacccattatgtactcccatacataagtaggtactagggctaccagggaaaataagccaccatgcctactctcaatgagtttacagttgagtgggcgtggcattcagtaaatgttacactagggatcaggaccagrcactgtagggacccaaaatacagcccctaaattggtctccggaatcagggaacagtttctagaaaagatgatatctaacctgaagtcctaacggataagcaggagtttatccgtttgggagaatgaacaaagagcagaggagagaggaagttcaatttggtgccattagtggaaacagcaagtggttccaatagtagggctgtgcagtttgagggggtaaaagaaaacaagacagaaattattggggaagaaaagaaatcctgtctcactgatgcccttggaggtactaagtagacttac

SEQ ID NO: 28113 - DNA, 601 bp, Human
acttcttattttggtgaaaaacaccatcttccagtctctcacaccagaaatctaggaataatctttgacttctcccacacctaccatatctggtcaggcatgaagtccttagcattcccatgacctcccgcttcttttctgctatttctctagtccaggccctcattatcgtttaacctgatgaccacaactgttgcagtcatgtgcaagtcaggctggtgttcctgcctacagtcttgttctactacaatttattctcagactgctgccaaagttgatattcaattcaaaaaaatattcratgagcacccattatgtactcccatacataagtaggtactagggctaccagggaaaataagccaccatgcctactctcaatgagtttacagttgagtgggcgtggcattcagtaaatgttacactagggatcaggaccaggcactgtagggacccaaaatacagcccctaaattggtctccggaatcagggaacagtttctagaaaagatgatatctaacctgaagtcctaacggataagcaggagtttatccgtttgggagaatgaacaaagagcagaggagagaggaagttcaatttg

SEQ ID NO: 28114 - DNA, 601 bp, Human
gcaaaaccctacctcaaaaaataaaaaaaattaaaaataggctgggcgcggtggctcatgcctgtaatcccagcactttgggaggccaaggcgggcagatcacctggggtcaggagctcaggaccagcctggccaacttgatgaaaccctatctctactaaaaatacaaaaatcagccgggtgtggtggcatgcacctataatcccagctacttgggaggctgaggcaggataatcacttgaacccaggaggcggagggtgcagtgagccgaaatcgcaccactgcactccagcgtgggcracagagcgagactccgtctcaaaaataaataaataaaacaaaacgttatcatgctactttacttccctctgcaacaaaactacaaatccttttctgtttcttcatcgttaataataattataattaggccaggcgcagtagctcaagcctgtaatcccagcactttgggaggccaaggcaggtggatcacctgaggtcagcagttcaaggccagcctggccaatttggcaaaaccccatctctactaaaaagtaccaaaaattagccgggcatggtggggggtgcctgtaatcccagcga

SEQ ID NO: 28115 - DNA, 601 bp, Human
aggcttataggcagaagagacttgccttgtctcagatgagactttggactgtggacttttgagttaatgctgaaatgagttaagactttgggggactgttgggaatgcatgattggttctgaaatgtaaagataaaggatttgggaggggccaggggcagaataatatggtttggctgtgtccccacccgaatctcctcttgaattgtactcccataattcccacatgctgtgggagggaccaaggtgaaacaactgaatcatggaggcggtttccccactactgttctcattgtagtgartaagtttcacgagatctgatggttttatcagggatttctgcttttgcatcttcctcattctctctttgcctgctgccatccatgtaagacgtgatttgctcttccttcccttccaccatgattgtgaggcttccctagtcacgtggaactgtaagtccaattaaatctcttctttctgtaaactaccccagtctcaggtatgtctttatcagcagcatgaaaatggactaatacaaatgggtacctacaacagtacttacttcactgggtttttctgttaattaaatgtgacaatacatg

SEQ ID NO: 28116 - DNA, 601 bp, Human
agaagtttgctgcaggggcggggctctcatggagaacctctgctggggcagtgtggaagggaaatgcggggtcgaagccgccacacagagttcctactggggcaccgcctagtggcactgtgagaagaaggccactgtcctccagaccccagaattgtagattcattgacagcttacaccgtgtgcctggaaaagccgcagacactcaaggccaccctgtgaaagcagccaggagggaggctgtaccctgcaaagccacaggggcggagctgccccagaccatgggaacccatctcttgcrtcagcatgtcctggatgtgagacatggagtcaaaggagaccattttggagctttaagatttgactgtcctgctggatttcagacttgcatggaccctgtagcccctttgttctggccaatttcttccatttggaacaggtgtatttacccaatgtctgtacccccactgtatctaggaaataactagcttgcttttgattttacaggcttataggcagaagagacttgccttgtctcagatgagactttggactgtggacttttgagttaatgctgaaatgagttaagactttgggggac

SEQ ID NO: 28117 - DNA, 601 bp, Human
gaggaaaaaggagtttcgtgagctgggcccagggtccctgagctgtgtgcagcctagagacttggtgccctgcgtcctagccactccagccatggctgaaaggggccaacatagggctcaggccatggattcagatggtacaagccccaagtcttggcagcttccatgtggcattgagcctgcaggtgcacagaagtcaagaattgggaacctccacctagatttcagacgtatggaaacacctggatgcccaggcagaagtttgctgcaggggcggggctctcatggagaacctctgctrgggcagtgtggaagggaaatgcggggtcgaagccgccacacagagttcctactggggcaccgcctagtggcactgtgagaagaaggccactgtcctccagaccccagaattgtagattcattgacagcttacaccgtgtgcctggaaaagccgcagacactcaaggccaccctgtgaaagcagccaggagggaggctgtaccctgcaaagccacaggggcggagctgccccagaccatgggaacccatctcttgcatcagcatgtcctggatgtgagacatggagtcaaaggagaccatt

SEQ ID NO: 28118 - DNA, 601 bp, Human
tctcagatggagatgaggaacttgttgtgaactggagcaaaggtgactcttgttacgttttagcaaagagattgatagcattttgcccctgccctagagatttgtggaactttgaacttgagggagatgatttaggatatctggcggaagaaatttctaagcagcaaagcattcaagaggtgacgtgggtgctcttaaaagcattcagttttaaaagagaaacagcataaaagtttgaaaaatttgcagcctgacaatgcaatagaaaataaaattccattttctgaggagaaattcaagcggctgcagaaatttgcataagtaacaaaaagccaaaagttaatccccaagacaatgggggaaatgtcttcagggcatgtcagaggtcttcaaggcagcccctcccatcaagccctggaggcctagaggaaaaaggagtttcgtgagctgggcccagggtccctgagctgtgtgcagcctagagacttggtgccctgcgtcctagccactccagccatggctgaaaggggccaacatagggctcaggccatggattcagatggtacaagccccaagtcttggcagcttccatgtggcattg

SEQ ID NO: 28119 - DNA, 601 bp, Human
tctcgtggtagtgaataggtctcacaagatctgatggttttatcaggggtttctgcttttgcatcttcctcattctctctttgcctgctgccatccatgtaagacgggacttgctcctctccttgccttccaccatgattgtgaggcttcccaagccacgtggaactgtaagcctaattaagcctcttccttttgtaaattgccctgtcttgggtatttccttatcagcagcatgaaaacggactaatttagtaaattagtactagtagaatggggcactgctgaaaagatacccgaaaayggggaagtgaccttaaaactgggtaacaggcagaggttggaacagtttggagggctcagaagaagacaggaaaatgtgggaaagtttggaacttcctagtgttgaatggctttgcccaaaatgctgatagtcatatggacaataaggtccaggctgaggtggtctcagatggagatgaggaacttgttgtgaactggagcaaaggtgactcttgttacgttttagcaaagagattgatagcattttgcccctgccctagagatttgtggaactttgaacttgagggagatgatttaggat

SEQ ID NO: 28120 - DNA, 601 bp, Human
gaacatttgctagaactgtattgttaaaataaattctctctttccacacaaattgctaaattatgaatatgcagttctcatcccagcagctatactgtcacttcaccggcaatgcctgcctgaggataaaatcaacccagagaaaaactgagccaaaatacaacatgagagagaatcccaataaccttgtttgggccctgaatccagcaatgactgaacaagtaaagctatacatttgatattccagaggtagcataacacaacagttaagaacaatggttttgcaattagcctacctacmtctgaatctctgctgtcacttgctgtggggccatgggcaagttatttaacttctcagtgccttcatttcctcatctgtttaaaatggtgatatggtttggctgtgccctcacccaaatctcatcttgaattgtactcccataattcccacatgttgtaggaaggacccgggaatagataactgaatcatgggggcggttcccccatactgttctcgtggtagtgaataggtctcacaagatctgatggttttatcaggggtttctgcttttgcatcttcctcattctctctttgcctgct

SEQ ID NO: 28121 - DNA, 601 bp, Human
gcagctggatcaggtcaggtttgatactattcatttttttatctatttctcggttgtccaaagcttgtttcttcaaatcctgctctagacgcattttgctatcatgaatctcacccagacgtgatttcaatttatcataattcatcataattctgtaaaaatatttgacatgttaaggctaaaatagaaatcaagcagacagatcctactgggtgagcacggtcctaatatcctttttttttttcccttgagattgagtctcgctctgtcacccaggctggagtgtagtggcatgatctcrgctcactgcaacctccgcctcccgggttcaagcaattctcctgcctcagcctccccagtagctgggattacaggcgcatgccaccacacccggctaatttttgtatttttagtagagatggggttttgccatgttgaccaggctggtctcaaacttctaacctcaggtgatctgcctgcctcagtctcccaaagtactgggattacaggcgtgagccattgcacccagtgaggtcctaatatcttaagcgtggtgaacatttgtttttgcctggcccatatccattcccatttctggtat

SEQ ID NO: 28122 - DNA, 601 bp, Human
cctacattctggtttgctccacatattaacttcagattaactctggtaccccctacaactaccaaggacactttcctaaattcttaccatcttactggccaattctcaattacaaatctctaatctcttcttccacctctagtgtctctagtgctggtagtaacctggcactaacgtctccctccccatacactcccagactacttacacaaggtgttgatctcggatctttcgcagctggatcaggtcaggtttgatactattcatttttttatctatttctcggttgtccaaagcttgwttcttcaaatcctgctctagacgcattttgctatcatgaatctcacccagacgtgatttcaatttatcataattcatcataattctgtaaaaatatttgacatgttaaggctaaaatagaaatcaagcagacagatcctactgggtgagcacggtcctaatatcctttttttttttcccttgagattgagtctcgctctgtcacccaggctggagtgtagtggcatgatctcagctcactgcaacctccgcctcccgggttcaagcaattctcctgcctcagcctccccagtagctggga

SEQ ID NO: 28123 - DNA, 601 bp, Human
ccagcctctgagatttccaaggcatttgtatggatcaagagtcctacattctggtttgctccacatattaacttcagattaactctggtaccccctacaactaccaaggacactttcctaaattcttaccatcttactggccaattctcaattacaaatctctaatctcttcttccacctctagtgtctctagtgctggtagtaacctggcactaacgtctccctccccatacactcccagactacttacacaaggtgttgatctcggatctttcgcagctggatcaggtcaggtttgatrctattcatttttttatctatttctcggttgtccaaagcttgtttcttcaaatcctgctctagacgcattttgctatcatgaatctcacccagacgtgatttcaatttatcataattcatcataattctgtaaaaatatttgacatgttaaggctaaaatagaaatcaagcagacagatcctactgggtgagcacggtcctaatatcctttttttttttcccttgagattgagtctcgctctgtcacccaggctggagtgtagtggcatgatctcagctcactgcaacctccgcctcccgg

SEQ ID NO: 28124 - DNA, 601 bp, Human
ttttttcccagatggagtctcactctgtcacccaggctggagtgcagtggcgtgatctcggctcactgcaacctccgcctccagggttcaagtgattctcctgcctcagcctcctgagtagctgggattacaagaatgtgccaccacgcccagctaattttgtatttttagtagaaacggagtttcactatgttggccaggctggtgtctcgaactccggacctcagatgatctgcctacctcggcctcccaaagtgctggggttacaggcgtaagccacagtgcccagcctagaacctayttcccctcagaggaaatagaaattccccactcagttctagtatgtaaacaaagattctgatttttatgttttaggcaaacattaatctgttcttgttaagatatagcattttactcatgccacagccagcctctgagatttccaaggcatttgtatggatcaagagtcctacattctggtttgctccacatattaacttcagattaactctggtaccccctacaactaccaaggacactttcctaaattcttaccatcttactggccaattctcaattacaaatctctaatctcttcttc

SEQ ID NO: 28125 - DNA, 601 bp, Human
ccagtgccttgagttcggacttcctagcctctagaactgtgagaaatttctggtatttacaaactacccaatttatgattttttttatagcagcctaaacagactaagacaccacacttattcacgccccttgggatggtatattccttgtatttcttattgcttttcagggcaaagaaggacttccattcattgttttggtgtatagcatagcctttttgagcctttcttcagcttcatgatgtgaccagaaccacgtgagcattccaagagcagacacaccccatttacagataagagmaccctccttgccttgtttacaaagctcttcagtatgctatatacacttggcttgacttttggccacaatagcaaactaaaatgatctcttgagagagctggtattaaaaactactcagcatggtgtagttgtaattgtttaccccaagaaatatcaccttaggctgggtacagtagctcatgcctataatcccagtactttaggaggccaaggtgggtacatcacctaaggtctggagcttaagaccagcttggtcaacatggtgaaaccccatctctactaaaaatacaaaaattagct

SEQ ID NO: 28126 - DNA, 601 bp, Human
gacatacgcagacaaactttgaaaacaccatgctaagtgaaagaagccagtcacaaaagagtacattttacattattttcattcatatgaaatgtccagaatagacaaatccatagacacagaaagtggattagcggttgtttagggctaaatgaaagaggtgatagggatgttaagtaaacagtgcagggttttttttaaggtgatgaaaatgttctaaaatatgtggtgatgacaaaatacctgtgaacatactaaaaacattgaataatacactttaaatgggtgaactgtatgcgaygtaaactgtatctcaataaagttgtaaaagcaaaaaataaaaccagaacacagcaccctccacagaacttttttttcttttttttttaatacagagtctcattctgttgcccaggctagagtgcagtggggcgatctcagctcactgcaacctccacctcccgggttcaagcaattctcctgcctcaggcttcccactagctgggattacaggcatgcgccaccatgcctgactaatttttgtatttttaatagagacagggtttcaccatgttggccaggctggtctcgaactcctgac

SEQ ID NO: 28127 - DNA, 601 bp, Human
gatcacaaatagatgcaataaattctacaggaaaaatctgaggcaaaacattcaaagacctaacatccagctctgattctgttggtgtggtaattgggttgtaaaaccaattagatttttagaaaagatactatatatacatattttttggcatggtcttggacccatctctctttggcccagcaatctcttcttaaaaaaaaaaaaaaaggaaaatactacttccatagattaaaaatagctggtgttagcatatcttttcctagccctaccccagcaagtaagggaaaaaatatgtatyatatagtgtcctttctaaagatctaattggttttacagcccaactaccacactttaagaagagagtttgtgtttcagtctaagacaaaaggattaagctgggaagcccctgagagagaaggacaggagaaacgactttgaagctgacgccttcgtcctggaagaaagcagaagcttagagcctggctgaagtagaaaacggggtgacagaaaacggtgcctcaggcacagggcatcctggatggagaatgaggttttaagatgcagcatctgttggtagccagtgatgagattactgtga

SEQ ID NO: 28128 - DNA, 601 bp, Human
tatcaaagaaatatgcacactgggtaaaaaagtgtgagttgaatgaatgcaccacattttctcttgaatccccattttcttttaaccaccaacctctttaaactgagcctccctttctgccacacacaatgttaggaactcatttcctaacactttcctaattgaaaaaaaaaagaaaaagaaaaattgcttttgctccaccctccatttatgatggtgcctaccttctgacttaggcaacttttccaatctcctaaaagtccatttcaaagacttatctagttctgagtccttacaaacstattaacaatgccaggagttgattagattttaaaaaccattttcaaaaacctcaaatagctttagtaaatacgttaattcacatttaatgttatcgaatcatgcactgatcacaaatagatgcaataaattctacaggaaaaatctgaggcaaaacattcaaagacctaacatccagctctgattctgttggtgtggtaattgggttgtaaaaccaattagatttttagaaaagatactatatatacatattttttggcatggtcttggacccatctctctttggcccagcaatctcttc

SEQ ID NO: 28129 - DNA, 601 bp, Human
ctggtgggctgcttttaacaaaatcttcacaactccaggatcatcctgtatctccccaagtatacaagataacttggcatcacacctaattttaaagttctgttagacagatttcacagtctttctcagtaagaattgccctttagttaacttggatttcattttttattcttagcaaaactggaaaatagataatatgtgatcttgatacaactgatttagtaacaaaccccctcccccacaccatcgcgtctgtcatcaaaatatccagatgccctcctctaagcattcttatcacccraagttttctatccttaaagaaactgaccttctctttatcaaagaaatatgcacactgggtaaaaaagtgtgagttgaatgaatgcaccacattttctcttgaatccccattttcttttaaccaccaacctctttaaactgagcctccctttctgccacacacaatgttaggaactcatttcctaacactttcctaattgaaaaaaaaaagaaaaagaaaaattgcttttgctccaccctccatttatgatggtgcctaccttctgacttaggcaacttttccaatctcctaaaagtccat

SEQ ID NO: 28130 - DNA, 601 bp, Human
attgagccatctgccagaggaaagacaccagtgtcagtatccatgcaaactctgactggacaaagtaggtatgtctgagccaactaaacttctagagtctagacacctcttgtttttcctaatcccacagaatgggcaaagatttcccaaaattagtctctcgattacttttctttcaactactatcaagatgaactgatcttttccagaaaaaggcagaaacatagagggctacttgaaattaggcccttcacttttcatttttcttttctggaggatgtgccaccacaagcacacacayactcgcactcacagtgggacatttgtttctgaaaacattaggttagcatggtgtcacatttgcaatctccactaagcctgaggacacacttcctgtgtgacctactgaattgagtttaatattttaactaaaaacttcaagatctatttttgcatttaagcaggccacaagaaattcagggtggcaatctgagtaattaatatgagtgaacttcattaccaagaaaatcatagtatccaagccgggcgcggtggctcatgcctgtaatcccagcactttgggaggccaaggcaggtggat

SEQ ID NO: 28131 - DNA, 601 bp, Human
ctcgattgatatcctcaacaaaccaggttttctcatcataatggggcaggttttcatcttcctcattgataaaatagttcctaaaaattaaatattagtatattattctaacaagttacttctatctaaaagcaaattcataaataaaacactcttctaaatctttaaaccacaaataacaaagcaaaattgcaattatttgggtgttaacttcattacttgctatggtgcataaagcaaagaattcatgtttcatccaataagctgaaatatgaacatctgaataaaagtgcttttacakccagattttgggtagctatactcaaagtagcttacacatccagattttgagttcagaagcaggtctctgaactccagtgcctatagggtaccttcaggcaattcaattcaaaagatagtcaaagttctagattcaatgtcctcaagtgacaatgacaaccaatatttaccacgtataaacaaggcgcatgtcttatattgataacaaagccctctgacagaaaggtatagagagaacttactcatcagcatcctcattcttaattcccagccagacattcaggcgtttctgtctcactcc

SEQ ID NO: 28132 - DNA, 601 bp, Human
ccattcatctttttgaggtccatctcagataccttttccacaaaacctcccaatccgctctttctccactaaaattaatgcttccacatgtgcacagcctactaataatacttatttcacagtggttctattcattgtggatatttggtgaaatgaaaaaagcctggtgcaatagaaaaatgtgggttttgaaaccaggtaaacttggattcaaactctgactccatggtacaagtagagcactatgaacaagatgatcacataaagcactgagcagtctgttaatatgaatgcctttcgyctaccttctccaccttgccctctaagggcacaatcattttgtcactttgtttgacttctgccacatccatcagtagcatcatcatcatattagtaggtgacatttacttcttatgtccctgcactgttaaaagcatattgtattacacagattaactcatttaatcctcacaaaaaccctaaagtaggtattatccttattttacagataaggaaactgggcaaagaaagattaagtaatttacccaaagttacccagctagtaagcagtagagccaggagctgaacccagtatatctgg

SEQ ID NO: 28133 - DNA, 601 bp, Human
agttctatccttggataacagtaatccaatgcacttttcaactcctcccccattttctgcccataagacatcccattcatctttttgaggtccatctcagataccttttccacaaaacctcccaatccgctctttctccactaaaattaatgcttccacatgtgcacagcctactaataatacttatttcacagtggttctattcattgtggatatttggtgaaatgaaaaaagcctggtgcaatagaaaaatgtgggttttgaaaccaggtaaacttggattcaaactctgactccatgrtacaagtagagcactatgaacaagatgatcacataaagcactgagcagtctgttaatatgaatgcctttcgtctaccttctccaccttgccctctaagggcacaatcattttgtcactttgtttgacttctgccacatccatcagtagcatcatcatcatattagtaggtgacatttacttcttatgtccctgcactgttaaaagcatattgtattacacagattaactcatttaatcctcacaaaaaccctaaagtaggtattatccttattttacagataaggaaactgggcaaagaa

SEQ ID NO: 28134 - DNA, 601 bp, Human
tgattcaaagctcaccatccccacaaaaagaatgctattcctcatctcagagaaacaggcaggaaggacagaaggggttagttacagtgatcaattttagcgtttgctaaaactcacaaattctagtctttttatgttcaagttttggtacagaagtatacattcaactatgagtgccacgttttcccatcaaacattggtctggcaacaaactgttttgttggcttctgaacataatacttcttcagagggaggggctggtgagatgctgaagcctaaattatgttggtaagaaacaaartaccttcagttgaaggttttttttatcatcttggcttagattatttaaatgaaatcccaagcctccccattttcctttggttgtctttttcatcaaatcccattctatcacaaaacctaaacagccttcttcgtggggggaagagagactgccaaagcaaaacacaactcccagcagagccatgcccctgctgcactctcaagagttagattttaaaaagacatggtctcttcagaggcttccaaatacaaccccacccgctataaccatcaagcctaatattctgttgagggtgtctgg

SEQ ID NO: 28135 - DNA, 601 bp, Human
aagcaatcgtcctgcctcagcctcctaaagtgctggaattacaggcatgagccactgagcctggcataatttgaccagtttgtgaaaagactagagaattgactcccaaactttttgatctaaggtctcctttacactctgaaaaattaaggaccctcaaaagctttctaaattttatatctattaatagttatgatattcaaaattaaaatgaaattttttaaaatattaattcattttaaaataataaacctattacatattaacatacataacattttcaaaaaattaatgagtgtcrttgttttacattttgcaaatctttttaatgtttggcttaattgaagaaagctggattctcatctctttctatattctgtcagttgtggtatcacacatcatgtaacctctcaattactccactgtatacgcatgagagaatgagaatgaaaaaggcaaataacattttagtattattacgaaaacagttttgattttatagactccctgaaatggtcttaaagaccccaggggtgcccatgccacactttgagaaccattgcactggaaaaagttttggagaacagagagcaaccagatt

SEQ ID NO: 28136 - DNA, 601 bp, Human
tagctaggatggtctcgatttcctgacctcgtgatccgcccacctcggcctcccaaagtgctgggattacaggcatgagccaccgcgccctgcccatttaggggtattttcaaggagtgtctttaaaggctacatttttaattgtcccaagtgattctaatgtaagtggaacagggaaaccacattaagaaatgatggcaagatgttgaaggattctaaaaacatgagtgatatgagatttatgttttagaaaatcactttgcatatataagataggttaaacaggtgtgtgaccagaaastgaagagttagggacctattgaaccagttcaagagcattaatttttagagtctaagtggtgacagtgataaagaagttgtagataattggcaagatttagaaaatgtgtctgaaatagaatcagaatactgtagtaggattttgtgatctgttggattgggaacaataggttattttcaaactttttttgaaattattaaccttgtgaaatagttgcattgtagggattttcatccagaaagagaagactaagagatggttttaaaacaactgaattgtggaaagactagaagtcttatt

SEQ ID NO: 28137 - DNA, 601 bp, Human
gtgatctgttggattgggaacaataggttattttcaaactttttttgaaattattaaccttgtgaaatagttgcattgtagggattttcatccagaaagagaagactaagagatggttttaaaacaactgaattgtggaaagactagaagtcttattttctagtaatgttattaatggaaaactcaaagcatttgacatttattttttaaggtatttagtaaatattttcattgttaatacataaagtcatagctacaaaagaaacattaaagctcatataatcccagtctttcatattgwggatgaagaaatttagacacagagggaggaagggactttctcaaaagtcacataactacttgataccagagccgtcaatatctcctgttttccaggctaggctgccagtcgagtatatagatagtcatgagctccatgttttagctaatgaattacctgtcctcattcttatttttctaagggaacaaatctgacaaaatcagaatttatgagcctggatgaattagaccttgtataagaacttagttcagtgctaaaatcaagaaaaataatggattgtgtgattttagcctgatttcc

SEQ ID NO: 28138 - DNA, 601 bp, Human
attgtagggattttcatccagaaagagaagactaagagatggttttaaaacaactgaattgtggaaagactagaagtcttattttctagtaatgttattaatggaaaactcaaagcatttgacatttattttttaaggtatttagtaaatattttcattgttaatacataaagtcatagctacaaaagaaacattaaagctcatataatcccagtctttcatattgaggatgaagaaatttagacacagagggaggaagggactttctcaaaagtcacataactacttgataccagagccrtcaatatctcctgttttccaggctaggctgccagtcgagtatatagatagtcatgagctccatgttttagctaatgaattacctgtcctcattcttatttttctaagggaacaaatctgacaaaatcagaatttatgagcctggatgaattagaccttgtataagaacttagttcagtgctaaaatcaagaaaaataatggattgtgtgattttagcctgatttccaagtaccacaaaatgggcggcttaagcagcagaaatgtattatcttacaatcctgaaatttagaagtctaagat

SEQ ID NO: 28139 - DNA, 601 bp, Human
tcaggatatgtatttgttttgcagttgctagagggctacccactttctacctgtgacagaccaaatctaattacttaggtcatgcacaattcttaggttatgtttagtagatactgggggtcacagacagtgggaggtaggtgagcattagttaattccttacagccttgctctcaggttataatgaaaccaagttctggcacacttaaaaacatctactggcaaacagagattaaaagtaacacaacctgttctgtaagcttattgaagtcccagtgttctgcccttgtttcatgctacygcagaactgcttataaaagatttacctgaagaaaatgcaacaatattctagctgtaggatttggttggctacctggttaactcagttgactaagaatcctttgaactagcggctaaggatcccaggcaaaggtgaaggacttgcttgatttgtatattctagttcatatgaatattactaaaatgttttagctagtccagtatcttgaaaaccattaatctatgaaaatccattcctgataatcattatgctaatcaaaaatatttggtgctaaatcagtgataaaagctagttgaagag

SEQ ID NO: 28140 - DNA, 601 bp, Human
aaatctaattacttaggtcatgcacaattcttaggttatgtttagtagatactgggggtcacagacagtgggaggtaggtgagcattagttaattccttacagccttgctctcaggttataatgaaaccaagttctggcacacttaaaaacatctactggcaaacagagattaaaagtaacacaacctgttctgtaagcttattgaagtcccagtgttctgcccttgtttcatgctaccgcagaactgcttataaaagatttacctgaagaaaatgcaacaatattctagctgtaggattyggttggctacctggttaactcagttgactaagaatcctttgaactagcggctaaggatcccaggcaaaggtgaaggacttgcttgatttgtatattctagttcatatgaatattactaaaatgttttagctagtccagtatcttgaaaaccattaatctatgaaaatccattcctgataatcattatgctaatcaaaaatatttggtgctaaatcagtgataaaagctagttgaagagcttaagctttggaatgtggcttttgatcaagtgtggctaactaaccactctggaatgttcac

SEQ ID NO: 28141 - DNA, 601 bp, Human
tctgcctgactaactacctttctttcattgttccttttaaaatttttatcttatagttttaaaaagcattttgtgttcattgaagaaaatatagaggacaaaatgacctgttatcccaccattcagcaatgatcattgtttgttatattttagaaattaaaactcacctattttttgtatctgtttccattaaaaaaagtaacatttctgggatcttattttatcacctaacagtataacatggatatttccttgagtcattatttagcaatgtggtttttaataactacataagatttcrttgtatggctagactatcatttatttaaacaattctccattgctggacatgtagaatatctctagtctactagtaaaggcactgccagactttttagatttaattcctttcccttcctcaaacctggtccttatgtgcccatcatttcctctgtcattggctgtaaaaatgctaatttccttttctttgggccaatcttacaaaattctttatttaggttttaaaaatgtaattttagctatccactaatataaaacttataattgcataaagtaggttaaaaatactgtgtagaatttt

SEQ ID NO: 28142 - DNA, 601 bp, Human
acacagcaaaaaggccatgtagctagagcagaatgaacaatggcagtgataggaaacaaggctgcagaagtaggcttgatcccatcgggcctgtgggccataggaaagagtcattaagtttattaaatttacagtaggcaactatagacctgtgagtcgtccacaatagtatacactcaggcaatgttaattaatggcaataatttaacctccagagctagaaacatagtcctgggagaatgccatcacaaaatcaacctgcccatatttgaagagaacagtgtgtcctaactggcataaytgaagaattagttctcaaatccatgcaaagcctgtttttcttttctattgtttaaagcttactcatttctctaacattctttcaagaacaattaatttagaaacaatttataaaggtacattctccttatttaattttaaaattagaaattttttagagttaaaggcctttattattagtttacttacctcattttacttgaggctgagattaagaagggtaagaggcacatccaaaattacaattggagtatgatttttaatatttgaagtagtaatactcagaaaaataccttcattc

SEQ ID NO: 28143 - DNA, 601 bp, Human
tcattttacttgaggctgagattaagaagggtaagaggcacatccaaaattacaattggagtatgatttttaatatttgaagtagtaatactcagaaaaataccttcattctgcaaagcgaatagtaatcataaatactatacataatgacaattctgagagtaaaatgaacattataaaagccacttcataaatgttttgtgaggccgtgatgagataatgcctatacagtgcttgatgtatgataaatacttggtaaatgataactttttaaatttacatttagcattcaatatattgscactgcctaggacattttaatgaatttttagggaatggtccatttctgcttattatttgaattttcaaaaaataataaaatgggccaggcatggtggctcacgcctgtaatcccagcactttgggaggccgaggctggtggatcacctgaggttaggaatttgagaccagcctgaccaacgtggagaaaccccatctccactaaaaatacaaaattagccgggcgtggtgttgcatgcctgtaatcccaactacttgggaggctgaggcaggagaatcacttgaacctgttaggtggagg

SEQ ID NO: 28144 - DNA, 601 bp, Human
cagcactttgggaggcaaaggtgggaggattgctagagcccaggagttcaagacaagcttgagcaacatagtgagacctcatctgtacaaaaaatttaaaacattagctggtcatggaggcccacgcctctagtcctaactactcgggaatctgaggcaggaggatcgcttgagcccaggaggtcaaggctgcagtgagccgtgattgcaccactgcactccagcctgggtgacagtgtgagattctgtctcaaaaagaaaaggaatgtggtggtcttcatattttttcattttgttatcrttacttttttagggtttagagactcattttacatttttatatgtgtattcctccatttctttttttctctaatcccatgacagattcttattctccagcatttcttattccacatgtagagccataaataaactcctaaaaatcacatgaagtttttttcccatagattgctagtctcatttcatcttcacattattcctgggagtaagaaacaataacaaacaacagccactgacaaaactaaaactaaaactcagcaacttttagtttctaacccagtgcacttttatttatgttata

SEQ ID NO: 28145 - DNA, 601 bp, Human
atttaggagtatcaaaaaaaccaaaggattaattttgatagattatcctggacagctttaaagaaaagatgtgattctttttttcttaatcggtacacagggaggagaatttcttaaattctggagaatttaaggtgggccacagttctcctcattcagtttcctctttaaatatctcaatgttacttcttcttggctttcttttgatttgaaattactatttgtaatttggtggggggagaagggtaatatccatttgaaaaatatttgcataaataagggcttgatcccttacaaagtrtcattaaataaggcctccaatcttatgactgcttttatattaattttatatgagactctggtctcatataagcctgttgagcaagtttttttttctttaaactatttgtgataataactaagataataactaatgagaaataagtagatgatttgatagtcttattttgccaacttcataacagcaaataaacagttatcactgtttttgatatttggcactcttcttgaagactgataatggcaatgaagtttcaatggcaaaaacaaaaaaatcttaaacatcctccatcataagaga

SEQ ID NO: 28146 - DNA, 601 bp, Human
tgggttcaagcgattctcttgccttagcctcccgagtagctggctctacaggtgcgtgctgccatgcccagctaatttttgtatttttggtagagacagggttttaccatgttggccaggatggtctcaatctcttgaccttgtgatccgcccgcctcggcctcccaaagtgctgggattacaggcataagccaccgtgcctagcctatgctttcttataatccttatgaccaagatttctacattccctttcttctcttcactccctcacgctttgatgtactacagccctgcagcctgkcttccacacctgtgtcttcacctaagcaggtctctcaagcgtcagtaacaacttctgtgttaccagatctgctggacattttccttctgctaggactctcggcagcagtcaacaccttcactctctcctctgttttgaacaccctgtcctaagctactgggaggcctgtcttaccaggcttccccagtctttctgtactttcctgtagtccttaaacaggctcatcctcctcgggctgccattgaaggctagagttcttccacactcagccttcttctcttacttgaaaatagctccatt

SEQ ID NO: 28147 - DNA, 601 bp, Human
ataaatatttttatatttcatgtgattgtgaacttttagtattatgaataatttttatatgttgaaactagaatttttggtgtgttaaaaattactatttttcccgtcatttcagatcttgaaaaatctcagccaaagttttattgaaaacatttcttatttaccagtttaaaacttggataattgaactgtatttctgttttatacagacaattcttgctcccccagatgtccaacagcagtatttatcaagtattcagcacctacttggagatggtaagattcttatttgtgacttttrtactaattttaattcatttatttttattattgaggaatttttaaactaagcaaggcttttaggtttgttttttctttaataggcctgacagaattgatcactgtcattaaacaagctgtgcagaaggttttaggaaggtaaggcatttttctttgacttttctgacttcttgattctaatgagtgaaagaaaattagaattgttctagtgaaaccagtgacttgacaaacggtgatttgtgaaactctttgtaataaaatcagataccatcctaggatattgcattgtgggatccatttt

SEQ ID NO: 28148 - DNA, 601 bp, Human
ggaggttgacggggaggatcacttgggtccaggagttcaggaccagcctgggcaacatagcgagatcctgtctctaaaaattaaaattaaaaaaatcagtcagatgggcatagtggtgcatggctatagtcccagctactcaggaggctgaggaggaaggattttttaagctcagcagttcgagtccgtggtgtgctatggttgcaccattgcactccagactgggcaacaccaatctgtctcttaaaaaaaaaatgctttgggaggccaaggcaagaggatggcttgaggccaggaattygagaccagcctgggaagcataacaagaccctacccctacaaaaaaaaaaaaaatgaaaaattagtatggtggcccatgcctgtagtcctaactactacttaggaagctgaggcaggaggatcacttgagcccacgagttcgaggttgcctaagctatgatcatgccactgcactccagtctggatgacagagtgagaccctttctcaaaaaaataataatagtaaaattaaattaaaaaaaaaggccgggtgcggtggtgcacgcctgtaatcccagcactttgggaggccgaggcaggc

SEQ ID NO: 28149 - DNA, 601 bp, Human
acttctcaatgaaactagagacatgttggaaaggtatgtatacttcatgtagcaggaaaaatatgtgtgtatgttgaatgtacttgagactattttttagtttttcttgaacaacatggtcggtataatattatattaaaattaaatttttgactctgttccccagcctttagataagatttcctactcaaactggagggaagcagggatttcttagggtaactcagctactaactctactatctgaattcatcgagttccagtcttttgtttttcctcagtaggattgtccacttttttsttattcagatttccacctcatcatttcatgaagctctggagaaggtcatcagtgatcttttgccatatccaatgaacctgtaatgttcatcttacttgacctttctctgatatttgacactgcctttcttgaaattctttgctcacatgactttcatgacagtataatctatatttttctcccacctctcaaatcatttcttagatttttctatctctgtctttcctttaaacatcagtgtttccaacctggtgcagcagctcatgcttgtaatcccagcactttgagtggccgaggcag

SEQ ID NO: 28150 - DNA, 601 bp, Human
ataatataaggtataattattgttactcataaaataataggtaagtcagtgaaatagaatgtaaaatccagaagtagccctaaaaattgtaggatgttagtaatgattgtgggcaaaatatatgttggtaagacgaataacaattagtcattttacaatgactaataaaattcaggaggtttaagcatttaaatatactaagtaaaaacaaatatactgatcgaaaacaggtgactatgtgacctcaagatggagaaggtatttctaagaatgaaagtaaagaactttatataaaagaagkctaggtttgactgtataatttttaaaacttcaagatcaaacaagctttttataagcttttcatcaatattaaatgcaaataatatacaggaggaaatgtttgctctctttatgtatatatatcatccatgagtgtaatgacattatatacagaacttttgcacatcagttaaggaagcaaacacctaaggaaagaaaaattttctttcttagaaaatgtgcatcaaagacacagataattcacaaaagagcagatggaaatggccagtttgttaatctaagatttattgaacacgtgtta

SEQ ID NO: 28151 - DNA, 601 bp, Human
taatcaaaatcatgatagattttgaaaaatgccacaaaggtaccatgaaaaaaaaaatgcctgcttccctcaggaatacataaatcttcccacttcctttattcttttttaagcattgcctcaaatctcagcatagcacactggttgtacaccctagcttcagcacttgcatgatatttaaaaggaaatttttagtgtagccctaggttgaaatgtatgagatgtcatatttaatgtaataagactaaatctacaaccccaacgcaaaaatgagtcttgttgtttaagtcattgcatcacrtacatacagtgatacatacatgtattcatttatgcatccaacaaatgtttattgtgctctaacaagttaaaaagttattgctgtagtccaggcaagagataatgctcagcttggaatctgttgggcaacggggagaattcttggcacttatttgaatataggcaagggaaagaagtgccaaggattttcaaaagattttaagattattaaaagatttcttttgagaaatctttagaatatctgattgggtataggcaagagaaagaagtgccagggataatgcccatatttgctgcttct

SEQ ID NO: 28152 - DNA, 601 bp, Human
caaacactttagaacttttaataagatggaaaatactcataacaataaaaatgcaaaaacagtgtgcttaggaggttagaggtttttggtagacacaaaaaaacaaagatatgtgtaaaaaaacgccaaaagaaattggtcatgatgtcaattagagttgttatttctaagcgatagaattgtggggttttttttcctttttaatagatttccaaaaatattctacaatggctatgtattacttttataattaagatgttaaagtcctgtggggtcatttcagaaaataatcattactgtratgatttttcagtctttccagtgtcagcctgcctttagctaagataattccaatagtaaacggacagatccattcagtttgcagtgaaacacctagtcattttgttcaggtaagaagaaagcttgggagtgttattaaaagcaaattatatttgtggtggtggtcatgtttgtctaacataaagttacattctctgctgagaggttttttcaaaaaatcacagaacttggaactacatgtagagtatggtagagtgtcccatgagagtaataacggaccatagcaaatgtgtaagtttgg

SEQ ID NO: 28153 - DNA, 601 bp, Human
ctacagtgggattcatttactttttaaaatacactgggtaaatcacctatacttagagtaacagtttgttatcaaaatgcctgataaaatatattcttaataaaagtcttcatttcataatgaaatcaatttatttggcatcttaatatatttttttagattcatcaacagaccagtttttgtgggcatatatatatacacgtgcaaatatcagaattgttaataatttgttacacatggacatttgttccaaactgactaaaaatcaatatagatattttatatacatatatatatatawaaatacaaaattcagtgtactttaccatattaatactgaggaaaaatctgttggagacataggtctaggatgtgtgaagtttggaaaaatatgctatttaattataatgttccctagactgctgtaaacagaagtgaatcagacttttctccagctacctttcaaaataataaattatttgtctcaaatataccttgatggaggacttttttattcttatggaaatagtgaattccaacaactatgatgaactatgttctttgctatttcttcactatattttttaaggttttattaaaa

SEQ ID NO: 28154 - DNA, 601 bp, Human
ttggggttgggatccaagcaggagctggtgcctgggtttgaggctagggctgggggataagtgtatactggtgaccgatactaggattaaggttttgccagggcttaaggctggactttggagctggccaaggggtggggtttgtggctagggctggggtttgtggctggggctgggttttgtggcagggatccaagcaggagctggtgcccctgactgatgctaaggctggacatggagctggtgatggtgctagcactggctgaggttgggtgcaaggcctgtatttggggatggtgcmggttttgggggccgagttggattgaggctagggttggagctggattggtgtcttgggttgacttaggttgtggaagatgctgaggtttaggattgagtttgggaaagtactaaaccagggcaggtattgggctagctagggagggtctggccttgggcctataggtgtagcctaggggtttgcctagaaggagaaggcagcctcctctgagcatgcagctgttgctgcagccaggattgaatagatggctttaaggtagggctgggtgtgcctctgggggcgggggttgggggcacggaa

SEQ ID NO: 28155 - DNA, 601 bp, Human
aggagctggtgcccctgactgatgctaaggctggacatggagctggtgatggtgctagcactggctgaggttgggtgcaaggcctgtatttggggatggtgcaggttttgggggccgagttggattgaggctagggttggagctggattggtgtcttgggttgacttaggttgtggaagatgctgaggtttaggattgagtttgggaaagtactaaaccagggcaggtattgggctagctagggagggtctggccttgggcctataggtgtagcctaggggtttgcctagaaggagaaggyagcctcctctgagcatgcagctgttgctgcagccaggattgaatagatggctttaaggtagggctgggtgtgcctctgggggcgggggttgggggcacggaaggggaagcttcggtcgctaagtgggccggcctttggaagggtctgggaggggccagcgctgactaacatgtcggtttccctaccctagacggctgcgacgaggagctggtgggtcccctgtatgcacgctccctgggcgcctcctcctactacagtctccttactgcgccgcgattcgccaggctgcacggtgagctc

SEQ ID NO: 28156 - DNA, 601 bp, Human
tgtggaagatgctgaggtttaggattgagtttgggaaagtactaaaccagggcaggtattgggctagctagggagggtctggccttgggcctataggtgtagcctaggggtttgcctagaaggagaaggcagcctcctctgagcatgcagctgttgctgcagccaggattgaatagatggctttaaggtagggctgggtgtgcctctgggggcgggggttgggggcacggaaggggaagcttcggtcgctaagtgggccggcctttggaagggtctgggaggggccagcgctgactaacatgtcggtttccctaccctagacggctgcgacgaggagctggtgggtcccctgtatgcacgctccctgggcgcctcctcctactacagtctccttactgcgccgcgattcgccaggctgcacggtgagctccgcggaacatcagctgccaactggcagcgcaccgcggaagggtgggggcctccggaggacttcggggagagggatagccggttaaagctcctgtcctttctataggcataagcgggtggtcaccacggattggggatccgaatccctggctccagatagacttaatgaaga

SEQ ID NO: 28157 - DNA, 601 bp, Human
ctaggggtttgcctagaaggagaaggcagcctcctctgagcatgcagctgttgctgcagccaggattgaatagatggctttaaggtagggctgggtgtgcctctgggggcgggggttgggggcacggaaggggaagcttcggtcgctaagtgggccggcctttggaagggtctgggaggggccagcgctgactaacatgtcggtttccctaccctagacggctgcgacgaggagctggtgggtcccctgtatgcacgctccctgggcgcctcctcctactacagtctccttactgcgccgmgattcgccaggctgcacggtgagctccgcggaacatcagctgccaactggcagcgcaccgcggaagggtgggggcctccggaggacttcggggagagggatagccggttaaagctcctgtcctttctataggcataagcgggtggtcaccacggattggggatccgaatccctggctccagatagacttaatgaagaagcaccggatccgggccgtggccacacagggctcctttaattcttgggactgggtcacacgttacatgctactctacggcgaccgagtggacagctggacacc

SEQ ID NO: 28158 - DNA, 601 bp, Human
ggctcacgcctgtaatcccagcactttgggaggccgaggcaggtggatcacgaggtcaggagttcatgaccagcctggccaacatggtgaaaccccgtctctatgaaaaatacaaaaaaatcagccgggcgtagtggcgggcgcctgtaatcccagctacttgggaggctgaggaagagaattgtttgaacccgggaggcagaggttgcggtgagccgagatcgtaccaccgcactccagcctgggcgacagagcgagactctgtctcaaaaaataaaataaaaaaaagaagcagagggcrggacgtggttactactctcctccacccccgcagaccttctttggtaacgtgaacgagtcggcggtggtgcgccatgacctgcacttccacttcactgcgcgctacatccgcatcgtgcccctggcctggaacccacgcggcaagatcggcctgaggctcggcctctatggctgcccatacagtaagtgtgcagagagcgcggagggggcctgggagacagcctccccagttcccggcccacctacggtcctttgcgcagaggccgacatactctatttcgacggcgacgatgccatctcc

SEQ ID NO: 28159 - DNA, 601 bp, Human
aggagttcatgaccagcctggccaacatggtgaaaccccgtctctatgaaaaatacaaaaaaatcagccgggcgtagtggcgggcgcctgtaatcccagctacttgggaggctgaggaagagaattgtttgaacccgggaggcagaggttgcggtgagccgagatcgtaccaccgcactccagcctgggcgacagagcgagactctgtctcaaaaaataaaataaaaaaaagaagcagagggcgggacgtggttactactctcctccacccccgcagaccttctttggtaacgtgaacgaktcggcggtggtgcgccatgacctgcacttccacttcactgcgcgctacatccgcatcgtgcccctggcctggaacccacgcggcaagatcggcctgaggctcggcctctatggctgcccatacagtaagtgtgcagagagcgcggagggggcctgggagacagcctccccagttcccggcccacctacggtcctttgcgcagaggccgacatactctatttcgacggcgacgatgccatctcctaccgcttcccgcgaggggtcagccgaagcctgtgggacgtgttcgccttcagcttc

SEQ ID NO: 28160 - DNA, 601 bp, Human
ggtagggtagatgctggatgagtgagtgcaggtcggtctctccctttctcttttcctctgtctctcagaggaaagacctggcattcaggctgtgggtggtggctcatgcctgtaatcccagcactttgggaggctgaggtgggaggattgcttgaggccaggtgttcaagactcacctgggcaacatagtgacatcctacctctatttaaaaaaaaattttttttcaaagacctcgcattccaattcctgaatatcctagcagcccttggcaaacttgccactcaccagaaaaaggcctggttttttttttgtttttttttttttttttgtgggtgttgttgctgttagcatgcagactcccaggcactatttcagaactaatgagatggggtttggaaattcagattttggggactaggcaaggtaggaaaattgttcccttggatcctcccacaactttgtggagttgttaaagaccctgaccccatctgcagataagaatcccaggcaggctaattgacttgcccaagggcgtgcagccgatttgtgttggagtcagagcttgaactcaagccttgaaaggcctagcgagctttagta

SEQ ID NO: 28161 - DNA, 601 bp, Human
tgctggatgagtgagtgcaggtcggtctctccctttctcttttcctctgtctctcagaggaaagacctggcattcaggctgtgggtggtggctcatgcctgtaatcccagcactttgggaggctgaggtgggaggattgcttgaggccaggtgttcaagactcacctgggcaacatagtgacatcctacctctatttaaaaaaaaattttttttcaaagacctcgcattccaattcctgaatatcctagcagcccttggcaaacttgccactcaccagaaaaaggcctgtttttttttttktttttttttttttttttgtgggtgttgttgctgttagcatgcagactcccaggcactatttcagaactaatgagatggggtttggaaattcagattttggggactaggcaaggtaggaaaattgttcccttggatcctcccacaactttgtggagttgttaaagaccctgaccccatctgcagataagaatcccaggcaggctaattgacttgcccaagggcgtgcagccgatttgtgttggagtcagagcttgaactcaagccttgaaaggcctagcgagctttagtaccgacactggg

SEQ ID NO: 28162 - DNA, 601 bp, Human
ggtcggtctctccctttctcttttcctctgtctctcagaggaaagacctggcattcaggctgtgggtggtggctcatgcctgtaatcccagcactttgggaggctgaggtgggaggattgcttgaggccaggtgttcaagactcacctgggcaacatagtgacatcctacctctatttaaaaaaaaattttttttcaaagacctcgcattccaattcctgaatatcctagcagcccttggcaaacttgccactcaccagaaaaaggcctgtttttttttttgtttttttttttttttttgkgggtgttgttgctgttagcatgcagactcccaggcactatttcagaactaatgagatggggtttggaaattcagattttggggactaggcaaggtaggaaaattgttcccttggatcctcccacaactttgtggagttgttaaagaccctgaccccatctgcagataagaatcccaggcaggctaattgacttgcccaagggcgtgcagccgatttgtgttggagtcagagcttgaactcaagccttgaaaggcctagcgagctttagtaccgacactggggaaatgtgtgttttaagtc

SEQ ID NO: 28163 - DNA, 601 bp, Human
tccagcctggggggcacagcaaggactgtgtctacaaaaaaaaaaaaaagcaaatcgcttctccatcttcccaccatcaccatggtaacacaggcgaactcccttgtcaatgtatttgatgattgctgcattcctaaaacatgtcaatgacccagttcttggttaaggtgagccttgacattccccatagcaagatcctacacacatgccaagactgcatcctccctaaggctggcctatagggaggatatatgagcaggtgggttactggtgggaggagtgtgggggactagggagatayaagacttagggaccaacagatttctggtggtggtttggaagtgtgagtagtggcacatatactacatggggtcaggatatccccatcacccaggctggagtgcagtggcatgatcttggctcactgcaacctctgccccctgggctcaagcaattctcctgccttggctttcctatagtagctgggattacaggcatgcactaccacacctagctaagttttgtatttttagtagagatggggttttgccatgttggccaggctgttctcgaactcctgacctcaagatgatctgcctgc

SEQ ID NO: 28164 - DNA, 601 bp, Human
gaggcctcagtttagcaccttagtacctccgctgcttcacttgctttagccaaagccataaaaaacctgcaacgtagagaaaataatgcagataccctgactagccagccctctactcctccaaccttttccaagatatgcaatggcctttgtgcctgcccaaaggcttcgccccctccagtgcatgaggaaccctctttcctccgctcagagatgctgcttcatttacccaggaggtcatattctttatatatattttttgttgcaaagtgtctctctagagaaactctatatattattygaatttttaaattatttgtttatatataaaagaaaagctcaattggctgtgctgtcctgtgctgtgctgtgcccacagtctgtagtttgcctttcctgtgttggaagtgtcgtgagtcctgctggtcacccaccagcctggtccggcctccactctgaagcagggttgagcctgctgtgctctcagacgcggagccgttccaataaagcagagtggcagagccccagtctgtgtgtggtagctggcgtcgtggttaggggataagtgggatgattttaagggaactaatctgagggctca

SEQ ID NO: 28165 - DNA, 601 bp, Human
cctcaaaatatcagcagaaaccatgtatacaagtcactgaacacaccttcaacataaaatgaatcatctttcgagcatttttaagcccccagagaaatcacatttgcataccaagtaagtggccaagaaaatgcacacatgtacttaacctacgtctgcaaagaagacagagaaagggctgctattactgtgaacatcaaaagggcttcagttacagtaacttcagttcacttcatgctcctaactcaggctctctgcctccaatgcttagcgtcccgcacccttctccaggttttgaacmtgatctcaatccaatcaaaagagaaactaagcagatttttttctgggcattcacattaccggtaacaatagaacattataaagatcttgttaacaaaagtagcttcttgccagagtctttttattaacacttgcaacgctatttaacaagctggccatgcctgtgtgacaccaaaccgcatgtggataaattcagtgtttcatcccaggcccaccaattcctatcctttgtaactaataatgttaacacgacagatcaagaaactagtttttcagaaagcagttttcattcattctctat

SEQ ID NO: 28166 - DNA, 601 bp, Human
ctttctggtttaaaactgtgcaaacctcaaaatatcagcagaaaccatgtatacaagtcactgaacacaccttcaacataaaatgaatcatctttcgagcatttttaagcccccagagaaatcacatttgcataccaagtaagtggccaagaaaatgcacacatgtacttaacctacgtctgcaaagaagacagagaaagggctgctattactgtgaacatcaaaagggcttcagttacagtaacttcagttcacttcatgctcctaactcaggctctctgcctccaatgcttagcgtccsgcacccttctccaggttttgaacatgatctcaatccaatcaaaagagaaactaagcagatttttttctgggcattcacattaccggtaacaatagaacattataaagatcttgttaacaaaagtagcttcttgccagagtctttttattaacacttgcaacgctatttaacaagctggccatgcctgtgtgacaccaaaccgcatgtggataaattcagtgtttcatcccaggcccaccaattcctatcctttgtaactaataatgttaacacgacagatcaagaaactagtttttcaga

SEQ ID NO: 28167 - DNA, 601 bp, Human
gcaaatgctgccctgagtgaaggaagaatgaggctccctgaaactaggtgcacaggcaccaaaatgcttacacattgagctggaatcatgctaggcccagaacacatttccttgaacattaaattcaggatggtgcaaaacaacattcacaaccagacttacacctaagaaaacaatttgcttagaagaccttaggatataggatctacatctctccgcatcctgtgtttatgctcctgtatgttccaggttggcccaacaagccagaaggaagagcctagcctgtcatcttggataccayccagatggaaaagcacgtcacagtcaaaatcacaatcaacattcttgcaacaatgtttgattaaaataaaaagtaaacttggaaacccaagaggaaatacttgctttctggtttaaaactgtgcaaacctcaaaatatcagcagaaaccatgtatacaagtcactgaacacaccttcaacataaaatgaatcatctttcgagcatttttaagcccccagagaaatcacatttgcataccaagtaagtggccaagaaaatgcacacatgtacttaacctacgtctgcaaagaagacagaga

SEQ ID NO: 28168 - DNA, 601 bp, Human
ttccagacacataacagccagtcccgaaagcgcagctgaaactctgtttcctttaaccattcagacatttttaaatgcatattctaagaattattaataaatgcaaatgaatgatttgccacagattcatgggctaaaatactaacctgcacctccccaaccagatgtgagccccactgtaagactgcacagaaaaccacaaaggcaggggcatgacacatatacctcataccattaggtgatgcaactagttttctttcctttttggaatgtaattttttatgatgagtaaacatggctkagtggaagaaaggaagcaacaaagtcctagagctccagtgttaggaagactttacaaagcacccagtaatttccacagtgacttgagatataaaaaatggtgaggagccagcttcactcccacctcaagctaagcatctactgtctactccattctaaccaatgcccagtgttttggagaatgaccatatgaacctatgggaatgcatcaggtttccaaagggttaaaacattcattagcattctcaatgctccaccactgtagttgctattttaattagtacattcaatctggagtatc

SEQ ID NO: 28169 - DNA, 601 bp, Human
gtaaactgtgtggctggttgcagtatctgttccagacacataacagccagtcccgaaagcgcagctgaaactctgtttcctttaaccattcagacatttttaaatgcatattctaagaattattaataaatgcaaatgaatgatttgccacagattcatgggctaaaatactaacctgcacctccccaaccagatgtgagccccactgtaagactgcacagaaaaccacaaaggcaggggcatgacacatatacctcataccattaggtgatgcaactagttttctttcctttttggaatrtaattttttatgatgagtaaacatggcttagtggaagaaaggaagcaacaaagtcctagagctccagtgttaggaagactttacaaagcacccagtaatttccacagtgacttgagatataaaaaatggtgaggagccagcttcactcccacctcaagctaagcatctactgtctactccattctaaccaatgcccagtgttttggagaatgaccatatgaacctatgggaatgcatcaggtttccaaagggttaaaacattcattagcattctcaatgctccaccactgtagttgctat

SEQ ID NO: 28170 - DNA, 601 bp, Human
ccctctgttacttcaaaggaatgaagtcctcaagaacctgcctgtccaaggattcctaaggaagctgtttatcccgctgtttatccccagagggtaaactgtgtggctggttgcagtatctgttccagacacataacagccagtcccgaaagcgcagctgaaactctgtttcctttaaccattcagacatttttaaatgcatattctaagaattattaataaatgcaaatgaatgatttgccacagattcatgggctaaaatactaacctgcacctccccaaccagatgtgagccccactrtaagactgcacagaaaaccacaaaggcaggggcatgacacatatacctcataccattaggtgatgcaactagttttctttcctttttggaatgtaattttttatgatgagtaaacatggcttagtggaagaaaggaagcaacaaagtcctagagctccagtgttaggaagactttacaaagcacccagtaatttccacagtgacttgagatataaaaaatggtgaggagccagcttcactcccacctcaagctaagcatctactgtctactccattctaaccaatgcccagtgttttgga

SEQ ID NO: 28171 - DNA, 601 bp, Human
tttccttggtatctacattgaaattatagtagaatctaatgctatcttttggttttcttcagtaagaaaacagtagggtagagacataggaaatgcttgtcacccatcttcaaaaactgaatcacatgccttcatccttttcttttacaccatccctctgttacttcaaaggaatgaagtcctcaagaacctgcctgtccaaggattcctaaggaagctgtttatcccgctgtttatccccagagggtaaactgtgtggctggttgcagtatctgttccagacacataacagccagtcccraaagcgcagctgaaactctgtttcctttaaccattcagacatttttaaatgcatattctaagaattattaataaatgcaaatgaatgatttgccacagattcatgggctaaaatactaacctgcacctccccaaccagatgtgagccccactgtaagactgcacagaaaaccacaaaggcaggggcatgacacatatacctcataccattaggtgatgcaactagttttctttcctttttggaatgtaattttttatgatgagtaaacatggcttagtggaagaaaggaagcaacaaagt

SEQ ID NO: 28172 - DNA, 601 bp, Human
tcgggacagcttccaatgtgaggatttggcacataaaaagaagaatattttgagtagcatacttatgactgctgttttctgttcttcccgctttatatcaattcttggaaaaccagctgcaagaacaaaagatccatccgtcttttgattaaatagtgcatcactaggactgttcctgtatacctgcaaatgctgacacctgcatagaaggagttcaaaatgcaaacactgctttatttaaatcaaaaaacacgtgtgtgtgtgtgtgtgtgtgtgtgtgtgtgtgtgtgtattttgccasctgttgttaatttagggccaccccagaatttatttgctgactacagtgctttccttggtatctacattgaaattatagtagaatctaatgctatcttttggttttcttcagtaagaaaacagtagggtagagacataggaaatgcttgtcacccatcttcaaaaactgaatcacatgccttcatccttttcttttacaccatccctctgttacttcaaaggaatgaagtcctcaagaacctgcctgtccaaggattcctaaggaagctgtttatcccgctgtttatccccagagggtaaa

SEQ ID NO: 28173 - DNA, 601 bp, Human
gtcaaagcacagaataaattctggccataatcaccaactacctgtcttgctcgggacagcttccaatgtgaggatttggcacataaaaagaagaatattttgagtagcatacttatgactgctgttttctgttcttcccgctttatatcaattcttggaaaaccagctgcaagaacaaaagatccatccgtcttttgattaaatagtgcatcactaggactgttcctgtatacctgcaaatgctgacacctgcatagaaggagttcaaaatgcaaacactgctttatttaaatcaaaaaayacgtgtgtgtgtgtgtgtgtgtgtgtgtgtgtgtgtgtgtattttgccacctgttgttaatttagggccaccccagaatttatttgctgactacagtgctttccttggtatctacattgaaattatagtagaatctaatgctatcttttggttttcttcagtaagaaaacagtagggtagagacataggaaatgcttgtcacccatcttcaaaaactgaatcacatgccttcatccttttcttttacaccatccctctgttacttcaaaggaatgaagtcctcaagaacctgcctgtcca

SEQ ID NO: 28174 - DNA, 601 bp, Human
atgggaaatgtaaggccaacttctgcaatgatcagacctttatttaaatgttacagataatgtatttcattttatatatacttttgagaccaagtctcgctctgtcaccctggcttgagtgcagtggtgcaatcacagttcactgcagcctcgaactcctggacttaagtgatcctcctgccttggccttccgagtagctggcactaaaggtgtgcaccaccaaacccagataattttttgtattttttgtagagaccgggtctcaaactcctggcctcacctgatcctcccacctcggcmtcccaacttaaagattaatttctaaccagacagctctaccactgaagagtcctaaaagcaccccaatttcaacattaaccatatattgatcagcaagcctttagtcaaagcacagaataaattctggccataatcaccaactacctgtcttgctcgggacagcttccaatgtgaggatttggcacataaaaagaagaatattttgagtagcatacttatgactgctgttttctgttcttcccgctttatatcaattcttggaaaaccagctgcaagaacaaaagatccatccgtcttttg

SEQ ID NO: 28175 - DNA, 601 bp, Human
gacttgtgaaacagatagatgttaatggagccgctgctggccctggacttgcggttctcatgcacactgactgacattttgcttccactcctaaaaataataataataataaattgaaaatgatgctcctgatgttcagaacagcagaacgaaagcaacaatggttttgcacaaaaaacagaacactttgttgttgaccatgccacctactattctagaatagtgtatggccattccaggacaaagccagagacaactacccggaaggaaggatattcactgctaatactgttgagctatktgaactctgcactgtttaaaaaaaaaaaaaaaatcactgcataaaaagcaggttcatcttggaaaacctgattgccaactttcaggccatcgaagtcttttagaatataagtcagcaaaagccaagaggagtgagtctcattcccacagctccctgtcctagtccagctcattcactgcgggccacttaaaatgccaggtctcctgctcttataatgccaggatgggcactggctttcatgccccatgcaacataaagccatgcgtaaaacaaacacctaataattaattccattaagaa

SEQ ID NO: 28176 - DNA, 601 bp, Human
tccaagacttctgggtggatggaattgtcaaagttgacctcactgtcctggctctctttcaggccaccactgaacatggcctcaaagtagcgactgcatgcagccagcactgcccggtggcaagggaaggtcctatttccggcatggagaaggacgtcagtgaagagacgctgctggcgtaaaagattcaggtgagtgaggacgctgtcagcgtaggaggacttgtgaaacagatagatgttaatggagccgctgctggccctggacttgcggttctcatgcacactgactgacattttgyttccactcctaaaaataataataataataaattgaaaatgatgctcctgatgttcagaacagcagaacgaaagcaacaatggttttgcacaaaaaacagaacactttgttgttgaccatgccacctactattctagaatagtgtatggccattccaggacaaagccagagacaactacccggaaggaaggatattcactgctaatactgttgagctatttgaactctgcactgtttaaaaaaaaaaaaaaaatcactgcataaaaagcaggttcatcttggaaaacctgattgccaactt

SEQ ID NO: 28177 - DNA, 601 bp, Human
tgaacttacacaatagcctaattatatgcatacttacatctatagctaaacttcttacctcatgctcactctctttagaatgtactgcatttaagaaggcagatgtttccaggtgctgacaaatgcagtaggaatcagcgagtacgggacagtggtgatgctgttccacacgtctaatgttggatcgtagcagtccaaagtcttgcatcgctgaatgccaaagtatcctccaaccacgtagagtttgtttccagaggccacagcatggcagctcatgcgctttgctgtcacatctcccacyttggtccactggtaagtctcactgttgaatttataagcagagcaggcagagaattctgtatcaccccccataataaaaatctggttccccagcacagctgctgctgtgtaacgccagggctggggacaggtggccggtacagtccacctgttttcacactgatcgtaacactgaactttggggagcttgtcatgactgacactggtacctccgaaagcaaataacttaagtttggcactcactactgcggcgttgctaacgccttctcggagtggggccaccatggtccatttgttgatt

SEQ ID NO: 28178 - DNA, 601 bp, Human
caggagaatggtgtgaacccaggaggcggagcttgcagtgagccaagatcatgccactgcactctagcctgggtgacagagcgagactctgtctcaaataataataataataataaaataaataaaaagctcttcaggagattctgaggctcagtaaaagctgagaaccactggctaatgccatggtgggggctgaggctgtggtcaacacaagtggataagttctaggggcaccagctctcttatttttacagctttggtagtacttctgcagtacagtctctgtggatcagatctcacyccatgtactgaacttacacaatagcctaattatatgcatacttacatctatagctaaacttcttacctcatgctcactctctttagaatgtactgcatttaagaaggcagatgtttccaggtgctgacaaatgcagtaggaatcagcgagtacgggacagtggtgatgctgttccacacgtctaatgttggatcgtagcagtccaaagtcttgcatcgctgaatgccaaagtatcctccaaccacgtagagtttgtttccagaggccacagcatggcagctcatgcgctttgctgtcaca

SEQ ID NO: 28179 - DNA, 601 bp, Human
gctactttttaagtaaaacatttaaaataagctaataattttggagagaataaactaggaatgaatttgagcaatacatttttaaaccctaatcattctacaaagggtttgaggaagcaaaatttgaatataaatgaagtatcacctgggatgacattggtgtcatggatgtgaagctcaagtttattcggtggcagtgcaacacgatgctccagtgctgatgccctagagccagaccccctgcattgacttcctaaccagctccacctcttactaagctctgctaactcgggcagcttascctccgtaatgcatgaaggttttttcatctataaaatgaagctagtaataattccccacggggttgttgtgaggatagaatgagatgatccgtgggaaacacgtggcaccgctgcaagcacacagtgagggctcaataaacattagctggcatacttaacagaggtcaggggttctcaacttggttgttcattggaatcatccggaaactttttaaaaatactgatgcttggaccccaccccagaccaaatgaaactaagtctctgggatgggcagtttttaaaaaagctcttcagggcc

SEQ ID NO: 28180 - DNA, 601 bp, Human
aatttagttttcatgtgcttgactctctcactggtagcgccaagggtgaagaggatgttatttcacatataacttaacactttacttgctctgtttcccagcgaccggaagggtatgattcagttcaaacacccagggtagggtgaagtcaagtgtttgccaacatgttcactctgggctgaaaaaggaggaaccaaaagtgaagtctaaagataacaagcagataatagtcaaagaaacctcattttcctaccacacagaaagctaattccactgccattatctcacagtaagttactayacgtcaagcactgggctaggtattttcgcctcttttaactcccctatcaattgacccaagtctgagttgggacagatcacaggagattaaagatcaaaccactcatttgacagagaagcaacctaaaactcaggaaggtctagaacttaaaactagggccagaatacacatgtggcttctctcctctttctgcctcaatttccttaccttgttccaaggattccagccagcctgcccattgtcattttttatgtaccaccaccctggtagcaatttttatggctcttctgtgcaaatata

SEQ ID NO: 28181 - DNA, 601 bp, Human
gaacgataataaaaaaaaaaaggacacacaacaacaacaacaacaacaaaatctagagaagaaacaaagcaaatcaaagcctaagttaggttgaggccacacggcaccatgaaaacagaggataatcaaagtaatttcctttctgcccttcccacccactggcagagcagcaggaggcagataaaacctcctaggtggatgagctttaagacctagggaaactttctgttaaacactctattaattccgttagcacctacatttggagggcagaggaatttgcagtttgggactgagaccyacctacccagcactttaaggcactccaaccccctcttaaatgttttagcactatcttgtgtagtaaactttagaaattttaaccaacattctccctgtcggaaattcaaagagtggctttgatcaggcgcttacgctgccctttaaaagcagcaaacttggccctgtcaaatttagttttcatgtgcttgactctctcactggtagcgccaagggtgaagaggatgttatttcacatataacttaacactttacttgctctgtttcccagcgaccggaagggtatgattcagttcaaaca

SEQ ID NO: 28182 - DNA, 601 bp, Human
taatagaggattcaagaacagaccccaactttgaaacagctgcagaaaattcatcctgctttcagaagccatgcagtgacacatacatctctcttggcagatttgcatcataaactacagagctgtaactgctacaatataaacgacactgactatgcccactgggggacaattagacatttgcattgcttagaacacatctaggaaccagggactgactgctggaaagtactgtgattcttttcttccaacagctcatttatttaggcccaactacagcccactcattcatggcatggayggacaaacacaattagtctaaagtactaaggtggagagaaatgttaaggatttatctgtcattagacaatgcaaacacagtcacaatgtaaaaggttgttatcagtcttaacccctattttctaaaatacagcaatgtgagaaacatggacgaaagcagttcgagttgcaaactttggtcttcccctgcacctcaggggaagcacctatttgagactagcactaatacctacgacggcacatgcttagtaaacaagcactccaactagcaaagaatgtattcacaactgatttccaactc

SEQ ID NO: 28183 - DNA, 601 bp, Human
gccggactaacatggtgaaaccctgtctctactaaatacaaaaaaattagccatgcttagcggcgcatgcctgtaatccgagctacttgggaggctggaacaggagaatcgcttgtacctgggaggcagaggttgcagtgagccgagatcgcgccattgcactccagcctgggcaacgagagcaaaactccatctcaaaaaaaaagaaagagagaaagaaagaaagaaagaaaaaggcagaaataaaagaaatctacatctcctggatttctacagaaaagaacagggtggaggatgttcygcaaatttgctgaaagtgtgttccccacccaagcaggggatgggatgtatggatgcagggtgctcacgtgaggctgttgtaggcatccaggtattcaggctttacattgtgaactgcaacagaggacagagaacaagaagtgaggtagggtgtgtacacagggaagaacttggggtgaggggagcccatcaaggccaggggtcccaggacagctgaggacattccagaccctcccatctccttcctggagcctcacaggcccccagagcccctgaaagggcagaaattggtcagctcagc

SEQ ID NO: 28184 - DNA, 601 bp, Human
taatcccagctactcgggaagctgaggcaggagaatatcttcaactcaggaggtggaggttgcagtcagccaagactgtgccactatctgccagcctgggtgacagagcgagaccctgtctcaaaaaagaaaaaagaaaaaaaaaaaaaaggccgggtgcggtggctcacacctgtaatcccagcactttgggaggctgaggcaggtggatcacctgagatcaggagttcaagaccagcctgaccaacatggtgaaatcccgtctctactaaaaatacaaaattagctgggcgtggtggcrcatgcctgtaatcccagctactcaggaggctgagacaagagaattgcttaaactggggaggcggaggttgcagtgagccgagattgcactactgcactccagcctggggcaacaagagtgaaactcagtctcggaaaaaaaaagaataaaagacagtgatccaggtaaagcaggcaaacaagaaataatgcttaaggcagaagaaagagaatgagcagtagtctggaactaaagagtgaaactgtcaatctgaggaactgagtcctgggtgggacagcacagcgaggcatggaggatttg

SEQ ID NO: 28185 - DNA, 601 bp, Human
ggcacggtggctcatgtctacaatcctagcactttgggaggccgaggaggtaggatcatttgagttcaggaattcaagaccagcctgggcaacatggagaaaccccgtctctaccaaaaaacacaaaaattagccgagcatggtggagcgcacctatagtcccagctactcaggaagctgaggtgggagtactgcttgagcctgggaaattgaggctcgagtgagccaagattatgccactgcactccagcctgtgtgacagagcaagaccctgtctcaaaaaaaaaaaaaaaaaaaaaaaggccgggagtggtggctcactcctgtaatcccagcactttgggaggccgaggcaggtggatcacctgaggtcagaagttcgagaccagcctgaccaacatgtgaaaccccatctctactaaagatacaaaattagccaggcctggtggcacaggccagtaatcccagctactcgggaagctgaggcaggagaatatcttcaactcaggaggtggaggttgcagtcagccaagactgtgccactatctgccagcctgggtgacagagcgagaccctgtctcaaaaaagaaaaaagaaaaaa

SEQ ID NO: 28186 - DNA, 601 bp, Human
ttcttctttttttttttaatatgtattttctttatagaagcaaagtctcactatgttgcccaggctggtttcaaactcctggcctcaagtgttcctcccacctcagcctcctaatctgctgggattataagcataagccaccatattcagtcctgaattttttcttttttagagacagggtcctcactgtgttgcccaggctggagtgcagtggctattcataggtgtgatggtattcaatcacggcctcgaactcctgggctcaagcagtcctcccaactcagcctcccaagtagctagractacaggtgagcaccttggcacacagcttgaactttaaattttatgtaattttaactaatataaatttcaatagctacatgtgaggccagggcgcagtggctcacacctgtaatctcagtagtccaggaggccaaggctgacggattgcttgagtccaggagttcaagaccagcctgggcaacatagcgaaaccctgtctctactaaaaatataaaaaattagctggctgtggtggtgcacacctgtagttccagctacttgggaggctgaggtgagagaatcatctgagcccgggagg

SEQ ID NO: 28187 - DNA, 601 bp, Human
attaaggagatacacctatctatctgcaggtcacagattattttcaaagacacgattatcagggctgtcaaaggatgaaatagattggcttacaagtgaactcttcatggctaggagtgttcaagggaagtttagaggaccatctgttatggctgtgctatgcagacactctaaaccagtactgtccaaaagtactttctgcatgagcctgtgtgtgtatgagtgagcatttgaaatgtagctagtatgactaagaaactgaattttttcttttttaaaatcttttcttctttttttttttaatatgtattttctttatagaagcaaagtctcactatgttgcccaggctggtttcaaactcctggcctcaagtgttcctcccacctcagcctcctaatctgctgggattataagcataagccaccatattcagtcctgaattttttcttttttagagacagggtcctcactgtgttgcccaggctggagtgcagtggctattcataggtgtgatggtattcaatcacggcctcgaactcctgggctcaagcagtcctcccaactcagcctcccaagtagctagaactacaggtgagcacc

SEQ ID NO: 28188 - DNA, 601 bp, Human
gtctgttacggaaaccaaataattgattaaggagatacacctatctatctgcaggtcacagattattttcaaagacacgattatcagggctgtcaaaggatgaaatagattggcttacaagtgaactcttcatggctaggagtgttcaagggaagtttagaggaccatctgttatggctgtgctatgcagacactctaaaccagtactgtccaaaagtactttctgcatgagcctgtgtgtgtatgagtgagcatttgaaatgtagctagtatgactaagaaactgaattttttcttttttaaaatcttttcttctttttttttttaatatgtattttctttatagaagcaaagtctcactatgttgcccaggctggtttcaaactcctggcctcaagtgttcctcccacctcagcctcctaatctgctgggattataagcataagccaccatattcagtcctgaattttttcttttttagagacagggtcctcactgtgttgcccaggctggagtgcagtggctattcataggtgtgatggtattcaatcacggcctcgaactcctgggctcaagcagtcctcccaactcagcctcccaa

SEQ ID NO: 28189 - DNA, 601 bp, Human
tagtgagaccctgtttctaaatggaaataataaaaataaaacataaataatatgttaatgtctgttacggaaaccaaataattgattaaggagatacacctatctatctgcaggtcacagattattttcaaagacacgattatcagggctgtcaaaggatgaaatagattggcttacaagtgaactcttcatggctaggagtgttcaagggaagtttagaggaccatctgttatggctgtgctatgcagacactctaaaccagtactgtccaaaagtactttctgcatgagcctgtgtgtrtatgagtgagcatttgaaatgtagctagtatgactaagaaactgaattttttcttttttaaaatcttttcttctttttttttttaatatgtattttctttatagaagcaaagtctcactatgttgcccaggctggtttcaaactcctggcctcaagtgttcctcccacctcagcctcctaatctgctgggattataagcataagccaccatattcagtcctgaattttttcttttttagagacagggtcctcactgtgttgcccaggctggagtgcagtggctattcataggtgtgatgg

SEQ ID NO: 28190 - DNA, 601 bp, Human
cccagaaattcaactccagcctgggcaatatagtgagaccctgtttctaaatggaaataataaaaataaaacataaataatatgttaatgtctgttacggaaaccaaataattgattaaggagatacacctatctatctgcaggtcacagattattttcaaagacacgattatcagggctgtcaaaggatgaaatagattggcttacaagtgaactcttcatggctaggagtgttcaagggaagtttagaggaccatctgttatggctgtgctatgcagacactctaaaccagtactgtcyaaaagtactttctgcatgagcctgtgtgtgtatgagtgagcatttgaaatgtagctagtatgactaagaaactgaattttttcttttttaaaatcttttcttctttttttttttaatatgtattttctttatagaagcaaagtctcactatgttgcccaggctggtttcaaactcctggcctcaagtgttcctcccacctcagcctcctaatctgctgggattataagcataagccaccatattcagtcctgaattttttcttttttagagacagggtcctcactgtgttgcccaggctg

SEQ ID NO: 28191 - DNA, 601 bp, Human
tctcagctcactgcaacatccacctcctggatttaagagactgtcctgcctatgcctcccaagtagctgggattacaggcgcatgccaccacgcccagctaatttttgtatttttagtagagacagggtttcaccttgttagccaggctggtcttgaactcctgacctcaggtgatgcacctgcctcagcctcccaaagtgctgggatacaggcatgagccaccgcgcccagccaagaagaaggaattgtctaacaactgtggtgctctccataggagatggatcaatggttcttacaagkttattaaaatgtagattcttgaaccctactcccagcgtacagctcaacatgattcagctgactatgtgagggactgaacttcaaggtacaaaaaatgtagggtatgctttaaaaagtcaggatcagccaggcgcagtggctcaggcctgtaatcccaacactctgggaggctgaggcaggagaggagcacttgagctcaggagtctgagatcagcctgggcaacatagcaagacctcatctctacaaaacaaacaaacaaacaaaacaaaacaactagcccaggcatggtggtgcatgtc

SEQ ID NO: 28192 - DNA, 601 bp, Human
ggttgcagtgagtcaagattgtgccagtgtactccagcctgggtggcagggtgagactccgtctcaagtaaataaataatcaactttgggaggctgaggcaggtggatcacctgaagtcggaaatttgagaccagcctcaccaacatggcgaaaccccatctctactaaaacaaaaattagctgggcgtggtgatgcacatctgtaatcctagctactcaggaggctgaggcaagagaatcgcttcaacctgggatgcaaaggttgtggtgagctgagatcgcaccactgcactccagccygggcaaaagagcaagactccgtctcaaaaaataaataaataaaaataaaaataaataaaaatcatattatctgcactgagttgaacaatgtcccctcaaaatttatgcccacccagaacctcagaatgtgaccttatttggaaataggtctctgtgggtataatcgacctaagatgagattatactaggtgagccctgagtccagtgactagtgtccttatcagaagtgggagatctggacacaggagaacactatgtgaagacagagacacacagagagaacagcatgtgacgagggag

SEQ ID NO: 28193 - DNA, 601 bp, Human
cttgaacccaggaggtagaggttgcagtgagtcaagattgtgccagtgtactccagcctgggtggcagggtgagactccgtctcaagtaaataaataatcaactttgggaggctgaggcaggtggatcacctgaagtcggaaatttgagaccagcctcaccaacatggcgaaaccccatctctactaaaacaaaaattagctgggcgtggtgatgcacatctgtaatcctagctactcaggaggctgaggcaagagaatcgcttcaacctgggatgcaaaggttgtggtgagctgagatcrcaccactgcactccagcctgggcaaaagagcaagactccgtctcaaaaaataaataaataaaaataaaaataaataaaaatcatattatctgcactgagttgaacaatgtcccctcaaaatttatgcccacccagaacctcagaatgtgaccttatttggaaataggtctctgtgggtataatcgacctaagatgagattatactaggtgagccctgagtccagtgactagtgtccttatcagaagtgggagatctggacacaggagaacactatgtgaagacagagacacacagagaga

SEQ ID NO: 28194 - DNA, 601 bp, Human
ggaggctgaggaaggtggatcacgaggtcaggagatcgagaccatcctggctaacacagtgaaaccccgtctctactaaaaatacaaaaaattagccaggcgtggtggcgggcacctatagtcccagctactcgggaggctgaagcaggagaatggcatgaacccaggaggcagagcttgcagtgagccgagatcatgccactgcactccagcctggacaacagagcgagactccatcttaaaaaaaaaaaaaaaaaattagttgggtgtggtggcacatgcctataatcccagttactcrggaggctgaggcaggagaatcgcttgaacccaggaggtagaggttgcagtgagtcaagattgtgccagtgtactccagcctgggtggcagggtgagactccgtctcaagtaaataaataatcaactttgggaggctgaggcaggtggatcacctgaagtcggaaatttgagaccagcctcaccaacatggcgaaaccccatctctactaaaacaaaaattagctgggcgtggtgatgcacatctgtaatcctagctactcaggaggctgaggcaagagaatcgcttcaacctgggatgca

SEQ ID NO: 28195 - DNA, 601 bp, Human
tgggccgggcacggtggctcacgcctgtaatcccagcactttgggaggctgaggaaggtggatcacgaggtcaggagatcgagaccatcctggctaacacagtgaaaccccgtctctactaaaaatacaaaaaattagccaggcgtggtggcgggcacctatagtcccagctactcgggaggctgaagcaggagaatggcatgaacccaggaggcagagcttgcagtgagccgagatcatgccactgcactccagcctggacaacagagcgagactccatcttaaaaaaaaaaaaaaaaaattagttgggtgtggtggcacatgcctataatcccagttactcgggaggctgaggcaggagaatcgcttgaacccaggaggtagaggttgcagtgagtcaagattgtgccagtgtactccagcctgggtggcagggtgagactccgtctcaagtaaataaataatcaactttgggaggctgaggcaggtggatcacctgaagtcggaaatttgagaccagcctcaccaacatggcgaaaccccatctctactaaaacaaaaattagctgggcgtggtgatgcacatctgtaatcctagcta

SEQ ID NO: 28196 - DNA, 601 bp, Human
atggtggtaaaggcatggctaccaggaagtgcgctccatcctgacagtgtgcctcatggggtagcagagtagtccccagaacagggctgggctgcatcccacatccagagaggtgtgctgagtggacactaacataccttattgtttttgagcttgttcatgcagtccatgagggctgggtagccacctgagaatcgccacaggtgcactgttgggggtgagaggtataggtcagtgagctgctgggacccccagcagatgacctccccaaggttggctaagtggtggggacgggggaggyggggtggcctggttccctgtagcagcaagactccctgagttccctctgccttggtggaagaccatgctggggaggggatgaccctagacacaagtctaggagacctggatttgagctccagctctgcccagcagccttggactgctctaggcctcaatgttctcatcttgaaaatgggaataatgttcccaccccaccttccttaaatagcaacaagaagatcagatgtgtcctgtaccctggaagcagtggcatgcataaggaagaccaccaggccttagaggggcagctgaacaaaag

SEQ ID NO: 28197 - DNA, 601 bp, Human
gctcccttcggaactccaggtactcctgtgggcatggtggtaaaggcatggctaccaggaagtgcgctccatcctgacagtgtgcctcatggggtagcagagtagtccccagaacagggctgggctgcatcccacatccagagaggtgtgctgagtggacactaacataccttattgtttttgagcttgttcatgcagtccatgagggctgggtagccacctgagaatcgccacaggtgcactgttgggggtgagaggtataggtcagtgagctgctgggacccccagcagatgacctccycaaggttggctaagtggtggggacgggggaggcggggtggcctggttccctgtagcagcaagactccctgagttccctctgccttggtggaagaccatgctggggaggggatgaccctagacacaagtctaggagacctggatttgagctccagctctgcccagcagccttggactgctctaggcctcaatgttctcatcttgaaaatgggaataatgttcccaccccaccttccttaaatagcaacaagaagatcagatgtgtcctgtaccctggaagcagtggcatgcataaggaaga

SEQ ID NO: 28198 - DNA, 601 bp, Human
actgccctgtctccccacctcccaagctgcagcggccatttggcctcattcacaggccctgacacacacctggtgtgcatgtttgcacacatgtgtatacaactctgctctgagcccatagggagggagaagccagaagccccagtctaggtgttggggcagctgcaaagcagcattgcagcagggaaattggggggcaggagggggtctgtcggagggaggcaccttgagcttgtatgtcctcagctcatagatgttgggacccattctgggctgtggctcattccagaagctgaactcraggagcagctggtttctcctggacagcagcatctggctccgctcccttcggaactccaggtactcctgtgggcatggtggtaaaggcatggctaccaggaagtgcgctccatcctgacagtgtgcctcatggggtagcagagtagtccccagaacagggctgggctgcatcccacatccagagaggtgtgctgagtggacactaacataccttattgtttttgagcttgttcatgcagtccatgagggctgggtagccacctgagaatcgccacaggtgcactgttgggggtgagaggta

SEQ ID NO: 28199 - DNA, 601 bp, Human
ctcaacctaccccagagatggtgcaccacgtagagctctcctatctgtgagaagaagccgcccactgcctcctggttctcctgccggtacttgatggcccgagccctggagaaggcacaataatatggggcagaagccagggctggtgcagagggtactgaggctgattccttggccacacttcacaggaggggcctaggtggaacccacggtcctccgggatgctgagagaaaggactgatggcggggtgttctaccaacggaggggtcacaaccttctaggagatcctcacctcctggytggatccttctcccagatccatgaggggcagaaggtaaagagttccctgtgatatggccctggaaaaggtggcccaccaggggccttggtggggcaggtgagcagggtacgcctcccccaaccccagtcttggtgctgccacttaccagttgttcccccactcgatcatggttcctggctgaaagagaaccaaagggatgatgggaatgagcccccacctcagattcatagcatcacagcttggcaaggaagggaaactgccctgtctccccacctcccaagctgcagcggccatttggc

SEQ ID NO: 28200 - DNA, 601 bp, Human
ccaagcactcttaacaaagcagacagcagccagagaaatcatactagaacaaaaatcaggtcgtgtcactgctatttgaaacaaatagtctctcattgcatttacaataaatcccaactcattccccctctcctgttccatctccccacattcttccctactcactccacactggcctccttgccacacctcaaaaccccgaaggcctttccccaccacagggcctttgcatgtgctgctctgtctacttggaatgcttttgcctagcaattcacagctggctccttctcatcctttagcyctcagcttacattttactccctcagagaggcattatttgtctacctagaccaatgtagatcccctatgtttttcaccatcatctctccctgccttttttttttttcttctttttttttgagacggagtctcgctctgttgccaggctggagtgcaatggcgtgatctcagctcactgcaacctccacctcccgggttcaactgattctcctgcctcatcctcccgagtatctgggactacaggcatgcgccaccacgcccagctaatttttgtatttttagtagagatggggtttcacca

SEQ ID NO: 28201 - DNA, 601 bp, Human
taccaagcactcttaacaaagcagacagcagccagagaaatcatactagaacaaaaatcaggtcgtgtcactgctatttgaaacaaatagtctctcattgcatttacaataaatcccaactcattccccctctcctgttccatctccccacattcttccctactcactccacactggcctccttgccacacctcaaaaccccgaaggcctttccccaccacagggcctttgcatgtgctgctctgtctacttggaatgcttttgcctagcaattcacagctggctccttctcatcctttasctctcagcttacattttactccctcagagaggcattatttgtctacctagaccaatgtagatcccctatgtttttcaccatcatctctccctgccttttttttttttcttctttttttttgagacggagtctcgctctgttgccaggctggagtgcaatggcgtgatctcagctcactgcaacctccacctcccgggttcaactgattctcctgcctcatcctcccgagtatctgggactacaggcatgcgccaccacgcccagctaatttttgtatttttagtagagatggggtttcac

SEQ ID NO: 28202 - DNA, 601 bp, Human
tctccttctcttgccccacacagacaattcatccacaagtcctgttggttccacctctagactaacaaatcttctgtggacttctcagcatcccactgccccatcccctcctgcctgaactagagtaatggcttcctgaagccctgctttctctcttgctcgcctaccaagcactcttaacaaagcagacagcagccagagaaatcatactagaacaaaaatcaggtcgtgtcactgctatttgaaacaaatagtctctcattgcatttacaataaatcccaactcattccccctctcctrttccatctccccacattcttccctactcactccacactggcctccttgccacacctcaaaaccccgaaggcctttccccaccacagggcctttgcatgtgctgctctgtctacttggaatgcttttgcctagcaattcacagctggctccttctcatcctttagctctcagcttacattttactccctcagagaggcattatttgtctacctagaccaatgtagatcccctatgtttttcaccatcatctctccctgccttttttttttttcttctttttttttgagacggagtctcgct

SEQ ID NO: 28203 - DNA, 601 bp, Human
ctacatttatatttctagtcgcaaacactcccaagggctccagactcctatatccatctactgcctacttgacatctctactttggtgtgtcagcatttttagtgtaacacttccggctgggtgcggtggctcatgcctataatcccagcactttgggaggccgaggctggtggactgcttgaggccaggagttcgaggccagtctggccaacatagcgaaactctgtactaaaaatagaaaaattagttgggcatggtactgcatgcctgtaatcccagctactcaggagcgtgaggcaygagaatcacttgaactcgggaagcggaggttgcagtgagctgagatcacactactgcactccagcctaggtgacagagcaagactgtgtctcaaagaaaaaaaaaaaaagtaacaattccaagggccaaaattacgctcctgaccccactgacttgctccttccctagacctcccagactcaggagatgacacacagcagctcaagcacgagcctgggagctcttctggaatgcccttctccttctcttgccccacacagacaattcatccacaagtcctgttggttccacctctagact

SEQ ID NO: 28204 - DNA, 601 bp, Human
tactaaaaatacaaaattagctggacatggtgacacacgcctgtaatcccagctactcgggaggctgaggcaggagaatggcttgaacctgggaggcggaggctacagtgagccaagatcatgccactgcactccaccctgggtgacagagtgagactgtgtctcaaaaataaataaaataaaataaaatataaaataataaaatagtttgtagaatcttccgttatagccctctgacagaagcactatcaccatcactatcttacagacgagggaacagcctcagcgaggtaaagaaccrtgcccaaggtcacaatgggcgtttgctaatccacatctcctaggcagaggcgtggccctggctatgttatcatcccctagagtactcacctaggcctgctggtatcctatggagtgtgccacttggatagaaacccattaactcattgtcttaaaagtgagttccccatcactggaggtaatcaagaaagactagatctccttgcagagaggattccatcctcagacagggttctcagcagaagacctccaaaggcttcactcacctgtatagtagacattttcatcccagcctctcttc

SEQ ID NO: 28205 - DNA, 601 bp, Human
agttcccggcacacagtgagggcttaattaacacccactgactctaggtggtttcaggttcctagcaaagtggcaaacaccttgagcaaaaaacttgttcaaggctgggcacagtagctcatgcctatgatcccagcactttggaaggctgaggtgggaggactgcttgagcccaggagtttgagacctgcctgggtgacatagtaagactgcatctctacaaaaacaaaaaccttattcaaaaacatttcctgcatgcttcctttgtgacagacactggagaaagcacttttcataaatsagtttgtgggccagatgtggtggctcatgcctgtaatcacagcactttgggaggccgaggcaggcggatcacctgaggtcaggagttcgagaccagcttggccaacatgataaaaccccgtctctactaaaaatacaaaattagctggacatggtgacacacgcctgtaatcccagctactcgggaggctgaggcaggagaatggcttgaacctgggaggcggaggctacagtgagccaagatcatgccactgcactccaccctgggtgacagagtgagactgtgtctcaaaaataaata

SEQ ID NO: 28206 - DNA, 601 bp, Human
actgcagaggcgagatcttcaaggggatcatgatcctagactccatgtgtcgcaccagggggactgcggagagagaaggcagaggtcacacagggggctcaagcaagccaacaacctcccctggccccacccacacatgctggcctttgagtgggcaggaggaggccccagatgctgcgacaggaatgtcccattgccctcgtggaagggcccatgaagagcaccagatccctcaaattatgggataagacaggagtttggtggtgatgagaataacattttcttaaattttaatagttayctgttggccaggcatggtggcttgtgcctataatcccagcacttagagaggccaagacaggcggatcacctgaggtcaggagttcgagactagcctgaccaacatggagaaaccctctctctactaaaaatacaaaattagccgggcgtagtggcacatgcttgtaatcctagctactcgggaggctgaggcaggagaatcgcttgaacctgggagtcagaggttgctgtgagccgagatcaggccattgcactccagcctgggcaacaagagcaaaactccgtctcaaaaaaaaagaaa

SEQ ID NO: 28207 - DNA, 601 bp, Human
ctctgggcagaatgtctgaacctcctcctgaccgtggtgacgaggtttgtttgtatttgtttttttgttttggcagttccaggcttttctccagcaggagggacttggctcagactgtccagcaagtgggtggcccagtggaaaccagggaattcctgagggcctggcctggcctcctctcttcccaccccacctctagccactggacatactaccttttgtgcaactaagctaaacagaggatttccaagggtgataactggggactggtggccttgagatgaggaattttagaagatawatgaaggcctaaaagatcactatctttcattcagggaaatcagaaactacttctagcagggggagggaggcaggcagggaaagtagaaagggcctgggcagagctgtaatcctcagaacttgtcagccttcagttcccccttgtctgaactgagcactgcccctcagagtcctcccagagccaagacaaaaccaagacagcaggaccaggagtgccactgtctgtcggggttgcctgagggagaaggggaaggaggtggaggtgtaggcagcatcactgcagaggcgagatcttcaaggg

SEQ ID NO: 28208 - DNA, 601 bp, Human
cgggcccgacgaagaactggtcctggcactgcgggctcagctggccgaaggctggcaagaagcactggttcatatgtactatgattggattggaagatggtccagtcatcaccaggcagtggccctggttctaggcggctggggcgtgtgagatgcagtagcggggcagaaggattcacttggtagtcccggagccccaagtttgagtgtaaaaaaaggggaaagcccttgagctgggcgctcagtaggctgtgctcgtgggctcggaaaaagccaatgatgcccacaccatactccacgcagtaccggtctagcagttcccgactccaggcatccaggttgacatacttgagcaggttctcataaatgaccaagacatagcggccatgggtattatcagtcaatgtgggcatgtcccctcggccaggtgccaactcagtgctataacgaaaacgactagactccaggatggccacaatttcctgccccagctgtgagtatgcactctccacaaacacaaggaccacgggttcagttcgagctgtctctggaggcctggggggccgaggtggaactggaggccgtgcagggccaggaccag

SEQ ID NO: 28209 - DNA, 601 bp, Human
tcccatagccaggtatagaatagatacactgctgcggatgaagagggaaatctcattggactaatacattcccctacaccctgcctggaccctctcattcctccccacctcccaagatgatgggtcaaaggtacctagcactattatgtggggtaccaaaggaagcccctttatttgtcccagaactgtgggaaaaggatacccttcccttctcagccatctcaggcctgggggctactgaggtagagggggaggggccaggccactctaatcccccttgtgggccctgctctggacctgmcccttagggaagcagggggcattttgctggtatgggaggctgggacatcagcccagactggaatgctgcagttcttcccgaagccacgagggcactggctgtccaagccggctcagcagcttcgacaactccaaattatggttccggaaaaaatccgtaaggaaaagacgggactgacaggagaaaatgaaggcagaaatggtaagaagtgggacacagaatcagatcctggaagtggagagggattcccctgcccctggctttacttacctcagtgtccatatctggatacctccggcc

SEQ ID NO: 28210 - DNA, 601 bp, Human
gccaggcgggcaggtgcgggtttgccagcacgcgggtgctctgcacgtctgggttggagggttttcagccattgcccacaagcatattgcaaagcaagtcctgaagcacattcaatccaaaccaaccctcactcggaggttcaccacggaaaacagggcctggcatggaaggagcccttggtgtccaggaaactggctccgggtctctgccccgtggccaccgggtggcgctgctgcagagcacttggcaccggctgcgcttcctcagagactgccctgagcaggcgactggtgggggccygggggcatgggacattggtggttctttctgacctgcacctgctggggttgatgccaactgtggactctctctcttctctccctttctcctttttctcttttctccattgctgtccgaagtactcggtatgggagtcccaaaagacagctccagttttacaggtaatgagtcttcattctccctaaaacccagcgagccgaaggccagggagcgggtgggaggactgcacccttgccgagcagggtgtgctggtgtattctctgaagccaaagcccccgagacccccaggctctgctcatc

SEQ ID NO: 28211 - DNA, 601 bp, Human
tctgggttggagggttttcagccattgcccacaagcatattgcaaagcaagtcctgaagcacattcaatccaaaccaaccctcactcggaggttcaccacggaaaacagggcctggcatggaaggagcccttggtgtccaggaaactggctccgggtctctgccccgtggccaccgggtggcgctgctgcagagcacttggcaccggctgcgcttcctcagagactgccctgagcaggcgactggtgggggcctgggggcatgggacattggtggttctttctgacctgcacctgctggggttgatgccaactgtggactctctctcttctctccctttctcctttttctcttttctccattgctgtccgaagtactcggtatgggagtcccaaaagacagctccagttttacaggtaatgagtcttcattctccctaaaacccagcgagccgaaggccagggagcgggtgggaggactgcacccttgccgagcagggtgtgctggtgtattctctgaagccaaagcccccgagacccccaggctctgctcatcaccctctgtgcctacccacaggatgctgtgcaatgtcctgatggaaa

SEQ ID NO: 28212 - DNA, 601 bp, Human
tgcgtacagtttgtgtttgaggtcacttttatctttaagacactagctggccgggcgcggtgactcacacctgtaaccccagcactttggaaggctggggcgggcggatcacctgaggtcaggagttccagcctggccaacatggtgaaaccccatgtctactaaaaatacaaaaattagctgggcgtggtaggggcgcctgtaatcccagctactcaggaggctgaggcaggagaattgcttgaacccagaagggggaggttgcagtgagccgagatcatatcactgcactccagcctasgccgtagagtaagactctgtctcgaaaaaaaaaaaaaaagacaatagctggttatagaatgatttgccccttgctttgaagttgctggataggcgctatctcagggtgaagtctggagttattaaggcaaaaggaattgccttacctcagcccaccagattggttcagttggagccctggggcccatatggttcaatctgaatcagccttgcctgacttggcctcgtttccctttcgatgtggtttctaaaccaggatgggagaattctgtagaacggcataacttcatttccaaacaat

SEQ ID NO: 28213 - DNA, 601 bp, Human
tttgggccgcagcagctgtaccctgcactatctgcagggctgctgtgtgaactgctcagcccagttctatgccatgccagggacaaaatgaaagcttgcccaggggtggaacaaaccacctggtgaggcaggaatgacagccaccctcacatggcacagggcagagtccacagtttgtaggacaccatcacactctcagccagtgctcacaggagcccatgaagggatcaaactatgctaggaaccctaaaatgacgtaatgcctgtcggagccaccacggtggtttcaggtctccagccctcccattgttaggtgccctttctgtggcctcacactccccattagaagcatgtgttcaagacaagctggacaataaaaatttaatagatgtaatggttgagaacctaacacttattatctcacctaatcctctatcaacccagggaggcaggtgctattcccagttcagggaagctgagcctctggctataaacaggtgcaggggcctcacctggcctctggccacagggggttccacctggtgctctttgcctcaacgcttgcggccagtgctcagctgtggggtaaccgtactggggt

SEQ ID NO: 28214 - DNA, 601 bp, Human
gttcagggaagctgagcctctggctataaacaggtgcaggggcctcacctggcctctggccacagggggttccacctggtgctctttgcctcaacgcttgcggccagtgctcagctgtggggtaaccgtactggggtagggacagattccttgtccccccagatgagggtgacagggaggtggcctgtatgtctcctgagcttccttctgacttcagtgtctgggacccagatactggaaggaaccaaaaagtcacaacataaaggctgcgtaaactgaaccaggatgcagccacagagcrgagggctttagaagtcatgttttaggtctaggggcggtggctcatgcccgtaatcccagcactttgggagattgaggcgggtggatcacaaggataggagttcgagaccagcctggccaatatggtgaaaccccatctctactaaaaatacaaaaaaattagcggggcgtggtggcaggcacctgtaatcccagctactcaggaggctgaggcaggagaattgcttgaatctgggaggcggaggttgcagtgagccatgatcgcaccactgcactccagcctggatgacagagcgacact

SEQ ID NO: 28215 - DNA, 601 bp, Human
ctctccgtcctcctcttctgtcagtcaagtctccgtctgtctcgtcctcataaggtcacctgtgatggcactgagggcccacttagctaagccaggacattctccccactgcagagtactcacgttaatcccatctgcaaagtccctctttctacctaaggtcacattcccaggttccagggacgtgatacctttggagaaccattatttagttgactgcagagaagaaagtagaaaaaggagggcaggggggcgggggtcctgacgacagggtggtcaggaagcagaagcgagcaaggamgccacgtggtggtccagagaaagagccttcgggggccaaggggacaaccaaggcacagccctaaggccgagtgttggggagaaggggatgcaggggatagagctgggggtcagggtgcagatctggtggagactttggctttgaccctctgcgagatggaagcccctggagggcttttgcatggaggaaatttgacctgatttaaaaggtctgccaaggctcgccctggctgctgcactgggaatggcgagtcatgaggatgtcccagagttcagcgtgtgcacgatcccatgtactcgg

SEQ ID NO: 28216 - DNA, 601 bp, Human
ggatgcaggggatagagctgggggtcagggtgcagatctggtggagactttggctttgaccctctgcgagatggaagcccctggagggcttttgcatggaggaaatttgacctgatttaaaaggtctgccaaggctcgccctggctgctgcactgggaatggcgagtcatgaggatgtcccagagttcagcgtgtgcacgatcccatgtactcggaaggcacatcctgatgtggcagggctgtcgtggagcctgggaggccgcatttctgatctcatgctgatgctggcccatggaccacsctttgcctggggaaggtgcagggagagaggatggaagcagagagctaggaggctattgtgagaaaccacccaagagccgctggaggctcagagcagggtgggcaccgtggaggtggggagacgggtcagattctggactaatttgcaggggaagccgcggcaggggctgaacttcaggctccagtgatgggaggattagtcaaggagggctccccagggtttgacctgagcacaggtgagcgagacctcccgggagctgatgctgccgcaggctgccctccctggcccacaccagcccca

SEQ ID NO: 28217 - DNA, 601 bp, Human
gatgtggcagggctgtcgtggagcctgggaggccgcatttctgatctcatgctgatgctggcccatggaccacgctttgcctggggaaggtgcagggagagaggatggaagcagagagctaggaggctattgtgagaaaccacccaagagccgctggaggctcagagcagggtgggcaccgtggaggtggggagacgggtcagattctggactaatttgcaggggaagccgcggcaggggctgaacttcaggctccagtgatgggaggattagtcaaggagggctccccagggtttgacckgagcacaggtgagcgagacctcccgggagctgatgctgccgcaggctgccctccctggcccacaccagccccagggcctagagtgcccctcccccacccaccctctccttgcctgcctgacaaactcctaaacacccttcaaaacccagtctttgtcggccgcactttgggaggctgaggcgggcagatcacttgaggtcaggagttcgagaccagcctggccaacatggtgaaacctcatctctactaaaaatagaaaaatcagctgggcttggtggcatgcacctgtagtccagctac

SEQ ID NO: 28218 - DNA, 601 bp, Human
ggatggaagcagagagctaggaggctattgtgagaaaccacccaagagccgctggaggctcagagcagggtgggcaccgtggaggtggggagacgggtcagattctggactaatttgcaggggaagccgcggcaggggctgaacttcaggctccagtgatgggaggattagtcaaggagggctccccagggtttgacctgagcacaggtgagcgagacctcccgggagctgatgctgccgcaggctgccctccctggcccacaccagccccagggcctagagtgcccctcccccacccacyctctccttgcctgcctgacaaactcctaaacacccttcaaaacccagtctttgtcggccgcactttgggaggctgaggcgggcagatcacttgaggtcaggagttcgagaccagcctggccaacatggtgaaacctcatctctactaaaaatagaaaaatcagctgggcttggtggcatgcacctgtagtccagctactcaggagactgaagcaggagaatctcctgaagccaggaggcaaaggttgcagcgagccaagattgtgccactgcactcccgcctgggcaacagaatgagact

SEQ ID NO: 28219 - DNA, 601 bp, Human
accagccccagggcctagagtgcccctcccccacccaccctctccttgcctgcctgacaaactcctaaacacccttcaaaacccagtctttgtcggccgcactttgggaggctgaggcgggcagatcacttgaggtcaggagttcgagaccagcctggccaacatggtgaaacctcatctctactaaaaatagaaaaatcagctgggcttggtggcatgcacctgtagtccagctactcaggagactgaagcaggagaatctcctgaagccaggaggcaaaggttgcagcgagccaagatygtgccactgcactcccgcctgggcaacagaatgagactccatctcccaaaaaaaaaaaataaccccagtcttggatattctggacatgtgataccccttggatgaaccttgaaccttgaggacattacactcactgaaacaagccacaaaaaggacacacggtgtgactgcatttgtctaaggtgcctagagtagttaaattcataaataccagagaatgatgggtgctggggctggaggcagggagcggggaaggggagttactgttcaatgggtacagtttcagtttaggaatatgac

SEQ ID NO: 28220 - DNA, 601 bp, Human
aactcctaaacacccttcaaaacccagtctttgtcggccgcactttgggaggctgaggcgggcagatcacttgaggtcaggagttcgagaccagcctggccaacatggtgaaacctcatctctactaaaaatagaaaaatcagctgggcttggtggcatgcacctgtagtccagctactcaggagactgaagcaggagaatctcctgaagccaggaggcaaaggttgcagcgagccaagattgtgccactgcactcccgcctgggcaacagaatgagactccatctcccaaaaaaaaaaaataaccccagtcttggatattctggacatgtgataccccttggatgaaccttgaaccttgaggacattacactcactgaaacaagccacaaaaaggacacacggtgtgactgcatttgtctaaggtgcctagagtagttaaattcataaataccagagaatgatgggtgctggggctggaggcagggagcggggaaggggagttactgttcaatgggtacagtttcagtttaggaatatgacagggagatggatggtggtgatggttacacaactatgcgaatgtacttactgccattgaa

SEQ ID NO: 28221 - DNA, 601 bp, Human
gtggcatgcacctgtagtccagctactcaggagactgaagcaggagaatctcctgaagccaggaggcaaaggttgcagcgagccaagattgtgccactgcactcccgcctgggcaacagaatgagactccatctcccaaaaaaaaaaaataaccccagtcttggatattctggacatgtgataccccttggatgaaccttgaaccttgaggacattacactcactgaaacaagccacaaaaaggacacacggtgtgactgcatttgtctaaggtgcctagagtagttaaattcataaataycagagaatgatgggtgctggggctggaggcagggagcggggaaggggagttactgttcaatgggtacagtttcagtttaggaatatgacagggagatggatggtggtgatggttacacaactatgcgaatgtacttactgccattgaactatgcttgaaaaaggttaaaatagtaaatttcatcatatatattttaccacaacttaaagtctctttgataaatgcagtaatgttttaattaaacaaaaagaatgaaagggatcttcatgagcaggtgtggattggtttttaggatgtatt

SEQ ID NO: 28222 - DNA, 601 bp, Human
attcataaataccagagaatgatgggtgctggggctggaggcagggagcggggaaggggagttactgttcaatgggtacagtttcagtttaggaatatgacagggagatggatggtggtgatggttacacaactatgcgaatgtacttactgccattgaactatgcttgaaaaaggttaaaatagtaaatttcatcatatatattttaccacaacttaaagtctctttgataaatgcagtaatgttttaattaaacaaaaagaatgaaagggatcttcatgagcaggtgtggattggtttytaggatgtattgtgagtgaaaaaatcaaagtgcagaaacatatgggtagtgtgccacccctcctggaagaaagatgggggataagaaaatacatgtgtctgaaatataaaaacagaaaacggagccctgggtcccctcctctgagaagccctgccaggagcgtgagtgccctaaccacagacttagccccttcggggcccagcgcaccgtgccctcctgggctctctcctcctgggcctggatgtgggaggcatctgggaaaagtcaggaggaagacgaggaggaagcagtgagcaggtg

SEQ ID NO: 28223 - DNA, 601 bp, Human
atggatggtggtgatggttacacaactatgcgaatgtacttactgccattgaactatgcttgaaaaaggttaaaatagtaaatttcatcatatatattttaccacaacttaaagtctctttgataaatgcagtaatgttttaattaaacaaaaagaatgaaagggatcttcatgagcaggtgtggattggtttttaggatgtattgtgagtgaaaaaatcaaagtgcagaaacatatgggtagtgtgccacccctcctggaagaaagatgggggataagaaaatacatgtgtctgaaatayaaaaacagaaaacggagccctgggtcccctcctctgagaagccctgccaggagcgtgagtgccctaaccacagacttagccccttcggggcccagcgcaccgtgccctcctgggctctctcctcctgggcctggatgtgggaggcatctgggaaaagtcaggaggaagacgaggaggaagcagtgagcaggtgaacaagccacccgtctgtccgtgctggagccctggtgctgggaaggaaagtgctagaggtggggagagattcctgggctctccctgggtgggcacatccgggaggag

SEQ ID NO: 28224 - DNA, 601 bp, Human
aaagaatgaaagggatcttcatgagcaggtgtggattggtttttaggatgtattgtgagtgaaaaaatcaaagtgcagaaacatatgggtagtgtgccacccctcctggaagaaagatgggggataagaaaatacatgtgtctgaaatataaaaacagaaaacggagccctgggtcccctcctctgagaagccctgccaggagcgtgagtgccctaaccacagacttagccccttcggggcccagcgcaccgtgccctcctgggctctctcctcctgggcctggatgtgggaggcatctgrgaaaagtcaggaggaagacgaggaggaagcagtgagcaggtgaacaagccacccgtctgtccgtgctggagccctggtgctgggaaggaaagtgctagaggtggggagagattcctgggctctccctgggtgggcacatccgggaggaggaggctgggggggcagcagcaggtccctcgggcggcggatgcatttgatgcatggatgcatttgatacctcagggcagttgagctgcagcaggaagacaacaacagagccccggcaggtggatcctgaaaaccgacggcctccacccccgg

SEQ ID NO: 28225 - DNA, 601 bp, Human
ccgtgccctcctgggctctctcctcctgggcctggatgtgggaggcatctgggaaaagtcaggaggaagacgaggaggaagcagtgagcaggtgaacaagccacccgtctgtccgtgctggagccctggtgctgggaaggaaagtgctagaggtggggagagattcctgggctctccctgggtgggcacatccgggaggaggaggctgggggggcagcagcaggtccctcgggcggcggatgcatttgatgcatggatgcatttgatacctcagggcagttgagctgcagcaggaagacarcaacagagccccggcaggtggatcctgaaaaccgacggcctccacccccgggcttcctgactcaaatcacagccgctcactaaccggggctcagcttcagctgtgctgtatttcagtgtctgagatgtttggggatgagtgccagtgtcgccaggctgccggccagatttccatacaccccccacccacaaacatgctgcctttctggcttctcttgagaggttggcagatctctagcaccaggtccgccttcccacgtgcagcatttgggcatgggccttctcccatgggtgcccccca

SEQ ID NO: 28226 - DNA, 601 bp, Human
gctctctcctcctgggcctggatgtgggaggcatctgggaaaagtcaggaggaagacgaggaggaagcagtgagcaggtgaacaagccacccgtctgtccgtgctggagccctggtgctgggaaggaaagtgctagaggtggggagagattcctgggctctccctgggtgggcacatccgggaggaggaggctgggggggcagcagcaggtccctcgggcggcggatgcatttgatgcatggatgcatttgatacctcagggcagttgagctgcagcaggaagacaacaacagagccccgrcaggtggatcctgaaaaccgacggcctccacccccgggcttcctgactcaaatcacagccgctcactaaccggggctcagcttcagctgtgctgtatttcagtgtctgagatgtttggggatgagtgccagtgtcgccaggctgccggccagatttccatacaccccccacccacaaacatgctgcctttctggcttctcttgagaggttggcagatctctagcaccaggtccgccttcccacgtgcagcatttgggcatgggccttctcccatgggtgccccccagtggtggctactcc

SEQ ID NO: 28227 - DNA, 601 bp, Human
ctagaggtggggagagattcctgggctctccctgggtgggcacatccgggaggaggaggctgggggggcagcagcaggtccctcgggcggcggatgcatttgatgcatggatgcatttgatacctcagggcagttgagctgcagcaggaagacaacaacagagccccggcaggtggatcctgaaaaccgacggcctccacccccgggcttcctgactcaaatcacagccgctcactaaccggggctcagcttcagctgtgctgtatttcagtgtctgagatgtttggggatgagtgccagygtcgccaggctgccggccagatttccatacaccccccacccacaaacatgctgcctttctggcttctcttgagaggttggcagatctctagcaccaggtccgccttcccacgtgcagcatttgggcatgggccttctcccatgggtgccccccagtggtggctactccgtcctcactctccatacctcctggccacaagggcttctgagttcagaaaggagagacgcagccctgtgaagccacccctggctggttttctgtcctatggtttttgagggttattaagaattattcacccca

SEQ ID NO: 28228 - DNA, 601 bp, Human
tttcagtgtctgagatgtttggggatgagtgccagtgtcgccaggctgccggccagatttccatacaccccccacccacaaacatgctgcctttctggcttctcttgagaggttggcagatctctagcaccaggtccgccttcccacgtgcagcatttgggcatgggccttctcccatgggtgccccccagtggtggctactccgtcctcactctccatacctcctggccacaagggcttctgagttcagaaaggagagacgcagccctgtgaagccacccctggctggttttctgtcctrtggtttttgagggttattaagaattattcaccccacgctgggcttgttgctggtgaggcccagtgctctgagccgcacctggggaagcgtgacactcagagggaagcagccctgtccgagagccagaagctcaggggcacctttctctccggcctcttggagggagctgtcacttgcagaggggctcccctcgctccatgagtcccaccccacgaccagttctttgctcatggagcacaatcgcgtcctgacagcagccatggagcaaagtctgatgcacagcgcatttagctcgggcag

SEQ ID NO: 28229 - DNA, 601 bp, Human
agggttattaagaattattcaccccacgctgggcttgttgctggtgaggcccagtgctctgagccgcacctggggaagcgtgacactcagagggaagcagccctgtccgagagccagaagctcaggggcacctttctctccggcctcttggagggagctgtcacttgcagaggggctcccctcgctccatgagtcccaccccacgaccagttctttgctcatggagcacaatcgcgtcctgacagcagccatggagcaaagtctgatgcacagcgcatttagctcgggcagtcattcatcsatcttgcccatgaggcagccaccaccacagcagtgccgctcagggccgggagtatgtgccgttggagaaacactggacaagaggccagaatggatgtcacccaccatgcaccagctgtgggatgtcagttgctccatctacaaaaataacaattcagtcctcatgtgcaggtgctgggaaagattcaatgagatacaactgaatacaccgccctggctttaaggacatagactcatcccagcaacatccacagagcccctgctggggactgccttggtttcctaggactgctgtaacaaa

SEQ ID NO: 28230 - DNA, 601 bp, Human
tcccaccccacgaccagttctttgctcatggagcacaatcgcgtcctgacagcagccatggagcaaagtctgatgcacagcgcatttagctcgggcagtcattcatccatcttgcccatgaggcagccaccaccacagcagtgccgctcagggccgggagtatgtgccgttggagaaacactggacaagaggccagaatggatgtcacccaccatgcaccagctgtgggatgtcagttgctccatctacaaaaataacaattcagtcctcatgtgcaggtgctgggaaagattcaatgagrtacaactgaatacaccgccctggctttaaggacatagactcatcccagcaacatccacagagcccctgctggggactgccttggtttcctaggactgctgtaacaaagtaacataacctgggggcctgaaacaacagacaccgttctgtcaccttctggaggccagaggtctgataccaaggtgttggcagggccaggttccctgtaaaggctcgggggagggtccgccccatgcctctttcagctcctgggggttgccaacagtccttggcttgtagacgtgtcactctggtctctgcc

SEQ ID NO: 28231 - DNA, 601 bp, Human
agccatggagcaaagtctgatgcacagcgcatttagctcgggcagtcattcatccatcttgcccatgaggcagccaccaccacagcagtgccgctcagggccgggagtatgtgccgttggagaaacactggacaagaggccagaatggatgtcacccaccatgcaccagctgtgggatgtcagttgctccatctacaaaaataacaattcagtcctcatgtgcaggtgctgggaaagattcaatgagatacaactgaatacaccgccctggctttaaggacatagactcatcccagcaacrtccacagagcccctgctggggactgccttggtttcctaggactgctgtaacaaagtaacataacctgggggcctgaaacaacagacaccgttctgtcaccttctggaggccagaggtctgataccaaggtgttggcagggccaggttccctgtaaaggctcgggggagggtccgccccatgcctctttcagctcctgggggttgccaacagtccttggcttgtagacgtgtcactctggtctctgccttcgtagtctcatggacttctgtgtctgcattttctctccttgtaaatcacca

SEQ ID NO: 28232 - DNA, 601 bp, Human
gaatggatgtcacccaccatgcaccagctgtgggatgtcagttgctccatctacaaaaataacaattcagtcctcatgtgcaggtgctgggaaagattcaatgagatacaactgaatacaccgccctggctttaaggacatagactcatcccagcaacatccacagagcccctgctggggactgccttggtttcctaggactgctgtaacaaagtaacataacctgggggcctgaaacaacagacaccgttctgtcaccttctggaggccagaggtctgataccaaggtgttggcagggcmaggttccctgtaaaggctcgggggagggtccgccccatgcctctttcagctcctgggggttgccaacagtccttggcttgtagacgtgtcactctggtctctgccttcgtagtctcatggacttctgtgtctgcattttctctccttgtaaatcaccagtcacatagggtgtaggacccaccctaacacagtacgacctcatcttcgctaattacattgaagaaggccctattcccaaatgaggtcacctctaagcttctaagtagacatgaattctgtggggatactgttcgacccagt

SEQ ID NO: 28233 - DNA, 601 bp, Human
acagtccttggcagtttcttcattccttttgccttctttattcttctcaatgggtttgttactgagagctgcctccatccctgtcctgtggcaggagagggcaaggagacagcccacaggggagcctgtcgggcccgggagggcagggcctggacacggggaggcctcccaggccgagagggtggtgctccagagcctctgggccccacccccggctggcaggacagtgtcggttttctcgtttcagatggcagagcagctcatgaccttggcctatgataatggcatcaacctcttcgayacagcagaagtctacgcagccggcaagtacgtgtcttttcacacgggaaaaagtggttcagaatgcctgggcagagccggagctacagggattcctgccgctcgcgttcccaagagtgctcacaaatgcaccttgcaccctgctttcatttttaaactctgaatggctttaggaggtgctattttcatggggctggaattgcagaacacttggacactgatcacttgctgaactccccgtggagccaccagggggaccacagtccctctggtgccaaagatgctgtgctgggtgagaggc

SEQ ID NO: 28234 - DNA, 601 bp, Human
gtgctcacaaatgcaccttgcaccctgctttcatttttaaactctgaatggctttaggaggtgctattttcatggggctggaattgcagaacacttggacactgatcacttgctgaactccccgtggagccaccagggggaccacagtccctctggtgccaaagatgctgtgctgggtgagaggcgcgatggagctgctgtcctgggctctcctgatgtgcctgacattttgacatttcatgtctcacttgtgcaactagggctgcagggcctcagagctggggagggcaggctccggccragtgctgtggggagcacttcccatcttggcggtgaactttcctgctcaattatgtaaaagctcagccttcttcagccaggctgttggcttcaattttaaagactggctgtaatcaaatcatccactctcctgcatcgggtttccagaagtcagcttttgtttgtgaaatcatttgttggccctctcttcatcctccttctgcccccctcctgcctggggccagccaagttcccgtcagccgggcaggctgcaggcctgggctgctgtgcaccatagctgcttggcccgcagctgcttcgt

SEQ ID NO: 28235 - DNA, 601 bp, Human
ggctctcctgatgtgcctgacattttgacatttcatgtctcacttgtgcaactagggctgcagggcctcagagctggggagggcaggctccggccaagtgctgtggggagcacttcccatcttggcggtgaactttcctgctcaattatgtaaaagctcagccttcttcagccaggctgttggcttcaattttaaagactggctgtaatcaaatcatccactctcctgcatcgggtttccagaagtcagcttttgtttgtgaaatcatttgttggccctctcttcatcctccttctgcccycctcctgcctggggccagccaagttcccgtcagccgggcaggctgcaggcctgggctgctgtgcaccatagctgcttggcccgcagctgcttcgtgggccctgggtggttacctgcaactgcagcggggcccagagcacccggcggcagggaacccaactgggccctgctcaagttcccacccagagcctggggagcgcacagccctgggggctgccgctgggaccctcaaaccgcctccagcccccatctgcagcccttttggccctccggatggcacagccccctcccactccctcca

SEQ ID NO: 28236 - DNA, 601 bp, Human
ccactctcctgcatcgggtttccagaagtcagcttttgtttgtgaaatcatttgttggccctctcttcatcctccttctgcccccctcctgcctggggccagccaagttcccgtcagccgggcaggctgcaggcctgggctgctgtgcaccatagctgcttggcccgcagctgcttcgtgggccctgggtggttacctgcaactgcagcggggcccagagcacccggcggcagggaacccaactgggccctgctcaagttcccacccagagcctggggagcgcacagccctgggggctgcygctgggaccctcaaaccgcctccagcccccatctgcagcccttttggccctccggatggcacagccccctcccactccctccatactggcagcagcttcccatcaaagtgaactgctttccagacagatgagcccagcggaggggtctgaggtcaaaaagcccagtgcagatgccaagccgagaggcacctcccgtcccgagccccccacctcttcgctgcctgctttggcctgggttatgctgccctgaagaatgtgtgggaggcagctccgtgcagcctccgtggatgaggccgggca

SEQ ID NO: 28237 - DNA, 601 bp, Human
cagccgggcaggctgcaggcctgggctgctgtgcaccatagctgcttggcccgcagctgcttcgtgggccctgggtggttacctgcaactgcagcggggcccagagcacccggcggcagggaacccaactgggccctgctcaagttcccacccagagcctggggagcgcacagccctgggggctgccgctgggaccctcaaaccgcctccagcccccatctgcagcccttttggccctccggatggcacagccccctcccactccctccatactggcagcagcttcccatcaaagtgaacygctttccagacagatgagcccagcggaggggtctgaggtcaaaaagcccagtgcagatgccaagccgagaggcacctcccgtcccgagccccccacctcttcgctgcctgctttggcctgggttatgctgccctgaagaatgtgtgggaggcagctccgtgcagcctccgtggatgaggccgggcacaccccatgtcacagcagccacactccgtcctctgtcactcgcagtttccatgttcccctgtttaactggacacccagagctggtgagctgggcaagttccctgggtctccggc

SEQ ID NO: 28238 - DNA, 601 bp, Human
ctagcatctgactctgccgttcagtgcaggaaatgagagggacacgtgcacccacacacatgcacacatgtatacacacacatatacacaagcatgcacagatctgctggaaatccagcccttgaccctgagtacatgttgattgtctctcaaaacagagcgtgacttgatgaataatttacctttgaaaaaagatacttgtcccggcgcggtggctcacgcctggaatcccagcactttgggaggccacagtgggcggatcactcgagatgaggagttcgagaccagcctggccaacatrgtgaaaccccgtctctactaaaaatacaaaaattagccgggcgtggtggcaggtgcctgtagtcccagctacttgggaggctgaggcaggagaactgcttgaacccaggaggcagaggttgcagagagccgagatctcgccactacattccagcttgggtgatagagcgagactccatttcaaaaaaaaaaaaacaagatacttctctggaaattttgcccacctaatgttgccaggcattttccctggtgaattttcagctgactaggaaatgggatgctcgacagcagctccttcctt

SEQ ID NO: 28239 - DNA, 601 bp, Human
acacgtgcacccacacacatgcacacatgtatacacacacatatacacaagcatgcacagatctgctggaaatccagcccttgaccctgagtacatgttgattgtctctcaaaacagagcgtgacttgatgaataatttacctttgaaaaaagatacttgtcccggcgcggtggctcacgcctggaatcccagcactttgggaggccacagtgggcggatcactcgagatgaggagttcgagaccagcctggccaacatagtgaaaccccgtctctactaaaaatacaaaaattagccggrcgtggtggcaggtgcctgtagtcccagctacttgggaggctgaggcaggagaactgcttgaacccaggaggcagaggttgcagagagccgagatctcgccactacattccagcttgggtgatagagcgagactccatttcaaaaaaaaaaaaacaagatacttctctggaaattttgcccacctaatgttgccaggcattttccctggtgaattttcagctgactaggaaatgggatgctcgacagcagctccttccttctgtgtgagagctggggccgccactgcttagacacgtgtct

SEQ ID NO: 28240 - DNA, 601 bp, Human
aattagccgggcgtggtggcaggtgcctgtagtcccagctacttgggaggctgaggcaggagaactgcttgaacccaggaggcagaggttgcagagagccgagatctcgccactacattccagcttgggtgatagagcgagactccatttcaaaaaaaaaaaaacaagatacttctctggaaattttgcccacctaatgttgccaggcattttccctggtgaattttcagctgactaggaaatgggatgctcgacagcagctccttccttctgtgtgagagctggggccgccactgcttaracacgtgtctgcaggggaacatgccacagccatcctagtggggggcaataacacagctgctcccactccctcgggccaaccctgtctgtggaatgagctactgagccaaggcgggtgttaacagcctggctctctggccccagtgacattttcacagagggaaccaagtggccagtggccacagtgggtctgggtttgatttttctgtttggctgtgatgagagctcggtgtcttgttttgcagggctgaagtggtactgggaaacatcattaagaagaaaggatggaggtaacggccct

SEQ ID NO: 28241 - DNA, 601 bp, Human
tcagctactcaaacccagaaccccactggcctggccacacttgggctccctatgcctcccctccctcctttggtgccccccaagttaccccgaccaggccgtccttatgcctcccctccctcccttggtgcccctcaagttaccccgaccaggccgtcccacacagattttctgcaacacgtgtcacattctgtagggaacgttgcagagagcttccctgcctgcctcccacctacatctttccatcctcaactcctgccagatccccccagagcccgcccctgccccctggcccacaccsggcctcctccagccttggctcttgccacttcctctacctggatcaaatccatgcacccctcatagtccctgagccaggcccccctcccacatcctgggcggaaggcatctcctccggactccggtcacactaggccccccactgtccaactcccactgcctgactcacagttactgcctcggtggctgcctcctggctccatgaggagcccacgcaccccggctgggcacgtggtacacatcatatgatggagaagtgcccatttcatgccccaggctcctgggtgggagggctttcagg

SEQ ID NO: 28242 - DNA, 601 bp, Human
tccctcccttggtgcccctcaagttaccccgaccaggccgtcccacacagattttctgcaacacgtgtcacattctgtagggaacgttgcagagagcttccctgcctgcctcccacctacatctttccatcctcaactcctgccagatccccccagagcccgcccctgccccctggcccacacccggcctcctccagccttggctcttgccacttcctctacctggatcaaatccatgcacccctcatagtccctgagccaggcccccctcccacatcctgggcggaaggcatctcctccrgactccggtcacactaggccccccactgtccaactcccactgcctgactcacagttactgcctcggtggctgcctcctggctccatgaggagcccacgcaccccggctgggcacgtggtacacatcatatgatggagaagtgcccatttcatgccccaggctcctgggtgggagggctttcaggacctctgtgtgagagatgaggacgtcggggatgaaggaggaccccccaggggccgggcttatcacaccccttctttctcttctgttccacaggcggtccagcctcgtcatcaccac

SEQ ID NO: 28243 - DNA, 601 bp, Human
agattttctgcaacacgtgtcacattctgtagggaacgttgcagagagcttccctgcctgcctcccacctacatctttccatcctcaactcctgccagatccccccagagcccgcccctgccccctggcccacacccggcctcctccagccttggctcttgccacttcctctacctggatcaaatccatgcacccctcatagtccctgagccaggcccccctcccacatcctgggcggaaggcatctcctccggactccggtcacactaggccccccactgtccaactcccactgcctgaytcacagttactgcctcggtggctgcctcctggctccatgaggagcccacgcaccccggctgggcacgtggtacacatcatatgatggagaagtgcccatttcatgccccaggctcctgggtgggagggctttcaggacctctgtgtgagagatgaggacgtcggggatgaaggaggaccccccaggggccgggcttatcacaccccttctttctcttctgttccacaggcggtccagcctcgtcatcaccaccaagatcttctggggcggaaagtaggtgcaacagctggcgatgcttcc

SEQ ID NO: 28244 - DNA, 601 bp, Human
gagagcttccctgcctgcctcccacctacatctttccatcctcaactcctgccagatccccccagagcccgcccctgccccctggcccacacccggcctcctccagccttggctcttgccacttcctctacctggatcaaatccatgcacccctcatagtccctgagccaggcccccctcccacatcctgggcggaaggcatctcctccggactccggtcacactaggccccccactgtccaactcccactgcctgactcacagttactgcctcggtggctgcctcctggctccatgaggmgcccacgcaccccggctgggcacgtggtacacatcatatgatggagaagtgcccatttcatgccccaggctcctgggtgggagggctttcaggacctctgtgtgagagatgaggacgtcggggatgaaggaggaccccccaggggccgggcttatcacaccccttctttctcttctgttccacaggcggtccagcctcgtcatcaccaccaagatcttctggggcggaaagtaggtgcaacagctggcgatgcttccagccccggcccagcagccacggccccgtgctccccagagaccc

SEQ ID NO: 28245 - DNA, 601 bp, Human
agctggcgatgcttccagccccggcccagcagccacggccccgtgctccccagagacccctgacctagaaggctcctggggtggcgggaggacagtcctccttgagaagggagagtggtcggggtctgtcctggacaggccccggcccagtgccatttcctgtccccagcaggggcagagctggtgtttctgcagccatcagctatgcctggtgcctgtccctgttaagggacgtcaaatccagaaaagaagctgtggccgagtttgccttttacaaaaacctcgcttaactttccttttwactcacatggattattttttcctggtcactatggtaacatcataaaaattatagagaaaacagaaaatttgtgaactgcccaaacccccaaagcactccaaattccctgggccgcctgtcacccctgcaggtctccaagtgtctagctccatagtttctgggctggacacacttgggctcataggaattataactacgattcattcattcattcttttttttatttttattttgtttttattttttatttttttgagacagggtctcgctttgtaatccaggttggagcgcagtgccaca

SEQ ID NO: 28246 - DNA, 601 bp, Human
tttatatttttatttttgtattttgtagagatggggtttcatcatgttgtccagcctggtctcaaactcctgagttcaagtaatctgcccacctcagcttcccaaagcactaggattgcaggcgtgagccaccacgcctggcattaatttgtccttttttaagatatggggtctcactatgttgcccaggctggtcttgaactcctgggctcaagtgatcctcctgccttagcctcccaaagtgctgggattacaggcgtgagccactgtgcccagcctgatgtgttcttaatttaaaaataataataataataataataataagtccaaatcaaacagacgggttaggttgaaaatcaaagccccccaccccctgctgctgcccccctcccctctgagccctgtgaccaggcctctccctgggcctctgggagttcagccctgtagcctcgggtccctacccccaaagtggaatccgactccacacggcatttgctgaccctgtttttgcgtctaacattgcatcgtaaacgttttttgggaggggccagggtgccaaaaccgctggtgacatcacacgcggtcggcctgttttccaggg

SEQ ID NO: 28247 - DNA, 601 bp, Human
cttttttaagatatggggtctcactatgttgcccaggctggtcttgaactcctgggctcaagtgatcctcctgccttagcctcccaaagtgctgggattacaggcgtgagccactgtgcccagcctgatgtgttcttaatttaaaaaaaataataataataataataataagtccaaatcaaacagacgggttaggttgaaaatcaaagccccccaccccctgctgctgcccccctcccctctgagccctgtgaccaggcctctccctgggcctctgggagttcagccctgtagcctcggstccctacccccaaagtggaatccgactccacacggcatttgctgaccctgtttttgcgtctaacattgcatcgtaaacgttttttgggaggggccagggtgccaaaaccgctggtgacatcacacgcggtcggcctgttttccagggcggagacggagcggggcctgtccaggaagcacataatcgaaggtgaggacgcgctcgggcacctcagggcccccatacctgtgggatcatcctcggaggccaaagtgatggcagcacagggcccgacccccccagttaacccactgagggccc

SEQ ID NO: 28248 - DNA, 601 bp, Human
cccagctatcaactctggtctctttaaatctttcttctatcaccaggggacccatttagttcctccaagtcaaggacattcatcatagaaggtacacagtgcccccagcctgactattgacttctgtgtccaagctgcattttatgagacagtatttttatttacatgattcttttaccccatgagaaacttctccataaaatgcataaagaggggaaagagcaccctatgagaacaccttgcaagtgaaggaaaagcaaagtggtgttggagcccctcgcccccagccccccatcccctygttcctccttcctcccgtgcatggcccccacccctgggcttgcactgctgagctccgcggcggccgggggtcctcttgatctgaggatgctgtgatccccacctggagccttgaccctggatggtgccatgggaagggttggggaagaccaggtttccacaaggagcaaagccatcagggaccccaaaacacgcggccccccaccgagtcttagctcctccatggtttatgtttgctaagctcctgtctctcctggaggcagagatcacctggcttgtcacgctgccccgtccacagcac

SEQ ID NO: 28249 - DNA, 601 bp, Human
tccacgcagcatgggcaaaggacaagcaggcactgagggagagccagggcttttccagggtcaacgttgttgctgtctttagaaacacttgcactcccactcactcccacactgcctttggcggtcgaacttgcaagcactgtatccgacccgtgagaagcctagcgccatagtccctcgccctgcaaagctcagaggcttctgaaatttgaaatttcgacgccaagttctgtttttaaaatcacaatatccccatgaggctgagagggagctataaccagcagattgctgtgtctcaaarccatgtttgaatattgggaagaatccactgtgtcgctggggcgagggtccctcctctcttctttaaaaggccagcgtgaagtctccgcgatttcatcctcagggccttaggagtctccgccgtccacgattcaggttgttcccagggctcatggagcctcaaaactgtcctactccaggccctggcccctcacaggaggagcacccagacccctgtggccctgggaccaccccttgccaggggacaggcgggttgggactctggcctggtgctgggctggtttgagaacctgggccatgg

SEQ ID NO: 28250 - DNA, 601 bp, Human
gcaggcagcccatttttcagatgtggacactgtggcacagagaggttcagtaacatgccaaggtcacacagcttgggccaagattaacatccaggctgtgtggttcagagcctgggctgctcataactggaccctccggcctgggggtcccaccacccacctccttttcccagctcaccagggcctgcctggctcccagggaagctatgagtgtgagcagtggggagcccgggctgcagctgctgggccagcctgctccggggacaccttggtgccctctccatggctgccccggcagccycccgcctgctcacaggcaagggccctcggggtccctttctgccttcacaggaggcctactccgtggcccggcagttcaacctgaccccgcccatctgcgagcaggctgagtaccacatgttccagcgtgagaaagtggaggtgcagctgccggagctgttccacaagataggtgggcaccctcgggcccctcgccccgccccaccccacccctgctctcgggcccagggcttgactccacctgcttttcctcttcaggagtgggcgccatgacctggtcccctctggcctgtggcattgt

SEQ ID NO: 28251 - DNA, 601 bp, Human
tcaagatgagaagagcccctatgagggagaagggtccagaaggaatgagcccatcggccccctgcacgtgggggtccaggtgacctgctctcatctgtagctgtgctgctcccctcccccgcaaccagggctaccagtggctgaaggacaagatcctcagtgaggagggccggcgccagcaagccaagctgaaggagctgcaggccatcgccgagcgcctgggctgcaccctgccccagctggccataggtaacggtggggtcgccatggggccagtgcccctggggagaacctgccccarctggccgtaggtaacagggtggggttgccatggggccagtgtctccggggagagagggaagggatccctggacatcatcccccagccagcctcgggtaatcgggctctaaggggcatggttgggaccccatgcctctagggggatgtcaggagtccctgaggacctgggccaccccctccatctgccagccataggtaatggggctcccgctttcatgggaagaggatggggagcgctaagcacttgggccacctctccatcagggagcagcgggctcccccatgcctcctccagccacc

SEQ ID NO: 28252 - DNA, 601 bp, Human
gcatggttgggaccccatgcctctagggggatgtcaggagtccctgaggacctgggccaccccctccatctgccagccataggtaatggggctcccgctttcatgggaagaggatggggagcgctaagcacttgggccacctctccatcagggagcagcgggctcccccatgcctcctccagccacctcttagacaaagcccgtgcccagcactgcagggcttcctagaccccctcagacccccagaccaagatgctgggtctctcggcccagtcagaggcaaggcagacccatcaggggyccctgtggtgggtgtttctccctcaccttgggtctcgccgccacagcctggtgcctgaggaatgagggagtcagctccgtgctcctgggggcctccaatgcggaccagctcatggagaacattggggcaatacaggtaagagtgagaggccctgctgggcagagggcccatcccagcccgagccccgtccagtgcatcctcccaggctcgtcctgcgtgccaggctctgttctaggcactcaggatgcgcccgtgaaccatcagagttgtgctcctggagagcttgctttccagcaggaa

SEQ ID NO: 28253 - DNA, 601 bp, Human
catgcctctagggggatgtcaggagtccctgaggacctgggccaccccctccatctgccagccataggtaatggggctcccgctttcatgggaagaggatggggagcgctaagcacttgggccacctctccatcagggagcagcgggctcccccatgcctcctccagccacctcttagacaaagcccgtgcccagcactgcagggcttcctagaccccctcagacccccagaccaagatgctgggtctctcggcccagtcagaggcaaggcagacccatcaggggtccctgtggtgggtgyttctccctcaccttgggtctcgccgccacagcctggtgcctgaggaatgagggagtcagctccgtgctcctgggggcctccaatgcggaccagctcatggagaacattggggcaatacaggtaagagtgagaggccctgctgggcagagggcccatcccagcccgagccccgtccagtgcatcctcccaggctcgtcctgcgtgccaggctctgttctaggcactcaggatgcgcccgtgaaccatcagagttgtgctcctggagagcttgctttccagcaggaacagacatgaacacta

SEQ ID NO: 28254 - DNA, 601 bp, Human
gagcagcgggctcccccatgcctcctccagccacctcttagacaaagcccgtgcccagcactgcagggcttcctagaccccctcagacccccagaccaagatgctgggtctctcggcccagtcagaggcaaggcagacccatcaggggtccctgtggtgggtgtttctccctcaccttgggtctcgccgccacagcctggtgcctgaggaatgagggagtcagctccgtgctcctgggggcctccaatgcggaccagctcatggagaacattggggcaatacaggtaagagtgagaggccytgctgggcagagggcccatcccagcccgagccccgtccagtgcatcctcccaggctcgtcctgcgtgccaggctctgttctaggcactcaggatgcgcccgtgaaccatcagagttgtgctcctggagagcttgctttccagcaggaacagacatgaacactaactgcacgaaacaaggaggttagaatgtgtgtcagggtggacgagcgctgtaggagagaagccagagataaagggagggagctggggccagggacggtggcgctgcagactcaggttcaagggggcctgtcaggtgg

SEQ ID NO: 28255 - DNA, 601 bp, Human
tgctgggtctctcggcccagtcagaggcaaggcagacccatcaggggtccctgtggtgggtgtttctccctcaccttgggtctcgccgccacagcctggtgcctgaggaatgagggagtcagctccgtgctcctgggggcctccaatgcggaccagctcatggagaacattggggcaatacaggtaagagtgagaggccctgctgggcagagggcccatcccagcccgagccccgtccagtgcatcctcccaggctcgtcctgcgtgccaggctctgttctaggcactcaggatgcgcccrtgaaccatcagagttgtgctcctggagagcttgctttccagcaggaacagacatgaacactaactgcacgaaacaaggaggttagaatgtgtgtcagggtggacgagcgctgtaggagagaagccagagataaagggagggagctggggccagggacggtggcgctgcagactcaggttcaagggggcctgtcaggtgggcttgttgagaaggtggtgcttgagcagtcttgagagatgcggagtaagtcacgcaaatgcctgcgggaagaaccttccaccagcaggaagagttgatgca

SEQ ID NO: 28256 - DNA, 601 bp, Human
aggcctggagcagaggggcagatcctgagaggcacgaaacacctccagggacttctgagtgagacgggagccgtggcaaaattgtgggcagaggagggcgagctgcagctcagcctggaaagggaggctgctctccggctgctccatcggggaggctttgggaagcaaaagtcgaagcagagagccctggtgggaagtggcagctgcgggtccgagacgggagtggtggttggatcctggatgtttgggaaggtggggcccccgggactggctgacaaactggatgtgggggtgagaaggygaggtggaagtcggtccccgggtgtgtcacccggaagggtggcggtgctgtatgctgaggcaggcgcagctggaaaaagcagtcacggacatggaagtccagcatttggcctggagtttccattttatgtcactgctgccaccacccttcaggaaggttctagggcaccttgacatttgagagggagtgcacagacccaggcatgcttcctctctgccccaaaccttctgaaacacaaaagcagcgtggcctccatctgcctcagatggagcccagatgtgatggggcaacccgggcctg

SEQ ID NO: 28257 - DNA, 601 bp, Human
agtttccattttatgtcactgctgccaccacccttcaggaaggttctagggcaccttgacatttgagagggagtgcacagacccaggcatgcttcctctctgccccaaaccttctgaaacacaaaagcagcgtggcctccatctgcctcagatggagcccagatgtgatggggcaacccgggcctggccagccgaccatctggaagagcctggccccacctcctccccaggccaggcccgtcttgttggtgggattctgatttgttgttgttcttgcacgcaggtccttccgaaactgtcrtcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaagg

SEQ ID NO: 28258 - DNA, 601 bp, Human
taagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccagrccaaggcctggttgggtccttggggcgggcagggccggcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgaccc

SEQ ID NO: 28259 - DNA, 601 bp, Human
acctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcrcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagc

SEQ ID NO: 28260 - DNA, 601 bp, Human
cggtaaagggctgtgcttcaaatgatggccaggtacataagtaaaggagtgaaggagtctgcgggggaagacagtacggaatggtggagactggcaaaatgggaacacacaccccctctacaagagtagctgctactcagctccagccaagtgtcgcgtgagggatgtggaggcaatcctgccaatgcttctgctctttcaaggtgtgctaaatatccagattttaatatgaaatctacccatttttttaagtgttgctttcaatatttaaaaacactatatcggccaaaggtacacaackgctgaccagatccatcccaggcgccatgagtttgccgcctggcgctaaccagcccaatgctgagtgtgcagtactgagtcctgtgctgtcgccccgccccggccacggggccccggggaacactggtgccaggccccagggctgggaggggcccaggcttcacctttcccggatgaattctgacatttccttctgcatttgtttgcccttcagctgtttctggagcagtagttcaaacccagccacggtgccgttgccttgggggtccttcttatcagcctacaaaggaagcagaagcac

SEQ ID NO: 28261 - DNA, 601 bp, Human
tgcaaagtaggacattttctccggtctcctagagctgtgaagacgagagctgtcgtttacacagttcctagcacagaacgggaaacataagacccctgaaccaataaatgaatgaaggaagaaatgaacgtttgcaactcgtgatggactaccagcaatccccagtgctgtcccctctcccttccagccccagaactcccaggtggcctcggaccctcagcagcagaacagaacatctccctactgtctcacacccccaatgcctctgattgtcaagcctgctgggtacaagtacttccayggaaacctagcagtgcccagggctgcaggtagattctatttccctggagaggaaagttgccttggatgtagcttccggcaggcaggcctttgacacatttgcaaggcaactccccagggagtgtcctgtattatctggcacgtccatgttaagcatgttgtcagaggtattgttcaccacctaagtggtcctctgggccacagtgggagacagaagagctatgcttatgccaaccagagctggccagagcccaggcttcggagagcccctggtccaccacacggtgaacagagaagctcc

SEQ ID NO: 28262 - DNA, 601 bp, Human
gcccctagacaaagggaggctggagtgggcatctagaggctgctgcccagctaccaggggtcagaccagaggggattctgacatacttcaacatctggaacgtggctcttggtcactaaagagaagacaatgtggaagtgcctttttttttttttgagacggagtctcgctctgtcgcccaggctggagtgcagtggcccgatcgcagctcactgcaagctccacctcctgggttcacgccattctcctgcctcagcctcccaagtagctgggactacaggcactcatcaccatgcccggmtaattcttgtatttttagtagagatggggtttcactatgtgggccaggctggtctcgaactcctgaccttgtgatccacccgcctcggcctcccaaagtgctgggataatgggtgtgagccacccgcccggctggaagtgcccttttgagtgtggatgcccacaccttgagtcatgggtgcccacccaagtcatgagcacctacctgagccatgagtgcccaccttgagccaggcctatggagagctccccatccaaagtggggccatgccagtgatcagtgatagtggctgatttccct

SEQ ID NO: 28263 - DNA, 601 bp, Human
ataagggtgcagccctgatctgataggattagtgtccttataaaaatagacattggccaggcgcgatggatcacgcctacaattccagcactttgggaggccaaggagggtggactgcttgagttcaggggttctagaccagcctgaccaacatggtgaaaccccgtctctactaaaaatacaaaaaattagccaggtatggtggcacatgcctgtagtcccagctacttgggaggtggaggttgcagtgagctgagatcaggccactccagtctgggcgacagagcgagactctgtctcaaaaaaaaaaaaaaaaaaaaaaatagacatcacagagctccctctctctctctctctgagcacacaccaaggaaaggctgcatgaacacacaatcagaaggcggccatctgcaacccaatgggagagtccttaccaggcaccaaccctgctggcaccttgatcttggacttcccagcctccagagccacgagaaaataaatgtctgtagtttcagccacccagtctgggacatcttgtggcagcccaagcagatgaatacacaccccaaaaggaaacccggtaacttttaagcagtcacaa

SEQ ID NO: 28264 - DNA, 601 bp, Human
accaatgtgcacatgtcctgtgaaatctaatttggacacagaagttgaattgcaaaagcctctccagcctccctgagcagcatcttcctcaactgctccaaatttctagactcctgctttgctttgaaagtcttcaaggagatagggttaaatgtccaaagctgtgtgtaaatgtaaatcagtgtctttgcacgttgtacgtagggggctcatgtgttcatgttccagtgcctgctgcaggagtgtgtgcatggggctgctgtgcgtgcatgcacacacagagtaatgtgtacacctacgrggcagtggccctgatgcatgtatgtgagcttgcgttgtgtttgtctctgtgtttgtccgggcatgtgtgtacagtatggtagtgtgggcctgacttatggagctggactgctcgggtgaggagcatatgctgtgcatgttggccaggacacagtgtccttggcagcagcccaggctggagagatggaagccggaagactccggagtggcacagtggttgcagggcacggggatacttaggaaagccccttgccaggcagcaagagctgctcctctatgtgcccccttcctgcccctatct

SEQ ID NO: 28265 - DNA, 601 bp, Human
taccaatgtgcacatgtcctgtgaaatctaatttggacacagaagttgaattgcaaaagcctctccagcctccctgagcagcatcttcctcaactgctccaaatttctagactcctgctttgctttgaaagtcttcaaggagatagggttaaatgtccaaagctgtgtgtaaatgtaaatcagtgtctttgcacgttgtacgtagggggctcatgtgttcatgttccagtgcctgctgcaggagtgtgtgcatggggctgctgtgcgtgcatgcacacacagagtaatgtgtacacctacraggcagtggccctgatgcatgtatgtgagcttgcgttgtgtttgtctctgtgtttgtccgggcatgtgtgtacagtatggtagtgtgggcctgacttatggagctggactgctcgggtgaggagcatatgctgtgcatgttggccaggacacagtgtccttggcagcagcccaggctggagagatggaagccggaagactccggagtggcacagtggttgcagggcacggggatacttaggaaagccccttgccaggcagcaagagctgctcctctatgtgcccccttcctgcccctatc

SEQ ID NO: 28266 - DNA, 601 bp, Human
ggtggctcacgcctataatcctagcactttgggaggcggaggagggtggatcatgaggtgaggagttcaacaccagcctggccaacacggtgaaaccccatctctactaaaaatacaaaaaattagctgggtgtggtggcaggcgcctgtagtcccagctactcgggaggctgaggcaggagaatcacttgaacccgggaggcggagcttgcagtgagctgagatcgcaccactgcactccagcctgggcgacaaagcaagactctgtctcaaaatcaataaatcaataaatcaatcaatmaataaatgaataaataaataaagaaggaccctttacttgttctgaaattttgcaacaaccacaaatttaaaaaaaattctccctttggcataacctaatgttccctgacactaggaagagacaggacatcctactccatccctttgaaagccaggcaaaaagaaagcagggcttcgtcactcaggggctgccctgagaaactgggcaggtgtgctaaggcctgctcccagtggctcccaagagctgaatgttaaattttcaggaattctgtttgctggttgttaaacacggccattatca

SEQ ID NO: 28267 - DNA, 601 bp, Human
gtgccgagtaccaccacggggtacatcgtatgggatcccaaagcagggacttgcaattgcagtaggaacgacactaggaaagagacaggaccagtgagtgctgaacgtggaagtcccaggaaggagcgaccatctctgagggatgctaccttcaaatgatcaagcacgtgtttaaagaagggagactcagcgtttaggcactttaccctgctgtgtctgactagtgatggtgggaggacagagggaagagcgaggaggccagggtcactgggatggtgcactctgaaaggtcccccccgctttttttttttttttttttgagacagagtctcactctgttgccaggctggagtgcagtggcgtgaactcggctcactgcaacttctgcctccagggttcaagagattctcctgcttcagcctcccgagtagctgggactacaggcatgcgccaccaagcccagctaatttttgtatttttagtagagatggggtttcaccatgttggccaggatggtctcgatctcatgatctcatgatccacccacctcagcctctcaaagtgctgggattacaggcgtgagccaccacgcctggcccct

SEQ ID NO: 28268 - DNA, 601 bp, Human
aagtcctttcacgtgtctcagtcatctgagtcattcattctgccttctgtgtgccgagtaccaccacggggtacatcgtatgggatcccaaagcagggacttgcaattgcagtaggaacgacactaggaaagagacaggaccagtgagtgctgaacgtggaagtcccaggaaggagcgaccatctctgagggatgctaccttcaaatgatcaagcacgtgtttaaagaagggagactcagcgtttaggcactttaccctgctgtgtctgactagtgatggtgggaggacagagggaagagmgaggaggccagggtcactgggatggtgcactctgaaaggtcccccccgctttttttttttttttttttgagacagagtctcactctgttgccaggctggagtgcagtggcgtgaactcggctcactgcaacttctgcctccagggttcaagagattctcctgcttcagcctcccgagtagctgggactacaggcatgcgccaccaagcccagctaatttttgtatttttagtagagatggggtttcaccatgttggccaggatggtctcgatctcatgatctcatgatccacccacctca

SEQ ID NO: 28269 - DNA, 601 bp, Human
gagttatatcctgcacacagccatccacaccacttatgtcaccactaccacgtcggagagagttttgccacctgttgagcactctaaacaatcaagaatcaggggtcctgctgatggggagtaaatgccaccaagattcccggggacccagcaggtgacctttccaaagctcgcaactctggctcccagccccaccccatcacaatggcagcccgcccaggatcttcccagtcaatggaagtttctaccacagcagagaatggagctgctgggggccccgacaggggaagggaggccttgrggggaaagctactcatgatctgcagctgaaaaataacttgctgttttggatgcaatgcaggaaaaagatccattcacggagttcccttctctgccaggacttgagtagcaattttctactgaagcgcttggtgtaatgaggttagttagcatgccttcactggctgggaattctcactcacatctgggtgtcaactcaatcttggggcacactaagccatggggagctgtagcagctctgttccctcttccaacccagctctttagaaagtcctttcacgtgtctcagtcatctgagtca

SEQ ID NO: 28270 - DNA, 601 bp, Human
agtagcccattggcaacccctggaaaggcacaggctcaagaagaggctgtgttttcaatgccattggtctgccaaagcaggggagctgctggaagaaaagctctggggaccaagtctcccattcgctcagtcctttcctttgcttcctctgtgactgaacccacctggctgtgtgaccatgggctgtgatctcaccccacctcttctcactgtgaaatgtgtatgctatctcgcgtggtggttgacggcaatgagttatatcctgcacacagccatccacaccacttatgtcaccactacsacgtcggagagagttttgccacctgttgagcactctaaacaatcaagaatcaggggtcctgctgatggggagtaaatgccaccaagattcccggggacccagcaggtgacctttccaaagctcgcaactctggctcccagccccaccccatcacaatggcagcccgcccaggatcttcccagtcaatggaagtttctaccacagcagagaatggagctgctgggggccccgacaggggaagggaggccttgaggggaaagctactcatgatctgcagctgaaaaataacttgctgttttg

SEQ ID NO: 28271 - DNA, 601 bp, Human
ctaccgcatgagattttctatcagcagaaggaattctgctcttctcccttcttcagcaggagccaggtataactttctttgtatacggctctctcatttctttagcaatctgttgctattagcaatggcttgagctaatggaccagaaaaaccacaaaaattgctgcaacaaaattgcatttcttaaagagcttttacccctgacacagagcattcagagcagaatttcaataagtcttttggagcagacattaaaaacggtttttggcatatggagctatattattcatggcagtcaaayacatccttggagccactttcttctcaaggaatcgccataaaaccactaggctgctgcgatgaccgcttgaggccaccaacactgaccgacaggctggaagcagccgagagcctctcgtagcaaagtctgttttgcatgacgggtcttcatgagcttcctgtcaactgaatggtgaggtccaccctgtgtcctgaacactaacttaaaatgttctgagcatgtggttgtccagggccagtctgcagtagcccattggcaacccctggaaaggcacaggctcaagaagaggctgtgttttca

SEQ ID NO: 28272 - DNA, 601 bp, Human
cccgccaccaaacctggctaatttttttttgtatttttagtagagacggggtttcaccatgttagccaggatggtcttgatctcctgacctcatgatccgcccgcctcggcctcccaaagtgctgggattacaggtgtgagccactgtgcccggcgatattaagtacttttaaaagacagttttttttttcctttaaaatggttaggctggtatctttagtacccattcttaacttttaagcatctctgttgaaccaggaatcagaagtccttcctcaaagtgtcctcacagactcaggcyggcctgtcatggcccatcagtttttctttccaaaactctcgctctctttgcttccttttcatctcacacatcagaagagaataagagaagttccaagttggtaggaatttcagacactgtctagtctgatatttttcagacggtgtgcggccgagagttgtgaaatcgatttaatgggccaggaccagctttttggtgagaacagaccagacttgaacagaaaataccagagtacattttaagtaggaggataaatactgttttatgaaacgtttgtttcagctacagatgtgtgtgaat

SEQ ID NO: 28273 - DNA, 601 bp, Human
cccaagtagctgggattacaggcacccgccaccaaacctggctaatttttttttgtatttttagtagagacggggtttcaccatgttagccaggatggtcttgatctcctgacctcatgatccgcccgcctcggcctcccaaagtgctgggattacaggtgtgagccactgtgcccggcgatattaagtacttttaaaagacagttttttttttcctttaaaatggttaggctggtatctttagtacccattcttaacttttaagcatctctgttgaaccaggaatcagaagtccttcctsaaagtgtcctcacagactcaggccggcctgtcatggcccatcagtttttctttccaaaactctcgctctctttgcttccttttcatctcacacatcagaagagaataagagaagttccaagttggtaggaatttcagacactgtctagtctgatatttttcagacggtgtgcggccgagagttgtgaaatcgatttaatgggccaggaccagctttttggtgagaacagaccagacttgaacagaaaataccagagtacattttaagtaggaggataaatactgttttatgaaacgtttg

SEQ ID NO: 28274 - DNA, 601 bp, Human
aggctggagtgcaatggcgcaatcttggctcactgcaagctccacctcccaggttcaagccgttctcctgcctcagcctcccaagtagctgggattacaggcacccgccaccaaacctggctaatttttttttgtatttttagtagagacggggtttcaccatgttagccaggatggtcttgatctcctgacctcatgatccgcccgcctcggcctcccaaagtgctgggattacaggtgtgagccactgtgcccggcgatattaagtacttttaaaagacagttttttttttcctttaawatggttaggctggtatctttagtacccattcttaacttttaagcatctctgttgaaccaggaatcagaagtccttcctcaaagtgtcctcacagactcaggccggcctgtcatggcccatcagtttttctttccaaaactctcgctctctttgcttccttttcatctcacacatcagaagagaataagagaagttccaagttggtaggaatttcagacactgtctagtctgatatttttcagacggtgtgcggccgagagttgtgaaatcgatttaatgggccaggaccagctttttggt

SEQ ID NO: 28275 - DNA, 601 bp, Human
catcagcgtctgtgtctccaagcactcagcacagtgactggggtacgcggcttcagtaaagaacagtcgaatgaatgccattcaattagaaggtctcaggtcagtcctatttatcgaacatctactccatggcaggtgctgagaatacaaaggtgagctagacagggtccaaacctcgaggaactgatggtgggaactgttggagacctgctggaaactcacaagggcaactgtcccgcattgcgctcataaagacattctcagcttgctgggctgcctggagcacaggcaaagggaaccrccctgtatcccaggggccagagaaaagggtttatgctgtcagaagagctgggtggcatcagggttttaagcttttttcttctcttttattccttccctctttcccatcccacccccctttaaaagaacttttccttaaaatttgttccttttgtttgtgagcataacatttatttattttttatttatttatttatttttttgagacagagtctcgctctgtcgcccaggctggagtgcagcgacgcgatctcggctcactgcaagcctcgccttccaggttcacgccattctcctgtct

SEQ ID NO: 28276 - DNA, 601 bp, Human
actcaggaggctgaggcaggaaatcacttgaacctgggaggttgcagtgagccgagattgtgccactgcacttcagcctgggtgacagagtgagacttggtctcaaaaaaaaaaaacaaaacaaacaaacaaaaaacaataataatcaatgacctcacacacttattttatcccacagcttcttgcacggctttgttcttatgtctctctcccttattttccgaactgagagctttctggggacagaaaccacatcagcgtctgtgtctccaagcactcagcacagtgactggggtacgcrgcttcagtaaagaacagtcgaatgaatgccattcaattagaaggtctcaggtcagtcctatttatcgaacatctactccatggcaggtgctgagaatacaaaggtgagctagacagggtccaaacctcgaggaactgatggtgggaactgttggagacctgctggaaactcacaagggcaactgtcccgcattgcgctcataaagacattctcagcttgctgggctgcctggagcacaggcaaagggaaccgccctgtatcccaggggccagagaaaagggtttatgctgtcagaagagc

SEQ ID NO: 28277 - DNA, 601 bp, Human
tactatttatggtttataatatgctgttttgaaatatgtatatattgtggaatggctaaatcaagttaataatcaatgggctgggcacggtggctcatgcctgtaatcccagcactttgggaggccaaggcaggttgatcacctgaggtcaggagttcgagaccagcctggccaacatggtgaaaccccatctctactacatacacacacacacacacacacacacacacacacacacacacacacacacaaattagctgggagtggtggcaggtgcctgtaatcccagctactcaggagrctgaggcaggaaatcacttgaacctgggaggttgcagtgagccgagattgtgccactgcacttcagcctgggtgacagagtgagacttggtctcaaaaaaaaaaaacaaaacaaacaaacaaaaaacaataataatcaatgacctcacacacttattttatcccacagcttcttgcacggctttgttcttatgtctctctcccttattttccgaactgagagctttctggggacagaaaccacatcagcgtctgtgtctccaagcactcagcacagtgactggggtacgcggcttcagta

SEQ ID NO: 28278 - DNA, 601 bp, Human
ctctgtggtccttgggtggcggcagttggctgggcccagggtgtcccagcagtttgagcccccttctcctctctaaggcactggggactgggaatcagtccctggggcacactctcttccctctaaggctgaacatcagttccctggaggtgagaccacccaggactcagcctcatccctgagcaggaaggagagcagggaggcggtgactgagtcaggacgactcagccaggtgaggcttaaacacggggccccacgtgaaccagcagcagcactgctaggctcggggtttaactggtcrccaacagccactcgactgcccactgcagctgcagcctctcctcgcacccctggccctctgggtggtcattccagcaccacagggaggcagctcctatctgcccttggatgggtggggtgctctggcgtaggcacgaggcttggacatccccctattcccctacctggggacaaagactcagccttggcgtatggagccactgctggcttcccagtcccccttcttccaggcagtcccccatgcacctgccctggcccagcgtcctgggcctctcaccttctccaccgaggcatagcggct

SEQ ID NO: 28279 - DNA, 601 bp, Human
ggccaccactggcatctctgtggtccttgggtggcggcagttggctgggcccagggtgtcccagcagtttgagcccccttctcctctctaaggcactggggactgggaatcagtccctggggcacactctcttccctctaaggctgaacatcagttccctggaggtgagaccacccaggactcagcctcatccctgagcaggaaggagagcagggaggcggtgactgagtcaggacgactcagccaggtgaggcttaaacacggggccccacgtgaaccagcagcagcactgctaggctcsgggtttaactggtcgccaacagccactcgactgcccactgcagctgcagcctctcctcgcacccctggccctctgggtggtcattccagcaccacagggaggcagctcctatctgcccttggatgggtggggtgctctggcgtaggcacgaggcttggacatccccctattcccctacctggggacaaagactcagccttggcgtatggagccactgctggcttcccagtcccccttcttccaggcagtcccccatgcacctgccctggcccagcgtcctgggcctctcaccttctccac

SEQ ID NO: 28280 - DNA, 601 bp, Human
tcttgttcccctcactgtactgcctttcctccaggccaccactggcatctctgtggtccttgggtggcggcagttggctgggcccagggtgtcccagcagtttgagcccccttctcctctctaaggcactggggactgggaatcagtccctggggcacactctcttccctctaaggctgaacatcagttccctggaggtgagaccacccaggactcagcctcatccctgagcaggaaggagagcagggaggcggtgactgagtcaggacgactcagccaggtgaggcttaaacacggggcyccacgtgaaccagcagcagcactgctaggctcggggtttaactggtcgccaacagccactcgactgcccactgcagctgcagcctctcctcgcacccctggccctctgggtggtcattccagcaccacagggaggcagctcctatctgcccttggatgggtggggtgctctggcgtaggcacgaggcttggacatccccctattcccctacctggggacaaagactcagccttggcgtatggagccactgctggcttcccagtcccccttcttccaggcagtcccccatgcacctgccct

SEQ ID NO: 28281 - DNA, 601 bp, Human
ttctggagctggacaagcctcggccctcttgttcccctcactgtactgcctttcctccaggccaccactggcatctctgtggtccttgggtggcggcagttggctgggcccagggtgtcccagcagtttgagcccccttctcctctctaaggcactggggactgggaatcagtccctggggcacactctcttccctctaaggctgaacatcagttccctggaggtgagaccacccaggactcagcctcatccctgagcaggaaggagagcagggaggcggtgactgagtcaggacgactcwgccaggtgaggcttaaacacggggccccacgtgaaccagcagcagcactgctaggctcggggtttaactggtcgccaacagccactcgactgcccactgcagctgcagcctctcctcgcacccctggccctctgggtggtcattccagcaccacagggaggcagctcctatctgcccttggatgggtggggtgctctggcgtaggcacgaggcttggacatccccctattcccctacctggggacaaagactcagccttggcgtatggagccactgctggcttcccagtcccccttcttc

SEQ ID NO: 28282 - DNA, 601 bp, Human
cagcctacctcaatctctcaaaccacgtttttttcccgatggagcctgtacaaagactggggacctaggcagtcctaaagtcacagcccctctgcttggaagggaccacaaaggccatctgtgtcacctccctgcagcacttaataggatgtagcaacagccctcccgttctggagctggacaagcctcggccctcttgttcccctcactgtactgcctttcctccaggccaccactggcatctctgtggtccttgggtggcggcagttggctgggcccagggtgtcccagcagtttgagcccccttctcctctctaaggcactggggactgggaatcagtccctggggcacactctcttccctctaaggctgaacatcagttccctggaggtgagaccacccaggactcagcctcatccctgagcaggaaggagagcagggaggcggtgactgagtcaggacgactcagccaggtgaggcttaaacacggggccccacgtgaaccagcagcagcactgctaggctcggggtttaactggtcgccaacagccactcgactgcccactgcagctgcagcctctcctcgcacccctggccctc

SEQ ID NO: 28283 - DNA, 601 bp, Human
ggagccagtgggcctcctgggccacgcagcccagcttccctttggagtcctttcgccccttgtttgtgtggatgatgccacagtggtccagagaggcccagcagccagagtggcaccacccagctaggtagaggctacaacccaactcttttcgtccttgcctcttccagtgacatctggactcagcctacctcaatctctcaaaccacgtttttttcccgatggagcctgtacaaagactggggacctaggcagtcctaaagtcacagcccctctgcttggaagggaccacaaaggccayctgtgtcacctccctgcagcacttaataggatgtagcaacagccctcccgttctggagctggacaagcctcggccctcttgttcccctcactgtactgcctttcctccaggccaccactggcatctctgtggtccttgggtggcggcagttggctgggcccagggtgtcccagcagtttgagcccccttctcctctctaaggcactggggactgggaatcagtccctggggcacactctcttccctctaaggctgaacatcagttccctggaggtgagaccacccaggactcagcctcat

SEQ ID NO: 28284 - DNA, 601 bp, Human
agctaactttgaccactaggtggaagcagaaaccaactcattgggagactattcccaagagactgaaatctggttatttctttaaacaaagtgtcagcctctgttcccagggcaggagcccatccccataggtgaaccttcagagagagcattgcttcctggggaagtgggcagcttgggtgagctgtgtgcttctgtgggctctgaacagggacagggccctgagctctcagtgcatgaaggagtttgtccacctcctggtcagagatctggggcttgggcggaaaacaaaaaaagccaygaccagggagagagtaaggagtccagcctctaccatgccccagaactagcccggcctgtgtccttcctctgacccccaaagtctctttctttgagatctctgggtgtgggtcagagagaagggaagagggggtacctcctggcaaacaagggaagtaatttcctcgctgcagtcttgcaaaggagagatgcaccctcgccagtcacctcatctcctagccccgtgccctctccttctgtgtgcactgaccaggccaggcgggtgcccagcacttaccagcctgtgtggactttctccgcg

SEQ ID NO: 28285 - DNA, 601 bp, Human
ctttgtgtattagctaactttgaccactaggtggaagcagaaaccaactcattgggagactattcccaagagactgaaatctggttatttctttaaacaaagtgtcagcctctgttcccagggcaggagcccatccccataggtgaaccttcagagagagcattgcttcctggggaagtgggcagcttgggtgagctgtgtgcttctgtgggctctgaacagggacagggccctgagctctcagtgcatgaaggagtttgtccacctcctggtcagagatctggggcttgggcggaaaacaaaaaaagccacgaccagggagagagtaaggagtccagcctctaccatgccccagaactagcccggcctgtgtccttcctctgacccccaaagtctctttctttgagatctctgggtgtgggtcagagagaagggaagagggggtacctcctggcaaacaagggaagtaatttcctcgctgcagtcttgcaaaggagagatgcaccctcgccagtcacctcatctcctagccccgtgccctctccttctgtgtgcactgaccaggccaggcgggtgcccagcacttaccagcctgtgtgga

SEQ ID NO: 28286 - DNA, 601 bp, Human
aacagatctcttccccttctgtgcccccccttctctctaccaataaatatactgtgccctctacttcttgatcctgtaatttattattgtgcattataagatttgtataataaacgttatccttctattacattattttttattgacttatttctatcttaccttattttgaaatgtaaggtggctgctttcttctataatgaaggaattgtaacaggttcaccagaaattgaggtgaaagggacctacagaccaaactctaatactacggcacacattctaattccagaggcaacatgcrtgtcctctcgtgcagtgaaacgtggcttcccttagatctagttaccgaggttttcactggttctaccaggccttctcttcctctttgtgtattagctaactttgaccactaggtggaagcagaaaccaactcattgggagactattcccaagagactgaaatctggttatttctttaaacaaagtgtcagcctctgttcccagggcaggagcccatccccataggtgaaccttcagagagagcattgcttcctggggaagtgggcagcttgggtgagctgtgtgcttctgtgggctctga

SEQ ID NO: 28287 - DNA, 601 bp, Human
caatggtgtgatcatagttcaccgcagccttaacctcctgggttcaagccatcctccaccttagcctcctgagtagctgattctacaggcatgcaccaccatgcctagctaattttttcaaatttttttgtagagatgaggtactatgttgcccaggctggtctcgaactcctgggctcaactgatcctcctgcctcagcctctcagactgccggattacaggtgttagccactgcacctggcctataagttatttttttaataacttaataatttaaacagatctcttccccttctgtgcccccccttctctctaccaataaatatactgtgccctctacttcttgatcctgtaatttattattgtgcattataagatttgtataataaacgttatccttctattacattattttttattgacttatttctatcttaccttattttgaaatgtaaggtggctgctttcttctataatgaaggaattgtaacaggttcaccagaaattgaggtgaaagggacctacagaccaaactctaatactacggcacacattctaattccagaggcaacatgcgtgtcctctcgtgcagtgaaacgt

SEQ ID NO: 28288 - DNA, 601 bp, Human
aattaaaatgaaaaacgattcatctccctgatagataaagaatctatggtcagtggggaaaggatatgagttaatcagttcacagaaagtacaacaatgatttatatgtatattttacatactcaacctgggttatggagaaaagcaaattaaaaacaaaatatcatttttccccactcactaccaatttcaaatcttgataacacacaatgttgataagcatttagagaacaggcattattcatagatgctgttgataggtgctctctctggaaagcaatttggaaatatccatcaagaygaataataccctttgactcagcaactatattctctctatatgcagatctggtcttaggcacacacaaagatgcaggtacaataacacagcttcactggctggcaagcactctgaaacaatctaagagtcctaaacctcagttaagggaatgatgaaacaaatttgggtacaatcatacaactggacactggccagccattaaaaagtttgatatgcatgaatggatgggcaaaaagatttacagaaatgaaaaagaggtatttccaagatatattaaataagttcagaagatagattgta

SEQ ID NO: 28289 - DNA, 601 bp, Human
cctcccaaagtgctgggattacaggcgtgagccaccacggccggccttcactattttaaaaacaaaaacaaaaataaacacctgaaacaaaaaaaaaaagtaagaaaaaaccctctaggtgattaaaaaaaaagatctaaatcagctccgaaatctaggcttcttatgggaaatatcactgtacagaaaaacagcaagaaaaaatagacaaacaagcaaaaaaaaaaaattacaaagaacaaaactaaaagacaaatgacaatctaggaaaaatatctgcaattaaaatgaaaaacgattmatctccctgatagataaagaatctatggtcagtggggaaaggatatgagttaatcagttcacagaaagtacaacaatgatttatatgtatattttacatactcaacctgggttatggagaaaagcaaattaaaaacaaaatatcatttttccccactcactaccaatttcaaatcttgataacacacaatgttgataagcatttagagaacaggcattattcatagatgctgttgataggtgctctctctggaaagcaatttggaaatatccatcaagacgaataataccctttgactca

SEQ ID NO: 28290 - DNA, 601 bp, Human
tgtctggtgggttacatatttcactgtctttttttgtttgtttgtttgttttgttttttgagacagagtctcactctcttgcccaggctggagtgcagtgctgcgatctcagctcactgcaacctctgccttctgggttcaagcgattctcctgctttggcctcccaagtagcttggattacaggcacacaccaccacacccagctaagttttgtatttttagtagagacgaggtttcactatgttggccaggctggtcttgaactcctgacctcgtgatctgcccgcctgggcctcccaragtgctgggattacaggcgtgagccaccacggccggccttcactattttaaaaacaaaaacaaaaataaacacctgaaacaaaaaaaaaaagtaagaaaaaaccctctaggtgattaaaaaaaaagatctaaatcagctccgaaatctaggcttcttatgggaaatatcactgtacagaaaaacagcaagaaaaaatagacaaacaagcaaaaaaaaaaaattacaaagaacaaaactaaaagacaaatgacaatctaggaaaaatatctgcaattaaaatgaaaaacgattcatctccc

SEQ ID NO: 28291 - DNA, 601 bp, Human
cttgcagtgagcagagatcgcaccactgcactccagcctgggcgacagagcaagactccatctcaaaaaaaaaaaaaaaaagcctttgttgtcatcccagctcaactacttattagctatgtaatcgtagacaagtcggttatcctgcgcttgcctccgtgtcttcatctgtaaaatggagataacgattgtacctttaccaagttgttatgaggaataaatatgtcaaaatatgtaaagcacttagaatagagatgggcgtagagagccaaatattaatatgggctatggtggtgatgawgatgatgatgatgatgatgatgatgatgatgatccctgaggatctgatgtctttccttctagtagccttggaaaagatgaggaagagggaggaaaggaacagaaggaaagaacaggtggcatttcctgagcaacaggctgtccagcaaaatggcgacaagcagagtctctggaatgagaggagactgaattgtggcttcgccgctccaccactgtggacctcatggaaggttctcattttctctgccatcagtcttctcatttgtaaagggtataaaaatacctccctgcagggggactg

SEQ ID NO: 28292 - DNA, 601 bp, Human
actcgggaggctgaggcaggagaatggcatgaaccagggaggcggagcttgcagtgagcagagatcgcaccactgcactccagcctgggcgacagagcaagactccatctcaaaaaaaaaaaaaaaaagcctttgttgtcatcccagctcaactacttattagctatgtaatcgtagacaagtcggttatcctgcgcttgcctccgtgtcttcatctgtaaaatggagataacgattgtacctttaccaagttgttatgaggaataaatatgtcaaaatatgtaaagcacttagaatagaratgggcgtagagagccaaatattaatatgggctatggtggtgatgaagatgatgatgatgatgatgatgatgatgatgatccctgaggatctgatgtctttccttctagtagccttggaaaagatgaggaagagggaggaaaggaacagaaggaaagaacaggtggcatttcctgagcaacaggctgtccagcaaaatggcgacaagcagagtctctggaatgagaggagactgaattgtggcttcgccgctccaccactgtggacctcatggaaggttctcattttctctgccatcagt

SEQ ID NO: 28293 - DNA, 601 bp, Human
gtgtgtgtgtgtgtgtgtgtgtgtctagggtattcctaggacccccaatcctatcatgagcccaagaaatgcttccctctctaaagatggcagttttattttacactggggagtccagattggttaaaacatgtcacacacaatttggtgctaagaataattaaggaagataaatttgcagatcatgtaagtgtgtgtgtgtgtgtgtgtgcatgaacacactgcaagatgtccttctgaaacacaaaagaacgcatctgtagtcacagtctaaaacatgcactggaggagcacaccccakcttcaggagagtggctaccttgggaaacagagaaagggtgagtgggcaggaatcagctccttctattgcattttatgtcatcacagaaagatccgaggcaaacataactattcaatctttaggactactctattactttgttatcatatgtatgtttagaacattttgtaattagaaagaaaacacactgcgaagtaattgcaaacattactaagcgtaccagcaccttggaaccttgctacacaaatcacagtctgtgggccagtggcacttgtatgccctggggtcggctagaaattc

SEQ ID NO: 28294 - DNA, 601 bp, Human
atcggccctgccgcctgttgttcacccttggtgagaggcctccccccaccccactgcctagctccatcctcacccatccatccactttgcaaggatctcctaccaaggacctgcaactcgtgtgtgtgcatgtgtggggcggtcctctcttcctatagcttggctatttttcctaaagaggcccttgtccacttagttgaggagagtcctcagttgaccctgacctctcaggggacagcccaagaaggatgtagccatatccaacccaaccctgcccacatccacacagctaggaagcgcyggagcagagatctgaatccacataagctggctcacattgaggtttcgaccccaacactgaagtagatttgatgaccatctccagggtcactccaccccatcatccccgcgcccaccaacaaccaccaggggctgctctgtgtcagcctctgtactgccatgtccacacatccctgcccgcttaccaatgtggtggtcaccatctcttcaaaccatttggactgggcctggttgtagagatccacacagcgcatgaggtcgtctcctggaaaaagaccacagtcaccatcatgaagcatcc

SEQ ID NO: 28295 - DNA, 601 bp, Human
tgtgctggatggacaggggtggctttaggcagtgggctgatccgatgagcacctggcatgatgcctcctgtcccatctggcccaagtaccagccacacttcactgtccactcaggcaggtgctgactgataaggagatgctgcccctttacaagaaatactcaagagcatcatcggccctgccgcctgttgttcacccttggtgagaggcctccccccaccccactgcctagctccatcctcacccatccatccactttgcaaggatctcctaccaaggacctgcaactcgtgtgtgtgcrtgtgtggggcggtcctctcttcctatagcttggctatttttcctaaagaggcccttgtccacttagttgaggagagtcctcagttgaccctgacctctcaggggacagcccaagaaggatgtagccatatccaacccaaccctgcccacatccacacagctaggaagcgctggagcagagatctgaatccacataagctggctcacattgaggtttcgaccccaacactgaagtagatttgatgaccatctccagggtcactccaccccatcatccccgcgcccaccaacaaccaccagg

SEQ ID NO: 28296 - DNA, 601 bp, Human
cctgctccgccacgcacagtgctgagggctttacgtgcgttccttaactgtcctcgttacaattttaagagatcgtttctgttattatccccattctccaagcaagggaactggggaactaacacctagagaggcaacaacacagctcacccaaagcgacacggaattatgggaggaacaggatttaaaccagagtccatcaggctgttactcatggcaatgcacccatgcagccctggccctggtgccctgatggggtataacaagggggcacatgtgggagctccatgccacacattcstgggaccttgtccctgggcctctgctgagcagcctcccttcctctgcctatgcctagtgctgtggccgcaatagagaccgggccagggaggcagactgggctgcacgtggcacagcttttgtcaaaggggagcgtggaaagggtttgtcctctggtttctagatggttttgtgtctttggaatctaggggatccggctgttactctgcatacaactaggtcactgcccaggtgattaatcagaaaggggggtaaagcagggggcttaattaggagattaaccaggaggaaaactaggtca

SEQ ID NO: 28297 - DNA, 601 bp, Human
ctgccgagaaagcaaaggccagagaactctgagcacgtcccctccacttgggggtccccccaccaagaccacaaaacgcaagtcactggctgtggacattctgtcccatctgactctctggggtctgatgaagagcgtgccccatatctaaggtgaaggtgaagctgatgacagcagcagcggctgttttacttcctgaaaagcctgctccgccacgcacagtgctgagggctttacgtgcgttccttaactgtcctcgttacaattttaagagatcgtttctgttattatccccattctycaagcaagggaactggggaactaacacctagagaggcaacaacacagctcacccaaagcgacacggaattatgggaggaacaggatttaaaccagagtccatcaggctgttactcatggcaatgcacccatgcagccctggccctggtgccctgatggggtataacaagggggcacatgtgggagctccatgccacacattcctgggaccttgtccctgggcctctgctgagcagcctcccttcctctgcctatgcctagtgctgtggccgcaatagagaccgggccagggaggcagact

SEQ ID NO: 28298 - DNA, 601 bp, Human
tcagtggcccaggagagagggtggggggcatccactcggcatgggccccatggtgggagcccagcccccctccccagcaggaccccccgaagctgcacaggcccatctagatctccatgtccacagggcggatgttgcccgtcttgtgctctctgacccacagctccctgtctttggccgggtccacttttcgaagcagctgatccacgggctcgactgtctgcaagagacagagaaaatgcgacactgttagagacggcggccaagccagggaggtctcctctgagacatgctgtcctcrccttagtgtctctgagagcagcctctctagagggctccggggccccagggggaggcccatctgagggacagcacatgaagagggctgtgaacggggaacccagtatgcatcccgaccctgcttctcaccctgcagaccccaggcctggatgagaggccaggagggccttaaaacctgtctctatcccttccaccccacatttaccaccagtgaacaggacaaataaaacttgagctttaggtattgtgaatatttctagaagttgttttttttggttttgttttttaagaaatttaataa

SEQ ID NO: 28299 - DNA, 601 bp, Human
tgtccgggtcacccttctggaatcaccagctctctcccctctcctcagtggcccaggagagagggtggggggcatccactcggcatgggccccatggtgggagcccagcccccctccccagcaggaccccccgaagctgcacaggcccatctagatctccatgtccacagggcggatgttgcccgtcttgtgctctctgacccacagctccctgtctttggccgggtccacttttcgaagcagctgatccacgggctcgactgtctgcaagagacagagaaaatgcgacactgttagagayggcggccaagccagggaggtctcctctgagacatgctgtcctcaccttagtgtctctgagagcagcctctctagagggctccggggccccagggggaggcccatctgagggacagcacatgaagagggctgtgaacggggaacccagtatgcatcccgaccctgcttctcaccctgcagaccccaggcctggatgagaggccaggagggccttaaaacctgtctctatcccttccaccccacatttaccaccagtgaacaggacaaataaaacttgagctttaggtattgtgaatatttc

SEQ ID NO: 28300 - DNA, 601 bp, Human
cccctggtgatgaacagtggctgagaaagccagatgtggactcccagaatgcaatgggaaaaaaataaagaaggagggctgcaaaggattctgggtgcggctgtgagctgaatggcaccttctacccatgattctgatcctgacacctggcttagagacagagccctccctaccctgatcctccaaagccctggagacaagggagccagctggaggaagagccttggggcttccagggcacaagcatgtgacagtgacccctacaaaactcggcaaggaccacaaagttccagcctctgtytgtttcagagcggcaagcacagcatgggagtcagggggtcttcagcctcagagacaagggcagggctgtgggtctgtcttctgggcctgggaatatgggggagcccccagctaggctgtccgggtcacccttctggaatcaccagctctctcccctctcctcagtggcccaggagagagggtggggggcatccactcggcatgggccccatggtgggagcccagcccccctccccagcaggaccccccgaagctgcacaggcccatctagatctccatgtccacagggcggatgttgccc

SEQ ID NO: 28301 - DNA, 601 bp, Human
ttacagatggcgcctgatctcatgggacacgattcagcgctcaatttggggctaatttgccgaatgaggtagttccatcctgacctctccaggcatggtgggtctgggaagacaggagccaagccttcctcctaaaacccctggtgatgaacagtggctgagaaagccagatgtggactcccagaatgcaatgggaaaaaaataaagaaggagggctgcaaaggattctgggtgcggctgtgagctgaatggcaccttctacccatgattctgatcctgacacctggcttagagacagagmcctccctaccctgatcctccaaagccctggagacaagggagccagctggaggaagagccttggggcttccagggcacaagcatgtgacagtgacccctacaaaactcggcaaggaccacaaagttccagcctctgtttgtttcagagcggcaagcacagcatgggagtcagggggtcttcagcctcagagacaagggcagggctgtgggtctgtcttctgggcctgggaatatgggggagcccccagctaggctgtccgggtcacccttctggaatcaccagctctctcccctctcctca

SEQ ID NO: 28302 - DNA, 601 bp, Human
ctctgggctcttttctacccgctgcgtgtgtgctcatgcaggtgtgcaggtggggtgctgctggagcttgtgccgtgttgtgggtgggcctccccttggcccctgagagcccagacagtatctagaatcataggcttgttggagaccacagccccctcctccaggaagctctcctgacctgccctttcccaggaagaaatgcagcctcctcctctgcacgcaggcagcacagaccaccctgtcctcacccagcaggatgcatgggctggtctctgtccctggcaggtgctgagcacagccrtggcatcggcaagtgtttctgggagaaatcactcatcccccagtccagtctcccctcttatggacgagtgtagaagtcaaggacgtttccagcccacaggcagaagtgggcagagccggtcacctgcagtgcaggtcccccaccccgggctgccatgtccctgtctcgccatctgggtcttgctgagagcaagcctggtgctctctcctctctgcctcacccttccctggtggaagattccctgtcctcactggagcctggggacggaggtaattttcatgtcctagggtctgggattca

SEQ ID NO: 28303 - DNA, 601 bp, Human
gcaggtggggtgctgctggagcttgtgccgtgttgtgggtgggcctccccttggcccctgagagcccagacagtatctagaatcataggcttgttggagaccacagccccctcctccaggaagctctcctgacctgccctttcccaggaagaaatgcagcctcctcctctgcacgcaggcagcacagaccaccctgtcctcacccagcaggatgcatgggctggtctctgtccctggcaggtgctgagcacagccgtggcatcggcaagtgtttctgggagaaatcactcatcccccagtycagtctcccctcttatggacgagtgtagaagtcaaggacgtttccagcccacaggcagaagtgggcagagccggtcacctgcagtgcaggtcccccaccccgggctgccatgtccctgtctcgccatctgggtcttgctgagagcaagcctggtgctctctcctctctgcctcacccttccctggtggaagattccctgtcctcactggagcctggggacggaggtaattttcatgtcctagggtctgggattcagattctgactcctcaactctgctgtgtgacctgggcagatggcct

SEQ ID NO: 28304 - DNA, 601 bp, Human
ccgtgttgtgggtgggcctccccttggcccctgagagcccagacagtatctagaatcataggcttgttggagaccacagccccctcctccaggaagctctcctgacctgccctttcccaggaagaaatgcagcctcctcctctgcacgcaggcagcacagaccaccctgtcctcacccagcaggatgcatgggctggtctctgtccctggcaggtgctgagcacagccgtggcatcggcaagtgtttctgggagaaatcactcatcccccagtccagtctcccctcttatggacgagtgtrgaagtcaaggacgtttccagcccacaggcagaagtgggcagagccggtcacctgcagtgcaggtcccccaccccgggctgccatgtccctgtctcgccatctgggtcttgctgagagcaagcctggtgctctctcctctctgcctcacccttccctggtggaagattccctgtcctcactggagcctggggacggaggtaattttcatgtcctagggtctgggattcagattctgactcctcaactctgctgtgtgacctgggcagatggcctgacctctctgacctcattcaggtctca

SEQ ID NO: 28305 - DNA, 601 bp, Human
caagcctggtgctctctcctctctgcctcacccttccctggtggaagattccctgtcctcactggagcctggggacggaggtaattttcatgtcctagggtctgggattcagattctgactcctcaactctgctgtgtgacctgggcagatggcctgacctctctgacctcattcaggtctcatccctgacccaggcacagccactggtcagtttaggagggggaggactgacgggctgtcactcccctgttgaagaaatgctgccacctcgtggttaagaggcttagaactatttcaaargccgctttcagaccagtgctgtccaacagaaacacaaagccatccacgcacagaattttatattttctagtagccacactaatgaggtaacagaaacaggcgaaactgattttaataacaaattcttttttttttttttgagatggagtctcactctgtcgcccaggctggagtgcagttgcgcaatctcagctcactgcgagctccacctcccgggttcacgccattctcctggctcagcctcccgagtagctgggactacaggcatctgccaccgcgcccaactaattttttgtagtt

SEQ ID NO: 28306 - DNA, 601 bp, Human
gcctggtgctctctcctctctgcctcacccttccctggtggaagattccctgtcctcactggagcctggggacggaggtaattttcatgtcctagggtctgggattcagattctgactcctcaactctgctgtgtgacctgggcagatggcctgacctctctgacctcattcaggtctcatccctgacccaggcacagccactggtcagtttaggagggggaggactgacgggctgtcactcccctgttgaagaaatgctgccacctcgtggttaagaggcttagaactatttcaaaagccgctttcagaccagtgctgtccaacagaaacacaaagccatccacgcacagaattttatattttctagtagccacactaatgaggtaacagaaacaggcgaaactgattttaataacaaattcttttttttttttttgagatggagtctcactctgtcgcccaggctggagtgcagttgcgcaatctcagctcactgcgagctccacctcccgggttcacgccattctcctggctcagcctcccgagtagctgggactacaggcatctgccaccgcgcccaactaattttttgtagtttta

SEQ ID NO: 28307 - DNA, 601 bp, Human
ctgggattcagattctgactcctcaactctgctgtgtgacctgggcagatggcctgacctctctgacctcattcaggtctcatccctgacccaggcacagccactggtcagtttaggagggggaggactgacgggctgtcactcccctgttgaagaaatgctgccacctcgtggttaagaggcttagaactatttcaaaagccgctttcagaccagtgctgtccaacagaaacacaaagccatccacgcacagaattttatattttctagtagccacactaatgaggtaacagaaacaggmgaaactgattttaataacaaattcttttttttttttttgagatggagtctcactctgtcgcccaggctggagtgcagttgcgcaatctcagctcactgcgagctccacctcccgggttcacgccattctcctggctcagcctcccgagtagctgggactacaggcatctgccaccgcgcccaactaattttttgtagttttagtagagacagggtttcaccgtgttggccaggatggtctcgatctcctgacctcgtgatccacccgccttggcctcccaaagtgctgggattacaggcg

SEQ ID NO: 28308 - DNA, 601 bp, Human
acctgggcagatggcctgacctctctgacctcattcaggtctcatccctgacccaggcacagccactggtcagtttaggagggggaggactgacgggctgtcactcccctgttgaagaaatgctgccacctcgtggttaagaggcttagaactatttcaaaagccgctttcagaccagtgctgtccaacagaaacacaaagccatccacgcacagaattttatattttctagtagccacactaatgaggtaacagaaacaggcgaaactgattttaataacaaattcttttttttttttttgagatggagtctcactctgtcgcccaggctggagtgcagttgcgcaatctcagctcactgcgagctccacctcccgggttcacgccattctcctggctcagcctcccgagtagctgggactacaggcatctgccaccgcgcccaactaattttttgtagttttagtagagacagggtttcaccgtgttggccaggatggtctcgatctcctgacctcgtgatccacccgccttggcctcccaaagtgctgggattacaggcgtgagccaccacgcctggcctgtaacagattctatttaa

SEQ ID NO: 28309 - DNA, 601 bp, Human
tagtagccacactaatgaggtaacagaaacaggcgaaactgattttaataacaaattcttttttttttttttgagatggagtctcactctgtcgcccaggctggagtgcagttgcgcaatctcagctcactgcgagctccacctcccgggttcacgccattctcctggctcagcctcccgagtagctgggactacaggcatctgccaccgcgcccaactaattttttgtagttttagtagagacagggtttcaccgtgttggccaggatggtctcgatctcctgacctcgtgatccacccrccttggcctcccaaagtgctgggattacaggcgtgagccaccacgcctggcctgtaacagattctatttaacccaatatgtccaaaatattccagcattttggcattcatataaaaattattaatgaaacacactgtttttagtactaagtctgaaatttggtatgcatttcacacatcgcacacattggtttgatcttgccacatgtgaagggctcagtggccacgtgtggctcgtggctgctgtactggagaccatggcttgagagccttctaggggcataggctttcaccccactgt

SEQ ID NO: 28310 - DNA, 601 bp, Human
agcattttggcattcatataaaaattattaatgaaacacactgtttttagtactaagtctgaaatttggtatgcatttcacacatcgcacacattggtttgatcttgccacatgtgaagggctcagtggccacgtgtggctcgtggctgctgtactggagaccatggcttgagagccttctaggggcataggctttcaccccactgtgcgtttgcaagtctgcagggggatccggggatgtctgtgtcccacggtggttggggtggggaagcaatggtgaatagcctaaccagccacagtygtcctggctttgctctgtggctgccagggcaggtgcggcctgggagaggcagagggtgggctttgggtcagcaggcccacccccgtgtggtaaggggcaaaaccagaggcctacggaggccaaggcagctggcaaaggcccagccacatcatgggactagctgtgtggtcttggggcagttgcagcccccgagggctcctcccagaccatcctgactctcttgtggccacagcagcacccactggggcttgctgattgttgggggaagaattgtgttttccagaaaagacatactgatga

SEQ ID NO: 28311 - DNA, 601 bp, Human
gtggccacgtgtggctcgtggctgctgtactggagaccatggcttgagagccttctaggggcataggctttcaccccactgtgcgtttgcaagtctgcagggggatccggggatgtctgtgtcccacggtggttggggtggggaagcaatggtgaatagcctaaccagccacagttgtcctggctttgctctgtggctgccagggcaggtgcggcctgggagaggcagagggtgggctttgggtcagcaggcccacccccgtgtggtaaggggcaaaaccagaggcctacggaggccaagscagctggcaaaggcccagccacatcatgggactagctgtgtggtcttggggcagttgcagcccccgagggctcctcccagaccatcctgactctcttgtggccacagcagcacccactggggcttgctgattgttgggggaagaattgtgttttccagaaaagacatactgatgatgtaatccctggcacctgtgaatgggagcgtacttggaaacaaggtctttgtggatgaaatctgattcagatgaggcctcacgggattagggcaggccctaagccaataactggtatccctagaa

SEQ ID NO: 28312 - DNA, 601 bp, Human
tgattcagatgaggcctcacgggattagggcaggccctaagccaataactggtatccctagaagaagagggagatttgggcagagacagacacagggacaaagttcacacatgacaacagaggcagggactggagtgctctggccacgagccaaggagcacctggggccaccaggagccgggaggggcgggagagttcttcccttagagccttgacagggagtgcggccctgcagacctgcagacttccagccttccagcctccagggctctgaactgttgttgcttttttttttcaagayagagtctctctgtcacccaggctggagtgcagtggtgtgatcttggctcactgcaacctccacctcccaggttcaagtgattctcccacctcagcctcccgagtagctgggactacaggtgtgtgccaccatgcccggctaatttttgtatttttagtagagacggggtttcaccatgttggccaggctggtcttgaactcctgacctcgtgatccacccgcctaggcctcccaaagtgctgggattacaggtgtgggccactgcacccggctgttgttgatttaacctaagcatggtgg

SEQ ID NO: 28313 - DNA, 601 bp, Human
tgggcagagacagacacagggacaaagttcacacatgacaacagaggcagggactggagtgctctggccacgagccaaggagcacctggggccaccaggagccgggaggggcgggagagttcttcccttagagccttgacagggagtgcggccctgcagacctgcagacttccagccttccagcctccagggctctgaactgttgttgcttttttttttcaagatagagtctctctgtcacccaggctggagtgcagtggtgtgatcttggctcactgcaacctccacctcccaggttcargtgattctcccacctcagcctcccgagtagctgggactacaggtgtgtgccaccatgcccggctaatttttgtatttttagtagagacggggtttcaccatgttggccaggctggtcttgaactcctgacctcgtgatccacccgcctaggcctcccaaagtgctgggattacaggtgtgggccactgcacccggctgttgttgatttaacctaagcatggtgggcgctttgctagggcagccctggcaaacaaacccacccctctctgtgccttgcacatggcggccagtggaagtggg

SEQ ID NO: 28314 - DNA, 601 bp, Human
caccctggtggtgtccttgggggcacggagcctgcgtggctgactctgggaggggcctgggtctgggtgcagcagtgcctgctggtgagggctccgggggctgacagttaaaacttttggaatcttctgaggactcagcggcttacggtgggaagcttgagattggccacagtagaggtacttgtgccccagcactcacagatgccacctcagggctcttctgtcctggacatcaggcttgtgggcaccatggcccagccccgggcttcgagccagatggatgccactgacgcctgctgcygcctgtctgtccttaggcaggtcatgtgacctctcagacgcagctttcatgcctgggaaatgggggtgactgtggtgtctgcctcaggggctgctgtgaagactccatgagatggagctggcggagggtggcctgggctggtccctacctgcactcagggccctggccgtgtgttgcccggtgagtgaaggatggcgaggcaggtccctaacagtgccatgtctctctttccaggtgaatgccacaggccaccagctgcagacagcggtacagtaccgggacctccctggcttctgttct

SEQ ID NO: 28315 - DNA, 601 bp, Human
ctgggaaatgggggtgactgtggtgtctgcctcaggggctgctgtgaagactccatgagatggagctggcggagggtggcctgggctggtccctacctgcactcagggccctggccgtgtgttgcccggtgagtgaaggatggcgaggcaggtccctaacagtgccatgtctctctttccaggtgaatgccacaggccaccagctgcagacagcggtacagtaccgggacctccctggcttctgttctgtaggagggctgcagcccccacactgtcagagcactttaggcagctgaatccrtgatttcagaagtgggtaatggataacacagcccattaatcaaactagaaccccctcgtaaacagccagagaaaaattagacataacaaaaaaagaccagctaggaaaaggtgcaccagcttcccaccgggctatgcccaccccagcccctgcagagatgtcctctccatccctctccagtccccactgcagtcacacgtcctgcatttgggccttgtccacatgcatttcatggtcactggctctgtgccgggcccctgctgagtctggggtttgggtgagtcacctccccctccaggc

SEQ ID NO: 28316 - DNA, 601 bp, Human
ggctggtccctacctgcactcagggccctggccgtgtgttgcccggtgagtgaaggatggcgaggcaggtccctaacagtgccatgtctctctttccaggtgaatgccacaggccaccagctgcagacagcggtacagtaccgggacctccctggcttctgttctgtaggagggctgcagcccccacactgtcagagcactttaggcagctgaatccgtgatttcagaagtgggtaatggataacacagcccattaatcaaactagaaccccctcgtaaacagccagagaaaaattagacrtaacaaaaaaagaccagctaggaaaaggtgcaccagcttcccaccgggctatgcccaccccagcccctgcagagatgtcctctccatccctctccagtccccactgcagtcacacgtcctgcatttgggccttgtccacatgcatttcatggtcactggctctgtgccgggcccctgctgagtctggggtttgggtgagtcacctccccctccaggccccgatttcctccttgtgacaggaggagtgctgaacgaatcttgtgagatggtttcaaaagtgacgtgggagccaaccaatgt

SEQ ID NO: 28317 - DNA, 601 bp, Human
gaatccgtgatttcagaagtgggtaatggataacacagcccattaatcaaactagaaccccctcgtaaacagccagagaaaaattagacataacaaaaaaagaccagctaggaaaaggtgcaccagcttcccaccgggctatgcccaccccagcccctgcagagatgtcctctccatccctctccagtccccactgcagtcacacgtcctgcatttgggccttgtccacatgcatttcatggtcactggctctgtgccgggcccctgctgagtctggggtttgggtgagtcacctccccckccaggccccgatttcctccttgtgacaggaggagtgctgaacgaatcttgtgagatggtttcaaaagtgacgtgggagccaaccaatgtgaagtgctcaggtcagggctgaggacagggctttttccctgaaaggggcaaacatttcattgtcgcctcctgacggatttgggcatctggtgtattctaagtggaggctttcaaaatatcagaaaaaaaattctgggtaccaagtcaatgacatatgtaaaatgcctattttattttattttttatttatttatttttatttttagagatg

SEQ ID NO: 28318 - DNA, 601 bp, Human
tgccgggcccctgctgagtctggggtttgggtgagtcacctccccctccaggccccgatttcctccttgtgacaggaggagtgctgaacgaatcttgtgagatggtttcaaaagtgacgtgggagccaaccaatgtgaagtgctcaggtcagggctgaggacagggctttttccctgaaaggggcaaacatttcattgtcgcctcctgacggatttgggcatctggtgtattctaagtggaggctttcaaaatatcagaaaaaaaattctgggtaccaagtcaatgacatatgtaaaatgyctattttattttattttttatttatttatttttatttttagagatggaggtcttgctgtgttacccaggctggtctcaaactcctggcctcaagtgatcctcgcatctcagcctcccaaaatgctggaattacaggcgttagccaccttgcctggctgtaaaatgtggtgagcagggcaatgtgaggcagaaagaatcctgtcctttctagactttgacatgagacgtggcaaaatgtcatgacttgtcctatgcgatgccacatcgggaaagtccagctgaggaaaagaggagaaggcc

SEQ ID NO: 28319 - DNA, 601 bp, Human
ttcattgtcgcctcctgacggatttgggcatctggtgtattctaagtggaggctttcaaaatatcagaaaaaaaattctgggtaccaagtcaatgacatatgtaaaatgcctattttattttattttttatttatttatttttatttttagagatggaggtcttgctgtgttacccaggctggtctcaaactcctggcctcaagtgatcctcgcatctcagcctcccaaaatgctggaattacaggcgttagccaccttgcctggctgtaaaatgtggtgagcagggcaatgtgaggcagwaagaatcctgtcctttctagactttgacatgagacgtggcaaaatgtcatgacttgtcctatgcgatgccacatcgggaaagtccagctgaggaaaagaggagaaggccatctgggggtgcgagcgtggagccagcggctgcggggacacagtcagctcccgacggggctggagggccctgctaggccgatgagggccttaaagatggggcttttggagctaaacaaacagctgtgatgaggaagcaggaaggtgcccagcaacaatgaggaccctaccctctgcctgggcttacggcat

SEQ ID NO: 28320 - DNA, 601 bp, Human
aactcctggcctcaagtgatcctcgcatctcagcctcccaaaatgctggaattacaggcgttagccaccttgcctggctgtaaaatgtggtgagcagggcaatgtgaggcagaaagaatcctgtcctttctagactttgacatgagacgtggcaaaatgtcatgacttgtcctatgcgatgccacatcgggaaagtccagctgaggaaaagaggagaaggccatctgggggtgcgagcgtggagccagcggctgcggggacacagtcagctcccgacggggctggagggccctgctaggcygatgagggccttaaagatggggcttttggagctaaacaaacagctgtgatgaggaagcaggaaggtgcccagcaacaatgaggaccctaccctctgcctgggcttacggcatccctgcgagctgcagagcagagatgagccggctgagccgcatctgtcattatccacttctcatccaagtcctgagccccaactgacccattagggtccccaaagacactagacgcccaaagcaggatgtgtcttttgggacgtctttgtgctgcggctgtggctcctgggtggtctgtgcctgtccct

SEQ ID NO: 28321 - DNA, 601 bp, Human
gggctgctccccgaggcagcatgttccccacaaaagggtgccaggcagggtcgggggctcagtgcagatggaggatcctctcgctgcccagggccccctagcagaagtctccagccccttagaggcaggctggggtggaagggtgctgagtccaagtgggggcagtgcccccgcccagggtgcagtgagcaggcctcgtgtgggggagcctgggctcagagtgcagggctggccctgggggtccagtcctcagccacagaccctccagaaccacagtgcttacccctggtcaaggggggggcgggacatttacatcccccgggaggtctggcgggcaaagcttcacgattgctcatcgctgggcctggaagatcacacagagggtttggcttggagtgactcctccaagcagggtctgcaccgccctgtgggctcaaggagggagaggagctgtggagaaatgctttgatgtctcttgcagatgaaacagtggagggggagtgggcaagactgggccaccatgggccacttgtctctgaggtgcgcaaagaggtgccagagggccacttggcagcggggctggttgggggccctgcatgga

SEQ ID NO: 28322 - DNA, 601 bp, Human
gtgtgccacattcaactgtgcagggcagtgtccgctcatggttgggttcagaggatctgactgcgggtgccacacatgtgctagctcacgcgagtctcacgacagccttgctccatggaagaggaagtggagcctcgggaagggtgacagcagtggggtctttagctggagtggcccaagcccattgcggatggagggatggatttggccatttgtcaaacagctaccgagcacccactgtacatgtggctttgtgctgggacattgaggagggcaggagaaggaaggcagacaaacaccygggccgggctccagcaagccctgggttccgggctatgtcaggtgctcagggctgaacctggcatgtcttgcagcctctggctcccaatctgagaagggtggaccctgggctcccatgcgatgcagcggtagggggggtgccctttgccagcaggtgggagccgtctgtctgcagagctcagtccctgtagaggtggtggagctgcctgtgggaggccagggaggcgaggaaggaagccaagcccacagccctgggaaagcccaaggagtcggttggagattattttgggcatctctacca

SEQ ID NO: 28323 - DNA, 601 bp, Human
aggtggtggagctgcctgtgggaggccagggaggcgaggaaggaagccaagcccacagccctgggaaagcccaaggagtcggttggagattattttgggcatctctaccaccaaattgccggcttcctctgctagtctttcccctggagaaccgttttgagcagaagcaaaaccacagggcaaggagaagcttagaggagcacattaactctctgtggacccaggaacagcctgcgggcacctgcgtcctgctcctgtgggcctgactgctgcaaagcccctggcggggtggagggagctragcgtcaccggggtggccctcagggcacctctgttctagtggatgacaggatggtggggaagctggtgcgtatgtggtgtagagacgttcgtattctagttccagaacccctccctcttccccagcccccttttttcttcctcccccaagtccttcccagagcccccctttctgtttccttcctggacaggcactcactgttgtaccgatgaggttgtaacagaaacactgggaagcctcacagcagccggagggggcaccacaaggagccttcctgtttccaccattagccaagcaaat

SEQ ID NO: 28324 - DNA, 601 bp, Human
gagctgcctgtgggaggccagggaggcgaggaaggaagccaagcccacagccctgggaaagcccaaggagtcggttggagattattttgggcatctctaccaccaaattgccggcttcctctgctagtctttcccctggagaaccgttttgagcagaagcaaaaccacagggcaaggagaagcttagaggagcacattaactctctgtggacccaggaacagcctgcgggcacctgcgtcctgctcctgtgggcctgactgctgcaaagcccctggcggggtggagggagctgagcgtcaycggggtggccctcagggcacctctgttctagtggatgacaggatggtggggaagctggtgcgtatgtggtgtagagacgttcgtattctagttccagaacccctccctcttccccagcccccttttttcttcctcccccaagtccttcccagagcccccctttctgtttccttcctggacaggcactcactgttgtaccgatgaggttgtaacagaaacactgggaagcctcacagcagccggagggggcaccacaaggagccttcctgtttccaccattagccaagcaaatgaagcaga

SEQ ID NO: 28325 - DNA, 601 bp, Human
catccatccatccatccatccatccatccatttattcattcagccattacacatccatccatcatccacccattcattcatacatccatgcatccatccactcatcatccatccatttatttacacacccatccatcatccgtccatccattcatgcatcaatttatccattatttcatccagccattattcactcatccatccatcattgatttatccatctatccattcatccatcattgatatatctatccatccagccatccagccagccattattcatccatccatccatccatccatccatcattgatatatccattcatccactcaagggccaaccaccttcccagctaagtaccaatgtgcactttgacttattacacaaacatgaagagagaccatcagttaaatttgcatgaatcaatgataacatatattattcatattcttgagttatgctaactaagaattctggctaggcataaaaaacgagcttaacaaaagtgatgaccttgatgagacctcattatatacagagattcttgagtcaaaacaagtatgaattggtcccagcccatctggtcattcttgctgagtg

SEQ ID NO: 28326 - DNA, 601 bp, Human
ggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgaggtgagcgcccagatgcctggatcctgtgggccaccgcccgaaccaccccctcattcatccatttatgagtagtttatcccagcagtgcttcgttcctgcctctctaggagaggagcattcagcaggtgtcgatactggcaaacccctgcttcargggctggggagaaggaaggcactgagaattctaggtgaattaaaaaggtgatgcgtgtgatagaggaaaatgatggaaagggagtcgatggtgcccgtgtgtgtcagcggggggtcagggtagctctcggggaggtgggcaacgagcagagcaggtgactgtcgagggcgccccactcagggggagcagccagggaaggccccaaggctgtgacatcagcaaggagccccggggtggagaggaggccaagggtcaggcatgcccccgagctcatcacataaagccgggggaaaccgcagc

SEQ ID NO: 28327 - DNA, 601 bp, Human
agttattccaggctctctggagttgtccttccctggggacaggagagcctggtgctccctccctgcctcagttacctgtctgtgaaatgggaacacctccttgctggggtgttggtgagattcagagattcatgttggaaacgcctagatccccgcaggggcccagtgatgggggccgagtccagctggtgcgttgatgtagagaccgttaatagtctgcaccattggagcccagagggctgctgaagcccagggtatggctgcgggccagtgggaaagcccagccctgagggcggcctcrtctgtcctgggcaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaaggtgagagggctgtcgggtgtgtgcaggggagggagacagtgtgcgcggtccccttggagctggtgcccctccagtcctgagctcagtgaaggcaaagctcctaggaacctctactcagagcgggtca

SEQ ID NO: 28328 - DNA, 601 bp, Human
ctgcaccattggagcccagagggctgctgaagcccagggtatggctgcgggccagtgggaaagcccagccctgagggcggcctcatctgtcctgggcaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaaggtgagagggctgtcgggtgtgtgcaggggagggagacagtgtrcgcggtccccttggagctggtgcccctccagtcctgagctcagtgaaggcaaagctcctaggaacctctactcagagcgggtcagcaccacctgctccaggcccagctctgcagggaagccccttcctcctggaagtctgtggcctcaggggccgtcgctcccctgatctccccgaggctggctgcactgtctttcacatgtccccgtctgggagctcctggggtggggaccctgcctcagcgctgctgttcctttgagctccgcccggcgcctggcggggtccccagtgcttcccaccg

SEQ ID NO: 28329 - DNA, 601 bp, Human
ttactcactcattcattgtcactcattcactcatcactcactcattctcttattcattcacacactaattttctcattcagtcattcatccattcactcatgcacttattcactttttcactcactcattctctcattcattcactcacaaactcattcactcactcttattctttcactcattggtttattcccgcactccttccctcactcattcattcattgactcttgcaggtagtgcacaccaagggtgcgaggggtgaggtgtctggttctctgctcagacctctgcaagtgccygcagaggtgactgggcggcctccacttctggcctggccttgcacccctgtgctcttgggggccatggctgggcagggcaggtgtccccctctgcacaggcccagtgtgtctcagcctcagagctggcagggcagggcaggcatcccctctgcactggcccagtgtctctcagcctcagaaccagatgtgagaagacgtccccaggggggatgttcaccccagtgagtcccatcagagccagagaaaataacactgtttccaagccatcaatcatcgggcagtgaccatgcagccctgtgg

SEQ ID NO: 28330 - DNA, 601 bp, Human
aacccctttctggctttgccaacgcttgctgtgggaatgagcatagccagtttcccaagggcttcctggggcaggagctgggtgggctgggtttcccacggtcctcagcctgtgtttctgggtccccattcagtcccagcttccctgctcccgcctggtttcatttatctgtgtctcttccttgcccatgtgcgcccagcctctggaccgacagctcctctgatgtccttgtcctgcacctgccctcccaggtcaggcctgtgttagccagatctgggcccctgcaccccagggttttggkgactggtggtcggcagccaccttccatgccttagccctagagactgaccagtgatgggagggaggccccagggcaagggcagggaggagggactgtagggcagggaggccttgtgggtagaaagggtgacacggtgggttgggtcaggagcagactttggagagagtcttgtcccaccctcctaccccccgaggctacaccctgtcaagctgacggataaaggcaggtcagaggtgggacacaggtagaatgtagcagatgtggcctgggcagatggaccgtttgttggatgtgattcat

SEQ ID NO: 28331 - DNA, 601 bp, Human
gcaggagctgggtgggctgggtttcccacggtcctcagcctgtgtttctgggtccccattcagtcccagcttccctgctcccgcctggtttcatttatctgtgtctcttccttgcccatgtgcgcccagcctctggaccgacagctcctctgatgtccttgtcctgcacctgccctcccaggtcaggcctgtgttagccagatctgggcccctgcaccccagggttttggtgactggtggtcggcagccaccttccatgccttagccctagagactgaccagtgatgggagggaggccccrgggcaagggcagggaggagggactgtagggcagggaggccttgtgggtagaaagggtgacacggtgggttgggtcaggagcagactttggagagagtcttgtcccaccctcctaccccccgaggctacaccctgtcaagctgacggataaaggcaggtcagaggtgggacacaggtagaatgtagcagatgtggcctgggcagatggaccgtttgttggatgtgattcattcttgatgggaaagtccgctgaggcttcctgctatgaggcagggcaggccactcctgagctgatgctgcc

SEQ ID NO: 28332 - DNA, 601 bp, Human
accgacagctcctctgatgtccttgtcctgcacctgccctcccaggtcaggcctgtgttagccagatctgggcccctgcaccccagggttttggtgactggtggtcggcagccaccttccatgccttagccctagagactgaccagtgatgggagggaggccccagggcaagggcagggaggagggactgtagggcagggaggccttgtgggtagaaagggtgacacggtgggttgggtcaggagcagactttggagagagtcttgtcccaccctcctaccccccgaggctacaccctgtyaagctgacggataaaggcaggtcagaggtgggacacaggtagaatgtagcagatgtggcctgggcagatggaccgtttgttggatgtgattcattcttgatgggaaagtccgctgaggcttcctgctatgaggcagggcaggccactcctgagctgatgctgccccacccacaggtgcaggggctgctggcaggatagtggtccatggtctgccaccctggaaccacagggcctgagtggggttgtgtttgtgcccttggtttgtgtctgtgggactgagtccagatggcacagcctcac

SEQ ID NO: 28333 - DNA, 601 bp, Human
ctcattcactcactcattcactcattccctcactctttcacttgctcacgcattcgctcactcactcattcactcattcattcgctcattcactcactcactcactcactcactgggccctgcctgtccaccctctagtgtcctccactcctcctttctgacagagggagccccctcctcagcacagacctgtcctgcttggtggggccctgatgagctcatgcagggtgagcccttcgcctgcctgacccaccaggagcctctgcccaaggtcagtctgggacttacagacggcccagarcccccacaaaggaggatctgtggactctgcctgggggatgggcacaatgcggggaagctctgggctgggaagggaagcctgtggggagggacccaggatcccagccacacatccaaacatgtcaagggtggcagatcctgtgagctgtgttctgtccctctgccaactgcagtggaagctggagggtggggtagtcagggaggggcttcctgcaggctgagtcccagcctctgatggtgctggtcagcctggaggtggagtggggtggggaatgaagcagtgattattcatagaagtagt

SEQ ID NO: 28334 - DNA, 601 bp, Human
tccaccctctagtgtcctccactcctcctttctgacagagggagccccctcctcagcacagacctgtcctgcttggtggggccctgatgagctcatgcagggtgagcccttcgcctgcctgacccaccaggagcctctgcccaaggtcagtctgggacttacagacggcccagagcccccacaaaggaggatctgtggactctgcctgggggatgggcacaatgcggggaagctctgggctgggaagggaagcctgtggggagggacccaggatcccagccacacatccaaacatgtcaarggtggcagatcctgtgagctgtgttctgtccctctgccaactgcagtggaagctggagggtggggtagtcagggaggggcttcctgcaggctgagtcccagcctctgatggtgctggtcagcctggaggtggagtggggtggggaatgaagcagtgattattcatagaagtagttggctttggagatgaagtcggggaaaatgcagcccacccttgccttcactgctccaacagcctgggctttataaactgtcaagccaacctgcacacaccctgtggacaccatgtctgtgtgtaacc

SEQ ID NO: 28335 - DNA, 601 bp, Human
tgaagccatcttcgcagcctgctctgaaaacttttctctcctgctcaatggttggcacctgtgatctttccctggtgcggcgcagcctctctcccttccagaacccaggcagagggccctcagcccccgtcatagccctgtgactggggtctgcaacagacacccacgagcagagctgggagaggcccctctctgttcctttttttttttttttttgagacggagtctcgctctgtcaccaggctggagcacagtggtgcgatcgcagctcactgcaatctctgcctcccgggttcaagcrattctcctgcctcagcctcccgagtagctgggattacaggcgcccaccaccacacccagctaatttttgtatttttagtagagatggggtttcaccatgttggccaggatggtcttgatctcctgacctcgtgatccgcctgcctcggactcccagagtgctgggattataggcgtgagccactgcacctggcctctgtccctcttgcccctgatacggccctgggaaagcatgaagccggggaccagagctagctggaccagagagacggtgactgtggctacactggggtctgggcag

SEQ ID NO: 28336 - DNA, 601 bp, Human
gggttcaagcgattctcctgcctcagcctcccgagtagctgggattacaggcgcccaccaccacacccagctaatttttgtatttttagtagagatggggtttcaccatgttggccaggatggtcttgatctcctgacctcgtgatccgcctgcctcggactcccagagtgctgggattataggcgtgagccactgcacctggcctctgtccctcttgcccctgatacggccctgggaaagcatgaagccggggaccagagctagctggaccagagagacggtgactgtggctacactggrgtctgggcagggactgtcaacagcagctgcaggctctgcggctcaggagccttgaacttcagaagggcgtgggctccctgtggcccccgacacagccagccctgtgggtgctatcatcctaggcctgccttggagatggtcatggcttctgctgaacaagaagctccaagagcagatggcacagagggcagaagcgggtatggctggggtcgacccagcttgctctgaggccttctcggctggccaggtggctggttgtccaccctagcctgggcccgtggtctccctgggagatggagc

SEQ ID NO: 28337 - DNA, 601 bp, Human
ccaagcggcctgagctcaagatgcagctctgcctcttcccattgcgggacccttaaatgcctcatgccgccatctgcggatctgcaaagtggggatcatatggtccaccttgcagttgttcagcccctcagctgcaggaggggcgtctgtggcgagtacctgctgcactcacctgcctgctgggcacttggctgacaccccgacgtcccggctgtctctgcgcggctgacaccccggcgtcccggctgtctctgtgcggctgacacccctgacgtcccggctgtctctgtgcggctgacayccctgacgtccccgccgtctctgtgccacaggcatgtccgacttcaactacctgcacaccaactgctttgagatcacggtagagctgggctgtgtgaagttcccccccgaggaggccctgtacacactctggcagcacaacaaggagtcactcctgaatttcgtggagacggtgagttctgacggtctcagggctctggtccagctgtggcctgggtggggtgggtcacattcaggcccccagggcagcccccgtagcctcactgccccatacacacatgctccttttgccaccacttgt

SEQ ID NO: 28338 - DNA, 601 bp, Human
caagatgcagctctgcctcttcccattgcgggacccttaaatgcctcatgccgccatctgcggatctgcaaagtggggatcatatggtccaccttgcagttgttcagcccctcagctgcaggaggggcgtctgtggcgagtacctgctgcactcacctgcctgctgggcacttggctgacaccccgacgtcccggctgtctctgcgcggctgacaccccggcgtcccggctgtctctgtgcggctgacacccctgacgtcccggctgtctctgtgcggctgacatccctgacgtccccgcygtctctgtgccacaggcatgtccgacttcaactacctgcacaccaactgctttgagatcacggtagagctgggctgtgtgaagttcccccccgaggaggccctgtacacactctggcagcacaacaaggagtcactcctgaatttcgtggagacggtgagttctgacggtctcagggctctggtccagctgtggcctgggtggggtgggtcacattcaggcccccagggcagcccccgtagcctcactgccccatacacacatgctccttttgccaccacttgttttggggttaactgtc

SEQ ID NO: 28339 - DNA, 601 bp, Human
tgcgggacccttaaatgcctcatgccgccatctgcggatctgcaaagtggggatcatatggtccaccttgcagttgttcagcccctcagctgcaggaggggcgtctgtggcgagtacctgctgcactcacctgcctgctgggcacttggctgacaccccgacgtcccggctgtctctgcgcggctgacaccccggcgtcccggctgtctctgtgcggctgacacccctgacgtcccggctgtctctgtgcggctgacatccctgacgtccccgccgtctctgtgccacaggcatgtccgayttcaactacctgcacaccaactgctttgagatcacggtagagctgggctgtgtgaagttcccccccgaggaggccctgtacacactctggcagcacaacaaggagtcactcctgaatttcgtggagacggtgagttctgacggtctcagggctctggtccagctgtggcctgggtggggtgggtcacattcaggcccccagggcagcccccgtagcctcactgccccatacacacatgctccttttgccaccacttgttttggggttaactgtccaccatgcacaacttgagatacagta

SEQ ID NO: 28340 - DNA, 601 bp, Human
aacaagggagcatgggcctgggcagcccggcgaggtgtctgacccagcctcagaggctgggggggcttcctggaggaggcagccgcagggcttcatcttgaagaagggtaggagaaatcaaaccacaggacagggagagctcccagcagaggggagcatgctagaaccccaaggggacatcaaaaccctcgagagccgctggggctgtggtgaggactcgagccgtgggatggggcgggcactgtgctccaggaggcgcagaagtgagggctctgggcagtggggtagctgtgtggttcakgcagggttttggggcctcagagtgaagggtataggcaggaagtggctggcagaggctgggggcggggcagggcgtcctgactgaggggtgactactatcgtgaggctgaggtcacccagaagcaggcaggtgggaggtgagtggggatggctgagaatgtgtctaaaatgaccccctcgctgccccagagagccaaggtctccctagcactcagtgtcagagtggggactctgtgcccatgtctgctccccttccagcacagctcacaccgagggtgctggggaccccaagaagggtcca

SEQ ID NO: 28341 - DNA, 601 bp, Human
caccgtacagttggcgcccacccacacagggcagccggttctgacaccaggccgggcggcagacggggccgtcccattttatagatggagttgaggttctggcctggggtctctgggccacacacaggcttgtgctccaggctcccaatgtctgcgagccagccagaggaggagacagagggtcagagagtgacatggcctgtctggtgtcgcccagatctgcttcttcccaagccctctgtccatgagccccctcctttctagaaaaatcaggaaccttcctccaagtaagaatcgagcsaactccctggggcagcagccgctgagataggaaagaaacaaagccccacacaaagtaaaatggaacattctgccatttgagtttctttctgatggctgtgccgcagccctgcaccacctgtggcgagtcccattcttctatgagctctcgcgccaggcctgtgcacattgcattttgcggctgtctgatgaacatgaggttgaaggagcctcggatgtggctggcattgctcctggatattacacatgaagtcttgggatatgaagatttacagcaagcgtggaccttggaaggctgggc

SEQ ID NO: 28342 - DNA, 601 bp, Human
gagggtccgagcactgtcctcgtcctctcccatgcccacgccaccttcaggagcctcagctcagagggacccagggagtcccgctggggctgggaaggcagggaaggaatgccgatcaggcagaagagtggcaggaaagggttctctgctcaatgcccatagagatggagtcagccaggcctcgggtgagatgcagggtcattcaaaagcccagaacgtgctcgggtcaattgccagggaggaaactgaggcccagagaggggagtgactgactcgttaaagatggcagagcgagggctgrcagagtggggctctgtggggtggttccccctagataccaagctctgaggagcatgtggggaacgagctgacggcctccacgctcagcaggagagctcacgccatctccctggcctccccttggtctcttcaggtgcaccggggcatcaaaggtgtggtgacagataaattcggcaagccagtcaaaaacgcccggatctcagtcaaaggcattcgccacgacatcaccacaggtgagcacgtccctggctgtcccctggggaccacgtctgccaaggaaatgccacaccgtggcagccgg

SEQ ID NO: 28343 - DNA, 601 bp, Human
ccgctggggctgggaaggcagggaaggaatgccgatcaggcagaagagtggcaggaaagggttctctgctcaatgcccatagagatggagtcagccaggcctcgggtgagatgcagggtcattcaaaagcccagaacgtgctcgggtcaattgccagggaggaaactgaggcccagagaggggagtgactgactcgttaaagatggcagagcgagggctggcagagtggggctctgtggggtggttccccctagataccaagctctgaggagcatgtggggaacgagctgacggcctccaygctcagcaggagagctcacgccatctccctggcctccccttggtctcttcaggtgcaccggggcatcaaaggtgtggtgacagataaattcggcaagccagtcaaaaacgcccggatctcagtcaaaggcattcgccacgacatcaccacaggtgagcacgtccctggctgtcccctggggaccacgtctgccaaggaaatgccacaccgtggcagccggcgccctcaggcactcacagtgtgcccagccctcagcaggatggctccattcctccccaggctggctgggtcggggagggt

SEQ ID NO: 28344 - DNA, 601 bp, Human
gcaggaaagggttctctgctcaatgcccatagagatggagtcagccaggcctcgggtgagatgcagggtcattcaaaagcccagaacgtgctcgggtcaattgccagggaggaaactgaggcccagagaggggagtgactgactcgttaaagatggcagagcgagggctggcagagtggggctctgtggggtggttccccctagataccaagctctgaggagcatgtggggaacgagctgacggcctccacgctcagcaggagagctcacgccatctccctggcctccccttggtctcttyaggtgcaccggggcatcaaaggtgtggtgacagataaattcggcaagccagtcaaaaacgcccggatctcagtcaaaggcattcgccacgacatcaccacaggtgagcacgtccctggctgtcccctggggaccacgtctgccaaggaaatgccacaccgtggcagccggcgccctcaggcactcacagtgtgcccagccctcagcaggatggctccattcctccccaggctggctgggtcggggagggtgggcaggaaccagggtctgcgtctccttacagcatttggtgagggaagag

SEQ ID NO: 28345 - DNA, 601 bp, Human
ccggatctcagtcaaaggcattcgccacgacatcaccacaggtgagcacgtccctggctgtcccctggggaccacgtctgccaaggaaatgccacaccgtggcagccggcgccctcaggcactcacagtgtgcccagccctcagcaggatggctccattcctccccaggctggctgggtcggggagggtgggcaggaaccagggtctgcgtctccttacagcatttggtgagggaagagcttgcccagccgtagctactgaatgatggtggatgcatgctctgtattcctaggaaaatgcygcctcctccaacattgccggggagagccacctccacccctaagcctgtttgtttctatcccaaagttcataccctgttgatagctggggtgtccagccctgtgcgggctctggctgtccttacaggaatttcacagccgatgaaaaatgacggtatgctgtgatatgtgttacctggcagagatgtggtccagagaagagggggacttttgctaactgtggggtgggtatggggggtgggagtggtcatcgaaggtttcagagaagaggggtgcctaagcagggttttgaggtataaata

SEQ ID NO: 28346 - DNA, 601 bp, Human
cctaagcagggttttgaggtataaataagagtttgacagagaaaaggggtgggaaggacgttccaggcccacacagaggcaagtacacatttggcgcctgcctcccatgctaacctctccccactcatatccatcacccatcaccccgtggctgggtctgcagtcctcgtgagaatcatttttaatctatttgtccacagccccagatggtgactactggagactgctgcccccaggtatccacattgtcattgcccaagcccctggctacgccaaagtcatcaagaaagtcatcatcccygcccggatgaagagggctggccgtgtggacttcattctgcaacctctggggatgggacccaagaactttattcatgggctgcggaggactgggccccacgacccgctgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccgtct

SEQ ID NO: 28347 - DNA, 601 bp, Human
gcccctggctacgccaaagtcatcaagaaagtcatcatccccgcccggatgaagagggctggccgtgtggacttcattctgcaacctctggggatgggacccaagaactttattcatgggctgcggaggactgggccccacgacccgctgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagcccyggccccagcacccgccaggatgtggagaccgaggcccgtctccgcatcccgggctcctggctcttgattttgtctgccacagacatcccacaaagccgctgccattttattaaagtgttttgatccactttccactggaatgagaggatctgtgtaaggcactttccagggaaggctggggactgacccttgttgcctgagggcagctgtggcctgggccccacagggcaatcccgggcagctatcctgctgcccacaggtccggattgcaggcccgagactccagcctatctgtactgg

SEQ ID NO: 28348 - DNA, 601 bp, Human
ccccgcccggatgaagagggctggccgtgtggacttcattctgcaacctctggggatgggacccaagaactttattcatgggctgcggaggactgggccccacgacccgctgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccrtctccgcatcccgggctcctggctcttgattttgtctgccacagacatcccacaaagccgctgccattttattaaagtgttttgatccactttccactggaatgagaggatctgtgtaaggcactttccagggaaggctggggactgacccttgttgcctgagggcagctgtggcctgggccccacagggcaatcccgggcagctatcctgctgcccacaggtccggattgcaggcccgagactccagcctatctgtactgggccaggtggactagctggcttttcccagaccaccaggc

SEQ ID NO: 28349 - DNA, 601 bp, Human
ctcctggaagaccacagacttccaataaattttaccattactccaaacacatgtgcaaccctctggtgtttgtggcacattctgttgacatttattgttttttcttttgaggttagtcttgatatttgaaaatagcccaaacacatttgggacagtctgcttcactatgcattcattcattcaggtttttttttttttgaatgatttctacagtattttatttgccacttgagtggcaaaactgctttgagatgtccacaacacagggagatatttttcaattatttttatgatcaatgamcataagacattcaattgcaatagaattccattacaacacagcccatgttacatgatttgggcatccactgcttataccatggttccgagcttcaggggctctcttgctaaaagtctgatataacacaactttcttatgaagcatatcttgtccctgttctctcccatgctccaacagcaccatgataattcatttagtacaataacattcaaatgtgcattattcttagaattaacaaaacttttgagcaatagagtggaggggaaaagaggagaaaactgcttaccagagttttaaaga

SEQ ID NO: 28350 - DNA, 601 bp, Human
tcaggaccgccgggtaatacaaaagttaacaaaattaatatcttataatgagatacatctgatcttatacatttaccaagagtttgaccacattcaaaattgtctcctggaagaccacagacttccaataaattttaccattactccaaacacatgtgcaaccctctggtgtttgtggcacattctgttgacatttattgttttttcttttgaggttagtcttgatatttgaaaatagcccaaacacatttgggacagtctgcttcactatgcattcattcattcaggtttttttttttttgaatgatttctacagtattttatttgccacttgagtggcaaaactgctttgagatgtccacaacacagggagatatttttcaattatttttatgatcaatgaacataagacattcaattgcaatagaattccattacaacacagcccatgttacatgatttgggcatccactgcttataccatggttccgagcttcaggggctctcttgctaaaagtctgatataacacaactttcttatgaagcatatcttgtccctgttctctcccatgctccaacagcaccatgataattcatttag

SEQ ID NO: 28351 - DNA, 601 bp, Human
tttagagccttttacgctatgtggcttcaaacaacgcaagacatagaaccaaaagaaatacgttttgccccaaccattcattgaacttgaccctatgacctcggagcaaatgaataactttataggaaaatgcatgtagatgcttcagatacatatttttttccaatggaagaagaaaattctcgaggaaaccaagaaatacaatacaaatgtagtcatgtcattcaaccaatcttggctgtgatcattgaaatagggatcgctacatttaatcagagctctacagtttgcaaaacaatgscacaccttcattcaaccttggggtccaggacaaagaatttttttgtcccaattttatagacatgaagacttgggttcagacagattaagattgtaccactatcaagtagcagaactggagctgaaatgcaggtcttttgagacaaaatctaggatcctcttttcacagccagctccttcacatgtgggtagcagatgtagggggcaaaccaagccatgtatctgatcccactgtttttcaaagcactttccgatatcagaagaaggacccaagacacttatctgtcaccaagttaaactt

SEQ ID NO: 28352 - DNA, 601 bp, Human
atgagtgcatcaggtcacttgggaagccacacacacattcccatactccactgtttagagccttttacgctatgtggcttcaaacaacgcaagacatagaaccaaaagaaatacgttttgccccaaccattcattgaacttgaccctatgacctcggagcaaatgaataactttataggaaaatgcatgtagatgcttcagatacatatttttttccaatggaagaagaaaattctcgaggaaaccaagaaatacaatacaaatgtagtcatgtcattcaaccaatcttggctgtgatcaytgaaatagggatcgctacatttaatcagagctctacagtttgcaaaacaatgccacaccttcattcaaccttggggtccaggacaaagaatttttttgtcccaattttatagacatgaagacttgggttcagacagattaagattgtaccactatcaagtagcagaactggagctgaaatgcaggtcttttgagacaaaatctaggatcctcttttcacagccagctccttcacatgtgggtagcagatgtagggggcaaaccaagccatgtatctgatcccactgtttttcaaagcact

SEQ ID NO: 28353 - DNA, 601 bp, Human
cttcataacatagtctgcttacgcaaatacagattcagctgtgagaactttctatggagtgcttatttgcatatacaatcccgggactgtgacatccaggtagggaagtttttttaatacaggcttttgacttggtggaaaatggctgatattttaaacaaattttcaagcatgctaacccaattcagggatcctttaaactgatggtttcagacaaacactggcgtcttcttagacattggaagcataatatttcccaaactgacttcagtgttgtcctaacttcccaaggacatggagytgaaacatgctctgccttcattcattgcttttttccgcctggacttttatttgggttcagtgtaagcttagttaatattggaaatagatgaaacagaccacagaaagataacattattacttgaggttagaagagtatttcccaaaatgtaggaagcataccattggtggatcagagaagattatagattgtgcagaaatatgatattacatagtattcaaatagtgaaaccacttctccttttccaactctcatttaatccttctactaacattctggagaaagtctcagtctggtgat

SEQ ID NO: 28354 - DNA, 601 bp, Human
gtaccttttctaaatgctgtgttatttttctggctcaagggttccctttgatgtgcatttagcccacttactcagagtcacatagaggttacaaaaaacaaggtccccaggtcctggagtgccagaatttacctgggacagctccagtttacctaatgcattacatacttggccgttttcaccgctcagccaccaccctttctctctctgcttagtctccctggaccactgttgcatcttgaagacataatttccaactttaaacttttatttgatgacaagaataaaaggtaacagtgayagacactgttttaagcacctgaatgtcctgacaaaagtcctatgacgaacgattattttttgtattttaaaattgatgaatcatagttttacatattttcggggggtccatgtgatattttgatgcctgtatacaaagtgcaatgattaaaccagggtaactggaatttccatcacctcaaactcttatcctttctttgtgttggaagcttacaatttttctcttctagctgttttgaaatatccaataaattactgttagctgtaatttcccaatggtactatcaaatgctacaactta

SEQ ID NO: 28355 - DNA, 601 bp, Human
ttgaggctattcctctcaatcccataaaaagctaaatcaaggagtttgatccactcatgaaaatcagggaagacttcactgagaaaaggatggttgtgctttgatctgaagggtgactgaaaattaaccagagaagggaagaagagagttttccacgcacagggaacaactgccctaaggtccttcggcaagtatcggagcaaagagtggccaagcgtggctacttcaacaacaacctctccttctgctttcctgggagaatctccatttgcccagtggtccattttagaccaagaatccrggggttggggctgacctcatccccatctctaagaaagggctctggttgctttaagccaatcatcaatctgccgaagtcattagaagggcggctccatggccccacgctattttggtgtaacttctgtggcttggctttgtaccttttctaaatgctgtgttatttttctggctcaagggttccctttgatgtgcatttagcccacttactcagagtcacatagaggttacaaaaaacaaggtccccaggtcctggagtgccagaatttacctgggacagctccagtttacctaatgcatt

SEQ ID NO: 28356 - DNA, 601 bp, Human
attaaataagcacttgaggcaatagtttagcagctttctcaaactggacagtatagaaagataaagacgtcggcctggttagttcttcagccctcctgagcacggaggaaatagatgagaggtaacactgttcagtgggcacttttgtactaggtccagtgttggaggttttaccatcattatttcacttaatccttacttcatttgtattcatttgtatgacataggtactattatcatttgcatcttacaagtgaggaaacgaaagctcatagagacaaactgagactcaaagtcagakctgtctgatttcaaacttttagcttttacatcagtgtttctcaaactttagccactggcacaccacctatgtggtttttaccatattgtatcatctgtagcagccatggaagtgtgctgctcagattcctgcaagaaagacagccccacctgtcatgccttcagcttctgctcctctccctgggggctcctaccaatgactgggcacgacaggagtactgggccattcattccggtccagtgtgggcctctggaacaggcaatctgtactctatgattctccattggcttggtcaggact

SEQ ID NO: 28357 - DNA, 601 bp, Human
ctgacattgtttttcaaaggaatagcttgaacttcaaagaagaaccactgtatctcttgtagattccaaacattaaataagcacttgaggcaatagtttagcagctttctcaaactggacagtatagaaagataaagacgtcggcctggttagttcttcagccctcctgagcacggaggaaatagatgagaggtaacactgttcagtgggcacttttgtactaggtccagtgttggaggttttaccatcattatttcacttaatccttacttcatttgtattcatttgtatgacataggtrctattatcatttgcatcttacaagtgaggaaacgaaagctcatagagacaaactgagactcaaagtcagagctgtctgatttcaaacttttagcttttacatcagtgtttctcaaactttagccactggcacaccacctatgtggtttttaccatattgtatcatctgtagcagccatggaagtgtgctgctcagattcctgcaagaaagacagccccacctgtcatgccttcagcttctgctcctctccctgggggctcctaccaatgactgggcacgacaggagtactgggccattca

SEQ ID NO: 28358 - DNA, 601 bp, Human
tcattagggagatgaatgtcaagttgtcctgacattgtttttcaaaggaatagcttgaacttcaaagaagaaccactgtatctcttgtagattccaaacattaaataagcacttgaggcaatagtttagcagctttctcaaactggacagtatagaaagataaagacgtcggcctggttagttcttcagccctcctgagcacggaggaaatagatgagaggtaacactgttcagtgggcacttttgtactaggtccagtgttggaggttttaccatcattatttcacttaatccttacttsatttgtattcatttgtatgacataggtactattatcatttgcatcttacaagtgaggaaacgaaagctcatagagacaaactgagactcaaagtcagagctgtctgatttcaaacttttagcttttacatcagtgtttctcaaactttagccactggcacaccacctatgtggtttttaccatattgtatcatctgtagcagccatggaagtgtgctgctcagattcctgcaagaaagacagccccacctgtcatgccttcagcttctgctcctctccctgggggctcctaccaatgact

SEQ ID NO: 28359 - DNA, 601 bp, Human
tttcttctgattgggtgcaagaaggagagacacaggggatttggtttttgatttcttttaacttcatatttttaatgatatactaaataaagctaaatagtggctcaaaagacagtgagactgaaataaatgaaattctatcattagggagatgaatgtcaagttgtcctgacattgtttttcaaaggaatagcttgaacttcaaagaagaaccactgtatctcttgtagattccaaacattaaataagcacttgaggcaatagtttagcagctttctcaaactggacagtatagaaagaaaaagacgtcggcctggttagttcttcagccctcctgagcacggaggaaatagatgagaggtaacactgttcagtgggcacttttgtactaggtccagtgttggaggttttaccatcattatttcacttaatccttacttcatttgtattcatttgtatgacataggtactattatcatttgcatcttacaagtgaggaaacgaaagctcatagagacaaactgagactcaaagtcagagctgtctgatttcaaacttttagcttttacatcagtgtttctcaaactttagccactggcac

SEQ ID NO: 28360 - DNA, 601 bp, Human
tttataataataactactctagcaataaagactataaatcaaaacaacttatactttcatatccatagcctgttctgggaaaaattcatttctgctgtctgtaactacaggcttataaactttaaaatcaatatgtttgaaagcttttcaactaaaaatgagagaagaaagagaggttaggttagttatcagtgaaaatataagaaaatgtaagaatttcctagaatttccctttgcatttttcaaaactcttcaaaaatttacaagggtgattttataatcatagtctttgtaatttaamgaaaagaaaacaaaggtcctcattttgctttctgctagaatataagctttcttacaagaatataagctaggaaagggcagacatttgtttactgctactttttcaatgcctagtatttagcacaaactatatagcacaaaacaacttagcacaaataaagtacttagcacaaataaagtaattacaatattgttgaataagtaaaactttgacgaagagccttttcttctgattgggtgcaagaaggagagacacaggggatttggtttttgatttcttttaacttcatatttttaatga

SEQ ID NO: 28361 - DNA, 601 bp, Human
ttttttttttttttactcgatcctcccaataaacacgaaagatagatgtcattggccaattttataactgaagaaactgaggctcaagagtttaagtgctccactaaaatttaaacagtcagtaactgtcagaactgagatttgataatgtctctgtggcttcagagtgcacattattttcccactccactctttgtctcccccaaaggaaagcagaaaagggatattttgaagatattccaaatatatcaattattaattacaaatacatgtgcgtgcgtgtgtgtgtgtgtgtgtgtgtatcatgttcctccaaatggatttcaaatcttttgatgctagcaaatgaattttatacttgttttgtacttaggtggtgttaacaccagaagccacacgtgggtgtttagtcatgaccactgattgttcatacttgaagaaatgatgacatcattcactgagcacatactatatattaggtgctttatatgtacaattattggtttcttataacaacactgtgagaaaaacacagtccttattttacagattagaaaggagggtctttgagtggtcaaccaatttgtccagggatacacag

SEQ ID NO: 28362 - DNA, 601 bp, Human
aagacagctccttgcaatatgttttgttccttaataaatattctttgtcggcttgcattcctccagcttcttagcatgcattagatgcaattgcacagagctgaaaaaaatagtaatgctaatagagataatagtgatgacaacccacattatagggccactcttaggctattattgtcaggcagtgggttaagtgctttatgttgtattccaagctagtattcaaatggaaaccaatcttctttaatttctaggtctctattggaacatctaataaactgttgcttttactcaaacatcrcatctgcctttggggcttgaggtgtgtctctactctccttgaaagctgactgatgtattatagcgtcctctttgagcatctttgagccaagcctggatctcacatttaacttgtatttgtattaggcatggtttccatgctcatacataaagacaaatgaaggcaacttctcccttctttctgtatgttctctatataacaggaagcctggagctagggagccaggaatatcatttttcaattcattattttctactgccaatgagtatgttgtggtggatgatccacagttgaggtcca

SEQ ID NO: 28363 - DNA, 601 bp, Human
tttgaactattcttgtacatttgcacactggcctgcaagtgtagccttctgttagtggttgttgaaatatccagttaaaataagaattcaaaaatggataataagagggcaggttctgatccccctttagtgtttgacacatgtaaaagaaaatctgctcagaacccaagtctagagtaccatacactgtggaatcaggtacaaattcagtgtttcagctatgcaatcttgagcaaattaatcacacttctctgcacctcagttcacttacccaaaggctgactgttagactatctactgmtcatagcgttgttttaaggaaaaaataaaataaggcctgtgtagggaaaatcatggctgaagcacagctgtgactcactgaagcctggtggctggagtcaaacccacatggttcctcttggtacttacatgaagaccctcatttacatgggagttggagatcctggaaggtatgtttatgggggaggggtaggaacaactcaaaccatgtctggaattagggtacagtggtctataggcttttctacaagccagaatgtattgaagtagagcaaaaataaaggtttcaagaaatggaccc

SEQ ID NO: 28364 - DNA, 601 bp, Human
tgtgaatatcaagaagagacttcttatagaatgaaaacaggagataaatgcactatgtaaaggattaaatgcttctcagattgtgtccaagagtcactctaaataattttgaactattcttgtacatttgcacactggcctgcaagtgtagccttctgttagtggttgttgaaatatccagttaaaataagaattcaaaaatggataataagagggcaggttctgatccccctttagtgtttgacacatgtaaaagaaaatctgctcagaacccaagtctagagtaccatacactgtggaatcaggtacaaattcagtgtttcagctatgcaatcttgagcaaattaatcacacttctctgcacctcagttcacttacccaaaggctgactgttagactatctactgctcatagcgttgttttaaggaaaaaataaaataaggcctgtgtagggaaaatcatggctgaagcacagctgtgactcactgaagcctggtggctggagtcaaacccacatggttcctcttggtacttacatgaagaccctcatttacatgggagttggagatcctggaaggtatgtttatgggggaggggtagg

SEQ ID NO: 28365 - DNA, 601 bp, Human
gggattacaatttgagatgagatttgggtggggacacagccaaaccatatcagatactttcttgaaactgcacccctttttctctgagattagtcagacactggttaataccatgaacacgtaatgaaccaaatggtatctttaaagccagacctcctcaaggccggcccacaaaagtttcaggaatcattatactgtttatattagactgagaaaacccttccattatttaagaacagcacttctaggtttacataccctttttcctgtcccagtttattgcaacaagactagtttttayctttgattgcctgtgtctagaaagtttctggttgttcattgctcactatatttcagaagcaactgggaacttggagtagattccatcaccaatgtagatgatggtgaggaatagaaggggctgcttctgaacagattttttaaatcttcattatggtttcagacctccacatctttctgatgttttaagtctggcattataaatattgtctttttcaaaaggaattgctattttatatttttaaagtcagactacttagcaaagcactcattttgggaaataatccagttgagcatctct

SEQ ID NO: 28366 - DNA, 601 bp, Human
accgcccaaagttagtaagaagctggatcaccatggaaataagagtgaacgagcagtcaaggtggaatgaagcagaaggcggagcatcattatccctcaaggaagcgcaaagctgttcttacgtgtagtagactctttcagcccctactgataacaattataaaaatttgtgccctgattttgcatttattttgcactgattcaatgagagttacaaaaattcatccaatgttatcctccatgcgtccctaatcacatacgggataagagagtctacaacaaacgaatcacactggcagcrtgcaagaacacaggaccccagagctgaaaatgcccaattgtacaacatggcggaagatgagaatggaatgattctgccgtggtgtgtgtaacttacattctcctccgcacctgtggggactgagtcctctttaactgactaaaggaagataaaaacaaaagtgagagttaaaaggttacagaaaacaaaattgttacataaaagcaaagggttagttgggctcacagtcttggggtgcgttcggggacactgaattgcctaggtacacctccttctaaaaagaaaggagacttacaaaaa

SEQ ID NO: 28367 - DNA, 601 bp, Human
aaggtgggcggatcacttgaggtcaggagtttgagaccagcctggccaagatggtgaaaccctgtgtctactaaaaatacaaaaattagccaggcatggtggcgcatgcctgtaatcccagctacttgggaggctgaggcaggagaatcacttgaacctgggtgggtggaggttgcagtgagccgagattgcgccactgcactccagcctgggtgaaaagagcaaaactctgtctcaagaaaacaaacaaacacacaaacagaaaaaaagaagatgaaatattgagccttaaaaatcaaawtgttgcttgcagtgttaagtcatttaaggcaatttttataatgcttctttattttatttaacaaatattttaccttattttatgtccctatcatcagtttttgtgttatcgtttggtgtcgataatttaacttttaattcctgtttatatttctatttaaaatttcacagtagaaaatagaatatctcctgtttgcctgttagagatcaactctgcattttagcatctgagctgcgggaaacacagggttccttaaacaagcaactacacacaaacatccaaaaagtttttctttagaaa

SEQ ID NO: 28368 - DNA, 601 bp, Human
tggtagacattgcatgaagatggcaggtacatctaacattgacaatatacatttcagtgaagagtttccctttttgcctcaaattttataccacacttattcttgaaatttggttatacagtttttactagagctgtggcttttggaaattgatttatggcaaatagatttcgtccatttaaacttcatgcacaacgtcatattaacattaaaggtttttattttagaatattttaaagattattttgataggacttttaatgtgattgattacaaagacctcccacagatttttttttttctactcagtaactattctctctcatctgcttacacactctaattttgctttgggagagcaatctttcccatcttcaagactatgtaatttggattaagccaattaaaaaggtctaaaccaatcaacatggtcaagctccttgactgtggttggtttagaaatgacagcatgcggcaaattgtattatttctccaattatttaccctaccttcctgtaaatgaattacacacctgtgcccattgatgtgtgacttgctttagtaatggaacatgggtagaaatgacatataccatgcctga

SEQ ID NO: 28369 - DNA, 601 bp, Human
gcaaagacctggaggaaaaattactcataaataaaatgatcagattgtatggcaataactctgtaaatcaattctatttggatgccagtggttcccttgctgagcctttccaaatgttgagaggtatcaacccataaatcctaggccacaagtccattctccagaacacaactattgcagtaggtaaaaaaatatagtacttctggagacttccactacctttgaagtcaggccaagaagctggcttttagtagccaaggaaaatccactgacatccagtgtggaaatccagaacaatctkggctaaataaggatctgatttgcatatacagacataggaattcaatttttatttggataattttccaaatttctcctaggccagggctttggaaaaagttgtttcctatttagaacatatgaccgcatctgcacattttaattttggatatcatgaatggacataattaaagtcagatgtgcgctacattttagaattaaatcccccctgcttgatttctgtagaggatatggtagacattgcatgaagatggcaggtacatctaacattgacaatatacatttcagtgaagagtttccc

SEQ ID NO: 28370 - DNA, 601 bp, Human
tactgccaaaaacttttcccaaacagcatctaacagatagctctgggggataaatttaagtaatatgagacctcattagaatttaagaatttgttttagatggatgctgtgagtggtttagaggtttttttttttttcatgctttctttggagtttcttgtacttttccctgttttaaatgaaggagcttcatgttggttatttggaagagaccatcattctatttactgttttttttttctgtacctctcaattccatccagaaatggaaaagctgatcactctcaatattatgatgagmtatttggggatcccatttgtaagttagatgagttgccggaaacaggccaaatgttcttttctttcctggcatcatgtaaaaattggttttaaaaaaaatctcaagtcttaatctccattttcactgccaaattgcagatcaaatggccaatgagatagatggggttttggccatatgggccgcccacaactgattctacactttttactccatgagaatataacaggaaaagaaaatgattcctgtcaacaatttctaacataattatttctaatatgcctcagttcccattggcaaggg

SEQ ID NO: 28371 - DNA, 601 bp, Human
gtgctgaacgactacagagaccctcttagggtagaaaggaatgcaagtcattggtagggacaggaattgaccaaattaatgcttccttcagaaatctttccttaaagagcaaatcagtattaacattttaatgctcagagaagaatttcatatggaagactttcggttttctgttttgtaactaccgtcacagaccaccctctttccacctccaatagtacatttcaacagattttgttagacttactagattgaatgtaattaatttaaaaaaccctctgatttcatggctgcctcctcrtttggacttttaatttacccattattaaagctcacagtatttctctaagcctgagaacattattccaacaaagattttcttacaaatctaatggtccaaagaaagatatgaggaggagtaaatgaaataaggtaggtgaaaatagtttggaggaggaaagcattttcaagtgtaaggtgttattaatattgacgaagtataaaactgtatctagatctaccacctttctggtttcatttgcctacctgctttgtggacacatgaatgcagtattctacccactcactttataaaaataca

SEQ ID NO: 28372 - DNA, 601 bp, Human
gacatttaaaagaaaaagaattgggctgaaaatttaatatatggtgactatatctgcaatattgtttatcagaccagtctcatgaaaacaaatccaagaatgggatctactgaaaatttctaggatcaacaaaggtaatggatctgagcttagtattttaccacaatgctcacttgaaatggaattggactagtcaggcaaaattccccagccaaggtaaattttgttttagtgacaaatatatttagaaaacctatgtgcaagctttaagtaagccatatattaattttcttctcctttsccttattgtcattttaggtaagtgcaacagctcaatgcatcaaaatggtacttccatagaacacattactaaagaaatcacaacaatggagcatgtggttgttctaccttcgtatcctttctgagaataccagctgcagaagcacaggaagcagcaattacacatgagtcaaagggtgagctttagaacaacaaaatgacaacaaaacaacaaactgagttggaattctggctctcccgcttaccagctcccggaccgtggaaaaatcccataaatactcactagtctctgtgtcctcat

SEQ ID NO: 28373 - DNA, 601 bp, Human
accttctagagaataaagttctctcacttgccccctaggagacaggaattctaaacttcccgttagttgtttcaatttggcattcattagggactctgtcaatttaaggtttcaatttgctttctttccccccatttctttgagagcccttggagaagaattgggattgaatcagaaggctgtgttgacagcagctgatctcagctgacatcatgaatcatgaaaacagacctccaggctgtcagggagattactgcaacaaagttcaacttcttaaaaaaaaaaaaaaaaaaaaaaaaaaagagagagagagtatctcaaacttttcagtgatttttctttattgcttattttgaggcatgtaaagctgtatgtatgcaaaggtgactgaagtttgggtttacacttagaatcttattaaatccatctgaagtcacttctgtagcagcagttattattaataacaactgtttccttccttccttccttccttctttccttccttccttcctctcgtcctctctctctccctcacttccctccttttcttctacccttctttcttttttctttgcagagacaaatcagaataattcatgtt

SEQ ID NO: 28374 - DNA, 601 bp, Human
tagaagattttaagatgcagtgagtggctaagaactcagtgtctggagtcagaaggacctggtttgtttctaattccaccataaccttgctgtgtgaccaaggataaactgacctcctagtttcctcatctctatgggagcaataaaagaaatgacaccttatggtgctgtgagaattaaattagctaaaaatggaaaggacacaccagtgttctcaagtctgaatccaaggctccggaaaataaaattcccaattggattctgaaaacactcctaggtgggtataaatagaaggatgtttctagcttatttggatttgtatggatgtcattccaattttagaatcaccaagattattggcataattccttcactgtaaaattccagacaaaatataccatcatatttaagcttgtcttaaaagcttaaatatgaagagtatagtaaaaagcaatatatttcctgtttaaaaatgtaggataaaccaattattatggaaataaaaatacaaaaacatatttacagtcattaccgtccatttgtgagtgtgatatgggcaacattataagatggaaattccctatcagcagcataatagtaa

SEQ ID NO: 28375 - DNA, 601 bp, Human
gtgtagaagattttaagatgcagtgagtggctaagaactcagtgtctggagtcagaaggacctggtttgtttctaattccaccataaccttgctgtgtgaccaaggataaactgacctcctagtttcctcatctctatgggagcaataaaagaaatgacaccttatggtgctgtgagaattaaattagctaaaaatggaaaggacacaccagtgttctcaagtctgaatccaaggctccggaaaataaaattcccaattggattctgaaaacactcctaggtgggtataaatagaaggatgtttctagcttatttggatttgtatggatgtcattccaattttagaatcaccaagattattggcataattccttcactgtaaaattccagacaaaatataccatcatatttaagcttgtcttaaaagcttaaatatgaagagtatagtaaaaagcaatatatttcctgtttaaaaatgtaggataaaccaattattatggaaataaaaatacaaaaacatatttacagtcattaccgtccatttgtgagtgtgatatgggcaacattataagatggaaattccctatcagcagcataatag

SEQ ID NO: 28376 - DNA, 601 bp, Human
ttaactgtttttgttgtgtagaagattttaagatgcagtgagtggctaagaactcagtgtctggagtcagaaggacctggtttgtttctaattccaccataaccttgctgtgtgaccaaggataaactgacctcctagtttcctcatctctatgggagcaataaaagaaatgacaccttatggtgctgtgagaattaaattagctaaaaatggaaaggacacaccagtgttctcaagtctgaatccaaggctccggaaaataaaattcccaattggattctgaaaacactcctaggtgggtataaatagaaggatgtttctagcttatttggatttgtatggatgtcattccaattttagaatcaccaagattattggcataattccttcactgtaaaattccagacaaaatataccatcatatttaagcttgtcttaaaagcttaaatatgaagagtatagtaaaaagcaatatatttcctgtttaaaaatgtaggataaaccaattattatggaaataaaaatacaaaaacatatttacagtcattaccgtccatttgtgagtgtgatatgggcaacattataagatggaaattcccta

SEQ ID NO: 28377 - DNA, 601 bp, Human
ctgtaggagaactttcttttcacaccagtgaatcatgcacgccccttagaagtaagcgggaagacaaacagcagagactccccggtccagaaggcctccaccggtgctcttcagagggcagaagtccttggagaaagaagcaacaggcatccagtgtaccttgagaagctcttctgtaatatatgtcttgaacacttctggcagaccccaactgtcagagttgcagcaaatgctaagatatggatgtccaagtacaatagatatcccagagcagatactctccttagaatgaaacagaaaytctcaccacaatgctcttcagaaaggccagaaaccagagatcccagttcaaatgccttgttaactgtttttgttgtgtagaagattttaagatgcagtgagtggctaagaactcagtgtctggagtcagaaggacctggtttgtttctaattccaccataaccttgctgtgtgaccaaggataaactgacctcctagtttcctcatctctatgggagcaataaaagaaatgacaccttatggtgctgtgagaattaaattagctaaaaatggaaaggacacaccagtgttctcaagtctg

SEQ ID NO: 28378 - DNA, 601 bp, Human
acttgacccaccggatacatgtgtataagcatgattcatgaagttatgtactgtacccaggtaaaaagttctacaacaaggtagcagctttgatggagaaggcatcaactgtaggagaactttcttttcacaccagtgaatcatgcacgccccttagaagtaagcgggaagacaaacagcagagactccccggtccagaaggcctccaccggtgctcttcagagggcagaagtccttggagaaagaagcaacaggcatccagtgtaccttgagaagctcttctgtaatatatgtcttgaayacttctggcagaccccaactgtcagagttgcagcaaatgctaagatatggatgtccaagtacaatagatatcccagagcagatactctccttagaatgaaacagaaattctcaccacaatgctcttcagaaaggccagaaaccagagatcccagttcaaatgccttgttaactgtttttgttgtgtagaagattttaagatgcagtgagtggctaagaactcagtgtctggagtcagaaggacctggtttgtttctaattccaccataaccttgctgtgtgaccaaggataaactgacct

SEQ ID NO: 28379 - DNA, 601 bp, Human
ctttttcagccttcgtacctattgtagaggctggcttctattaaaataattagaagccacagtgtaaatcattccctgggtggtgttcattttaaatgaatgaataaatcatgggttaaaaacgtgtaaactaagaccaggcatggtggctcatgcctgtaatcccagcactttgggaggctgaggcgggcggatcactcgagctcgggagttcgagaccagcttgagcaacatggagaaacccgtctctactaaaaatacaaaattagccaggcgtggtggcgcatgcctgtaatcccakctactcgggagactgaagcaagagaatcgcttgaacccgggatgcggaggttgcggtgagccgagattgcaccattgcactccagcctgggcaacaagagcgaaactccatctcaaaaaaacaaaagaagtaaactacaagaaatccaaatactttccccaacatctttcctggtcctttaggaacttgctactcaaagtgtgatccctggatcagcagcttttgtagcatcaatcaggagctttgtggcatcccaagttggaccccaaaactactcaatcagaatgtgtgttaatagat

SEQ ID NO: 28380 - DNA, 601 bp, Human
atgaatgaacatggcaatgttccaataaaaatttatttatagaaacaagggttgcatttttaatacccctggtctagctcactgccaggattctaaatattctacaaatatttgttaagtgaatgaccagattattagaaatcatctgaacttttccataccatctttctttttcagccttcgtacctattgtagaggctggcttctattaaaataattagaagccacagtgtaaatcattccctgggtggtgttcattttaaatgaatgaataaatcatgggttaaaaacgtgtaaactragaccaggcatggtggctcatgcctgtaatcccagcactttgggaggctgaggcgggcggatcactcgagctcgggagttcgagaccagcttgagcaacatggagaaacccgtctctactaaaaatacaaaattagccaggcgtggtggcgcatgcctgtaatcccagctactcgggagactgaagcaagagaatcgcttgaacccgggatgcggaggttgcggtgagccgagattgcaccattgcactccagcctgggcaacaagagcgaaactccatctcaaaaaaacaaaagaagta

SEQ ID NO: 28381 - DNA, 601 bp, Human
gaatatacctccagcgcctagttcaaggcttggcacatgtttctgcaaagggccagttggcaaaaattttaagccttatgagccatgcagtctagtcaactagtcaacccaaccagtcaaccctagtcatgcaactagtcaaccctcatgtttttgtgtgaaagcagctagacaacatgtaaatgaatgaacatggcaatgttccaataaaaatttatttatagaaacaagggttgcatttttaatacccctggtctagctcactgccaggattctaaatattctacaaatatttgttaartgaatgaccagattattagaaatcatctgaacttttccataccatctttctttttcagccttcgtacctattgtagaggctggcttctattaaaataattagaagccacagtgtaaatcattccctgggtggtgttcattttaaatgaatgaataaatcatgggttaaaaacgtgtaaactaagaccaggcatggtggctcatgcctgtaatcccagcactttgggaggctgaggcgggcggatcactcgagctcgggagttcgagaccagcttgagcaacatggagaaacccgtctcta

SEQ ID NO: 28382 - DNA, 601 bp, Human
taaacttatctactaatactttttagctgcatgcttccccttcgaatatgaacccctgatgtcagggaccctgtcccctttgtttgctgaatatacctccagcgcctagttcaaggcttggcacatgtttctgcaaagggccagttggcaaaaattttaagccttatgagccatgcagtctagtcaactagtcaacccaaccagtcaaccctagtcatgcaactagtcaaccctcatgtttttgtgtgaaagcagctagacaacatgtaaatgaatgaacatggcaatgttccaataaaamtttatttatagaaacaagggttgcatttttaatacccctggtctagctcactgccaggattctaaatattctacaaatatttgttaagtgaatgaccagattattagaaatcatctgaacttttccataccatctttctttttcagccttcgtacctattgtagaggctggcttctattaaaataattagaagccacagtgtaaatcattccctgggtggtgttcattttaaatgaatgaataaatcatgggttaaaaacgtgtaaactaagaccaggcatggtggctcatgcctgtaat

SEQ ID NO: 28383 - DNA, 601 bp, Human
tgtaattttaacgttgtagttttaataattttaaccttgtttttaaacttatctactaatactttttagctgcatgcttccccttcgaatatgaacccctgatgtcagggaccctgtcccctttgtttgctgaatatacctccagcgcctagttcaaggcttggcacatgtttctgcaaagggccagttggcaaaaattttaagccttatgagccatgcagtctagtcaactagtcaacccaaccagtcaaccctagtcatgcaactagtcaaccctcatgtttttgtgtgaaagcagctcgacaacatgtaaatgaatgaacatggcaatgttccaataaaaatttatttatagaaacaagggttgcatttttaatacccctggtctagctcactgccaggattctaaatattctacaaatatttgttaagtgaatgaccagattattagaaatcatctgaacttttccataccatctttctttttcagccttcgtacctattgtagaggctggcttctattaaaataattagaagccacagtgtaaatcattccctgggtggtgttcattttaaatgaatgaataaatcatgggttaaa

SEQ ID NO: 28384 - DNA, 601 bp, Human
tgcacagcccctgcatgaggaggtccccgcccacggctccaatcttacttccatcattctccccctaccctacctctccaccctcagcaaccacggccttgtttctcttcctgaaatgtactaagctcactaagctcattcccacccccgtgcctttgccagggctgtcccctcctcctggaagaaagagccttgctctcttcctgtctggcacctttaacctttcctgtctcatctcagatgtatctcctcagagacaattttgggatccaccgattaaaagtagcacaccctgccccccagacacactcaggcaaaagtagcacacacccccccatccatactcaggcaaactctatcgcgggaccttgtttatttccctcagtgatctcccagacctacaattttgttggcaaattttgtctttaattttgtaattttaacgttgtagttttaataattttaaccttgtttttaaacttatctactaatactttttagctgcatgcttccccttcgaatatgaacccctgatgtcagggaccctgtcccctttgtttgctgaatatacctccagcgcctagttcaaggcttggcacat

SEQ ID NO: 28385 - DNA, 601 bp, Human
cattccttgcacagcccctgcatgaggaggtccccgcccacggctccaatcttacttccatcattctccccctaccctacctctccaccctcagcaaccacggccttgtttctcttcctgaaatgtactaagctcactaagctcattcccacccccgtgcctttgccagggctgtcccctcctcctggaagaaagagccttgctctcttcctgtctggcacctttaacctttcctgtctcatctcagatgtatctcctcagagacaattttgggatccaccgattaaaagtagcacacccygccccccagacacactcaggcaaaagtagcacacacccccccatccatactcaggcaaactctatcgcgggaccttgtttatttccctcagtgatctcccagacctacaattttgttggcaaattttgtctttaattttgtaattttaacgttgtagttttaataattttaaccttgtttttaaacttatctactaatactttttagctgcatgcttccccttcgaatatgaacccctgatgtcagggaccctgtcccctttgtttgctgaatatacctccagcgcctagttcaaggctt

SEQ ID NO: 28386 - DNA, 601 bp, Human
tcactgtgagacaaagatcatgcagggatcggcctgcggtgtgtctcatttcctgtgggtaacaggcaccacaatagttctgtgggtggtgacaggctcggctgccagcattcccctcccaggaaggcggtcaggcaaccctggggaatgtgtccagcttgaaagtcttcgaggcttggtctttggaaagcggcagggaagcccccctccgtcctccatcattgctggaggccttgtgacactgggacgatgcaggacttggggtctagggggcctgagctgaatgctgcctctgtctctkacaacctgtggaatgttcagcaaaagacacagcttcttggaggcctggcttatgtgtctgggaggtgtggcagaagcagtcccagcctgaagggatgctgccatcctaaagagatgaggtctgtaaaggagtgtggtcccagaggagggactcggtgtctagaactgtaattagtgtctcaaacctgtccacttcttgtcacttcttcaggaatcaccaggccaatctccatcagctctcccaagaaatatgacctgtattaactagctcctaatgaccttcaacagccattctccacca

SEQ ID NO: 28387 - DNA, 601 bp, Human
caaaccagacccattctcttacctgttctctctccagcccagtgaggtggacagtgattattattcaccctattttacagatgcagaaactgaggctccaagatgacctaggactaggtcatgcggtaacggcctggccactttgacttggaatctggccctcagctcacctgttgtccccggctctcttctgttcactgcccgctctttccaaccctcggtctcaggctccttgcagtgactgcgctgattgtcacaagcctcggttcagcccacaccagtgtggacagatgtcttcccytttcaagcctccatttgttcacctgctaaacctgcctgcagattgcgctgcacacaatctagcacttcaggggctcatgaaaatgggaaaggggaaggctgggaaagggccatcaaagaagtggtgcttaggggaagggagaaacccagtcttccatcaatcagaatagtttcacttttatcatatgtgtctgtgtgtgcgtatatgcatatatccgcacacacacacacacacccccaggttttgtgacattttcttttgtaaacaaaaaagtccctttgctcaaaaagaaaggaaaat

SEQ ID NO: 28388 - DNA, 601 bp, Human
tgcagacaatacattgtgttattaatagttttggggcatcaagagatgaccaggacaccgtgaaataccaaaagcttgggctcaggagtcagctgtgggtttggggatgctccatccctttctggttgcatgacctctggccggtccctcaccgctgagagcctgctgcctcatctgtgtgaggtcttagactgccatcccacccggtcctcactgcagcccacgaggttgacgccactgtcgctctcaggctacagaggaggctgctgaagcccagcgagcccaagccacttcagtcaarttcctgccagtaagtggggtgccggcttctgtccccgatctctgaaccctgagctgggtaaaggccattccccaacccctccatttaccgtgcattgtaatcgcttgttgctgtgattagagcacaaactccccatggcacagcggtgcccgactcatctctgcacctttacaacccagggcaggggctaactaaataatactcacaaaatagcctttcctgactagttaaacctcacaagcattgctctaagggcattgtacactactgcccttcatcttcatgctaaccctgtgacgt

SEQ ID NO: 28389 - DNA, 601 bp, Human
aaccgctccccaccgcagaccctggcaagcaccgatctgttttcatccctagagttctgcctttgccaggatgtcatatcatgggatcctagagtatacacagcccttcagactaacttctttcatgtagcatagtggatgtgcgattcatccaccttgctgcatggatcaattgtgggcctccttttatactataagacagtatagggtagtacagtataagatttatatattgtatacagtatatatatatatatacacacacacatagagagagtatagtatagagtagtataataaygtattgtagcatagtatatatagatagtatagtgtagtataaggtaatataggatagtataatatagggtagtgtatattttatagtatatatagtatacatatatagtatagtcaagtatggtaactatagcacagtatagtttagtccactgtatagtatagtaaataaagtatagcaaagcataatgtacaatatagtatgatatatacagaacactatagtatatagtataggaaagggaagtataatgtactatcacaaagtatgtatggtctagtatatgtacatagtgtcata

SEQ ID NO: 28390 - DNA, 601 bp, Human
tggttctgtcccccctcagatctttcttgtgccttttgtggtcaaccgctccccaccgcagaccctggcaagcaccgatctgttttcatccctagagttctgcctttgccaggatgtcatatcatgggatcctagagtatacacagcccttcagactaacttctttcatgtagcatagtggatgtgcgattcatccaccttgctgcatggatcaattgtgggcctccttttatactataagacagtatagggtagtacagtataagatttatatattgtatacagtatatatatatatattcacacacacatagagagagtatagtatagagtagtataataacgtattgtagcatagtatatatagatagtatagtgtagtataaggtaatataggatagtataatatagggtagtgtatattttatagtatatatagtatacatatatagtatagtcaagtatggtaactatagcacagtatagtttagtccactgtatagtatagtaaataaagtatagcaaagcataatgtacaatatagtatgatatatacagaacactatagtatatagtataggaaagggaagtataatgtact

SEQ ID NO: 28391 - DNA, 601 bp, Human
cctaaaaccaccatccaaatcaacatgtcacatggttctgtcccccctcagatctttcttgtgccttttgtggtcaaccgctccccaccgcagaccctggcaagcaccgatctgttttcatccctagagttctgcctttgccaggatgtcatatcatgggatcctagagtatacacagcccttcagactaacttctttcatgtagcatagtggatgtgcgattcatccaccttgctgcatggatcaattgtgggcctccttttatactataagacagtatagggtagtacagtataagatatatatattgtatacagtatatatatatatatacacacacacatagagagagtatagtatagagtagtataataacgtattgtagcatagtatatatagatagtatagtgtagtataaggtaatataggatagtataatatagggtagtgtatattttatagtatatatagtatacatatatagtatagtcaagtatggtaactatagcacagtatagtttagtccactgtatagtatagtaaataaagtatagcaaagcataatgtacaatatagtatgatatatacagaacactatagt

SEQ ID NO: 28392 - DNA, 601 bp, Human
actgctgggctcatgtgatccttctaccttggcctcccaaagtgatggagttacaggtgtaagccactatgtctagcctgagtactattattattattattactttaccgtttctgtcaagtataacttataagtagtaaagttaaccttttctgtatttggttctatgaggttagaccaacacaaatagccccctaaaaccaccatccaaatcaacatgtcacatggttctgtcccccctcagatctttcttgtgccttttgtggtcaaccgctccccaccgcagaccctggcaagcacsgatctgttttcatccctagagttctgcctttgccaggatgtcatatcatgggatcctagagtatacacagcccttcagactaacttctttcatgtagcatagtggatgtgcgattcatccaccttgctgcatggatcaattgtgggcctccttttatactataagacagtatagggtagtacagtataagatttatatattgtatacagtatatatatatatatacacacacacatagagagagtatagtatagagtagtataataacgtattgtagcatagtatatatagatagtatag

SEQ ID NO: 28393 - DNA, 601 bp, Human
acaattattttattttatttttttgagacaaagtctcactctgttgcctaggctgaagtacagtggtgggactatgttcactgtagccttgaagtcctgggctcaaatgatccccccacgtcagcctccccagtagcttggactacaggtgcacaccaccaaactcagctaattttaaaattttttttgtagagacggggtctcaatttgttgtccaggatggtcttgaactgctgggctcatgtgatccttctaccttggcctcccaaagtgatggagttacaggtgtaagccactatgyctagcctgagtactattattattattattactttaccgtttctgtcaagtataacttataagtagtaaagttaaccttttctgtatttggttctatgaggttagaccaacacaaatagccccctaaaaccaccatccaaatcaacatgtcacatggttctgtcccccctcagatctttcttgtgccttttgtggtcaaccgctccccaccgcagaccctggcaagcaccgatctgttttcatccctagagttctgcctttgccaggatgtcatatcatgggatcctagagtatacacagc

SEQ ID NO: 28394 - DNA, 601 bp, Human
tgtgccatgttggtgtgctgcacccattaactcgtcatgtaacattagatatatctcctaatgctatccttcccccaaccccccatcccaaaccctattttattctctctcagaacataccactctctgaaatgatcttattatctaatttatttgtctaacatctgtcttctacaccagattggaagctgcaaggattctgcgtgtctcagtgccttgcaggttcctagcacatggtacctagccttaacattgactgaatgtgggtgaaggaatgttgtcaggcagatacaattatttyattttatttttttgagacaaagtctcactctgttgcctaggctgaagtacagtggtgggactatgttcactgtagccttgaagtcctgggctcaaatgatccccccacgtcagcctccccagtagcttggactacaggtgcacaccaccaaactcagctaattttaaaattttttttgtagagacggggtctcaatttgttgtccaggatggtcttgaactgctgggctcatgtgatccttctaccttggcctcccaaagtgatggagttacaggtgtaagccactatgtctagcctgag

SEQ ID NO: 28395 - DNA, 601 bp, Human
gctaggtgttgggctaaattaatatatctcattcctcagtgctgggtaagagaatggtctccagtcagatgcccgggttcgatacccagttacatgactttctagctttgtgaaatcttggacaaattacttatcatctctttgcgctttggtttctttatctttaaaatggaaatgacaaacttatctcagagggttgttcccaagataaagtgagttcatgcttataatgtacttagtacctagggggtactaattctacctcactttagctccctccccagttaccatctaggttcaycaccctgttttattttcttcttttttttttattatacttttaagttctagggtacatgtgagcaatgtgcaggtttgttacatatgtatacatgtgccatgttggtgtgctgcacccattaactcgtcatgtaacattagatatatctcctaatgctatccttcccccaaccccccatcccaaaccctattttattctctctcagaacataccactctctgaaatgatcttattatctaatttatttgtctaacatctgtcttctacaccagattggaagctgcaaggattctgcgtgtc

SEQ ID NO: 28396 - DNA, 601 bp, Human
tcctgacctcaggtgatccacctgcctcggcctcccaaagtgctgagattacaggcgagagccaccacgcccggccaccactgccattttcatcacttaacccgaacacattcctctattccctccctttcctgcttggtgatcatcgactcttctgacccaactaggtgacctgctaaaccatctttactgttatttgccagaaaagactggaccagagacgtaaataatacacctcaatatacaacagctcgggcttaatttctaggcagaatttcatttgctggccatcagaagaatrtatacatggagcgtgtttggggaggagatggagtaaggagaacacatcttggtggcaggagaacctggtgggaaccgtgctgatttgtttacttggatttgccaactggtccgatggatactgggtctgtttgcacttgagcatccaacatccgctttggtccctggagaaaaacagaaagacgtggcagcctattgaagctctgtaatgtcaacagcaacaatggccatttatgtagcacttactctgtgctaggtgttgggctaaattaatatatctcattcctcagtgctgggtaag

SEQ ID NO: 28397 - DNA, 601 bp, Human
tggcctggctattgcttgggaaggactggagggatccagttgaggaggtcagacatgttagtgaatttgctggatgtcaagtcagaaccatttgactgagacccaggaggacctggctgagagccccttctttgaacccctctgagatccatgttggggaggctgtgacccttgctttcttggaggcctcaatgcctcacctccttttctttaatttactattttaactgaaacatatgccagagtgtgtgtctgggccgggtattgtggcccacacctgtaatctcagcagtttgggagrctgaggcagtaggatcgtttgaggctaggagtttgagagcagcctgggcaacgttgtgagaccccgtctctacaaaaattaaaatatgagccaggtgtgatggcatgcacctgtagtcccagccactcaagaggctaagatgggaggatcacttgaacccaggactttgagactgcagtgaggtatgattgcatcagattgcatcgctgcactctaggcgagaccctgtctccttaaaaaaaaaaaaaaaatagccgggtgtgttggctcacgcctgtaatcccagcactttgggaggcc

SEQ ID NO: 28398 - DNA, 601 bp, Human
taatttactattttaactgaaacatatgccagagtgtgtgtctgggccgggtattgtggcccacacctgtaatctcagcagtttgggagactgaggcagtaggatcgtttgaggctaggagtttgagagcagcctgggcaacgttgtgagaccccgtctctacaaaaattaaaatatgagccaggtgtgatggcatgcacctgtagtcccagccactcaagaggctaagatgggaggatcacttgaacccaggactttgagactgcagtgaggtatgattgcatcagattgcatcgctgcrctctaggcgagaccctgtctccttaaaaaaaaaaaaaaaatagccgggtgtgttggctcacgcctgtaatcccagcactttgggaggccgaggcaggtggatcacgaggtcaggagttcaggaccagcctggccaagatggtgaaaccgcgtctctactaaaaatacaaaaattagctgggtgtagtggcaggtacttgtaatcccagctacttgggaggctgagacagagaattgcttgaacccaggaggtggaggttgcagtgagccaaaatcatgccactacactccagcctgggca

SEQ ID NO: 28399 - DNA, 601 bp, Human
aatacaaaaattagctgggtgtagtggcaggtacttgtaatcccagctacttgggaggctgagacagagaattgcttgaacccaggaggtggaggttgcagtgagccaaaatcatgccactacactccagcctgggcaacagagcgagactcagtctcaaaaaaaaaaaaaaaaaaaaaagtgtgtatctcagtgtctcatcttgttctttcagactgactctggagatggctgagctaataatgtgtgatcctatttattggggagatttctcaggtccttcttcctcttcttttgcctrctgccttggacataccaggttggacaccagtcctatcaaaaagtaaaggaaggaacctcaaatgaatctcttaagctgtgtagtagctctttgatacaaatttaagtgacagaggagtctgcatatcaccgactaaaagggaatttagcttctgattctgttaatgaggcaccgtcagctgtttggtaagggccttctgggtgccactggggcactgtggcagggattacgggtccagaaagcagtcgagagagtcctgttgtgacagaaagggatcatggggaaggaacgactacagga

SEQ ID NO: 28400 - DNA, 601 bp, Human
aaaaaaaaaaaaaaagtgtgtatctcagtgtctcatcttgttctttcagactgactctggagatggctgagctaataatgtgtgatcctatttattggggagatttctcaggtccttcttcctcttcttttgcctgctgccttggacataccaggttggacaccagtcctatcaaaaagtaaaggaaggaacctcaaatgaatctcttaagctgtgtagtagctctttgatacaaatttaagtgacagaggagtctgcatatcaccgactaaaagggaatttagcttctgattctgttaaygaggcaccgtcagctgtttggtaagggccttctgggtgccactggggcactgtggcagggattacgggtccagaaagcagtcgagagagtcctgttgtgacagaaagggatcatggggaaggaacgactacaggaacaaagacgcagcaagccaggcgctggtgcctgtgcattgctgagtgcagtaggaacacaggatattgctgagcgtgggagatggggttaggggaggcttctcagaggaggtaacatttaagaagagctttgattccaggagggacaggaagtcccgcactgagg

SEQ ID NO: 28401 - DNA, 601 bp, Human
attaaagggtggcagtgggaacagagaggcaggaatagagaggaggacaattttttttttattattatacttcaagttctgggatacatgtgcagaacgtgcaggtttgttacataggtatacacgtgccatggtggtttactgcacccatcaacccatcatctacattaggtatttctcctaatgccatccctcccctatcctccccacccccaaacaggccctggtgtgtgaggttcccctccctgtgtccatgtgtgagaagaggacaatcttgaagagagaattggcagaatcaacrttgcggaaggaagcaagaagggagttgagaattctgtggtttctggactgggccagcaggtggatagggacgccatgaactgaagtaggaagacagaggacagagtagacttaggtggggaaaggttgagttctgttctagacctgtgcatttggagtgtctttgggcagatgatggagacaggtctgtgaaccggaggttagtagatgggctctccaggtatgacatggctgtttccacttccctagcatataattgagagcctcatgaacttgtgcacccagtggagtgggcaccttt

SEQ ID NO: 28402 - DNA, 601 bp, Human
atgtgcagaacgtgcaggtttgttacataggtatacacgtgccatggtggtttactgcacccatcaacccatcatctacattaggtatttctcctaatgccatccctcccctatcctccccacccccaaacaggccctggtgtgtgaggttcccctccctgtgtccatgtgtgagaagaggacaatcttgaagagagaattggcagaatcaacattgcggaaggaagcaagaagggagttgagaattctgtggtttctggactgggccagcaggtggatagggacgccatgaactgaagtwggaagacagaggacagagtagacttaggtggggaaaggttgagttctgttctagacctgtgcatttggagtgtctttgggcagatgatggagacaggtctgtgaaccggaggttagtagatgggctctccaggtatgacatggctgtttccacttccctagcatataattgagagcctcatgaacttgtgcacccagtggagtgggcacctttgtctatggtagcacggtggtatgtcagacgggcttcagcgtgcatgactaacatattaggctgatttttcagaagtcagagaatttt

SEQ ID NO: 28403 - DNA, 601 bp, Human
ctgcgttgtgaatgggatagataagacagcatgtcaggggcttagcatgtaccctgggatgccgtggtgctcaggaaatggtgggtgtgttagatttagccccagaaatggctttgacttttaggacttttcagaagactacagagaagtacagcaccatgattagcagtagaatggaaaacaggaagggctgtggatttaatgtttcttttggaatctttataatatttatttatttataacattttaattgttataacaatttaggacagctacagcgattgaatcaatccattaagamgtattttttgagcaccggttctggatttagcagtgtgatgggcactttcatgggtagaaaagaagtggaaggtatacgctgccctggctactgagttagggaggcagaaataacacagttggagtgatcagagaacagcaggaaacgtgggaccatctgggtgactgctggcctgtgggagggtgcagaggagacgagctgtgggagccaggagaatcacctgccggaggtgggaccggggctgggtctggaatgatgagtggattcccatcagcaacatctggctttgccttttgtttc

SEQ ID NO: 28404 - DNA, 601 bp, Human
tgccttttgtttccagtctggacgatgggccagagggtcagagtgaatgctcttgtcaagccaggaaaaggactgtgtgatgagaagccccaggcatccttctcaggtcccttgcagaccgtgaatgtttcaggatggggactggcccaggtgtcctcaggcatgggcatctgtttctcagcttcccagagtttcctctgttggattcttggaaggaaagaaaagcgctttggggaagacctcgtttaatgggggaggtccgagccttggtagccagtgctggagcctgtctggagcctgycagcaggatcccatctctcctgctgcctcccattctgctcacctttcctttgtatcttgtgccttctaggttggacttggctcagtctctgggactcactcagctgcaggtgaagacctggtatcagaatcgcaggatgaaatggaagaaaatggtaagaaaggagtgactaaccatgatcccttcctgatgggaaggacttttactccagggctgttgggagggaggccggaccatttggcagtttgggctgcagagattggaaggccttctatgctgctggcttgcggggaagctgtt

SEQ ID NO: 28405 - DNA, 601 bp, Human
gctggcttgcggggaagctgttggatctgtaggttgagctattcctcttgacctggagttcctaaacagagggatattctttttctgtttccttagaaatcaaaggaaaaaaagcttacaggcttttaacttgctagttttattattatacttaagttctagggtacatgtgcagaacatgcagttttgttacttaggtatacatttgccatggtggtttgctgcacccatcaacccgtcatctacattaggtatttctcctaacttgctagttttaaccctacctgctagccttttcaarcaacttccttcttcctcccaccaagagctaaaaatagaagtcagtactctttgtttataatgacgtagaggatgcatctgttcttttggctgtgcgtcctctaacgcagtgatcctcaaactttggtgggcattagcgtcccctgggtagcaggttaaatgcagaactctaggccccctcccaggattctggtcccagaggtctgggccaaggctgggaatgtgcgtgttaacaagagccctggttattctgaagtgcctggtatgatgaccacagtttccatcatcctgctctagtgcc

SEQ ID NO: 28406 - DNA, 601 bp, Human
cctagctaatgaatatttccatctttgatttttaagtattagaatagatacatccctacgttgtgaggaactcaatttcattatcatttattcttttcactaaaaagggcactattaaatcaaaattttccaaagtagttgagtgtttcctttctcagctttgtaaaccactgagacaaggtcaaagcccagagcaaaagaaaacgaggaggggtggcgataagggaagaagccctgctgttctctggagcccaggtgccaccatgccacctgccataggcttcttaccccctcaccaaaygttagtggctctttctcctctcgtccatgccatgccttcatgatgacattctaatttgctaacctgtctggtcacaggccctatgtcttggtgtttcagggctaaaatatgatgtttttcacaataatcaaataactacggggttctgccaaccccagttttcaggaaaaaaaaaaagtcagtggatagatgttttctcaatgttgtggttttgtccaatattgttttttcttaagcttttagttcttgctattccttgctattttctgctaacaatgaggagaaaaaaaaaaacaaaat

SEQ ID NO: 28407 - DNA, 601 bp, Human
gataagacatgagcctgtccaccagaaaataaaattataaaaaggtactcagtcaagtgcagaagacacatctgcaaactggtattattatttcacggagcggtcagggcagcagcagggaaatttataggatcagcgcagagagtggaatagcaaggctgtgttgtgatcctgattgcttcatctagtttcccagtaaaactcttttcaaggctatctgtttaggtaccagggaggaaaagaaaaagataattgagtaataaagatgtctcaaggctagtaacctaattggaactggaaraagattagcagttgattctcagacttattcacatggctgccaagggtaactttgccagaaccgagatagcatctctgacgaattctgacccgtcagcattggtaacctatagcgggttgggtaaatttaatcttgcatatttaagatgggatgcgcaccctctattccatgtctgttggctttagttcccgcaggacccacagtgttttgcaacaggctgaaagagcctcattatttggtggtctctttgagctctaaaatgcaattctcttccatgagaggatccaaacagatacctcc

SEQ ID NO: 28408 - DNA, 601 bp, Human
agacaaggtggtgtataggttgtctagcctccaaactggattatgctaagaatctgttttttacaaaactatatgaataatattttctgtgttattaaacattctcctatatagtaattgtaatggttgtcaagtattctgtctttgggatttactataattctacccaattacatggctaaacttttaggatatcacccccctccaacttttgctgttataaccaatattgtgatgaatatttttgcagatcaatctttgtctcagtcttagataattttttagaatttagcctaaggamtttctgtgtcaaaaagccatgcacattttaaggcttttgacttgaactctcaggttgtcttgaaaagtgtgtaacaatcacactttcatacagtgtgttttttttcctgcttgctacaaatattattgttgtctttttagcttgtcaacttgatagttattgcattaacattttaattttcatttctttccttattgttgaagttgaattctgaagctgcctatgattgttgtattaaatgccaaaatatataatgttgaccaaaaatgcgttgagcatttaaaaaatggaggtgtcttt

SEQ ID NO: 28409 - DNA, 601 bp, Human
agtaaactgcgggcgaagagatctacccgtctccctccctcccacagttaccattggccttgtcatcgcaagcatttgacaaagacttgcttgtcttgggcctgtcacctcctgaaaggctgctttagctgtggatgcccttgattaagggagagagcgcctaggagctgcctgccccagctggggtgacggctgtagggctgggtctatgttgcaagccctatatcctagcatgcagtggaaagtgcttagctctctccctcctgacctctgggcagccagtcatcaaagcagagagacrtggcggcatgtgggcagcatgcccaggttccttgctgactcagcacttatttctgtagttttaaaaaagaatttaatgtttttggttgtatttttttgggggggtgagggtgggcaaaaacatggggggagttctgagttgttagaaatgtttctgaatcaagtttgtttgaagacacgtgtgcctttgtacccattataagatggtcataagacccaagaactgataagctttggttttttttttgttttgttttgttttttgcttcatttacccattcatgcctagggttccattatt

SEQ ID NO: 28410 - DNA, 601 bp, Human
aactgcgggcgaagagatctacccgtctccctccctcccacagttaccattggccttgtcatcgcaagcatttgacaaagacttgcttgtcttgggcctgtcacctcctgaaaggctgctttagctgtggatgcccttgattaagggagagagcgcctaggagctgcctgccccagctggggtgacggctgtagggctgggtctatgttgcaagccctatatcctagcatgcagtggaaagtgcttagctctctccctcctgacctctgggcagccagtcatcaaagcagagagacgtggyggcatgtgggcagcatgcccaggttccttgctgactcagcacttatttctgtagttttaaaaaagaatttaatgtttttggttgtatttttttgggggggtgagggtgggcaaaaacatggggggagttctgagttgttagaaatgtttctgaatcaagtttgtttgaagacacgtgtgcctttgtacccattataagatggtcataagacccaagaactgataagctttggttttttttttgttttgttttgttttttgcttcatttacccattcatgcctagggttccattattggaa

SEQ ID NO: 28411 - DNA, 601 bp, Human
atgtaataaacattactgcaacaaattgcttatgcacgttcattgggggagatgcagttttatctttcctaaaaggtcagacttttcatttgaaatgcattgtgccacctggcatgaatacgtattagtgaaatgataagatattcctgtggcattttagcttgagagtctctgggttctgggagatttccctactcccttttaaaatgccaaggcacctataatttgcattgtgggtgttttacagttggtcttcttagccctctttcattggagaagaaatcatgggtatgccccagcrttttcctgtttctttgcttccttgtcacttggtgtgtggtgtgatcctggcaggatacagcaggagtttttcctgcatttcatgtggttccctgaatagccactaggtatcttggtgaattgcacaatctagcgaaaccactgaagtttcatcattcgtttctactgacttccagataatcggagtcaaccttctaaccttctagtctcacttcttccaaataatactgtacagactggggagaattattctacccactccctcatttcatgcttgtctgccttcctctcgaaggctcgt

SEQ ID NO: 28412 - DNA, 601 bp, Human
attttgccacggtgcaatgttgtatgcattgactcttaggtttataaatacatcagaatgttctttgctgcctcgcttacatggaaaactcacaaaccacctatacaatccaaaagaggggaaacagctcatctcatattaattatggtccatttccatgataggatattatgcaaccattaaaaatcatattttatctgagtgttagtatatggattattttaattatttatacttttcagtgtaattcttctctgagcatactacttttggagttaggaacacaaatcagtaaatgcattttttttttttaacaaaaactaaagcacctggttttttggagtatagtttccaggtgcgccacaggccttctgaaacgttttccttcggatttttctttccccaggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcag

SEQ ID NO: 28413 - DNA, 601 bp, Human
tgcgccacaggccttctgaaacgttttccttcggatttttctttccccaggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggytcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttc

SEQ ID NO: 28414 - DNA, 601 bp, Human
cctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgsgggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcact

SEQ ID NO: 28415 - DNA, 601 bp, Human
aaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttggggggkattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcat

SEQ ID NO: 28416 - DNA, 601 bp, Human
tcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggargaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaacc
